United States Patent 8,071,291 (GENETIC POLYMORPHISMS ASSOCIATED WITH VENOUS THROMBOSIS, METHODS OF DETECTION AND USES THEREOF) - sequence listing, part 7

SEQ ID NO: 550 - DNA, 601608 bp, Homo sapiens
ttgacttccaacattccacatttccaaaggtacatgtaatctcaatcagatttatgttttttgtgtgtgttctctaataacttttgggatcttttctctattctctaccattaatttcggaagtttcactctgcgtaggtgtgaacctaaaatatttttcctgcatcttgttttatatttccattcctaaacactttaagaattttaaagatacttatcttgggatacttttcaggttgacttcatctatttcctttggtgtaaactcttccattcgctgttattcataatgtttatcttctgaaacatttttaggatttttgttttgtgagctcacattctgtacattcctcctgttgttctctttcatggaaagccgcagcctgtttcccaggtccacgccaggctgcatttgctcagaaatgctcctgcatagtgttcatatatttatcctcagaaatgctcctgcatagtgatatatttatgctcagaatatgccctgcatagtgatatatttcctccccgtgtctgctaatggcatgacctcactcaccttcatgtacaggggatcataccagaaaccatggccactgcaaaccatggtcactgtagttccttagtggccttgggaatggtgcaagggtgtccagttagtctctgtttatgggagttctgtgtttcccaccctgagctccaggaagatagtgtttattgggactgcattcaaagagatctaagagatcctgcctccggcttctgaactttctgcttgagatccatgccctgttctcccaggagaagtgattttagtctttgacaattaccaaataccccctttggttatgttcttgttagaaaatagtcacttttcttcttttcctaaggaactatgtgtttgctagtcttgaaattttagaaatcattcccatttggagagagtggagggtttagaatatgtttcatctggctttataattatatatttttgttttattattattattattattttatagagatgaggtctctctatgttgcccaggctggtctcgaaactcctgagttcaagtgatcttcccactttggcctccctaagtgttaggattacaggtgtgagccaccacacctggcctgcctttataaatattattgtaaaatgtctttagcctagatgaagctgaaattctttccagtgaatcttctgctgtggctattaaagtttactatgaaaaagaagcagaaagacatgctcctgtgcctgaacactgaagaggattgcaaaggccaaaggcaggaagaagttcaggggataggatggagaatgagcatagcaagttgctcctgaacttagtcctgtaataagtctgcagggcagaaggttccagggcacataaactaggataggaactgctatcctagtttatatggagtggagtgatatagtttgtgtggaatgatatggtaactaggtatatgaatacattcctcatagcaacatcattccacacaggcaattcagactctggcctgaaggcaacaattctgagtttattctttatttcctgaattcagtctccctcaacctgtgaattgcaacctcacctaccaaatgtctgctaccacttgagtgggaccatcaccagcctggatttgagagctcacctggcaatttctccagccattatatcatggaatcaataggttacagggtctccaagacctcctatgccaaatcattcagtctttctgtggggttatgagtaccccttccctgtgtagtccaggagactgctggaaacttggtgtgtgtgtgggtgcagagggtggcgagagaagttcctatacttgtaggacaaaaatacttttggagccagacaaaaatagctttggacaccctggactgggaaagatgggatgattccatccctgctacattatcactctctgtcatctactctcttcttcacctccagctcataatggctaggttcccataggattttccattctacacatgtcttagtctgttttgtgttgctgtaactgaatgcacgagactgggttatttacaaagaaaagacatttatttctcacagttttggaggttaggaagtccaaggttgaggggttgcatctgatgggggccttcttgccggtggggactctctgcagggtcctaaggcagctcagggtgtcacatggcaagaggacaagaaaatgccaaactggcttttataacagacacactcctgtgataacccattagtctactaatccgtgaatgggttattcctttcaagacagaagagcaaatataacccagccacctctgaaataccccatcttcaacatgagtcttggaggacgcagacattcacaccatagcatgaggctgtagatgtcttcaaaacaacctctgcctttgtcttctagaagtggagtttccagactctacttgttcaaggatgctgtgtccttgacttagctcattatcaccttttggtcacctttttcatcctggtgctttatggactctaattgatcggtttccaacccaccaccatatctgactgtgctctaggtgtttcctgtgatctctgggatcctgatccgcaccactcaactttggcctcctaaacttcatccttgaccccaccccaggtaggaaggatgtgtggatatttcttttatctttctgcaacgatgaccttttggagaaaaagaaaggaagcaggtaagataaacattgctttatccattatgtatcaagcactgtgcttgatgatttacattatcttcatcctttcaaccaatactggaggaagatgatattcatctttaaaatatatcaaacatgctcagctttatttcccaataaatgtgaaatgattaaggtcctataatctgattaagatatcaagattaatcaaattttttaaacaaaattcgcattttatttagattgatataaattatagtttattttcttcaccaaaaaataactgcaatattttccgtatttttctagataagccaatacacttatatttgtaggttttccgggtttttcttataaatcaagatgaggcaataggtaagagtcatgaaaaaagacagaaaaaaaagataaatcagttgtcagtatccatagcctctgattctgtcttagccgtgaaacagaagtggtcaacatatacttactaaaaaagcttaggaaaatgtaggctccacaaaggaatataaacagcaacaactagatgtggaacgacagcaggctcttccattcaaactttaactgtcatttgttcctttaagttcatttgtgaaagataaaaatctaccctgaaatccttgtttggcaagctcacaagcgtctctttctctggtaatttcttgtaactgtccaatatagatttttaacatacttaaaactcctattagtgaaaggtcaattgtgggcttcactgtaacattttataaaatgtattccttcctctcatacctcttcaaaatatgtttcttcaaagaattggtaactcaacacccaaggagcagagatccacagtgataataaatgcggtgtctcaaatgacttaaacaattgcagagtgccacccacagagatcatgcggaagtgaaagatgacactttcaatgttctgttctggaagaacagacaggtcttcaaagcatgcgggttcaaacgggccatttaaacaggtagattatcaatggctaatgtattcaatggaggcctacaggcaaagatattaagtgattaaggcctacatacaccttatggctttccttccaaatatcgaatataagaaagactatttttaaaagtctcaggtattttccatggtttctgaattatctgtgggaagctctgacttactgttacagagtttaatatatgtgtccaccaataaatccaggtcatgttttatatcaaaatttatgttaatctaagccaagttacttgacctttggtctgtcaaagtgttcctcaagtatgctttaagatgctttcgtccattttcatactgctcattctcaaccttcatcacaggagaaatacacaggacctttggcaataggtcatttagcatacacattaggaaaaaacttgatgtcaggcagatggagggcttcataaatggtggacagaagctctgtgtctttccccatttccatttgattctccaacaatgaagctcggctgagagcatgtcgggattgggtaagtcatttctatacatgtcagcatggtgttcctccgatgtattgaatttgagttgtcccatgactgagggtaccagagataagcatttacgagcttggaggtgctgttctgcgattatatctttaagttcctgaataatgtgctccactgttgggacacttaggatttctttatagtaactctcagaggttagctgagattccaagttacgctggtaagctctgcaatatttcccagggagtttcatttgaatatcaagtttggttgccaaatttgtggcttcctcaaatcaaaattcctgataaacttcaatattctccgtcacttcactgagtgaacgcagtgctgcagtcaagctactggctgcaaagaagacatcaaaggtttgcccctggagatttttcccaaaggctctggtaaaagataggacatttttaagaacaacaatagtaacaatgaagtcaaaatctgttactgcactgcagagtacaaatgctcagccagctacagttattccatctaatatttgtgtcactatttatatcatctaaacataaaacaaatgcttgcagaagttccactacaatttcaaaaacatcatgcctgcctgtccactgagaatggcagagttccttcagttctttgtccctttctttactgttctgaaaaagaacagaaattacattgtcaaattctaaaagcagttgtggtgattgatggaaaaaaagaacaaactccgtcaattgttcctgatgcaacagatactcccataacaggtactgattttaccaaccacatatttaagacgcaggaagagcagagtgggtagatagcttggggatatttctctaaaagtctagaagcaacaactttcattttggaagaaaatccagtagacaaaatgtaagcttggtcatgacagtactccatatttaatccccatttctcagctatcatagtgtgaaatttcacagccaaaacttctgcatcagcttcataaggcaggaagcctacaaattcccctcttatgttttgagactcatcaacaaacctcaccgagactcatcaacaaatctcaccaacataggtaggtgcccttcccctgccatgtccgctacatcgtcagttataatggaaaagaagtgtgagtctctcacttccctgcattcttcccgaatgcagctctcacagatctctagcatctgcctctgctgtgtttttaataaaacaacatgttaactgctgttgtctcaaactgctttctcaggacctcttgaccagaatttatccagcactccagcacggcttgcacgttatctggagtaaagagaccttctgggatttcatcagcctcctgtccatcaagaggtatgttttgctttcccatcagaatcaagatttcaaacagagattttaggtatcctttgttttccttcttttcaagggttagaggtaaaatgtcctcatctggcccttcactcccttctttactggggttcggagcattgctgttgttggtttctttatgtttttgttcctgttcagaagtttcatcaacaattcttttattcgttttctgggtctactaggtgggttgttcaaatgaccagtaagagcaaatattgttggtattgcattatctcatagaactgtcctataaggactagttctacagaccccagatgtctcaaaatgtttggcacctcattgatcatgtttagctgatcatccctggggctggggagggcagccaggccagccagcgcgcagggcaggggcgggcggaggagaagcctggaggaggctgacgggaagcctcgaggaggggcaccccggtccgaggctgggctgggaacgctgctccacagcgctgtgagtggccgggaggacttaccgccaccaccgctgcctctggggcatctcccacccgcccgggatgctgccgcctcctttccacaatgcctgttgatcaattttttaatcaagaagtattcatgtctacccagcctctaatgacttttttgaaaatgaagttacaaacacaaagcacatatcagctccaaaaactcctcaaaatatctaagggcgtctgcaagtttttcttctaatctgatttttaaatggaagcatcttatgtttgatacaaaatttgatgtcttttaaaaaatgagttctagagcacaacattttcaataaaaagtacaaatgtatggttgtacaataaaatgtataagataccttttttgtgtgtgtgtaatacatgaatgtagttcctctctattctttatgctctttaaattcttcattattatgcactatttcttaaaatggcctagggaatggattggtagctttggctgtttcctgctgacgttttagagggctactaaaatgtgcaaagaggtagttacagacaacagtaaaacaactaaatattcaatgtgccctttcaaatgtgtatttaaggacacagaatcttctgtgtggagacaatctgtgcatgcagctagactaaatgcgtgctagcagccaagacttgcctctctcagtagaccagaattattcataaaccatcatgtaaagagaagtgagcagtcaaccaggagaaccaagggcacagctgtgagtcctgagtagcaagatcaaatctcacacactcattacgaagagggagggtttgtgccttcatttatttttggacacagcttagctaaggttgctggccatatttctgttattttgattcaagcagaaaatcctgtgcagatccacggaacacattattgtaacatcgctcagaggagaattgggccaatgcaatttagaggatgaaaatagctctgcaacgtggtgtagaaactctggtttattggaggataacttttttgatggtctcaaagttaaaaaaaaacttaaaaacaattttattaaatagaaacttgagagatttttattctatgccttatagatcaaatgattttagcatggggtgcgaggcagatgccaagggcttactggagtgaactgcaagcaactccaaaacttttctgtgcttctcctgaaatactcttgctttgtatgtgagtcgtgtctaggccacattaaatggagtcattaggcttgagtaacttgagtaactttttaaattaggaattcttgacttggggtttctcttttctgccgtctttttctacgattgaaaatggcaataaggacgaatttttccatgatttggaattaccaggaaggatggacttctaaggactgatagcttgtgaaagataaccactgaaataaccaatcgtatttgtgcaaggctcattgttttaacgccatattcgtcttataggattattgttttccttaaaagaatgtttctactaactagacttttaatctaacttcagtgctgtctgtccaagactgtcctgaattaagtgattttaagggataaagtctatcaatttaatttatttgcattttatggattcttcttttttattaaaaaaatgtttacagtttagattatagcttatatacaaatttctcctatgaagtctcttccgttttgtgacagtttgattaaataaccaacagactccactgctgatttatcaccaatgataataaattttttcagaatttaaatttatctacagtaagtaacaggcattaataacttggtttcttttttaaataaccagagtctgcaatgccttggtttatgcaaaagcagacaggtcaggcccatctcctggctgggtaacctttttttgccactgatccagcccttaaagtgagtcaagttgtttacttgggggtccatggatgagctacagagattagtctgtgaatatcctaaaattcagtacaactgtgagtttacgtaaattttcacataatttttatcaaaagaagtttgtggtataatggataggtgggcactatagtgtaccctgcagtcagactgcctagatttatatgatgatgggctttgtgagttctattccaaaatacggtaccttggcatattgagtattttaagctgaagaaatttgagaaatggcaggttcaggaaggactctctggccttcccttgaagcaggtcataagaccctcctgtgagagatgctctccctatacccagagaaatggagcattcttctccctgaagatggaggggcgctgaagggaatctgaattaacaggcgttgctcagtttcccccagtttactgcccttagcacctacgcctctgccctgtcacattttcccacaactcttcatcaaacctagtataagaaaacactcaggtttaatcattttttaaggtattcatttcttaatgaagtctcccatgtcacataatacttttttttttgagacggagttttgctcttgtagcacaggctggagtgcaatggcacgatctcagctcactgcaatctctgcctcctgggttcaagtgattctcatgcctcagactcccaagtagctgggattacgggtgccagcaaccacgcccagctaatttttgtatttttagtagagacagggtttcaccatgttggccaggctggtcttaaactcccgacctcagatgatccacccgcctcagcctcccaaagtgctgggattagaggcgtgagccaccgcacctggcacaaaatacttctgttacgtaaatttgtatgcttttctgttgttacagagccacagctaagaacctagaagggtagaagcaaaagatttttttcctcctgtataatcccaatccactacttaggtaggtgacttcaaacaagttacttaacctctctctgcttcagtgttctcaaaattgcagaaacgatcttataggactgctgtgatggttaaatgtgagaattttgagggcacagaaaactcttaatgaagtggcaggtacttagtaagcgtcactaaattttactaattacatcacacagtcggccctcctcgtccacaggttccatagctttagattcaagcaaccttccaacaataaaaataataatgcaacaattaaagttgtattaattaaaaatacggtataacaactaatagcatttacattgtatcagatattacaataatctagagatgacttagtatgtgggaggatttacgtagtttatatgcaaacactacaccattttatattagtgacttgagcatctgtggattttggtatctgaggaggtccaggaaccaattatttcccagggatgccaagaggtgactgtattctcaaaataatctgtaacctccaaaaagttaagagacactgagctatgatatttttagaattgtgttttaaagaacaaatcagtacctgatttaataagtcacactcaagcttaattcaaacagaaatattaatttgcaaaatatacagatgcatattcatcatgaggcagaaaggccttttaaatagctttgaaaatgtggaacatcaatttgtgttgttcttccatgggagaaaaaggattactaagtctcaggtaagcctccaaaaaatatttccatctgcccctggcttccgtactatccaagcttgtcttgaaaccttgaaataaatttcaaggtgacaacctaaatttaactctgcggtagtgggttgtggatttctcagcattttcctttttagttagcatggaagtcaaaagttacaaaagcaatgagattctgcatcttttaatgaaagataaaacaacaatataaacatacacaaatttacagagaagggatcaactttaatacatttggagtaaaaggtgtttcttctttaaatatggtataaaaataaatgcgagaaacattaacggagaatgtacagacaacagacgaagacatgagtttgtttctgactgtgacacattggtgaaatgaaactttctgtgcggaatttattgtttaataaatgtgaagccacatgtatacttattgatatatacttttttcttttacagttcttccagtttttgactgactgaattttcagtgaactgtgtgtctaactgaagctttgagagagagagagagagaaagaaggaaaaaaagaaaaggttttacttcacttgaacttgttaaaaaggaagagacacagatccagcatagtagaaggagaaagaaagcagacaacagtttggaatggaggcattgagacggaagagtccattggagatggaatgtacacacaaaaataacaatttaggtcctttgctcatgcaacatcttgttctaatgtcctctgctccaggtcacaacattgagctacaaagtgtgtgcagtgactccagtctgcattcatgctacaagatgatccgtttagtaagactgagcaaggcttgttaacctcttggacgtgagagatttcccctgagaaaatatataaaacaagagaaaagaaagaaaatcaagtacgatcactgaaaacctgcttagtagtagcaactatttactgtagctgatttttgtgcaaggtcaacactgaaccctttaagtccatcttagttcaaacctcatgaccaacctgccttcccccctccctccctccactgacacgtcaaacaaaactatcctccctccctccaccctcctacccctcccaaatccttcctccccactgcaaacagactgatggtttcacagcacagattagcaaatcataaaacatatccataaatgctccatcaaggcttagcaatgaagcaacacctaggttcccaactgattataaacatgttacaacaaatcttagtaagctgctctgaaagataatgtgagtgcattcttgttcaatggctgaaattaatgtcacatttataaatatctagaaatgtagaggatacgatttaattaaataaaatgcagtttttgagggtgtgattcatgaaactcaagattgagtctgttccctatcttacataataatggataaaaaggtgccaattatatatctgaagataaaagtctacttgttccctgtttctagctgttgatgtcttcctgttctttcctacctgacttcttccaaccctaatacaagaaaaaatctgttctattctgattccacaaatcatatgattacataaagcacatacttatgttttagaaatcttgtaagtcaacagtgttgctgttaatcacaagtactctagagagataagaaatttgagaccgggcgcagtggctcacgcctgtaatcccagcattttgggaggctgaggtgggcagatcacctgaggtcaggagttcgagaccagcctggccaacatggtgaaactccgtctctactaaaagtacaaaaataagccaggcgtggtggcgggcacctgtaatcccagctactcaggagaatcacttgaacccaggacgcggaggttgcagtgggctgagatcgcgccactacactccagcctgggtgacaagagcgagactctgtctcaaaaaaaaaaatagaaatttgaaacgtttgatcggaatgcaaaactgctggttttcatttcatgtcttattttatatgttctattataaaattatgtgggccagttatttaatgaatttttgtacatctcagaagataagtaaaaattaaaaaattggaaacatatattttagtaataaatcacagtcatagcaatactcttgatttgctacctaatgtggctcagttttagaaaggggtcagcggtgatgggagatacatcatcactcatggccattgccttagtctgtttgggctgctataacagaaaacgatagactaagtggcttataaacaacagaaatttatttcttataggactgggaagtccaagatctagacacttatagattctttgtctagtgagggccttctccttggttcatcaatggtgcattctcgttgtgtcctcagataatggaagaaggaaataagctccctgggacctatctgataaaggctcctgttcataagggcttcaccttcatgatctaatgaccttccaaaggccctaactcctaataccatcaccttcatgatctaatgaccttccaaaggccctgactcctaataccatcaccttcatgatctaatgaccttccaaaggccctgactcctaataccatcaccttcatgatctaatgaccttccaaaggccctgactcctaataccatcaccttcatgatctaatgaccttccaaaggccctggctcctaataccatcaccttcatgatctaatgaccttccaaaggccctgactcctaataccatcaccttcatgatctaatgaccttccaaaggccctggctcctaataccatcaccttcatgatctaatgaccttccaaaggccctggctcctaataccatcaccttcatgatctaatgaccttccaaaggccctggctcctgataccatcacccttgagattaggatttaacatgtgaacttgagcgggaagggatcacaaatattcagttcatagcagccacatttttggaaaaagacaatatgtttaagaaaagattaataattccataatcaacctgtctttacacaccatataattactgataagggcccttttgctgatatgaacagcagcaatgaaaatcatgcaccattttctcttaattttttcttaattgggaaaaagggtccacaacttagctttcagcatctgagagtagaagatattaaagtggtttttgttttgttttgtttttttgagacggagtctcactccgtcgtcaggctgaagtgcagtggcgaaatctcggctcactgcaacctgcacctcccggattcaagcaatcctcctgcctcagcctccagagtagctgtaactacaggcacctgccaccacgcctggctaatttttgttatttttagtagagatggggtttcaccatgttggccaggatggtctcgatctcttgaccttgtgatccacccgccttggcctcccaaagtgctgggattacaggcacaagccactgcgcccggctgatatcaaagtttaatgctggcatttcccactaggcttatgtttattcactttatgggagaaacaacaataaaagagaaaacagtttattaacaacagaccctgctttataaataaaatatgcactcctgcctgctctggtctgtctgtccccctcaaagctcacatgttgaaagcttactccccagtgtgatgctattaggaggtgggggctttgcgaagtgaccatgtatgagggtgaagctctcattaatgggattagtgttctttgtgtgtgtgtgtgtgtgtgtgtgtgtgtgtgtgtgtgacagtctcactctgttgcccagactggagtgcaatggcgcaatctcgggtcactgcaacctccgcctccaaaggcccctacctttggagggcctcaaattgcttgagttgctgggttcaagcgattctcctacctcagcctcctgagtagctgggattacaggcatgcaccaccacgcccggctaattttgtacttttagtagggccagcttttgccattttggccagcctggtcccaaactcctgacctcaggtgatccacctgccttggcctcccaaagtgctgggataagaggcatgaaccactgcgtcaggcctagtgctcttataaaagaggccgaaggaagcttgtttgcccctcccaccaggtgaggacacagtaggaagatggctgtctatgaaccaggaagggggccctcatcggacactgaatctgccagcatcttgatcttggacttctcagcttctagaactgtgagagataaatttattttgcttataagctacccacccagtttgtggcattttgttatagctgactataacggactgaaatgctgcctccacttctatgcctatttcctcatctgtaaaatgaggataataatagtacttattttcaaattttgttgtgaagaatgatacaagtaaattgcttaaaattatttatggatcattttgtgcactcagtttacgttggctattacctcattatactatcattataattattaacactatcattatatgctctcttcattaagatacccaaacccagagtcactattctgactctaaaaggacagaaagttataaattaaaagctaaaatcatactgcttttccaccccaatcctgggcaataagctaatcaaatgatgttgaaataaaaaagattcagttcttaaatacaatgccatttcctgtgtttactactgtagtctctgtgctatgaatagaattgtatacacatgtgcatatatacctattctgagactgaacaatttatatttaaaaagtgcttacttggctgggcatggtggctcatgcttgtaatcccagctctttgggaggccgaggcgggtggatcacttgaggccaggagttcaagaccagcctggccaacatggtgaaaccccatctcttctaaaaatacaaaaatcagctgggtgtggcggggcacacctgtagtcccagctactcgggaggtgggagaatcatttgaatctgggaggcggaggttgcagtgagccaagataggccactgtactccagcctgggctacagagtgagactctgtctcaaaaaaaaaaaaaaaaaaaaaaaaaagtgcttcctctttgtgggatgaaggaaggtacacatcagtacacgttgttgaggcacaggaatgaattcttatatagtagaagactggggaaagatgctgatataaaactgtttcttttaaaactacagattaatgtgatttggttcaaaattctgggaagaagaatgggccgggcgcggtggctgacgcctgtaatctcagcactttgggagagcaaggcaggtggatcatgaggtcaagagatcgagactatcctggccaacatgttgaaaccccatctctactaaaaatacaaaaattagctgggcgtggtggtgcgtgcctgtagtcccagctactaaggaggccgaggcaggagaatcgcttgaatccgggaggtggaggttgcagtgagtcgagatcgcaccactgcactccaacctgggtgacagagcgagactctgtctcaaaaaaaaaaaaaaaaaaagagtgaaatagttacattgaaattggaagccatttgaaactcagatacagtcatttttttatttgaacaatgacatctactgttgtctttatcaatttataaaaaaaaaaaaacatggttctctttctatggttttgtttttattttttcaaatatcctcaaatcctcaaagctactagtacttggcctgatatggacttcattaaaaattggatgatacaagttaagcccgacaaactcttgtcccaggaaataattaaaaaatactttttcatagcagcccagagagaaatacaggcccacagtaaacctggggctttgtgatattagcataacaatgggcaaaaatgagaaaacatacaggtgtattttaacaacaaaactctgtgtggaccaggcgaggtggctcaggcctgtaacccccgcactttgggaggccaaggctggcggatcacctgaggtcaggagttcgagaccagtctggccaacatggtgaaaccccatctctactaaagatacaaaaattagccaggtgtggtggcaggtgcctgcaatctcaactactcaggaggctgaggcagggagaatcgcttgaacccaggaggcggaggttgcagtgaggtgagattgcgccactgcactcatcctgggtgacagagcgagactctgtctcaacaaacaaacaaacaaaacctctgtgtgtggtatagatttatcaaatgtgcaataaggatatttgttttgtatattgagacaactaaaaggcaaacttgggtacaactaacagttaacagatcttgggctgggtgtggtggcccacgcctgtaatcccagcactttgggaggccgaggcaggtggatcacttgaggtcagaagttcaagaccagcctggttaacatagtgaaaccctgtctctactaaatatacaaaaattagctgggcatggtggcggtcacctgtaatcccagctactcgggaggctgaggcaggagaatcacctgaacctgggaggaggaggttgcagtgagctgagatcgcgccattgtactccagcctgggcaatagagtgagactccgtctcaaaaaaaaaaaaagagatcttaagtgcagcactgaggtcaaagcagacagcatggatgcccaataggccatctggattggaagatttacacttggatctatttgtaaaccatgtgcaaatcctgccttattcacatagtggaaaggaaaatgcataagccctactctagtgcacaaagaaatgattgtgtgtatacttttggttgctcactcctccactgcaatgtattaagttaaaaagaacacgatcacttccagggaagtacacgtggtacggtatttgcatgtcagccattttggaacaatcattttcagtgcagttccttggatgctgtatggaaccagctcctgccaatgatcttttcccaatttttccaaattgaagaatctgagaaatggtttttaaaaactattttttaaatttttcgagacagggtcttgctctatcacccaggtcagagtgcagtggtgtgaccatgacacactgcagcttcgacctcccaggctcaagcgatcctcctgcctcagcctcccgagtaggtgagaccacaggtgtgcaccaccacacctcgctgattttttatttttagtagagatgaggtctcattatgtcatccagtctgatctcaaactcctgggctcaagcgatcctcccagctcagtctcccaaagtgctaggattacaggtatgagacactgtgcccgaccaaatatgagacatttttatagctaagttttaaagtcttaattccagaaatgaaaagggctaacaaaccctatcaatggcacttttaaaaaacgaaattgcttacaataattctatgcgaataatacttatttttaacccaatgattacatatgtgttatgtgatttaaactcttcctgtcagattctaaaggaaacagattatagtggaaacaaatctatagagaaagacaaatatactcagaacataacaaaaactcaagatcctgtgagattttgtaatatctggttaatggaaatatgctagaaaaagcagcatataatcagtttcaggacaaaataaacctgagacttcagctggcacgtaagtgaacagagagcatcatcctagtctataatacaataattacataaacaaagagagttctctagtgtgtcacaataaaacttcccctcaaccaaaccaattcctttctgtcctaaatggtttgcagagattttgttataattagggacaacactctcaaaacaaaaataacaacctatgtatttgtccttaacttttccaagtgagctatcaaaggtataaattttaactgactttaaaaacatcattcttggcctgggcacagtggctcatgcttgtaaacatagtaccttgggagactgaggtggatggatcacttgcagtcatgagtttgagaccagcacggccaacatggcaaaaccccatctctactttaaaaaaaaaaaaaaagcagggcatggtggtgcgtgcctgtaatcccagctacccaggaggctgagacaggagaattgtttgaacccaggagacagaggttgcagtgagccgagattgcgccactgcactccagtctgggtgacggagcgagactctgtctcaaaaaaaataaaaaataaaaaataaaaaaaaatcgttcttggtcttaaagtaataacagaaagttgatggtaaggagccctgagtcagtaggaattgatgaaggccaggctcttagctatagcctgagagcctggggcattagggagatggaagcaacttcctacattcttctcctgcaatcccttcttcacaaaggaaatagagagaagctatgtttgctttagttactaagcccacttattttattgctgtcataaaaacacacagaatggccaggtgcggtgattcatgcctgtaatctcagcactttgggaggccgaggtgggcggatcacctgaggtcaggagtttaagaccagcctggccaacatggtgaaaccctgtctctactaaaaaaaaaaaaaaaaaaaaaaaaatagccgagtatcgtggcaggtgcctgtaatcccagctactcgggaggctgaggcaagataatcacttgaacccgggaggtggaggttgcagtgagccaagattgtgccattgcactgcagcctgggctacaaaagcgaaactctgtctcgaaaaaaaaacaaaaaaacaaaacaaaacaaaaaaacacagtagtcttttctagtatacaggacactgaagagattgagcagaaataaaggggcagatttttaaagggtggctatgaaacagattacagagaagagtagaaagttatcaacatcttttagattttttttgaggccgggtacgatgtctcacgcctgtaatcccagcactctgggaggtagaggcgggcagatcacgaggtcaggagattgagaccatcctggctaacacagtgaaacctcgtctctacaaaaaaaaaatacaaaaagaattagccgggcgtggtggcgggcgcctgtagtcccagctactcaggaggctgaggcaggagaatggcgtgaacccgggaggcggagcttgcagtgaaccaagattgctccactgcgctccagcctgggcaacagaataagactccgcctcaaaaaaaaaaagatttttttttttttgaaaaaaaatttaacctccattttcgctatccttttgcaattcctgcttgtttgtctccagccactgcctccgagtctctcccatatgttgctgtagactgggatggatattcttgagtgccttgtaggctgcagagactatggagaggcactggggataagaaaggtaaaatcttatcgttgcccttccactggtttatgtgatccaactgtctcaccagatgctcaaccccacagctatgttaataaaaagaactgaccatatggtggtaaaatgagatgctattggaccagagatagggaatgtttttaggagagtctgagctaaaggatgttatctgtttattattttactctcatgttgaaaaatgccttttccacttattgaaccagggataggcagtgctcttagcagagtctaaactaagggatgctagatgtttgttattttactctcatgttgaaaattcccgtttcacttataaatataaacatctttgcctggatttccaaatccttcactacctgggttccgtggcctttcagactctttactgttacccacgaagtggttctttggctggcccttgtgcctgctgctctctccgctggtcacctgtttgtgcatgtacctgttcagaccctatccactcttcaaagatgaacttcctatctatgtccttgctaaagctttctaactatccctaaactcctccggttccctctttgaattcttcttgctggtagaacctgcattagcacttttatatgccttcttacgtgattttgtaagtcatctggcctgatgaagtgataacggacagctgttaaacattaatattatagcagtctccaaataagtagttgattatttgcaagagctgagctccttggctgcaaatctcattaagggaataaacttctagaaatcagggtaatgagattccaaggtcttgggaaaattaacttttaatttgggggaggagagacatggtggagagagggatgggggtcactggtcacaccctaaatgttaacagattgactaatagaatcagaatattttcaagtaggcaggtgctaagaaggaattcaagctaggctaggtgttagggaagctcttgcacaatttaaatgaaatcagttcttccaggtaaacttacaagtgagtttgctgaaacatagtgaataatttttataaaactgtggaggtgggtgagttcctagaatgttaaagataagctcgaattcttgagaattaagatggcaaggacaagaggaagaggattctgtagttagttttgaaactgtcatatttaatgttgaatgctgaaaaatattctagtactacgtactaaaaagagatagcttatgaacacatatacatttaagtactggtcactagcttcctaagagaattgagaaagaataagtatagccaaatactttcattttcttaaaatatttttccataataaaaccagtatgtgttcactaaagaaaatgaagaaaacatagaaaaaagagaagaaataaatattacttgaaatatgatcatttacattctattatgtccttctacctttttatacacagatacatgtttaaaattttttttacaaaactgaaattatactgtgcatggtactatgtcatattctgaataacgtgtgtattaaagagattacattttgttcaattacccatgttatggatgtttcttcaaaaataatgttgttttaccaactaaatgcattagttggtaaggaaatcaatttagagagatgcaaccaacatttagaaaaaaattaagtacagaatacattttaaaaatcagattgcattgcacataagggaatgtattgttatttcagttctatgtacatataaacacacacaaatacagtttatacagtaaccatatatatgtacacacacacatatacaaatacgcacaaacacatgtatgtgtcgatcaaatgtggctactctgggcacactgcctatggattagccctgctctgcaaggaacaatagaaaaattaatattttttaaaaaatgtgtcaaatatgggtatcattaaaagaaacaaaagccaatgctttaaaatataatttttaacattcgtataacattccaacagtagatatgtcttgatacagttaagaaattcacaattgttgtactttcagattgtgttctatatttgacaattatataatgcaacaaatattttttatatgtgggaacacctgggttttttttaggattaaactactagaacttgaattactgattcaaagtgagagatttttgaccttctggcacattctgtcaaattctattcgacaaaagtgatagcaattcagacttttatgagcactgtatgagatcacctattttcttaacccctttctgatactagatgttatcatattaacaaaacacatctatttggaggaaaaagtgattgtgctgctttctgaattttacttgggtattaataacaataggttttcttttttgttttctcacatatcaatgtactgtttgtatttcttttgttaaaattgcctaagtccctccctcattcttctaatggtgtgttgctcttacgacattatatgtttgcaaggagctccctgtagaccctgtattacattttggtctgtcatagagatgctcctttattcattttaaaaaggagtttaccagatttgagcacaggaacttgctttaaacaaaagaccttcggctacgtaaggcacgcagcaggatttgcagtatctctgtgattgaaaaagagaaagatgtgcttcataactaaacaaacaatgaccttcaaagtgtgctattagggcagtggaattctgtcttcctccctgttccttatggtattttaatcagtaatttgaaagattaaactgatgaaattctgataaaatgtatgtatgatctacatatgataaccttggtttaaagactgagtaacaaagaaatacttcaaaaaattatgtaaagctttaaaaatgagctataactcacaagataaatttagtggaaagaagggtaaagagccaacatacactaaagtgaataagtaaacaatgaacgaagaaacctagcagcaaaacacaaaattagggacatgtaatctcagcacatgagaaaaaaaatccaatttttaaagtattttattttaagccccaaatgacattacatgttgctctggttgggggaagttgatgcaattttcaggttagattttaaaagttataatatatgctggctgggccatatctcaaatattgtgtttggttacgattacgaggcctattgatgaactggaacacatgtacaaagtgagcaaacagcaggatgaaagaacaggaaattattaaatgggacaacattagaagctcactttcccattttaagtgtcactcagatttaatttgctagcaacatttaagacatctttatcaagtgtttttgtgttcagcttaattttcacagaagtatctttttctttttatactcaaatttcgacaggtttattttaataaagtacttaaatgcagtatgccatatatttaattataaacagctatgggaacaaatggaacaaaacaaacaaaaatggactcttatactatacagttcaatgggtggttgcagaaatgtgaggacctaattggacagcagcatctcagctgtgacatttgtggctcttgacattcactgtggagaaagtgaagagcattggtacatctagggcagtggttttcaaagtgtggtcttaaaatcagcagcatcagcatcactgagaattggttaaacatgaaaacacttgaattggatccatcagaaaatgacttacgtagactttctgaaagatggagtccagcaatctgtgttatcatgagcactccaggtgattctgatgcgtctcaagtgagaactgcggatgtttagtaaggagagatcagctgggaatacttctatttgtgtgatgatttttaaactgtatggttttgggatgcttgtaaccaatgcggagcagagacaaagacagaataattctaatgtaatcagagatgaggttacaaatctgcatttgccaagcccctggtgatttttgaggtatggatagttggactacacttagaaaaataatgaagtaggcagggtgtggtggttcacgcctgtaatcccagcactttgggaggccaaggtgggtggatcacttgaggtcaggcatttgagaccagccttgccaacatggtgaaacctcctctctactaaaaatacaaaaattagccaagtgtggtggcgcattgttgtgggaaatcagggaccctgaatggagggaccggctgaagccatggcagaagaacataaattgtgaagatttcatggacatttattagttccccaaattaatacttttataatttcttatgcctgtctttactgcaatctctgaacataaattgtgaagatttcatggacacttaccacttccccaatcaatacccttgtgatttcctatgcctgtctttactttaatctcttaatcccgtcatcttcataagctgaggaggatgtatgtcgcctcaggaccatgtgatgattgcgttaactgtacaaattgttgtagagcatgtgtgtttgaacaatatgaaatctgggcaccttgagaaaagaacaggataacagcaatgttcagggaacaagagagatcaccttaaactctgactgctggtgagccaggcagaacagagccatatttctcttctttcaaaagcaaatgggagaaatatcgctgaattctttttctcagcaaggaacatccctgagaaacagaatgtgtccctgaggggaggcctctgaaatggccgctttggggatggctatcttttacggtcgtagctgtgggatgaaataagccctggtctcctgtagcgctcccaggcttattaggatgaggaaattactgcctaataaattttggtcagaccagttgtctgctctcaaaccctgtttcctgataagatgttatcagtgacaatgcctgcccaaaacttcattagcaattttaatttcaccccggtcctgtggtcctgtgatctcgccctgcctccatttaccttgtgatatcttattaccttgtgaagcatgtgatctctgtgacccacaccctattcatacactccctccccttttgaaaatcactaataaaaacttgctggttttgcggcttgtggggcatcacggaacctgccgacatgtgatatctcccccagtcacccagctttaaaatttctctcttttgtactctgtccctttatttctcagaccagctgacacttagggaaaatagaaaagaacctatgtgaaatatcgggggtgaatttcgcccaatagcgcatgcctgtaatccaagctatttgggaggctgaagcaggagaatcacttcagctggggaggtggaagttgcagggagccgaaatcacgccactgcactccatcctgggtaacagactgagactctgtctcaaaaaacaaaaacaaaacaaaacaaaacaaaaacaaaaaggaaagaaataaaaaaataaaatgaagtagagttttctttttttaatttataaatttgttttttatagagaccagatctattttgttgcccaggctgatcttgaactcctggccttaagtgatccccacaaccccttgcctcagcctcccaaagtgctgggattacaggcacaagccactgtgcccagccaatgtagagattttaactaagggaaagaaaaagaaaacttgagggaggtgatgtaaatcacaccttcaagcaattcactagttgtcatctagaggaagtgcttgtattactctgcagtggcttcaggaaatagaactaggattaatagctggaagttacagaaaagtggattagggaagggatttctaagagatggaatggtctgctgtctacgggtaccacatctcagatactcaggagctgccaaatgctgaatacccatttgtcactgagcctacagaaaagattcttgcaatgggctggggattggacccagggaaatagggacctctaagttcctttcaattctgaaactgcaaaaattttatcattccccagatctcctgaaagtaccttgaagatttacattttataatcagaaaagagaaagctctcccaataatcttttctatctcatgttaggaatatattcttgttagatattaatatgcctatttcaggtgaacagtgttgataatagggacttgtttttctcctttgtagtaactgagcccatgtctattgggtaatttggctgatgaaatagatgaaaaacttctttaataccaaaataaaatctgcatgactcaaagaggcaaaaaactgatgatgaactttttttcccccaggaataatagagcattctagagaatgtgctttaaatttccaacaactgccacagcctattttagtaatggcttctgctggttgaaattacaggaataagtggtgtatttaggattgtccaatgtgtgttcctattattattaggtactggccattgacaaaaacaatgacaacagccatcaaaatatggtgcacaatgaagagggcaggagattttgcccaatctgggcttgtgtacagtatcagccaaaaacatacgaaaaatttaccaaggtgtctgtagatatacacataatatatccatgcttatagatggatgcaatttagataaagatgtctaatgtattgctattttaaattgtctattttagtgtcattgctttctgggtactagcaaaaattatggaaaagaaaaaattacaaccacagcttgtcatcagtataaaaatggctttcttttctgaaagaggtttcataaaagaatgctaatgagtatatatgaagctacatgtgtctttagactaagcaagagaaaaggattttgaaagagatgacttgttgatgacccagggctgtctagtaagtggcctcacaactagaaataattaacatatgactccacttttggtggaaattaaatttggacaccataataaacccaaactttacatcaacaacttccattcatctttttcctagatacttaaaacaaatttataaaaataatgtgcaaatattaccctttagaccgttgatggaattctgcttaactctttttcattctatttgatgctgtttaattcaatgacataaattgagattgagagttgaccatctgcaaggtactgtgccaaatgttgaaatgctaagattacattacatagaagatataagtcctatatctccttgctttactgagctacaattttgtaccataatatgagattcagatcattttgaataataattcaagttcaaatatcaccaaataaaataaaagtgataatgcaacataatgagctaatggtcatatataacatgattttaaagtgagacagtgtgacatttatttttctgctgtcaagtcttccagtaaacttggttcaaaaatgttctaaaaagtttattggtgctacaagtcttcttcttccttcatttcttctattttgccacccaagtttttgttatcatctaatgtgcagatgactacagtagctgctgatgctgcaaacacatcctcctatctctagattctcctagcttgccctcatctgctgtgtagatgatgatggcccacgtgtagatccagagcacaggatatgttcttgattaccttcttctgtactctgcttctctcactggaaacctccacagtagtccctgcccgaatttgccttcttcagaccctctttcttgtgccacctttgctctgtctctctctctcctgcagggccccactgtttagcaggcaggtctcttgctaggccttaactcttcctctccctgcctactctgcactgttttaagagaagctatcatgatttatattaaggaagttcgtggaaagccaaatctgttcactgaacagttaacttgcatgagcagaatgaaccaactcaggtgcaactgttagtagtatctccaaagtagtaatttgtgttcatatctgtccttttgcaaagtataagcttcctatgagcagaggctttgtcttatctatccattctcagaacaaattgcctggcccacagtaggttcccaataactgttttgttgttgttgttggatataagaatctagtagtgcttgaatacatgggtgctcttggtttgtaaacttatcatacagagcccccaggatggtctctggctgaagcctcatagctactggcataaacccaagacttcatattcattggaacacaatactttgggaaatgctgtagaaacttctgcccctggcatatgtagcagcaggggtgacatttcccactgtggggagtgtctactcagcagccccacagcattccttaggaacccccagggctgtatcggacactctgacaaaaacccatgatacaattcagagctcacagaacttgagcagcaacttaagaactaacgatgctgccaggggaaaatgaagatatattgtctgaactcaattaggctacaaggtctgatacattgcacaccaatcgatttacatcatgctgcagggaaactaaaattgttttctcaggcaagttatcatcaccgccagtttcaataaaataagatggatagccatatctgccaactacaaaatgacaaatgagatggtttcaggtccacagcagaagaaagacgagaaaatagttcatctttgagcagacacatttcatatgcttgctggtaatatctatggtggggaaactcaatggtcagtttataaattattttcactgaaggtgtagtaggaatatatatatatatatatatatatattttttttttttttttgagacagagtcttgcactgtcgcccaggctggagggcagtggcatgatcttggctcactgcaagctccaccttcccggttcacgccattctcctgcctcagcctcccgagtagctgggactacaggtgtccgccaccatggccagttaatttttttttgtattgttagtagagacggggtttcaccgtgttagccaggatggtctcgatctcctgaccttgtgatcagtccgcctcagcctcccaaagtgctgggattacaggcgtgagccaccgtgcccagccatagtaggaatttttaagcgtagtttacctatattagtgtatctataatcccaagcaacagaatccatagcactcaaccctaaaataatatgcacaaaggctttctttaaggtaaattcacagggcagagatgtaaaatcaaaaccttccttctcgtaggttccaagtctgcttgtgtcctatgatgagtgttttgtgaagcagataatctgcctcattatgatgggtgtttgtgtcagttgaggatctgactcactctgtggagctcttaccatgcctacaacttcattaatatatatataatctagaaaaagaactttctgaatactctaaggcttgtctctactttattgtggtagagattgatatcaagggaagtgaaagtaaggacagccaagctgtcttttttaaccacaaagagtatcacataacctgacacttagtcaaaacttactacctgttgatgaatgaatgatttagaaactagaataatggtatataaaaacaatgatatcaatgtagcagatgcgtggatcccaggccaccaggtcaattttctctgttgggattatttatggggaacaaatccaatggcaagtttatatgttttctttttatttgtcctaggaccctttccaaaatagcctatttacactaatgtgcatgtaggtccaatcagtaaagtccagagtgttcagccaggagggacatgactcaatcccgaacagaaccaaggtccatcccaaacgtgccaggaatgggcagctgagggactgcccaagtagatttgacactgtactgcactgctcctaccctggctccatagctgggctggggctgtgattcccagacgtggcacctgtattattcacaggtttacactgtatgcagaggggagttcccagattatagttttatacgttttataggttattagaatatggagggaaatctcacactagattttacatttaataaaatccaggtaaggctgggcgtggtggctcatgcttgtaatcccagcactttgggaggccgaggcaggcggatcacctgaggtcgggagttcgagaccagcctgaccaccatggagaaaccccgtctctactaaaaatacaaaaaaattagctgggcctggtggcacatgcctgtaatcccagttatttggaggctgaggcaggagaatcgcttgaacctgggaggcggaggttgcagtgagccgagatcacaccattgccctccagcctggacaacaagagcaaaactctgtctcaaacaaacaaataaacaaaaaaacccaccaccaccaacaaaaatcaaaccaagttaaaaatcatttgaccagggactaaaaagtatccttcaagttttcaacagtgtcttaaaaaaaacaatatgtttcccggaaagtagctacagttcttcactgactgaagactaattggtggtggaggtctgtcattaatgtgtaacacactggttttggaaatcaggaatacaacatctgattcccaccttccagaataagttatttttccctctagtgtatgctcttgcatgaaggaaaaaataaagatacaaaagagataaaaagagataaatggatacctcttcccttgtaaatttacattccatttaaccaagcagttcaattttttatgaaaagaaaatcaatatataactttgattttattgtactttgacctataaaagcaatgaataataaataagcaacaacccaaacgtccattaatagatgatcagaaaaattacagggcatatccattcaaaagaattttgcatggttaataaatagaatcatgtagaaaaatagtcaattatttggaagacatttacaatgcattttaagtgaataaagaatgtttcaaaagaatatttaaatataattcaaattcttaagtatttatatttatttgtgcaaaatgctaattggagctgtgtctgggtagagagggtcatctagaggtgaagaaactgaggttcagcagtttaaatgattttttcttttattgttattataattattattatttttgcagagacggggtcttgccatgttgcccaggtggttcttgaactcttggcctagagccacgttcccgcctcagccccacaaagtgctgagattacaggcatgagccactgcacccggccttaaatgattttttaaaattcacatggctagaatatataggactaggtttcaaacctaaatagaaacacatcaaattccttggcccaggctctttttaccatgttaccacttatatataatctgcataaggctgtattaaccagtaattccacagtgggcttagataaatcatttaattttatttaatcaaaataacattctaaaggaactaagtgttgtatcttctttgttttctatttcaaataagaggatttacatttacatttgctcctatcaacatttaaacaattgagttacagagttaaaaacagatttcggctgggcacagtggctcacacctgtaatcccagtagtttgggaagctgaggtgggcagatcacttgaggtcaggagtccaagaccagcctgcccaacatggtgaaaccccatctctactaaaatacaaaaaattagccgggagtgttggcgggtgcctgtagtcccagctacttaggaggttgaggcaggagaattgtttgaaccatggaggtagaggttgcagtgagccgagatcgtgccactgcactgcagcttgggtgacagagtgaaattgtgtctcaacaacaacaacaataacaacaaacagatttgatcctaaagatcaactgatttcagggccaacccactcctgttaaatttctctcacggagtctccacaacttctggtcattccttgcagtccccagagcacagttaggagctcaatccaccagcacaaatacaccaggacagagagaacgggatagccaaggaggcatcatcttttttctattgattcttttaaagtctctacagataattgtcttcattaagatagagtgaaaatattttcaaaaagagataagattaggtgactccctgggtgttcaacatcaatactttctaatattcatttttacttttctacttttgtagcccagagccaggctgatttaatttccacttcacacaaagacaaaaccagtgtgttacacattaatgacagacctccacaaccaattagtcttcagtcagtgaagaactgtagctactttccgggaaactgatattgttcacacaaagacaagacagaaggtgagtcacacagctggcacttgattatgaatcttgattgaaggtgtggctgatcagtcatcctaccctgtttttcctttgttttctatctgtccctccttaatgtttgcatagcagacagatgctatggtttttcttatcttatcatgttatcttttcttattttttcagacagagtttctcttttgtcacccaggttggagtgcaatggcatgatctctgctcactgcaacatctgcctcctgagttcaagcaattttcctgcctcagtatcccaagtagctgggattacaggtgtgcaccaccacgcccggctaatttttgtatttttagtagagacaggctttcaccatgttggccaggctggtcttgaactcctgacctcaggtgatccacccgcctcggcctctcaaagtgctgggattacaggcatgagccaccatgcccagcagatgctatgatattttaatggctgaaaaagtggtgtcagatttgatgatggtgatgaagaaaataattttcataattcttaaagcatatgaacctttttgaaagagaataaagtcaacttaataacatttaaaggtatgagaggacatagtaacccttggaagaccaaccttaagagacttctctgatagcaagaaaaataaagaaataaaagagtaaacaagacatgaaaaggagctttcttgagacaacaaaccccaatgcgggcattacacaaatgtgagttatttttctcctacccattttgggattaatgaaaagaataagaataatctatgaagagtaatgaatttaaagtaaaagaaaaagcttgcttcgagttccagctctaatgctcaacagctggaagatattggtgaaggtgccctcacctcactatttccccatttttttgtctgtgaaaaaaggtgatacctgcctgactacctcccaggattgttgtgcatgcaaacaatgaccaaaacaacaacaaaacacacaaaaaggagtctatattttttggaaaattgaaagtgcaatgcaatcctcagctgtttattataatttttctctaaagtgctagtaagtatttatgaatctgggtaactaacaaaaactcccctgcaaaagctggctagcaaaatatttttgtctctggggtgaaacaaaaacaacaatgccatttttctaaccttggttataaaaaccctaggctggaacatgtaaatcaacttacaaaaataggcacgcattggaaatggactcagactggggaggtgggtatcatcaggtggcaaggtttatttattttttgtcagttgggagaatgtcaaagagcagggtggatccgtggaaatagcactggggaacaaaatacatttggagtcagtcccagctccttccctaactatgtgactctgggcaaattatgcacctcctttgaccctttaaatttcttacctacaaaatgggtaaaataatggctataataatatctaccttacagggccagcatatggattaaattagataatattataaagcgcccagtgcagagcctggtacatggcagatattcaatgaatgtgagtttttccccattattttcctagactacatatttgtttactattttcccctattccatttctttcttggatactgttgaccttgtagcctccctgtatgtaccagagcaacctgtgtagaggattcctttaaaatatttacataaattccatctttactccagtaagtctatctgattataataaaatcactcattctttatcttccattaaattattttattgatcctataaaggtgtctcataaaatttagtatgtaaagatctaagatgcttgatacagctgccgaccatgaagttataaaatacggaacactaaaccaaggggaaattcagagaaccttttaatttccttactccatttcttcagaataacacccaaataaaggtattaaataaaaaagattgcattttattttcctggatggaaaaggattaacactaagcaacagtgtctgaaagttattattatggtttgtgtgtgtgtgtgtgtgtgtgtgtgtctatgtttgtgtgtgtgtgtgtgtgtgtgtgtggatggtattcaacttcttttccttcagtaattccagttgttttttttttttccacttctctttaagaaggtggttgctcttcttggtctagtgaaatcctgcaaattcagttaaatgtaacttctgggatttctcagattacatatgggccctccctcctcaccctaacacccagtagaaattgtttatctttcccttgtacatcctaacattttgtctataccattgggtacctttgagatcaagctctaccatggatatccaaccttttggcttccctaggccacattgcaagaagaattatcttgggccacacataaaatacactaacactaatgacgaataatcttaaaaaaaaggtctgtgcataatttttataacatctaccaccacagataagcaaaaatgtccttgcattcaaagggttggacatggctgcaagtctatactttctacatggtcccaagacatagcacatggtttagaatagaggtggcaattgtgtgaattttgattgaaggtgtggatgatcagtcctcccttccccttgtttcctgttggccctttcttaaagtttgcagtgtgtgaccatatggtactattttaagagtttgagaagtgggttagatatgatgttggaagaaggacaaccatttgacttcccctttccatcttccccaggttacatcactattttaaattatatcacagaaatttccattgtaatttcaagaacagtatattctgtcagcattacgtttgaaaaggattaacttgaaatgcttcttaaacaatacacagagtacctcacattatctgatagtcactttctccagcaaaatcttggagaattgtttgacattgtctttattgccccatggtgacttatgaggcatgcttcagaaaattctgtattaaagaacagaggttccaatagtgccagccaaaatttcataaaatttatttacaatgtgattaattcctggagtccatcattctccatccctttaattcatgcaatcacattgaatgttcacagtatatattactgttcaaattctttcaaatactctgtgtaccgttgcaatggtaattcacaagtagaaatgagtaacattccccaccacaaggatccttgaaggaaactgaaaacaaaagccattatctttgttgaatccagtttgctcacatttcaacacacataactccactgaactggccatcacagcaaaagccacaacacacacacacacagcagcatggagctaaaccacacaactcaacagacaatgcagacaaacttgagtataaaccaagatttttctacctcttttcataacaggttagtgctggccctcagtgttggtgtacagtttttatggcatgggaaaatagggatgtttctgccctataaaaataaatgtgttgaaggctttagtttgagcttacacaatgtcagaaagttccaaaggcactggcacaatacaaaaaaaagaatcttacaaacaaatatatatcatcaaaacacatggcaagatactaagaaaacactggtaggaaaactactggtttctcaggtgatttatgcaacagttttcaacaccttcctgaaaaataaggaataagaaaggcaggctagtgggtctctggtggggcatatcttgtcaccaaccaccactcatataaaatctttaattttaaactgctcagtagatcattttctctctgcagaagtaaaacgcatagaaccctcattgttcttaacattttaagcctcaggaagggctaagggaaagagcatagaaatacatgcactatctttaataaagaaaggaatacaaggaataaaaataaaatataaagaataattattattccttccttttatatgttgtaatataaacttctttccaaactttaattctgtacagataacttgttcatatataacatctttttctactttggaaagggatgggacagaaagataagcagaaaacatgaagttctgaatttgaataaaagaaacacttttgctgttatatcaagaatgcaaggtgggtaacagggctagaaatagggaaattggaaaaatttcattggacttaatgattcataattcctcaaaaaattaaacttaccacattctgtgcaaatttttcaaaagatgttctgcgatccattgagtttccagacttacgtatgtggggtaggataggatgaagggaaataagggaagattaaaaaaaagaaagaaagcaaggaaaacagagcagaaaaagacaggataatgaaatgatgcaacaccaaatccatgttctaaatcagaaggcccatagaggttggagagccgccaagggaggcttcttctcacaggacatgggctctgcttacaccaaaaactttccttgtacaaacaaaatggtgtgattcaagcaaaatcaaattcagccaaaataaagtggatatgtgaagcctttatactgacatttgcagagcctaaatatttaaaaatctagcagcatatcctcagaatttcctcaaaacttttatgagaaaaaattcctattgacaacatcattaattccatagagcattaatgtctaatagaactttccaaaaggatggaaatctcattctatgctgtccaatacagaagcccctagctgtggttactgagcacttgaaatttggctagaatgttatataattttaattaactaatatttaaacagtcccacgtggctagtgactgctgtactggatagtgttactacaaagtatccatttctagttgtaaaggcaatggacttttaaaaatcttattagcctacatgacgatcatgaactacacaaaattataatttaaactcagagtttcaagaagctatgaactattttaacattaaaaagaatgaatgacgttgatgtttatgtccagattttctcttccctgttatattgattacataaggagttatgaacagagagacattgattattaacattgttgaataatgaggtctactacaatacccccataatgtgcttggctaccatgctaggtgtataaaattcatcacagggatattaagtgattcaggataaatgccaaataaaaatattcggaagcaaacattccgacattttgtcatctattattgaaaaaggtgagtctactttcagttatgaggcctgtggttcaaaacatacattctagcttactaaacaaagaaacctctcttcaagtttttgacctaatgactttgttactttcttttctttattgtaattttgattccatgaaactaggcatacagaagactaacatgaaacatgaaaacagcttctaataaattttgcaaagcatgaacatctgcagaaacaaacaaacagaaagtaatacaataagcaataaacaaacagaaacaacttaaatggcccttataaaatgcaaaggtttgggggagggtcttggagtatgttcacttaccattagtccaataccctggattcagcagaggtaattactccaaataattataactgagaactaggccaagaaaaaacaactcacaaaaaaccagtacctttttctttgcctgtagaagctcctgataggcactggatcttataaaacgtgggtatgaatcacttttcatcagtttgtaaatgtgctcctaaaaagaaataatggttgaggtgcttctttatgatttcttgggaaaagtaaaatatcatgatgtcacacatggctaaagaacaaatctagtagcagcgaaaaatagtaataacaatgctgattagaataccttctatttacaggatatttagatcttcaaattcattatctcattcatagatcattgtttaaattggtttaggagctactgaggaggcaaatcacatccagtcattacaaaaatggaatttgattaataaaatgtcataaaattacctcaaatcaagttgttgacttatatagatcactagagaatataactaaatttgctgtctcttaaaactactccaggcctgaagtgggtaatgttgactcagactgagtaatcatcctggatacctttggcctctacatttactgggagggtgccaactacccagaagaatcaaatcatctctttggtacaaattgcatggaaaattgtcttccatacccactttgggtcagagcacaagtccaaaaataaattttgtgatatttaattgctaaatctccaaatttgtgtgctctttcttattacttacccagtgacagattaggtaaatagttgatcatttgcccctaagaagtttgcaatattctgttttgatgatgaattttgatagacaagtcaaaaaaaaaaaaggaaaaaggtactcattcaattcaatctagacccaatctagggaggttccactctggtctaccgcagctcagggagctaacatgtgccttgatcttccaactctagtgaaatatcagttaggtgtagagcttggaactattggagagcattctgaatgttccagttttcttttctttctttttttttttcttgaagaaaatagatgtttcaagaaatgactccagttctctggtcttaaacacaacagcaataatttgaagttactttaaattcatttaaagacattcaggattaaatctcaagacttagcccaatggtgatcttcaaaggatgttaagtttggaactgtatgggaatttgtttgaaaagtagagcaatggctggttttggagttaagcattttgagattcacattctaccttgctcaagaactaccacttacaaatgggataaatataggccaactttttcatctctctgatccttaattttctcatctataaaatagcattgttgtgatgattaaaggaataataaatgtgtagcaaagcatggggtgtggatagtaagtgctcaaatatacttgggtatatggcaggtactcttttaagtgctttcctgtattagttaatataagccttacaaaacccctatggggttggtaaccattatgtccattttacaggtgaagaaactgaggcgtggagaagtggtcacagagcagagctgaaatcagaacccaggcaatttaccttacgatcagattttttttaaaaaccacaaaaaaaactagaattaaatatctgagcttaactgaaaaagaaatctagggccaagtggtattgttttctatagaatttttttttctgtaagaaaagaggatcctcttaggcaagaatatttttaaatgacaccgataactaaaaaaaattctattttaaacctcaggaagggcattccaaacattttccacattgttggctctagaaagatgctcggcattttatcttggactgaaagaaagaaaaatcagcagagaagtgagcagcagggccagagtttctggcctgctctctgtcctgtgtctctctagagtgtaattatttctacattggagaccatggctgaaccacatgggataggtatccagttagctgttaaaattcatgttagtttactacacagttgctgatttctttaaatgaaagccaaggagaaatatattttctatagagagtggaaataaggaaggatattcgtgtatctcattcttcatcttctatattttattttagtaatgtgtgttttttaaaaggtactttttagaattaatattcttctccaaaagaagtttaagaagttatgaagtatgcacgttctgatttaaaaaccaacttcaacacatcattagggagtgggtgcagtggcttatgcctgtaatcccagcactctgagaggctaaggtgggaggattgcttgagcccaggagttggagaccagcctgggcaacatagggagacccaccctgtctctacaaaaaaaaataaaaaaaaattagccaggcatggtggtgcatgcctatggtcccagctacttgggaggctgaggtaggaggattgcttaagcctgggaggccaaggctatagcgagccatgatcatgccactgtaggtaacagagagagaacttgtttccaaaaataaaataaaataaaataaaataccacattattaggaaacactatcccctcattacaagtttatttttcttcttaagtttcaacattttttgagagaaggcagaaattcaagttgtttctacaaagggaattaagatccagtttgagaaaagatgactgaaaatttgccttaggaagttagaatcagttttccttattttttctttctgtaggctaaaaaattaacttgaaaatttaagaaatgtcagaatctaatgtttgattttttttttcaccagagataaaactggtttgagtttgacataactttaagctaattcagtttgaataatttataataatgaataattcaggaatgtcagagtcttagaatgtctacattgaagatgccttaaagattttaaatctttttaaaaaaatgttttaaaaaatcttttactgaggtggggtcatcattagatggtgtttgctcacttactggggggacaaacagagtagaaaatgaagtaaaagttgtaaaatatttcaaatatgccccttcatataaaaatattcaaacttagaaaatattcccaggttttaaaaaaactattcagtttaatgtgtctttgttccttcctagatcagttagagttattttacagttatctaaattgaaaatgttagaaatagctgccatttagaatgaaaataaaatgaatacatctaacgctcaacttctcggaagcacgtttgtggtgtgaggctcaccgtacacccacctgagcatcttcaaatgtgtatcgtccaggttccttcacgttctgtgtggttttgtcataactcttggaatccaagttaatagcactgggggctccgggagccagaaactcttgccatatttcctgaactcttgagggtacttctttaataggcctctttttcaggtcctccactgccagccagaatctatgcagaatgtgagatcgggtgtttactctgatggcccatcatctgaaaattcttgtgacatttacggatcatgcagttcatcatgacgactcacagccagctcactttctctgagggcttccagtatcagggtggtactgactgtgttcaaaggataatcttctttggaagattattatgaaaaataattattaataaaaatataaaaatattaataaaaatattttaaaaatataaataaaaaatattaataaaaatataaagaaacatgaaaaactctctcttctaagtgtttgttgttaaaagcagatctgtcagagccccgtataacactgattttacctaaggaaagtagcacttctgactgttgattgaaaacaaagaggagtttgaagggaattaaaggtgtgggacatggagcctccaattgggagataaagctgtgcattacactgtgttctttggatgttctgtccatttcagcaatgggggctagtatggagagccttttctgttctaggtggtaagggaattacaaagaagctttgctggagttaaaagaggcctggacataagatcagaaaatgctctggctggaaaaataaaaacaattaactaatgttaaggtaatttaattgagagagttatggaatgaccaaagcagcaagctttcacatggaattatttgaaaagttgaaatgtgtagaggcatcattgcaattcagaagccacggaataatatatactgacttacttctgaagatagacttatttataccatatgtatactgaaagaacctgggagtgtgttttggttgataatagcaagtggtaaagtctagtgagaaggggccacattgtattaatcggttgcatttcttcaatattttgctctaggctagagcttgctggttagatctctagaaataatgtttaaaagataaatgagtatatcataatttgttaatagaaacaaacactctactagaaaaaggagctgctaggactgtgttatcctccataaacactcttactgctctaatagtagacgaagtcaaagaaaggcaaagagggccacagagacagcaaacttcaggctacagagtcttaagagaggcacaggtgatcagcagtaccttcgtaactactaagctttaacttgaccattaataaataatcagaaatcagtaatgaagtgcatgagctagaattagaatatcaactactactcagtctagtgatttttgagttttcatttccagattttgtttttttatagatatatgtagcagaggataatctaagtttgacaacgcctcaaacaggaaactaccaccatgacttttagaaaggaaggctcaagacctttccctcttaaaacacagatttagacactgtgcactctaataggaatactatgcgaggctgggcatggtggctcacgtctgtaatcccagcactttgggaggctgaggcgggcagataacctgaggtcgggagtttgagatcagcctggccaacatggtgaaaccccatctctactaataatacaaaaattagctgggtgtggtggcgaatgcccataatcccagctactcgggaggctgaggcacgagaatcgcttgaacccggaaagtggaggttgcagtgagcagagatcatgccattgcactctagcctgggcaacaagagcaaaacttcatctcaaaaaaaaaaaaaaaaaaagggaatactacgcataatccgagggagcagaagtgttgaaattaacatatgctcaggcaagttcatgccagcacactctgaacacatcaatcaaaacagtctctgtcctcaaagaatgagtagagaaaaagataaaccatttaattggccgtaacaccaggaagtacatgaatggctctctaggaagagaacgaactagacggtctgggaaaggcaagcaggaaagagcccctctgctggggcaagtgctggattggaaaagggggatctagacaaagctattctaaatccagtgacatctgaaatgggcctggaaataagcataaaatataaaggggttgagaagttaataaccacacctacactgttatgtaagtgcaggcactgctctaagtgattcacctatattaactcatttaattcccacagtaattctattaggcaagttctattatttccctcattttagagaagaggaaactaagcatatgaagattaagttgcttatttaaggttgctcactattactgtcacagctgaggtttgctcccagaagatctgcagcagatgacatgctcacaaccactccctcacacggtctttctaacagcatcattgcctttcttattctcaccattactgtaattattgtaatagcttaatagcatggaggagccaggtgcaatggcttgcacctgtggtcctagctactcaggaggctgaggtgggaggatcagttgagcccaggatttcaaggctgctatgagctatgacagtgtctctgaactgcagcctgggtgtcagagaaagatcccatctctcttaaaaaaaaaaaaaaatcctatatcctttatataggtggaagctaagtaagtatttttaatgtctttgattcttgatttcctcatcagtaaaatgggatgataacgcctatttcactgggtttccactggattaattggtttccattggattagttgattaaattaattccgttaatgtatactaatgatataaattatatagaaggcactgaaaagtacttggcatatttttagtcactcaaagataaaaactcatgatattactatgttttcttagcacttgctctatgctatgtgttttgctcaaaaaaaagaatgagggaaatacatcataaaatttcaagtttctgctctctattagggagagcagagggtatatttgaagcataagtagttatcgagaaacagtgcttcttatttttttcctgtcctaatatttgaaaaaaaatgctcagacgagtgacacactcactgatagcaggagggcagctgtttaggtaagatgcacggagagttattttattttaagtgcaattcacagccctgttgaccactggaccattttgtctccttcagtgtgtgacacagatatgtcagtggaagcagagtagggctcagatttggggagcagtggacagtagcttggtactggtttgtaggaaaccaagaatgccacttacatgcaatctgacctccttagccacactttctcggcttaaccttcctcagccacgcttttctcatctataaaatgaggcaatatttacattttatgttgttttggtggttggatgtgtgatgatcagaaataatgaatgcaaaatataacagcatacttataaaagtagtagatataaaatatattctggtgtcttgtaggtattcaagaattaatctacatctttcatttatctactgatctatacttactaaggaaacatatgataggcaatatagtagatactcaagaaatatatgtatatgtgtgtatgtatataatgtgtgtgtatatatataagataatctaatatttcttagatataatcacttagcctagagtctagtacggcatagaatgattaagatatgaaatgattaaagcttgaactaagaaattggcaggaattcaattcatgcctgaaacctagtatgcacatgctatcctctttttccaaaggcatcttctctcttcctgttttgatggtttatctcctccccattgtccagctcttagcctagaagcgatttcccctagtatcccttcgctgatctctaactctgggctaggcatccctctctgcttctcccaactaaacacccatgattttgtgctgtgatttgttttcttgtctgtatctaccaatagactgtaattttaatgagagaaggcgatgtttttatttggctaggtgaggctggtaaggcttattacttatttatttactcatgatgatacaaatgatatcagcatgttttcaaaaacttagagaatgagaggaatgtccatctccctagccactaaaatgcctcaaggatcctttatctctgctttatttttaatgcattctttttttttttttttttttgagacagagtcttgctctgttgcccaggctggagtgcagtggtgcaatctcagctcactgcaacctccacctcctgggtttaagcgattctcattcctcagcctccccagtagctggcactacaggcatgtgccaccatgcccggttaattttaattttaattttttgtagagatggagtttgccatgttggccaggctgctctcaaattcctggcctcaagagagccacctgcctcggctcccaaagtgctgggattataggcgtgagccctcgcacctagccttttaatgaattcttgcactcaattattgacaatgtgacctaatatagaaaatgttattagtagtctcaatacagaactttagcaactttagcagcaagatcttgcaaaagcccaagcatgaagggttcccataaactggaaggagaataggaagctgcatgccagcaatccatgccaggcacacacagagagttacattcctccgggttctgtctgtggtcattttgcttcatccatgcgacatgtgtcagcgtcctacatctttctgaatggtttgggattcctacctgttaaatctcctgaaaagaacgtgaccatgcctggcactacttcgttccaatgaaaataaatgaatgcagagaactttcagtaaatgaattttacaggactgcataagtcatggaaaagtaaaaattgggcatcagctttcaaaagaataatgaatgaaagaactcatgaaacaacagtcttatatagtggaaagttatcactcccttcaatgatgttaaatagagctattaaaatccactctaatgtcttatatttaaaaatgcaattttcagatcctccttatgttagcaagttttaaaaatatataaagatgatgtttacaacagatgggcagaatgggtgtcactctctcacgaacagctcaatgctgtgctgctctcaattgccctgtggctattatttaaacatgcaaagagaatgagacagcccaatagtttggtttcaagttatttgatatagctgcccagtctcttcttctctaacttgcttgagaagtgatacgcaaagatagtcaacaatgacaaataggtgatattttaattgaacttcataaatgttattggccaatctccactttgccaaacattgttctctgtactgcatttctttacagagtccatttcaaagccaccaaatttgtatagttaaaacatctggagatacagagacggcgtaaaaataagttataagaaattgatacgttggacagcctttgccttgctatctcttttcccttcattaggtggcagaaattcaatgggttcatgacatcattatgatgttagtggaagaataattgatctattacctccaaaataaccagacacatcacagacagtatttctctggcttataagatccaagcaatgtgttttaccttaaattttccgagctgaattctgactctagaaatttaaggaactgttctctcccaactgggtctttcaatgcctcgtccatgccaaaaccccatcgttttaccctctgctggctcggttctttgctatagaagataaaacaaaggcaaatacattcctttcattagaattcccatttttttgttattacattccccttcaaaatcatgtgtgcctcgaagttcccatctttaccttttctttaaaaatatatatatccgattaacggctctgcatgaaatcatcgtgtacattagtattaataataaagtctaacatttattgagcattatgtgccaggcactttacataaatggtctctttttgtttttgccaaccactttatgagatagccactattaatcttattattttccagatgaggacagtgaggcacagtattatcacttgccaatgtcaggcaagtaataaggggtaaagatccagatattctgaccccagtgccacatttcttttttcttttttttttttttgagatggagttttgctcttgtcacccaggttggagtgcaatggcgtgatctcggctcactgcaacctccacctcccgggttcaagagagtctcctgcttcagcctcccgggtagctggtattacaggcacctgccactatgcccggctactttttgtatttttagtagagatggggtttcaccactttggtcaggctggtctcgaactcctgacctcaggtgatccacccaccaaagcgtcccaaagtgttgggattacaggtgtgcgccaccatgccaggcacacatttcttaaccactacgccacacagggtcatgcaggtatattgaactggggaaaatgcattggtaaccaaaagatctcaatactagctaatgattctggtgtcaattaaatctgtgacctaatcccaactgagtcacaacattttggggttccagctttctcatctataaaatctttagcttgtggaggaagagttctgggcatgtccagtgtttaagattcatggctggatgcaaaagtgagagagaccagaaatgcaatctagagaactgctagaagtgtgacagagcacccatcttttctttgtaaagtgatacgccatgatcctcttatgagtctgttaagactgatgatgtagttctttccctagatagctcatgaaagaaactatggagtcctaagtggtgctttgcttttcttaggaagtgtcttgccagtttctcttacagtgtctatggtaagctcattctgtcttaaaattgaatttataaagacatacttgtgttgggcttaagtatgtatggctttagcattcactttacttgactacatgagactttgtggctacgtgaattttccaggaagataatagcaatgagctaaatttcaagagctgaagatcctaactctgactaattgcacctctaattttgggacggtctttccagcaatgcaaatcttaatgcaaatgcaaatcttaatgcaaatgcaaatgtctaagtttcaaaagccatgatctcgaacaagaatgttagatataggccaatgtagataaagaacaaaattacattcacaattagccaacaataaaatccttcccatttcactcagaccctgaaataaagcaacatatgggcgagaaagataaaatgccacctaccttgcctcaagttcccagaaagtggtgtcatcggacagccatgggttagaagggtcaggtggcaaaagaaacgggtcgtattctaaatactgttccgtgtaacttagtagactaaggagaaaaaacatttccagtttctttagttttctgactggggttgcagccagtccaaagcagggaaaacaatataaaaatgtgggaccaaggaatccttgttcacttaaagcatgaaatccaatggcaatcttcacgcttcagtaactttcatgcaacaacttattgtgcttcttggcagacaactgtggctaaagattccatctctacccatgcctaagccatgtaaatcagtatcccttggttaacatgaagcactatggaagaggtcagtgtgtgaagggcaccgctaagagtcagttccaatctttggttaatcagtccacccacagcagaacagattttatacaactgagagaagggcttaaaagggaaattttgtcaaaagtatttacaggaattaagtaaaatgggagccactgacaagttttttaaatgtatataaaaattttaaaaagggagaagggaaagaagttggggaggtaggatttggcaatgcccaaaagtgaagaatatgaatggcattaagaacagatttaaatgaagcaaaggaaaatatctgaaatttgagtttcattcatattctgaagtcaggcaggaacagtgtcaattgtcattgttaaaataagtttatagagaggctccagtttgcccaaaggtcatcaataaatggaaagtttcatgtcttccagcaggagtgaaaaggctagactctgcagaattatcctctatatctgattcttagtggaacaaggactggatgtctagacatttaagacaattataatcattctgtcatttaaactacatcaaaagagttctttgaaagtttttctatgtgcaaaaaggaaaacaaaatcacattacttacaggattccaattatctgtcccaactcctgtccccacagttctctttcatttttaaacacatgtaattgtcatatgaaattttaaaatttatacagacactttgaaatactcacctgtcagcgacttttgacatttttaaccgatgtctatctaactgtatttgccaatattttatctgaaaagagggttagagaaggagttacataagtaatgacattttcacaattttccactctaaatcatgatcagctgggcaattctgaacaagagtatagtctacgtcagtacaatttcaaagttggttaaaaaaatagaagcagagggctcttaaagagttaacaaaatgaaatgttggaatttgaacacaattgatatcactttagaagagcaatgagtttgaccattctgcctactttaacaaaatgtgattttattttaaaattgtagagattttgctgggtgcagtggctcatgcctgtaatcctagcactttgggaggtcaaggtgggtggatcacttgagcccaggaattcgagaccagcctggccaacatagtgagaccctgtctgtaaaaaaatatatacaaaaagtagccaggtgtagtggtgcaggtactatagtcccagctactctgggggctgaggcaggaggatcacctgggactctgaagcagaggttgcagtgagctgagatcacaccactgcactccagcctgggtgacagaacaagattctgtctcaaaaaaataaaaaataaaattgtagagattttaaacgttcattcatggtgaatacctaaatccagaatcatacttccctccaaatttagaaaataaatgtatttattactataatttcaaaataaatcctatctcctaataccaagaaagtatcaatgatatgtgttttgagaataattttatcaacaattcatgacaaatgctcacatggaataatcacacacagaaaactttaattaaaaacgctctgaatgacttttccttcctgattattgtaaatatactagaaaagtatattttacactcttgataaactatattataataaaatatcagaggaaaagagtcaaaatgagaataaagccccataactgaaccaatcatgagattatttgatttcagacactggagtttgctttgaaatattacttggagtcaacaccattgatcaaatgctaaaaaaaagaggtagtgtatagcatgactccatggctgtacgccagtggtgataagaaaaaacttcaagaggtagagagaaatcagcactgcagaaagcgagagtaagcactcttgtgaagaaaatgtcctatcattggatgtgggaagtgtgacaatgttctcaacctcttgtcctcttactctttaaaagagagctttggagtacaaagtaactattgatgatggagtcacttacaaatcagcatatgtgatttttacaattggttagaggaacaaggatttgggtaaataaagagtgaggggttttgaaaaccattaccatatattgatacattttcaagtaattacaatacttaaaattacaacattttattatcttttaactgcaaatcttccacatgaaacagtcagtcatacaaataacctataaaaatacccactattaacatttaccctctggttttcatagctgttactctgtaaacctttaacaggtcatctcataggttgactcacctgttgttgtaactcatcttctgttggaggtttagtttctggtgtgggtgtgtgggtaggactgtgacttctaatatcattttgtaaaccatagacagactatattaaaataaaaaataaacattttaggacaaaataccgtttacagtcacagactttctaaaaagtaactctagcataaattcagtaaggtctctcaaagcttatttgattaagcttcttaacaaaattcaaaaggcactgctaagataaaaatcaaatgcatataaaatagaagcacagctcggaaaaaatgtgtagttagattattaactttgacagaataattggttatatgtagagagcaaggtgcatgtgataaaatttgagagcaagctgggaataccaagttggagaatgtcaacactaactaacatttcataagcattgatttaagaaaatagagaggtggatgaagaatagaataggaatgcaataactcaaaagaagatttaaaaataactcgatattttacataggaattaaatggggcactgaggagagtgacaagtcaagaattctattgctgatttgatttctgatggtgcaatagaagacaccagggtactcctactctccatatcaacagtgggttatttacttcacaacactagccttgccattgggtgccatttgcaaacatcagtgaccccagaggcgtcatgcatcttcggaattctcaatacccttgtattttttaattaacttgtcaaaaggtcagacctactacttaggaagactcttttttgagaaaggcccattgcttagtaagtataaataaagatctggtgactaaagggataaaaaactatctgtaactgactatgagacatctcacgtgtcaactcaaggaagaagccaaattatttcttcttggatatcaaagtattattcctttaaaataaagaatttaatgtgtgttattgagcactttttctttggatatgagcaagaaggatgagggcataataaaactgcatgagctccacaaaattagtaccagataaagtttacaaagacacttttgaaattagatgaggttagatccagatgcctaatgatgccaattttcaggcccgtcaccaagcttgccaatatctctaaattcaatgtgtttttattcctgaactgctttcacttggaccttaaatccacttaacactacgtcttgactctgtatctgtcttgactctgtatctgcaccttttggatgtggttttgcccttgtgtctcccgccctccgtcctttttatttttatttttttgagacagagtctcattctgtcattcaggctggagtgcagtggcgtaatcttggctcaccgcaacctccgtctcctgggttcaagtgactctcttgcctcagcctcccaagtagctgagattacaggcacgtgccaccacacccggctaatttttgtatttttagtagagatggggtttcaccatgttggccaggctggtcttgaactcctgacctcaggcgacccatccgccttggcctcccaaaatgctgggattacaggcgtgagccaccgcgcctggcctccgtcctttttttggtgctcttatcctttctttatagattttaacttggacttaatcattggaataatctattcccagactatcttgggtaggcctcttcagtgtcctttcttgccctaccaccagaaccttggaacccaattcccatcactgaggatatccatttcttttttttctttttttataatgccaaacaagaggcaggaaatggccatccatttcaacacaaggatttgctcatatgctttgaatttactctgaacaggacggagctgaatgtcttaaactagcccttttatttcatttattttttcactcattcattcattcattcaacatttattgaacacttactatatactagatatagtactaagcattagggaaatacaaataaacaaaatagatgtgcttctttctgcactgggactcacaatccagtggaagggaaagaagttacacaggtaattacacaaataaacatatgactaaaaaagggagcagtattatgaaacaaaaaagaataacaagcatagggcctggaatataaagtgatttaatttacactgaaggaatggaaatggcccaaactgatactagccatatttgaacatgattaaataaaacaaccttctgaattctgaaataacagtagaggttgatttcttaaaaattatgtgttatatacataatggaacactattcagcctttatagaacaagaaattctgtcatttgcaataacatggatgagcctagaggacattatgtttagtgaaatatgctaggcagagaggtctttaccatagaattacacttatatgtggaatataaaaaagctaaagtagagagtagagtgacagttaccagaggctgggatagggggtgaggaaaagaaagctcttggtcaacgggtacaaagttagttagttaggaggaataagctctggtgttctattggacagcaaggtgactattgttaataataatgtattccatatttcaaagtaactaaaagagaggattttaaatgttcttgccacaaaaaggataaatatttgaggtgacgaatatgttgattactctgatttgttcattccatggtatatatgtttattgaatattacccgataaatatgtgcaattattatttgtcaattaaaattaggcaacagaaagatcaccaattatataatagttctacctttcagtatctgctagtttttcaactgtatcaccttaatttttgagaagaaaaataaaaagactctgagacttgaagtttccattcttttttaacttggtttaattatttaaagtttttaaataataatctacaggtcatataaacagtgcttataaaaaatagctgatggttttaacagtaagtttttaggcgaagattaaaaaaataacataaaagactgctagaaaaacacagcaatttgtggtatcatgaaagtaaaatgatctataagttatcttttatctctacatttctataatgatttcaacatttatgcatttcctgtaaacttcatagaggtccgatacgaggccgggcgtggtggctcatgcctgtaatcccagtactttgggaggctgaggcaggcatatcatgagatcaggagatagaaaccactctggccaacatggtgaaaccccatctctactgaaaatacaaaattagccaggcatggcggcatgtgcctgtggtcccagctacttgggaggctgaggcaggagaatcacgtggacccaggaggcagaggctgcagtgagccaagatcgcaccattgcattccagtctggcaacagagtgagactccatctccacaaaaaaaacaaaacaaaaacacaaaggtcccataagagaccatgacccaaaccattgggaggtgttgcttaaaacatcttccaggagcctggctacttgctctgaagttactgcagagtttccatttcttgtcttacgtaaaagtcaacatcaggaagtctccctttcaccaatctgagtactgttcatttcctggggatagtgatagcgtttaactttgattgttggctacaatgaaaacagccgagaagaatataattttacatatggggattattttatggacaaaggaggcaaagagattaatcctattttggcagacaaattatgaaaattatttgcaatgtaaaaggctttgcatgttttagaaaaaaaatgtattcaaatcgtggtacagggtggggtggcatagaactagaaacaggtaaggttagagaggaagagaaataaaatctcttaatgtcttaatatttgcagctggggaaaatcaaattaactaattgagatccatttttagttttaatagcaagatcatttatttgcaatgctttggcttgattaacacgttcctttattcctatggtgctaagacaagcactttttcatatgcagtgccatctatttattcattaaataaaatagattcggcctcctacataaatctgttcatgtgtgatttcccttgacattttagaagagaactagaaaaattatcccgtttttttttttaggcagggggtgggggtttgctatggtctgaatgtttgtgtctctccaaaattcttatgttgaaatcctcaacccctaatgtgatggtattaaaaggtggggactttgggaggtgactaggtatgagggtgaagcccttgtgaatgggattagtgcccttataaagaggcctgagggagctcgtttgccgattccacgatgtgaggacacagcgagaaggcaccatctttgaagcacagagtgagctcgcgaaagatattaaatctgctggtgccttgatcttggacttctcagactccagaattgtgagcaatacatttctgttgtttataaattacccagtctaagatattttgtcacagcaactcaaacagaccaagaactaagtcagagacagtaaaatagaaaccacaaagtacaagaagcctttctgtgtttctatgtgaaatgtaatctctggggcttttctgactgactggtgtggtagtatttctctttctttcacggttgctcagctgagctagagaacagattgtgaccatatctgacacaatatggaggaagtcagtacacagaaagaagcagagagaaggcaaccagagagagaaatcatgagagagctgggtcgactcacacctctgggcaagcttgaccactgcctgccacaaggtttcagaccatgaatcagaaaagtcccctcttggccgggtgtggtggctcatgtctgtaatcccagcacttagggaggctgaagcaagtggatcacctgaggtcaggagttcgagaccagtctaggcaacatggtgaaaccccatctctactaaaaatacaaaatgagcagggtgtggtggcacatgcctgtagtcccagctacttgggaggctgagacaggagaatcacttgaacctgcgaggcagaggctgcagtgagccgagatcccgccactgcaccccagcctgggcaagacagagtgagactccatttcaaaaaaagaaaactcccctctttattcattttcatttgagcagtttctattgcctgcacctttactataccctttacttgacacacttttgtgttgttctaagacaagagtagtttattctgttcagtaacacattaaaatttaaatgtacacatgctgtatatggagttgaagacatgtccatattttatgcagaaacagctagaaccactggattattaatagcaggaaaaccagacagctaattatacatttgctgttgtttttctaggatgtgcacattagcttttcactgatgctgttaactgtaatatttagtgccatgatgtccaaatgaaggtgacagaggaaaaagagaacaggataggaaatagcttactgttattttgaaatatgggtgctaagttacaggagggagcccaaagtgtgggtccaatcacacatacatgcagatgctcttatcatttccctcaggttttgtgacctaggacccctctagctattgtcctacagaaggatacagcctgtggtggtgaattttgtgtcaacttggctggctcatagtactcagatatgtggacaaacattactgtggatgtttctttgatggtgtttattggatgggattaacatttaaatcaatggactttgagtaaagcagtttgcccttcacaatgcgggtgggcctcatccaatcagttgaagtccttaatagaacaaaggctgacctcccctgagcaagaagggattctgtctccagactgccttttttgttgttgtttgttgttttgaagaacaaggatatttactcttaaaaaagaagcgctgtcccacaaaaagatgtacagatttgaaaaacacttattttactgtattaaaaaacaacaacaacagaaaaacaggcaggggatgtctagatggcagaattgaagcagctctgtacgaaaatgaagatggtacgatgatgtgacttcaaagaaaatgactaaaacaaaatttcacaaacatcttcacgtttctaataataatgcacaaaatatcaaaaatacaaagtctgggtttcttccctgtaggtttatgataaactattaaacttctatttaatgcatttactttcataagccttctttgtttagaagtacaagctatacaagtacatacatgctggtattttaccatgaaaatttcacttttcatctcaaactagtgatttgtcttcttacccatacttatatacatttcacttccatcataagacatgtaatacatttctagtggtacattttaatcaatatatattttttaaatattgatttttaaaagaatctttttagtgctatgatacgatggccttaatttaacagctgaagcatgatatggtaactacactgtactgtttaattttcagctgtaggaaaacatttgagttttaaaatataaccaagatgaggctggatagtaataaacaccgaaatactagaaaacagtgaacgaataaataatacattttttttcatcaggggctattcatcattttgtttttagaaacctggaagaaattgtcttgagtttcaaatgttctggtaaatctagtcgtttcttagcctcctcaatgtcacctggaattgctgaaataagtgagtctaaagaatcaaagttcttttctggtctgaggtagccaacaatggccacattggggatttccccatagaagtcctctttgaaggtatgcaggataagcgtgtccatggacttcttcgtattcttgtggtagagggtccatcctatgctcaccaccacctaaaggccatctccacttccgacactggcccaaccataataaatgccaatggatacatcaactggaagattagctactacttgttctggaaaattagctgcggagatgcccagcggcctggagccacggccgaagccccgcaccacttgggcccggcagaggcagggcagatgcctcacgttatagtccagtccgctcaggacacgggctgcggccgggtccgcgcgttctacggagccgccatcgacgcggtgcccggaccctggatcagcaaggggtggggtggggacatggccgtgagctctgcctgccgcgggggcgcaccaggggcctggcgacaagacgacacgccgcggtgggtccctgaggcaaccaacccaacaaaagcttcccggcgactcaagagctgtgtctccccagactgcctttggatttgaactgccactcttccctaggtctccagcctggtggcctcccccatgagattttgaactcgccaagcctcagtaatcctgggagtcaatgccttaatataaatctctgtctctgtctctctcccccctcccgccccccactctgtctctggttcggtttctctggagaactctggctaatacagaatctattacagtaaaaattttagtatcggactcaagaacatcagaccgacagttccccttcaaacttacttagattaggctgatttctttctggctatgctacattatcattctttcacagatccttgagataatacatttttacctatttccttatattgtagtaaagtatattctaattaaaaagaaagacttgaaaatagactaattttagattcttaacatatctcaaatcatgcatacagcaaagccttcgcttcctatatttgataaacatgtcaaacattcaacaattagatacaacattcccaaatgaaatgtgaaatgattctgatattcttcaggcacctatgctagattgttactttagggatttactgggtcctttattcttgtcacggcacgtaattacaggaaaaattattatagctcactcccaaagaaatgaacagcagctctccttgctacgagcattatctgctttcaaagtttaagcatgttccatagcttccacttcctgagcagccacagtataaagatggaggccgaccacacagccaggaggaggcgctacagagacggctcaattatggcggaagggaagggtggcttccaggggcaactggctggcctctgccatttctgtctgtggtttgtgatctcacagcgtcacctgctccgcagatacagagctgtggacccctcagagggtggtgaaacagcttgctgattgctgtcaaggtattcactgacaaaatgcagtggcaatcacaagcacgaatcacgtacactccctttgtcatatgtcatggacggagttgtgtcccctcccctaaattcttatgttgcagccctatcccccaacatagctatatttggagatcaggcctgtgaagaggaaataaaggttaggtgggttatagggtgggaactaatacaatagaactggtgtccttttaagaagaggaagagaccccagagttggttgttttgttttgtttttctctctgtctctatgcacacacaggaaaagccactgaggacacgagaagaaggcagccatccccaagcaggaagagacactccacaggaactgaacttgccaccaccctgatctcgaacttctagtttccgtaactatgaggtaacaaattcctactgtttaaaccacctagtttgtggcattttgttaaggcggccccggcagactacatgaagcttaacaaaatcatatacttatatccatgtacagacatttatctccttgctcaacacctgcacccttatgagaccatgaattaggggagcaaggccctgactgtcccatttactgtggagtacctaaagcccaggacatgtctggcatagagtacagactccttaattttgctaattcagtggatcattacagttcctaaacaactatgagctaaagtatcagtggtgatacttctaaaaaatattagtatgtggcttggagtcggataaccttccatgtaaaataacattatcatctgcgaagattctagcaaattgaacacttctgactgtgagaagctacatttatcaaaaggtgagaaaaatccgttttctccaactgtggaaaataagggtatacctgttatttgctgtcagatttttcaggacttttgttttcttctggcaaatgttagcgctagacagctctggagtgaggccctgtcattctgttgttactgattcacaagaaattagatgttatcgagacaaagagagctagatctcaatgactctgtttctttacaatatttcaccttgcaatgcctcatgggcttttcatcattaaatgagggctgatggtatgtaaagaacgacattgtaaactaatgcttctcaagtgttcaaaaagaagggtgccatgtgaaacacgagaaagatgatctatactgaatatggtgccgaagagagagtataaatgatgactttattgtgtctaggtgctatcttgttaatccatatgcattctcttctgaatcacagcatgtctgtgttagggtctgttgggggaaacaggacacccaataaagtatttcgaagagtaatttcactattcagaaagtggagagaggtggcttaatgcactttttggagagccgatagcatttttgaatcttgttctgcaaaaatagttcttggtgccctcaggatgtgctgtgagcagaggatgaaagcaattaagttgggccagccaccagagagacagaccagacaggcttgctttggtctggcttcgcctctctcttggagagttcctacgggcagaagcatttgagcaccgcatccgaattggttttgtggtgctttgcttcagcttctttatcctaacatcaaggtaaactgccttaaaagaaagaaaaggtacttggaccatattggggcctttgaacatgatggtatgtttctagggatgggagaaaatggcaacacaaaataagactagaaaaaaatattgagtgcttactacagggacacagactctggaaaacacgatggctaacgaaatactaaggaaatggccacagaaaaaagaccttgaactttgtggaatgtattaatccagcagcaccaatctataagctgtgttctcaaagcgactgctacaggccagaaattcttgtgtacatcaagcgtgttttatagaatgaataaaaatgccttctagttgtacgtgttgctttaaaaaatatgtagaaactattgctgtgcattttcaaagggttatttaaaatgtcactggactcagaatagcttcccccacaccctgcacaccgatattctctcagataacaaacactgaaatacaaccactgtcttatggttgtatcacaaaattctagtgttaagaggggcccctgcactctttctggaattaaatatcttttagatgtccccctttcctcaggttttaaaatgcccttctctcatcagtatcaggttttctaaagatgatttccttagaaatcctgttcctctcgtctcagtcagtcatgaccaccgctctgtcttgggaccctggtgtgcttgagcattagggtggggctattcttgaggaagggagggctgtggaaggctgggaagagtgggaaagatactgcatgacatgagaagaaagtgtttttatggctgacgtcctgtaaacaatgcaatccatcaccaagatcagcacaacaaatgacagttttaccttccgtgttttgtgggggtttctcattctggatgacttcttaatgtccacttcagttgtatttacacatccaggctgggaatggaaaaacagagagacaaatgaatctttgggtgtgaaatttctgaccaggacaatcatgaatggctcgctctccagagcccgagcaaatgccccaatgacacaaatcaagggaggtgttttctagatggccacagccagtcccatcagcagtagccagtcataaaagacatgatacttcttaactcttcacacttaaaagccttcagatgctatcctcaaataactcccagagaaacaggaaaaagaaatactcggactgcacatgtgaaagtggtgtcaatacgtatagcgacaaacccgacagacagagtgagggcactcctggacaaagagataccccttgctggttttctgcagacagcctctcgcagagatctctctttataaaaagtgaggctgggccgggcgcagtgactcatgcctgtaatcccagcactttgggaagctgaggtgggtggatcacctgaggtaaggagttcgagaccagcctgaccaatatggtgaaaccctgtctctactaaaaatacaaaaaattagctgggcgtggtggcgggtgcctgtaatcccagatacttaggaggctgaggcaggagaatcacttgaacccgggaggtggaggttgcagtgagtcaagatcacaccattgcactccagcctgggcaacaagagcaaaactccattgcaaaaaaaaaaaaaaaaaaaaaaaacaggctgttattagatgggtgccttgcttttcccaggctggaagactaaaatggcatttagttgagccagctcacatcccagaatgaactgtcttacaaggattgtgaaacccagcaactaggaatccttgtttgccatagacagaatgtgcaatggagttcatggttaaaatgtgaaagatggagaaagaaactggtaaataagatgccatgcttcttctgataaattcctgaccttccttttccttaagggcaggtgaacccctttaaaacagaggggttgatgaagtataggcagcctgctgttagcttcctgacaacctcaggtgtctcatttgtcagatttattgttctgttgtacagaaacaaatagatgcaagctccttgtatatttggaggaggagaggggaggagggaggaagaagaggggaagggagagaacatgaatcacgaaacagagaagacaggagattcaaaaatacatagtagcttaaatgtagaaagggcttagacatcacacatcctttagaagtgatgagaagttaatggctacatggactgtgtttcctttacttttggtgcaggatttaacgatctctggtattagtaaaaaacatcggccaggtgcggtggctcacgcctgtaaccccagcactttgggaagccaaggtggatggatcatgaggtcaggagttcaagaccagcctggccaacatggtgaaaccccatctctactgaaaatacaaaaattagcaggacatggtggcaggcgcctgtagtcccagcttctctggaggctgaggcaggataatggcttgagcccaggaggtggaggttgcagtgagccaagattgcgccaatgcacgctagcctgggcaacaagagagaaactccatctcaaaacagacaaacaaacaaacaaaccatcaagttgcatgtctctgctcaatttctctatttcttcccacagactgcaagaaattaaagcattagatgtccttagaagtgactccagagaaactgtgaatacggaaaagtcttccgtggagttggggtggggttgggaagaaagggcaaaaaggcagagctgatgtgattggcagactcagctgttcactacagtaacgggaatcagttcattgtgtaatgaggacagaggacactttccttaaagaaccatctcctgctagtatagccattgggccaaaactccgccataatattataatagataaggaagtaaatgaggaaaacatttttttttgtagaatatgtatatactacagatacacacacacacactgtactacaaacattaaataaattatgagtttggtttgcatatctatttaggaatagaaatcactggttcagcacagtggtcagcttggcagtgtaggagggaggaagggcacccagctgggtgggactaatttcctaagtgacactgagcaattcactaaactctcccagcatctggttgctgagtatgtgatattgtggtttgatttttttttatggttggtctaagcatttgttttttaaaaagacccccggggattttaatctgcagccggagttcacaaccactgatgtaggtgtaacaaagacaaggtttttaaaacattaaaggatcgagttttcactttccattcgatttctatttctttgcagccttccatccctaagcctgagccataacggaagggaaggcagtaaaattctttaaactcctatcaacatatcaggagccaagcacagtgccaggtgcagtggcttatgcctgtaatctcagcatttggagaggctgaggtgggaggatcacttgctttgaggagtttgaggctgcagtgagctgtgactgagccaccacactccagcctgggtgatagggtgagattctgtctctctctgtctttctttttcttttttttaaagagccaagtatgataagatgtgtcatagagattttcttccatatgttaaggggtgggaaaaattaggatataatatccaggaaaaggaaagcatgtttcttcatgacctggaggcaaagaaagataaaggtaagatactgagctcagcaggtgtttcatttttctcctctgtggaagaaactcgaagaagaagaggtgatagggaggaataaaaagtcccagacaagtatgaggaagcctgtgaagtagtcagtcccattcccatagaagaagccccacatgcaatccgagccaacatgaattttatatcatatgggtgttagcaagaaagatgagcttaagaaaatgcttcccaagcctcttatgtggcagtcaagccatccggagtttcttgcatgccacagtagtaaaaggcacagaagatctaagaatagtgggtggatgggagcctgaagttgggacaaaggctgcagtgtgcagggattttatgctggaagcagatgtctgaaacacaaacttcagcagtgagttccaggtgatgagatggtacctgttgcaacatgcaaacctgtctatagcagaaatcgacaaggatctggaagatgttctgggggtgcttggccctctggccccactgcacaagactgtaaaaacaaaacctctagaccccaaactctcttccaaaccaatcctggatagcagcagagaaaggccgagaaaactgaaaatgtaatcatttatccacaaatgaccgagtcatctaaaccaactatttcaattatggtggcatgcagagcacatgcgttgaaacctacccttcaaataggtttctgagaaaactatgtcaattatagaaaataaagaaactgtattttctttatacatctgaggaagctgaactaatttgaactctaaactccttccataaagagctaggattccaaatcaattttacttcataccaggggtcataattaacaaatggccctggaaatcgtgtcaaccattgaaggcataaagtggaaagattcccctccccagaggaacatatctgactgtcagtcctgaaggaaattagaagtttcatcctcatatttaaaagatgatggccttttaaatttgattaatgaaccattagcttacatctgaaattcccacttgagccaattattaacaccactaatcagcaaattaataagaaagcattgattttaaaagtaaatgtcattagagactgaacggtaagatatgttttataacccggctcccatcccaggaaaatgaaatctgccagttcaaagtttgttactaatgactaaatggttaaaatagtaagctggatctgggatgcttgtctcggaggccctgtaatttctaatgaggcctcatgggacagctaatggttcaacagatctatgatatctaagtcaactaggaaattcttgaagattaaaaaagcttagaggcccaaagttgcctggaatacttctgaataattaaggtcatgacccagtgctgataacccctgaataactgctttcagaagtcatgcactgtggtaagtgaaatatggcaataatttttcttgaattctcttatgtattcaataaatatttctttctgcatctaattgtcggatcttgtgacaaatggtgagttacagaaatgaaggcacgagccctatcccagtaacttcctgatacaataaaaacgacagacacatgaataatcagaatatgggagcataatgactaagtggaagttggcacagagcattacatgacaacagaacattccagacatcctttttttttttttttttttcctgagacggagtttcactcttgttgcccaggctggagtgcaatggcgcaatctcggctcactgcaaccgctgcctcctgggttcaagtgattctcctgtctcagccttctgagtagctgggattacaggcgggtgccaccacacccagctaattttttgtatttttagtagagacaaggttttgccatgttggccaggctggtctcgaactcctgacctcaggtgatccacccgccttggcctcccgaagtgctggaattacaggcatgagtcactgtgcatggccaagacagacatccatttttatgcacagtctgttggttctcctcaacatggcaaacactattcctttaaaagttatttttaagcaatttttcaatctcgatgagaccatgttgtctttggttatttaaaaaaaagtcaatcatctttttgatgcatatataataggtaccactagctggcaccagaccttcgtgaaattcgtaaaattggtttctgcagagctaaacaaatctatcttcccaataagatataaataacattaccattaccaagtagacattccattaaaatcttcaaatatatactatttgctggatacagtattaagcacatagtattgttggatgtaaggaataatgaaatgctatttacatcagcctggaagagaattgtgttatttctagtgattcaaagatgaatttcttttcaaccgaactaagctgggttgcaacattattataacgttatttattataaagtaggatttaacattgtggaagccactcctgagggagtaaacggagcatatcattgagaaatactactgtcataacatttacgtgagtgtcctcatgaggtgcaaaagagaagctggagtttttggtttcattattgatattttaagtaaaagcatctaaatgccatttagttcctttcatgcgatagtacatttttgttagttatagcagaaggtacacttgtgttcaagacaactcggcaaagcctgtggtgaagagcgacagtgagagagaggaatacagaacagctgtgtttaagttccatcactgcagctgatgtgtacctgggagaacagtgtcctaaacgacaggtgagtggaggattagaaatgcaccatcaaatagagctgatagcaagacatcaagtacaccctagaaagttttaaaaaatcatgattctgggaaaattcaggtttcaaatatgcatagtccccccttatcctggggggatatgttttactactgcccacccccacaaaagagatgcctgaaaccacggatagtaccaaaccctatatatgctgtttttcttatatatacacatgcttatcataaagtttaacttataaattaggaacaataagaaattaacaacaataactaataataaaatagaaaacaacaataagtaataataaaataataaaatatgccagcctcactgcgcttgggctttggggtcattctgaagtaaagtaagggtgactcgaacacaagcactgcaataccaggacagtcgatctgataacctagaagactactaagtgcctaacaggtgggtaccacagacagcgtggatctgctggacaaaggggtgactcatgttccaggtggggcagaatgggatagacgagatttcatcatgctactcagaatggcacgaaattacaaacttatgcattgtttcttgaattttccatttaatatttttggactgcagttgactgtgggtaactgaaaccacagagtgcaaccatagataagggggagctactgtatttagatggtccctgacttactatggctcaacttaaaatttttcacccttactgtgagtttattagagtattaaatgcatttttgacttactatatttttggcttacagtggctttattgggacataaccccattgtaggtcaaggagcatctgtatatatattaattcaaatagaagtaaattaatgaaaaagagtcaccgctttgtaatacagtacaagttataaaaactgcatgcatgatccatagtaccccagtaagaatgatcccttattcttacatgaagtaattatagattttaaagtgttcacttacatgaagtaactatagattttaaagtgttcagtctcaggacttttttttttttggcccaggctggaatgcagtggtgcaatcacagctcactatagccttgacttcctgggctcaagcaatcctcttgtctcagcctcttgagtagctggtactacaggtgagtgccaccatgtctggctaatattttatttttaatttttagtagagacagggtcttgctccgttgcccaggctggtctccaactcctggcctcaagcagtcctcccatctcagcctcctaaagctctggtattacaggtgcgaagcactgtgcctagccaggattctttttttaaagatccaattcaagcttttcttcattttcttaggcagttgtcagttgattcagcctctgatcctttcagccctcctcctcccgacccatctacttactaagtcctacgcacaaactgaagaaagttgtttgaggaaattgctccaaatttcttccattcactcttctctatagtatttactcatttgattcctattaggcctcatttgctagctacagactcttgggtatgatatcttgcttcagtgtatgctgtgaatgaactccacacatccaagaggcagaaggaaacagaatcatacgaagtcagcctgaagctgtggaaagtgggcaggttgagtagaagtcacagaccatgataaggtggtaaggactttggtttaattctttatttttatttttaaggttttttttgtttgtttgttttgagatggagtctcgctccaccgcccagactggagtgcaggggcgtgacctcggctcactgcaagctccgcctcccgggttcacgccattctcctgcctcagcctcccgagtagctgggactacaggtgtccgccaccacgcccagctaatttttttgtatttttagtagagacggggtttcaccgtgttagccaggatggtctccatctcctgacctcgtgatccgcccgcctcggcctcccaaaatgctgagattacaggcttgagccaccgcgcccagcccgactttggcttaattctaaacataattggaagccactggagagttttaaacaggagagtgacttcatatgatttatttttcaaaactcattcagaccttacactccacacacacacacacacacacacacacacacacacacacaaactcaaaatgaatcataaacctaaatgtaaaatgctaaattataaaatttttagaaaataacaggagaacatctaggtgaccttgagttgggtgatgactttttagataccctatcgaaggcacaatccatgaaagaaataattggtaacttggatttcattaaaattaaaaacttctgttctgtgaaagatactgtcaagagaatgagaagacaggccacaaactggaaaaaaaataggcaaggttattatccaaaataagtaaagaactcttaaaacccaacaataagaagataccacaacccaattaacatatggacagatgatctgaacaggcacctcaccaaagaaaatatacagatggcaaatacatttatacaaagatgctccacatcgtatgtcattgggaaaacgcaaattgaaataacgagataccactacacacctattagaattgccaaaatccagaacgctgaaaacaccaattgctggcaagaatgtggagccacagagattctcattcattgccagtgggaatgcaaaatggttcagccactttgcaagacggtttggcagtttcttacaaaacactctaaccattcgatccagcaatcatcctcattggcatttacccaaattgagtcgaaaacttatgttcacaaaaaaacctgtacacggatgtttctagcagcttgttcttcataattgccgaaacttcaaagcaaccaagatgtcctttagtaggtgaatgtataaactgtggtacacccagacaatggaatattattcagcattaaaaagaaatgagccattaagccacaaaaagacaaggaggaaccttacgtgcgtattactaagtgaaagaagccaatctgaaaaagccacagattgtacgattccaatcatatgacattctggaaaaggcgaaacgatggagacaaatagttttgccttttccagatcagtggttgccaagggttgggaataaataggcccagcacggagaaattttagggtagtgaaactgtatgacactacaatagtgaatacatgtcattatacatttgtcaaaaccatagaatgtacaacatcaacagtgaactctaatgtaaactacagagtgcaggtgataatgatatatcagtgtcggttaatcgattacaacaaatgtaccgctctggtggggttgggggtggggggttgataatgggggcggctgtgggccggggagaggttgctggggaattcagtactttccacttaattttgctgtgaaccaaaactgctctaaaaaataaaattgattaaaaagcaaccaaacaaacaactcattcaagaatattgagcactttgagagtggattatcagggtgggaacagggcaaagcagaagcaaggggcccagtttgaaggttactgcaattattcaggcaagagattatggtgacgtgggtttgcctgccagcactagagatgatgtgaagtggttgcatctgggatgcattttgaagctataatcaacaaaacttgctgatgggttttgtctgtgggcatgctgaaggaaacagaatatcaaggatgactcccatgccatctgctgagatgggaaagcctgtgaaaagaagagaggaatccaaaatgatccctgggttgtatttacatacaatgtttgtatttgctgaagtctccaaagggaatgcaactctttatgcagtctctatgaagatcacgaatcagagcatttccaacacaaatgcctgtataatcatttgcccttggcctgtccttttgtgccattgcgtttttgcattatcactggtggtatgaacatatcattgaatctgcaacattaaaacatgatgatcaattcctgagaatttggtggagctgtctctcattactcagagtctctgctacactttcctaaattttctgtagtcctaccacattctattaatctgctctaattgaaatcagaccacttcagcctcacatctagcaactatctgtgcatccttcaatgacattccctttttatagactaggaattgccttgcaggtaccattctcaaagagcaaccaagaggactctaaccagtacatttgctatagcttctttgtggtcactgggattacccatgtttaatgttcagctttaaattacctaaaatgttcccagttagaactgctttgaaatttaaaaaatcactgggcagaagctaagttgtcataattatctttaaaataggggctcctgcaggaagaaacaaaaggcctgaggcaagtaagcgtggacactttcctgtgacacctggcctgctgtgcgcacatgagcgattgatgtccttccctttctatgattatttccctacaaaaagctggctgcagtgtgaggacatgcaaagagtttcaattggatgagaaaaaaagtctctcttagatttgagactgaacatgtgtgctccaacttgttctatatcctgggttggcatattgggtacttttatacccataattgaactggcattttgatttgcattatactgttcctctggtatttcactggtgggagggtgagtagcaacacagaattttaggattcctggtctgtgggcttaaatgggtcatcaaacaccttaaacatttttactttaacacttaacatgtttcttgaatgcagaaattaagacatgaaatctaggctatgtctctggtgacaacataaatttccccaatgtaaaggtaaggtgccaaaaagtaggaaaatgaactagctactgaactggagaaaacaatctttatttttttacacagtgctattgttagtactggtgacttacatggtatgctgtaaaggctaaagagaaccaaataaaatttcatatagcatcaataactcacagtaaattcaagggcttataataatttttacaacagatagcaatgggacaactaggaaataagtttgtgaaaatcatcacatattggaattaaccttgaattacaatagctgccttgaattcaatagctttgaatcacaaaggatatggggggctcctaaatcataagttcccaaatagaaaaggggtgcatctccctgtcttagtctcttcagacttctataacaaaataccataaaccaggtggcttataaacaatagacatttatttctcacggttctggaggctgggaagttcaagatcaaggcagtgaaagattttgtgttgggtgagggtcacttttcagttcatagaaggttccttcttgctgtttcctcacatggtggaaggcataatagttctctcttggcctcttctgtaagggcactaatcccattcaagaggaaagaaccttcatgacctaatcaccttccaaagatcttagctcctaataccaccaccttggaggttaggaattcaacacatgaatttggggaggacacaaatgttcagaccagagccctccctttacaggacacacatacagagaaaggccataacacatacctcggtttagcaaaatctctgtaaagaagattaatttcaaagatatactctgttgcattcaacttgatttccaaaaagagaaaaagatgtagtggtgttagaaaagagatttttacataaagttcttttctagatttcatatttattgctaagagccaaaattttattttcagtgctagggaaaaaaaatcttttaaaataattcccatgcatcctcgcattcttacttaatcatatccaaaacaacagagtctttcttgatgatttgaggtcgtgattatttgaggacaatgcttattttttattattttttttttttttgagacagagtcttgctctgtcgcccaggctggagtgcagtggcgccatctcggctcaccgcaagctccgcctcctaggttcacgccattctcctgcctcagcctcctaattagctttaggattacaggattaggattacaggctaattttttttgtatttttagtagagacggggtttcaccatgttggccaagatggtctccatctcctgacctcgtgatccgcctgccttggcctcccaaagtgctgggatgacaggcgtaagccactgtgcccggcctattttgctgtctttaagacagcaatgcctatgaggctagatgatcccaactcctaatgccttttgagcttttatgtgattttatgccatttttagttcctctgccttatcccagttagctgtcactttttgctgctctcagcatccttgactccagcgcatctcattattctctaattcgttgcttggttctgatgtggatcagaaaactatacaaatgctcctttgccacagggtctcacattttagcgaatgaaccgatcaaagcacacggttagagtgtgagagtttaaacagctacttcggttaagactttttgagtttatttcttggctgagttttggatagaattagacttgaagatatgagaggtaagaaaaagtctcaaaactgtaacaaataaaatgtggacaagttctcatgatatatttaggaaaacttatcagtacatacatatcatagaagccaattaaagggggtcagaagtagatgacatcaaacatttatctggagttctaagaaagaggatggcatactgagagctagaaatttgttctgtgctccgaggggtggggagaaaagttaactgaggtgaagggcagcattcttgggttgcatctccccagatcctgagtgaacaatgatgcactctcttgtctacacccagattcttttggaaaaagcctgccagattcattgctaattttggtttagtttcccaaaaaggataaagtgtccaagccagaactctcagtttctctcccctcctacctattcttttcttggttttctgcctttcagtgagtgcctccaaccatccatcaagagactcaagccatcaccaaggaggcatcactaagccctcttttccccttacttcccacacttgattcatcagcgcatcatgcaaactttacctccaaatacaccccgaacctactggcttccctccaccctcactgttaccaccctgctccaagctgccatgatctcccatctggactatcacaacagccttcttatttgttctaattcctctcttgctttgtcctccctttccccaagttattctccacacagtagccagagtcacctttttaaactacagcgacatcacatcggtctcctcgtcaaacctccaaagggctctcgtcatgctcaggataaaaggcaaacaccttgccatgctctacgaggtgttacacttttcttttcttttttttttttgagatggagtctcgctccattgcccagggtggagtgcaatagcatgaactcagctcactgcaacttccgcctcctgggttcaagcgattctcctgcctcagcctcccgagtagctgggactacaggcatgcgccaccatgccagctaatttttgtagttttagtagagagacagggtttcaccatgttggccaggctggtcttgaactcctgacctcatcatccacccaccttggctgcacaaagtgctgggatttcaggcgtgacccactgcgcccggcctcactggccttctttgtgtaccaggcccttttctctgtactagatgctacttctttctccaaatactatgtagtccctctcgatcacatcaccttgcttttatttttatcatatcacttacctccacctggagggtttttgcacattacacttgtttgttttctctgtctttcaccactgaggggtaaattcctcaaatacagggacttcctatgtcttgtttagtatctgtcactggagtctgaaatttcctggtacctagtaggtgctcaatgaatgtttattgaatgaatgaatgtgaaagactttttgaacatacccatctattaaaaatacaaaatgagttttattttctgtttgcttgtgtgtatgtgtgtgtgtgtgcatttgtgtgtgcttgagaatgttggtacctataacttaacctcttggccgactgatcatcacctctcattattatcatacatttatttaacaggaaacaaatactccaattcttcagttagccttaaaagaaacatttctagtgcagaaaaatttagctcaaatgttcttttcctgtgcaatgtgattagcccatcagttgataagtgtaaatagcagattgcttccagatttgatgggggttaagtagttaaaaagcaggaagacactgggaacttacaaagcctcagttttagagaagtcaagatgagaatagagcaggcctctctgtccctgcctttataactttgtttaaagcggttcccatcttgacctacaaatatccaaggacaaacaaaatctgtgcccctatgcatttctttacccgggtgtgcaatggcacagcggagttcagacaacacaactgagccatattatacaaccagcacatctccactgggctgtattatggagctgaagattaaaaccccatatgagaaaaacctggattcaagatataaactaagaaaagataaagctaataacgcctcttctattgtgcagtactttgacatttttcaactataaccatcatctaatatgagtttcataagcattctctaaactatatagattagtcactatgaacctaattttcactgaagcatatcaaagattcaaaccttggaagagaatataaatattatctggtctaacttagcatccaattcatgatttcttctggcaacttctacgacaagagtcattcaaccttagctcgaatgcttgttgcctcctttcccctaaaatacctccatctgcatcacacttgaaagaaaatttttgaataagtcatttatttaaaggaccatgccacttttaaaacatgttaataatcatacctaaaaaagacaaataacatgatgacaaactagttaagattcttggaaaagtagaaacttctttaagccttggtgtctcttctttcagagcgagtgcaataaaaattgttccaacctcctcagtgtatgaaatactgcacgtaaaaggggtcagcacagttcttgacacacagaatatgcaaagcacatattagtttcccttagtattagtattattagcagtataatttgacatcaataaaataatcccatagaagcaagggactggttcttctatgatttcagattatgtttgtcaggaatttttttttttttttttgagacagagtctcactctgtcacccaggctggagtgcagtggcaagatcttggctcactgcaacccccgcctcccggtttcaagcgattctcatgcctcagcctcccgagtagctgggattacaggcatgcatcaccatgcccagctaatttttatatttttagtagagaccaccatgttggtcaggttggtctcaaactcctgacctcaggtgatccacctgccttggcctcccaaagtgctgggattacaggtgtgagccactgcgcctggctgtttgtcagtatttgaggaagttgcttatgaaagtaaacaagttgaactatactgaatggaggaaaagcaaaaagctaataaattttagtaattttaggccaaatatcagatttaatttttaaaaaggtaagcattttggggggggaataaatatagggtaagtgtggaggcaagagtgtaaaactcagttcacttcaaagttcttctgatatatcaagccagaccaatacgttggagttgcatttcctttctttctttcttccttccttccttccttcctttttctttctttctttcttttttggagttccattttcttaatggcagttttctttttttcttttttctttttctcataaggggtaactgctaacatttgaaaatatgtggccaagcgtggtggctcatgcctgtgatctcagcactttgggaggcctaggcgggtggatcacctgaggtcaggagttctagaccagcctggccaatatggtgaaaccccatctctactaaaaaaatacaaaaattagctaggcatggtggcgggtgcctttaatcccagctacttgggaggctgaggcaggagaattgcttgaacccaggaggcagaggttgcagtgagctgagatcatgccgctgcactccagcctcgggcacaagagcgaaactctatctcaaaaaaataaaataaaaataaaaataaaaaaagaaagagaaagaaagaaaaagaaagaagaaagaaagaatgaacatatgtaaggacaaatatctttttttcttttttctttttttttgggacagggtcttgctctgttgcccaggctgcaatgcagtggtgtgatctcagctcactgtaacttcaatttcctaggctcaggtgattctcctgcctcagcctcctaagtagctgagactacaggtgtgtatcaccatggctggctgatttttgtattttttgtagggatgaggttttgctatgttgcccaggctggtcttcaactcctgacctcaagtgatcctcctgccttggcctcccaaggtgtcaggattacaggcatgagccactatgcccggcctgacacatatctttatgttgagttttctcttaatgaaatgtaatttgttttgaaaaaatccagttattgattgtgaggaggtatatgcaattattgtgagggaaatagcagagctgaggagaaatctagagttttttgtatttgagagaggatttgctatcttttaaattaatccagattgcttttaattttaatttaattgtctttctcaggaaagagaaaattcatttgaagaagatagctgatgtcctattaagggaagacagcctatcttttctttctttcttttttaaaaatacaatttgtgcatctggggaaaagcaaatgaacagggaaaaaaaacaagctcaaataatgactgctctctgtgaaatcagagtccatgctggtcccgtcagggttctggcagactgagcccatgttgttagctcagccagcccctcaaagcctgtgtgcacgtgcatgcctgagtgtgtttgtacacattttaaatcttagtttcgctttgatatgatttcaaacctacaaggattgcaagagtggtttaaagaactcccatagactctttacccaggttctcctattgttaacatttggccccattttctccccttccttgtctatatttaaactactggcaaacagaaattcagctatagtaggaatggcccaagaggctggcttctcaatagagtatcagggttagatgctccccttccctccccgacacctgcccagacacccacaactatgcaagataccatcagtacttgagatcaatactatcctctatccacttccctgagagttagctgttggctcttaagaccttcctgctatcatcaccccaacccctatccacatcctcatcatttcagaagaaacaggacagaaatctgggctcatgattttgaaaagtcgccaatccacaagggataaaagcaccaacttaataataggggaagcagtttttattctcattctacccatggctcacataaatagcatcagatattacataataataggacactgtatctacaaatctattcagggatagaaagagcagacagaagatgaaagatatagccaggaagcaaaaaagaacagtttcactcatagcggcttgtgatagccagattgtcaaaatatttttcaatccaaaggaacagatgggaataatagacagaaatgctgttccattttcagagcacaaaagaaatatttaaatttggatgaacacattttggattttctaaaacagctcaaggtatcagtaatgagatcatggactattgataggaaagacagcatcatgagtatgggctgatttgaacttaagaacaaaaagcttgcacagttcctattgatttcaacctaatttgtttctcatgaacaccacaaaactgacaatgccaaagattaaaataggtatgtaactgatatcttccaagggaaatattagggaaaatattagggttctcctacagcttaagctccagatgagcacatgaaattatgcatgtggattgcacatcagttacaaaattaaaaagcaacctccctgaaatctatagaatactatacctgctggctcaaacccagaggtagacatgaacatttctaagggatatttatacctgttgcatttacttgacacaatccatgctgtgactcctttccagcagcctagcatggctgataatatgtagccgcctctcagagatgttgggacaatggacatatactgccctttgcctcagagttcaagtagacatgcaaggtgcaatagaccatttaatacataaaaaactcaattaatcatttcactaataagaaataaaaactagttaacatgcacaaagccggtcctggtgcgatataatatcctgctgtgtcttatgaattgacaaagtttgcatcctatgcaatagagatcacatggggttttggagaaaatgctaggttttcagtcatcattagggatttgactcttaaccatatcaaaaccaacaaaacccaactcttcagagtcttgctttctcttatttgttaattaaggaaaatagttacccaccccacgaagtcattgtaaagaataagtggtatgataaatctaaaaggcttttgccaccagaaactgctacacaggcaatcaatgttattgtcatcgatagtaatccacatgcattattgttctcttacattttgtagaaagaaatccaggtggcatgcatttaacatgtgttttagagtaatgtatcctgaagagagaagtagctcgaacagtaaaagggacaatgctggaaattgacaagcttctcgataactgacaaagtcctgttgcctcatctctggccactgctgccttggttggttcaaatattggagccccgtggaaaagaaaaatctgtgtgcttttgaaactaagtcagtatgtatttaatgtcatccaaaaggatgtagataggatgagggaaatcaagaattattaatttattcatgaattcaaaatctatccattgagtgtctgctgtgttcctggtacttgactgaggcctaaatacagagtcagggacaagtgaagcctagtctctgtcttcttatggggaacagttactacctcatatttaccatgtcattcccagtataaaaatcattcataaaaagtactttcatgttcatctcaaaagtttttttccttaatattatgaaagagatgatttgctctgcttaaatattgtggaagttaacctaaaatataagtgagtggtgagagacattctttagtttaggagggagatttggcaaagaactcatgcgccacagctgtgaggagtatacaggattatccccttattcccctcttgatctagggctttgttctcttcctcctgcttacaggttactgtaaggtggttccagcagcatctgcataggtcaccctcttcactgggaagggtttcattcatgctagggcttaacctagttttattttttccaccaccctttccaaattctattttcccagattctactgtggtgagtaccctccataacagtccctattgacctccttctgctggtattctcactctgtgtggtcccctcccacactgcaccagggttggtttgtgtaaccaataaactatgacagaagagatgacataccacttatgagattaggatatacaaacatgaggttttgacatggggctatctttctattttgggatgacatggcggaaactgtcttggacatccttatggagaggtgcatgtggccaggaactgaagctgcctgcaaaccaccatgtgaatgaagtgaaccatcagccccttcagatgaccatagccttggccaacagcttgactgatgcctcatgaaagaacctgagcctgcatcaccaggaaaaccactcctggattcctgactctcagtagctgtgtaaaatagtgaatatttgttgttttattccgctaaattttgggataatttgttatacggcaatagataactaatatacttaaccttcaaacttcaactccaactcttctgatccccaaaagtatttttcctgattataccagttcatagctatctgctaacctttttacccacctcctcatctccttttaaaagcatgattgctaaaataacttcagctaccaattactgaacaagggttgtgtgccaggtactgtcctaagcaatgtacaaatattatttccatgtgttctcaagggtcgtgtagggtaagtatttatttttcccatttcaaatgagaagtttgagacttggaggcatttagtaaaatctcactcaagaaggaagttggtgtttgagccaaatctttttagctgcagttgcatcccttgaacactacatcacataaaactgtcatagctgtgtgagttatcttgaagtctttgtatctgaggcagggaaaatataaatggagagagcctaagcacagtggcaggagtgggaagagaagtgagaatttttatgtaatccatcattcgggcatttagctcttgacacaatgttgccctccccaacttctgtctcactggatatctttagattaaagaaataacataaattttgcatgagacttttcgaaatcatggaagagtatgccaaaaatccataacattaccattctttatagtcaggtttttattatagaaatcaataagaagcctagtacacgccaatttcacctttgaatatgcatgtcaaaattctaaatcaacatacaaacaaaatccaatatcacattaagaaaataacacgacatgaccaagtagggtttatttattctgggatttcaaggatcactcaacattagaacatctattcatagaattcacatattactaacagatataaggacaaaaatgtataaaaagctttagaaaatagttttatcaatcatttctacttgtaaaaacaaatacactaaaataggggttcttattcaggggttctgcaagatcaaaattatttccataaagatcggaagccatcactgccttgttctcagaaatatacagtagattttcccagatattgtgatgacatgtatatagcaaaggaattgaatggagaaagagataggtgaatggagctgccttctagtaagcttatgattaaagtgatttgcaaaagtataaaacagttccactcttcctgctaattttcctttggaaaatgtgccaatttttcattaaaattacactgattattttattaagtgattggtgtcctattgttatcttacatgaaaaaataaatatttaaacagtccttggttttactgttgagtctgataaatgctaatagataaaacttgtataagcaaagacacttcaggacacacaataatttttaggagtgaaaaggaataataagaccaaaaaataataagaccattttcaaattttcagaatttgaaaatgatagctgtgtaagatacaaatgtaaggtccagtttcttaattctatacatagttcctttataaaagatacagcagaaaaggaaatctcatttataacgagaggtttttttttttaagaaagaaacctaacaagaaatgcatgagacatgcacaagaaaaatctaagatgctcctgaataacacagaagttggtaagaacaaatgcttaggatgactcagcttcagaaaaaaactcaattctcccaagttttctataaatgtataacatttgaatgccaaaaagggttcttttctggtgctagacaattgattccaaagatcacatagcaaaataactaggaaaaacctaaaatgaagagcaacaagtaaaaggtgtattgggattgagagggtctagacttatgagacataaaacactaaaatccaaacagtgatgggcagaatgtgatatctccaacccagatgatgccttttaaccattttgttgcctgtgtaaggaactcatcatccatttcctagtacaggcctcgctagcatatttcaatgataattccctaagtcttccctcctttctttcatcctaattttttccagaataattctatcatgtggtgtgagatttccagagaggtgtatctcttaaacagatctattctactttgcctttaattacatgtttcattcaacaagttacccccttcgtttttcttggtttattgtaagttctaccttactcatcctaatggctttcctctgtgatctgttatgttaacctcagggcctggctttgagcagcatcctgagttagtggaaggaatcctgagctgcaattcagaacacctggattcattcctggctcctctcaaagaaaaagaagtcctgggggaaataaaacaaaactcagtctctctacacttcagtttccttatttatgaaatgaggacaaaattaatgccaactgatatggtttagatatttgtctcctccaaatctcatgttgaaagggaatccccagtgttggaggtggggtctggtgggaggtgtttggatcatgggggtggatccctcatgaatggcttagcaccctccccttggtgatgagtaagttcccgagagatctggttgtttaaaagtgtgtggtgcctcccctcctctctcttgctcctgctctcactgtgtgatgtgcctgctcaccccttcgccttccactctgattgtaagctacctgaggcctcaccagacgcagatactggagccatgctgccacagcctgtagaacgatgagccaattaaacctcttttctttataaagtatccagtttcatgtattcctttatagcaatgcaagaatggtcgaacacaccaacctaacagagtaatgtgaaattaagaagaaagtttatatatgatcacattccgcacccgtactggatttaccaagaggcaggaaggtgttgtgataaagagtatgggtcctgggaccagaacacctgccttcagtaacagcttcctcatttagtacttgtggaactttgcacaacttaaatgtcccatgtctgagattccttatctgtaaagagaaaagataacagtaaaggcatatctcattttattgtgctctgatttattgttcttcacaaatattgtgggtttttgtttttgttttgttctttttgcagattgaaggtttgtgacaaccctgtgtccagcaagtttactggtgccatttttccaatagcatgtgcttgcttgctttgtatccttgagtcagattttggcaattctagtaatatttcagaccttttcattattatcgtatctgccatggtgacctgtgatcagtgatgcttgatgttattgtcgtgatcgttttgggatgccacaggccatttcccatttaagatggcaaacctaattgataaatattgtgtgtgatctgactgctgcatcttccactcttcaggcttccctattttctgagctacaacaatatcaacatcaggccaataataaccctacaatgacttctaagtgttcaagtgaaaggaagagtcccaagtctctcaatttaagcaaaaaactagaaaatattaagcttagtgagggaaagcatgttggaagctgagataggatgagagctaagacttttgagccaaacagccaagttgtgaatgcaaagaaaaagttcttcaaaagcacttgaaaagtgctactctagtgaacacacaaatgataagaaagcaaaacagccttactgttgataggaagaggtttgagtggtctacatagaagaccaaagcagccaaaacattcccttaaaccaaaccctaatctacagcaaggccctaagtcatcaattctatgaagactgaaagaaataaggaagctgaagaaaaaaagttggaaactagcagaggttggttcatgaagtttaagaaaaggagccatctccataacataaaagtgcaagatggaagcagcaagtgttgatggagaagctgcagcaagttatccagatctagctaagatagttgattttcgatgtagacaaaagagctttctacaggaagaagatgccatctaagactttcatagctagacaggagaagtcagtgccaggcttcaaagcttggaaggacaggctgactctcttgttatcaggtaatgatgctggtgattgtaagttgaggctaatgttcattgatcattccgaaaattctagggcccataagaattatgctaaatctactgtgcctgtgttctacaaatgaaacaacaaatcctggatgacagcagatctgtttacatcgtcatttactgaatatttaaagcccagtgttgagacctactgctcagagaaaaggattcctttcaaaatatacccactcactgacaatgcacctggtcacccaagagctctgatggagatgtacaaggagataatgttgttttcatacctgctaacacaacatttaatctgtagtcaatggatgaaagagtaattttgactttcaagtcttattacttaagaaatgcatttgtaaggctacagctattgtagatgatcagattcctctgatggaatggggcaaagtaaattgacaactttctgcaaaggggtcatcattctagataccattaggaacatttatgattcatgggaggagtcaaaatcttaacattaacaggagtttggaagaagttgatcccagcccttagggatgattaagggattcaagagtttggaagaagtaatcgcagatgtggtggaaatagcgagagaactagaattagaagtggagcctacagatttgactgaattgttgaacctcatgataaaactcgaacaaagggggagttgcttcttatggagcaaataaagttgtttcttaagatgaaatctacttccggtgaagatggtgtgaacattgttgaaataacaacaaagaatttagaatattatataaacttagttgataaaacgaggacagggtttgaaaggatgtattccaattttcaaagaagttctactgcgggtaaaatgctatcaagcagcatcacatgttacagagaaatcttttgcaaaaaaaagagtcaattgatgtggcaaactttattgttgttttattttaagaagttgctacagcttctccaacctttagcaaccaccgcccagatcagtcagcagctatcagcactgaggcaagatctcccacaaacaaaaaggttacaacttttgctaaaggctcagatgattgttatcatttttcagtaataaagtatgtttaaattaaggtatgtgcattgttttttagacataatgctattgcacacttaatagactacagtatagtgtaaacataacttttatatgcactaggaaaccaaaaaatgtgtgtgatttactttattgtgatatttgctttatttctgtcatctggaatttaaccccaaatatctccaaggtatgcctctactacctgtagttgttgtgattattatatggtaatttatataaagtaccaggaataaaacctggtacctggtgaatgttctctaggcactaataaactaactgttattatctactgcccatctttttccccaacttgatgaagacagaggtattgattctccaatgttgcctctgctctgtggaaaagaacttcagggacccaagaatatagaacctcaccctttcctctcacaatcaaaggtaagtaagagccaaacaagacaaaaaggaaattatcaacataaacattactttcccctggctctaaggcacacaagcagcaactcaagctaagggattcctgggggttttgtgttgctctaagtggcacttttctgaacagtgaaacttgatgaaggaaaagaccaattttaagtcatctggatcacaaccaacattgtctgtgattacccttgtcagtgtgtgttaagaactggtggtgaaatatcaagtattaatgaaggttgctaagtaaccacacaattacataaatcttttcaagtgcatttttgagtatttttaaataatgaggtaaaatgtaggacatcatatgaataactaaggtaatgcaaccacatgcatgtttaaagagatttctaggcctgattttcttagaaaaaaataagtatagtatttcccagggaaaatattgtctgtcttggagaatgtatcagttgcaatcacttctcttaaagtagtaaataaagaatagttttatcagaaacgactacaggggaatacagacatttttagaggaattgcttcttcaagataaccaagcatgttagcaacatgaaataattatagcaaaaattatattatttacattatgataacactctctcaacgacagcgtaagatacaacttcttggtccagattaatacgaaagctacattcccaacatttgagataatgaagccaatgatgggaatcatttgaaaatttaacaacactcctcacagtaacaatagtcagaagaacagacaatatcacttgcaaaaattggttcaatctgtgaactgataaaaggcagcagtcattcattacatgtactaccagatttcaaagcatgttctggccgggcgcagtgactcacgcctgaaaccccagcactttgggaggccgaggcgggctgatcacgagggcaggaggagaccatacgggctaacacggtgaaaccccgtctctactaaaaatacaaaaaattagccgggcgtggtgcgggcacctgtagtcccagctactcaggaggctgaggcaggagaatggcgtgaacccgggaggcggagcttgcagtgagccgagatcaggccactgcactccagcctgggcgacagagcaagactccgtctcaaaaaaaaaaaaaaaaaaaaaaaaaaaagcatgttcttcattttagaaatggcaaatatatgaaaatccatgctgattacgaaacatacaaaaaacattcaggaatgttctcttgggaacacttctggaaccccctttctggagctatttaagagaaatgtcacatatacatttttgaggctgaacaaagataataattgatagagacaatttagatgattgctttcactgtgtgacaatcacaccctggtcttaaataccacatcactggctaaaagagaatcaggcattaattgcacgtgcaagatcacggactttgatcatgggaaaagacggtctaccaaggagcaagcttcactcttgataatacaactggaatttaaatctcaaactttttttctcccctcttggtcatctattcccagtttgcttaatgtcatacaaatctgtaatgtatccaatttaaaaatttgaattcagaaaaaagcgttatgcaccatctctttttattaaattggctggaatatgatgctctcaaatttcaatccgagttcctttactcaataacactccaatttcaccctctcctaatgcaaagcactgaatagtaggggagaagatccaagtaatgactcaggaaaggagacgctacgcctcgtctggacttttcagacggcagagatctccctgccatgtgatgccatccactggacaattagaaggatgaaaacagttttcattcagacaaaatctgcctccttttatccaaagcaaagcaggctaatcttactcctttttccaatgacagctgcttaaatacttgaagacagatgagtaacagcatctaacttctctgccttaagcttaatttttcatgtcctctcacttactttagtacttcacatcccctccccggcctacacgggttgttctgttcactctgctcaaaagatgggcagagtttctacatgttgtcccctaagtatgcagtgcttgggatgggataccatacactctgtgtgttctgactatttccaggcatggcagaagcatgcctaccttcatctcggacgttacaggccaaacaggaggatttaaggatactttatccacaatttttcagagtataaatgtgacatctctttatagaaaattaaaattgcctatgatatcaaatatcccagaatagttacaatcaatattcagtatattgtctcttaactgtttctctaggtatctatttttataaacaaaattgggatcatattacatataacctttttttggatggtagaatcattgcaaacaatataatatttatttattcactcgtttatttaacaagcgcgtccatagattacacatgctgttgcattccagcctgggcgacagagtgagaccatgtctcaaaaaaaaaaaaaaaaaaaggagaaacaaagaagaaaaggaagaaattatctaaatttcttatccaatttcttatatttagataatttcttatatttagataatgtcttccttttcttctttgtttcttcctttttttttgagacatggtctcactgtgtcgcccaggctggaatgcaacggcatggtcacggctcactgtggccttgacctcccgggctcgagtgattttatttcacatttcagcatagtttttctccacatctttccaagtctttaaaattctcattttgagttatacaatatactgtcttgtggatatatcttatttaaccaccccggtaagttgaatagctatgcgatttcaaatgttagctaccctatgtttaaccactctaattttattgtatagctctggacaagttaatctacttgtgaaaaagattttatctttttaattcatattgtcaaattaatttttatacagataataccaatgcacacacccaccatagcatttagaaacacttgtctttctattgctcttgccaggattgcatacaattaatttgaaattttaaaataaaatatattgaaaaaaattgtcatctctttgtcttaatttatgactagaaaggttaaactcttttcccaatttttaatagccatttatatattttcttttatacatggtcagtttaagccctttatctagtttatgtgaaatcatgatatttctgaattgtttaattattttatacattcagaatatcaaaatttatttatcttgctccaagtattttcagattatctctatgcctttcaattatatttttaaacacaaaatcaagtttttaataaaatgtattagcccgcttattttgtgatttattctgctgtctttatgcgtgaaaagttctctagatcctaacattagctcaacgtaaacctctgtttcaaaacagctatattcatagctctactatagatctcattatagtatttgcataataattattcatttacacccccgttctacttattctggactctgagtatctcagtcactggggcagtatttttcatcctcttctctttagcctttagtgtgggaaactataaatgttggttgaaagacatactaaatgaatgaatcaactgtgtaatgcacagatttttttcagtgaaaatcaaagaaatgtaccactttacttctcttattcctttttttcttgccaaactattgtatgaatagtatagttagaaaaatgtattccacaggaataacgatattttatcatatacttgtttgtttaaagtacacaattaatatacaatcatgcctcagaacaacatgtggggtgtccatacaaccgtggtgcaactaatccttcaaaagataattttgaatttttagcattctctgaagaaatattttgcatgtatcaattctcatccaggagaaatcaatggcaggatttctcacaataatcataaggagaaaaatatttctcttatgattagtgtgatttttcagagaaaaaatatctgagtcatttttgtgggactctgcttctttttaaatcacattgatcatgtcaagaatgaatctaccaaataagacaaacaaagccaagcacactgagtaaagtagagaaccaatacatgggctttgtattttacttcaaggtcttgtctatatggcatacaaagacacacagtggaacaaccatcagcttttctatataggtggacctgatgttaggcaagtaaaattcactttatctgctgatatcaccacatgacgctgttttgttcttgtggtcggatattttgttgagttcattatactctcctatgatgtgccctctgtttcactttgtaaaaaagttatatctctatttttttttgttatgtcatggactttatttttgagtagtttaggtttacagaaaattgagtacagagaacagagaattcccgtatgtcccctcatcccaccccaaagtcccctgtattattaacatcttatattgatgtggtacattgtttcagttgttgagccaatattgatacattaatagtaattaaagtccagagcttgcattggggttcactcttggtgctacatacactgtataggctgtgataaatgtataacaatatgtatccaccattaaggtatcttacaaaatattttcactgtcctaaaaatctgtgctcttcctcttcatcatccctgctttcccttcaacccttcatctttttcctgtctctgtggttttgccttttccacaatgtcatagagttggaatcatatgataactggccttctaagactggtttctttcatttgtacgatgcatttaaagtccttccatgtctttttgtggcttgatagctcatcccattctatcattgaaaaacattctgatatggtttggctgtgtccctgcccaaatctcatctgaattgtagttcccgtaatccccatgtgttgtgggagggacctggtgggaggtaattgaatcatgggggtggttacccccacgttgttctcatgatagtgagtgagttctcaggagatctgacggttttataaggggcttctcccgctttgttctgcccttctccgtgctaccaccatgtgaacaaggacatgtttgcttccccttctgccatgattgtaagtttcctgagacctccccaaccatgctgaactgagtcaattaaacctgtttcttttataaattacccagtcttgggtatgtctttattagcagcatgagaatgaactaatacaccttccattgtatgaatataccatagttattttttgaaggacatcttgattgtttccatggtttggcaattatgaataaagttgccataaacatttgtaggtttttgtgtgaacagaactttcctattcatttgggtaaatacgaaggagtgggaatgctatattgtatagtaacaattcatttagttttataggaaactcccaaattgtctttcaaagtagctgtaccattttgcatttccaccagcagagaatgagagttcctgatgttccacatcctcaccagcattggatgttgctagtgttttggattttagtcatgctaataggtgtgcagtggtatgcaattgttgttttaatttagccctaatgacgtgatgttgagcatctttttgccctctgtgtatgttttttggtgcagtgtctgttcagatcctttgtccatttttaattggctgttttattactattgttgagttttaagagttatttgtatattttgaataccagtccaaaatatcagttgttttgctaatattgtcccagtctgtggcttgaattctcataacatcttttatagagtaaaagattttaattttaatgaagtctaattcattagtctttataatatggatatatgatttttttctttttagcctgtagaagtaatcaattatatcaattgattttcaaatgttgaaccagtcttgaatacctggaataattcccacttcactgtggtgtaaaattcttcttgtacaacgctggacatgatatcctaatattttgttgaggatttttgcatctttgttcatgagagacattggtgtgtagttttccttccttgcaatgactttgtttgctttgggtattggggtaatgctagcctcatagaatgagttaggaggtagccactctgctattttctggaaaagattgtaaagaattgatataatttgtccctctttgctagaattcatcagtgaacccatctgggctggtgcttcctgtcttagaaggttattaattattgattcaatttcttcatttaatttactgttttttaaatttttgagacagggtcttgctgtgttgcccagactggtcttgaacaactgggctcaactgatcctcctgtctcggcctcccaaagtgctgggattacaggcatgagccatcactcctggcctaatttctttaattgaataggttaatctttaataatagatgttaagatgtaggccttctcattaatatatataggcccatatatattatctattttcttggtaagttttagtacattgtgtttttctttctttctttcctgttttttttttttttttttcttttggtccatttcatctaggccttcaaatttctgggcatagagttgtttagaatatttcattattatgcttttagtgtcacagaatcagtagatatagacccttttatatttctgatattagtaatttgtgtcttctccctttattccttagttaacctggctagaggattattgactttactggttttttccaaaaaaagttttgattttattgattttctctatattctcttgccattctcattgatacctgctttaatttttatcatttcttctcttctacttactttggatttaacttgttctcctattcctagtttccaaatgtggaagtttagattactaattttagatctttctttcttctagtacatgtactcaatgctataaatttctctctaagcactgctttcactggatcctaaaaattttgataaagcatatttttattttaagctagtttgaaatatttttatatttctcttgagactgcttctatgacccatgtgttatttagaagtgtgttgtttaatctactagtattttgagatattctagctgttctgatttctagttttatatcattttggtctgagaacatactttgtgtgatttctattctaaatttgttaaggtgtgttttttgacacagagtgcaatctcttctagtgagtgctccatggaagcttgagaagaacgtgtattctgctgctgttgtattaagtattctatagatgtcagttagatccagttgattgacggtgaacttcagttaaaccttgttcttagttccttactgattttctgcctgcttgaactgtaaattactgatagaggggtattacagtctcaaaataaaatagcgtatttatccatttctccttgtacttctttcagtgtttgcctcatactttgatgttctgttgttaaatgcatagacatcaaatattattatgtctttatgaagaattgatctttttatcattatgtaatattcctctttatctctgataattttccttgctctgatgttggctttgtctgaaattaatctagctactccagctttcttttgatcactgttaacatttaacttcatattttaatggatttgtacacacacaggcacacacacgcttgcttcgccaggctattctatacaaatttatttgaagaaaaatagatacgtagggacatttatgggactacaggcaagatagaagaaagacaagagaccttccaaatgaataacaaatcctctttcactctctatgccttcctctaacaaactgaccttgtatcagggtttaactattacctttagcttaatgagtttcagaatcaattctatatcccaaaacatccctcaaattttggtctcatgtctacaactattgacaagatctcgctccatctgaatgtcatgtcatcacactcagcatgccctaaaacaaactcactgttccaaatctgctacgaacccttagcaaaatcctttgtaaatttcatatgtccaccattttctcaactactcagactcaatattttgcattaagttgtatgctacaaaatgttaggtttaggatagggaattgaagacagactttctgctcttcaagagatcatggtctgacagatgttaaaacaagtgatctggtcagggtcaacgaaaatgctacaaaatgctgattatatattggttttaaaaagcataaataaatcaactattctcactactttgtgattaggatttgcttaaattgaagtcaggaagaattcaatgattattgtttctatattgaacattctgatgaagtacatttccatttctctgcttaagcatttttatccgtgacgtctttgttgaatgcttggcatgcattcaaccctaaactaatagactggggaagcaaagaaggtgatctaattcttattgcttcagtgctggaaagaactctaaaattatgaatctcattttctatccagtgattgccttttctccattctgtttctggctcatgacttctaatctacttgaatttatcatttgcatcattagaagttggcaatgacctttagatagctttgagtattaggaagcttttatattgatattttattttccagtcattttcatagtagtcatacagaacccaatgtgtggtaaaccaataaactttattccaactctgtttaataacatttcaaaataggaagacactttccatgggaattctcattcctagggtcactaatcttattaataatttcacaatttttttttgttcttgcttttttttagtttgcctccttaccgtccatccattcacctcttaactccagctcatccacattctttttaaagtatggtgcagaggattgggcacaaaatgctaaaattgagtttcttcagcactttgacaagtagaagtttcactgcaatttagctagatgttaaaatcctgttaatacaagctactaacgcattattctttgtgtgtgtatatgtgtggggcttcattaaattattgaaacattaaatacacaagtcaacccaaatactatattatctttgtcatcctacaatttggtgtatttctcccactatattcttcagtagttagtttctggcaattctgtctggagtccttagtaagttaagagtcctttttagtgttatgaccttaatttttttttctggagtaaatgttgacatacttaggaggctaactttattttatagagatattaagtactagaatgattattctgtgtcaatccgacctaaaagtgacctcatggttttttgaaaggtaaaaaatcatattatgtatattttctacactctaggtaaaatgcacataatatatcatattttacattaaattgactttaagtatattttaaagattctgaactgttatttcaaatttccctttcctcactacatttctggctaatggcttccaatccattcttgaggttggaataataaatgctcgtgtcaaatcggatcaaataaaagtattcaaaaggcaaggtagcatatcacctttacttgaattaaaagctttagaaggatcaggtgttacctggtttttttttattgaaaggtgtaatagcagaactgtgaaagggaaaacaaaatgaaaaacattcaacaaaaatgctgttaggataactccatttctggcttttgaaaataaagatactttatatatttatgaaggcaaatcgattcaggaaaatataatgacataacttaaaagtctttcagttagatcgtgtcacagatctgtgatatttaagctttttattctaatgggaatatcaatctcaagacttttaaaattgatagtgattgcttcatagtttttcaattaaccttctgaaaaaccataacaaaaataagaccctactttcttatctctttttttttacgaataatttctgtaaactaaatatgtgtgtgtgtgtgtgtgtgtgtgtgtgtgtttgtgtgtgtattttagagacagggtttcactctgctacctaggctggagtgcagtggcatgatatagctcactgcaacctcgaactcctggccgcaaggaatcctcttagcctcagcctcctgagtagctaggattataggcatgcaccatcatacctggctaatgttttgtagagatggaatctcactatgtcgcccaggcttaaatatagtttatatattttaaaaattttaggccgggcacggtggctcatgcctataatcccagcactttgggaggctgaggcgggaggatcacttgaggcctggagtttgagaccagcctggccaacatggtgaaaccccgtctctactaaaaatacaaaaaattagctgggcgtggtggcatgcgcctgtaattccagccattcaggaggctgaggcaggagaattgcttgaaccggggaggtggaggttgcagtgaggtaagatcgcaccactgcactccagcctgggcgacaacgtgagattctgttttaaaaaacataaataaataaaaataaaaatgtagatcctttttgaaataataacgtatgtaggttgttacacaatattatcatatctaaatattgaagataggacttatcaggcagccctgttggcaatagccctctagggtgtatattgtataaacatccctggcaggggtattctacacatgttagttggattcccctaggtcaggggtgtgtggtctataatatatgaaaaatgccctgaactctggacttttaaaaacagcaaaaggatatgtgaaaaccgttttaaaataccattttaaaatacaacaagacacctataaatacagctattttttcaaaagcaaaaggacatatgaaaaccatgagtaaaatataataagacacctataaatacagctatatcctctgcggactattgcattctatttattctttctttttgcaggatagatacataaagtcaggatctcattcttgctggagctacttacctgcctggacccacaccaccccctagttccaggcctggctctcccaccgctagctctgaacctgagtacgtcctataaacaacatgagcatctgtatctcccttcagaaaacaaatggtgcagtcatactcatcctgctgtgttaatgactatgttcataaaatgcgacactggactacgagttttaggaatcaaggagtgtgttttagtccactctttatgactggccttagtataatatctggcacatactgatatagaataaaaggtatcattacatgatacctttctatattatatccacatgtatcccatgatccatgttccatattatggaagggtggcaacgccctgtttcacgagtttcagattcaacttttgaaggaaacatgttttagtcattgcattggcagatggctccaggacttacatatttaaataacaaaaatgttggggataaaagtattccccaaacagttcaaaaagtttcataggtgggtaaaggaaccatccctttgaagaggaaagtcaacagtctgacttatttcaggtaaacaggttgataaagacaaagaaaggctgctttgttctaagtcttgcgttcctgcacctagaggacagatcccacattccagaataaaggcttaaataaaaatgcaagcatacaggaaataaaagagttcaaaaataaagggtactaagagagaggggtcatagattagcattaacaccatggtgaccacatcagccttaagtcaaggtcagactatttcatgcaagttatccctaaatggaagagtggaatgataaggctggaggaaaaaagagatggctatgggagtggtcttcagagttattctggttgggacctcagaactgaagacaaaggttgtgatgctccttgattgtcctctgtgagattcatagatgtcattaaaaccatgaagtacaggagctgcatttgcattatctgtttccatattccattttttttttgctttttcctttttttttgctactctctgtttcttttcacgaagaaagctgaaaatttattgtctttcacctgtcaagtgagatgctaaagtgatctgctagctgcttttacccatataatctcatttaatgttcaactaacactgcaaggtaggtagatatatttccattttataagtaagactgctgaatcttagaaagggcaaatcactgtgcaaggtgggcctcgtaaataatggactcatgtctatctgattccaaagcccacctgcttcccactctgccccaggtctccctattcccttttttactggttgttggctgacataataaaaactggaagtgtacacaataggacagtctcttagatatggacatcttctggtgaggggcggtatgcaatatcaggccccaggccataccagattaagcctctggacagtttgagatactctctggtattttcctacacgtggtctgggattctacgttgctcaggaggcaataatttggtgttaacatggaagacctagcttcctagcttcacagatcctgtctagaagacacttaaattttacagtgaatactacaaggtacaaagagtctttcattacagccacagtcaggacagactatgaagaagaaactgagctatagaaatacctattcactttaactctgggatataggatttagggtctaaatatattaggattgattatgacaactgcagaattcatttctagggacaaatgtaaaagtgtagacattcttagaaattatcacaatattgctgttttcccctatgccactttttcttgagggggcctagttaccttagaaagttcttgtcattgcttagctaacactacagccagcaaatagagatagagcttatgtgtttggctgagaaaataacataggagctctcttaggagaacctttctgttaatgtccctgtcatcatcatctttgtctattaactcacagtaaggacccaaaagactaaaaacaagataaacaccagtacctgtatggcagacacagcctttggacaagtgtcagcatttcgcaagtgcctgagatcacttcaaaatgtttaaatttttaaaatgccaagagggattacctctaaagtaatacaggaagttataatgttaagaaaaagaaatggttgaaggtaggattggttttaggcgaacgccattctcagaggctcatgacaacccgaagctctattttcctctagaaaataagggatgatggccgggcgcggttgctcacgcctgtaatcccagcactttgggaggctgaggcgcgtggatcacgaggtcaggagatcgagatcatccttgctaacacggtgaaaccccgtctctactaaaaatacaaaaaattagccaggcatggcggtgggcacctgtagtcccagctactcaggaggctgaggcaggagaatggcctgaacccgggaggcggagcttgcagtgagctgagattgagccactgcactccagcctgggcaacagagcgagactccgtctcaaaaaaaaaaaaaaaaagttcaacaagggagatggagccagtggcttctgggtggtttctgcctccagatcctccttgggatgactttctagttggaagcctagtgaaggatgtggtggaggcctcttggataacactcatatgtgctccttgctggtgggagacacgaaagactagcgcccgacttgcactggatagagggaaagacaactttgatcagattctgcctccaacagaggcacacaaagggctaaggcaatggagcaggggagtgtttgaggtgggatcatgtgtcatctctgtgagcatgagagtctcagagcatgaaatagacgtgggcagtgcaggggagctggcatggtgtgagtccttttgggttgccaggaggatccaggtcatggaagctaaacgaggctagagatgagccaccagatgtccaggggacaaagtggataagcacaggaacataacacattgactggtttctagaggttgcttaaaacaaacaaaaaaaataaaaatcctacttaatgtccttgcaatagctatgcacctgacctcataatcctttttcttcatgaacaataaaactcacactgaattttcagtagcaaagccagttaattctcagttgattctctttgaatctttccagaattcaaaagagagaacaaattcaatatagcatttaacaattacattgctatctgaagctgaaatatgtacatatataaacaaacctttggagactttctattttggtctgactctgaaggtagttgggagaaaattgtaaggtattcttatcaatcttgatttgtctttcatgctatgaacctattatttattctaataatacttatataaatattattctctactgccttgtctgtatttaaataaatctacagaagaaaatgatacagcatcaaaatagaaggaaatatacgaggttgtcttatagttgctggtaaccactgtttaatttcatccataaagttttctggtattaattaaggatattcattaatattactctgaggcacgtagtttaacattaataaggaagaaagccagctaagttattagagatccaatgttatgtcattaaaagtgtgagctgatttgaatttgagccacaggaaatgaaagtctgtgaaagtcaacaaccaaagcaggctactaataggttttaagaaagaaaatcaggctgggcacggtggctcatgcctgcaatcccagaactttgggaggctgaggcagacagactgcttgagctccggagttcaagaccagcctgggcaccatggcaaaactccatctctatcaaaaatacaaaaaattagccaggcttggtggcacatgcctgttgtcccagatacttgggaggctgaggtgggaggacggcttgaactgggaggcagaggttacagtgagccaagatcatgccactgtactccagcctgggccacagagccagatcccataaaaaaagagagagagagaaagaaagaaaagaaaagaagagaaaagaaagaaagaaagaaagaaaagaagagaaaagaaagaaagaaaaagaaagaaaagaaaaagaaagaaaagaaaaggaaagaaagaaagaaagaaagaaagaaagaaagaaagaaaggacggagggagggaaggacgaaggaaggaaggaaggaacgaaggaacgaagggagggaaggaaaatcagggcaggaataacacttgtactatgaagccagaaaaatgtaaacaataaaacatgaaaaactgttttgttgcagtagtttttctttcaaatgtatacagaagcatcagataccttcaaatagcaagagagtaagcaagcgatatcatggtgggaaaatgcatggttttataaattaaatacgatgctattgaggtctagtcatcctacacaaaagtggtgatcttttcttaatgaattcaccaagataccatggagcgtgcatggggtcactacagtctttcacttactttggcagggcacccctcacttcccacagacggagaagatggattcaagacgagagtgcgacgcttgcttaccacgggcctgtgcacgtcccagaacgctctctcttggctgtcaaggatcttcctttcaatcttgtctctcttcttgtccactctgtcaacacagtaacaatagataacatttagtattaattgtagtgcctctctgaacaaaaaggccacaactggaacaaatcttccaaacgactcacaaggactcactttgcttgtgcttctgcttgcatgaaaatgaactcccacttccgggcaaatgctctctgcagcctggccaggctctcctgaaaaacataccccaggtgaagacatttggtgttcattgtcactgctctcttctagcttagttaccacttgtatttgtcaaggaaacaaatagagagtttctaaagccctaagtgtactgtggttctcaatgataagtcatgctccctgaattcagctcatcttcatattggcagtcttaaaggaagcagaaaaacctgttacaaatatcgattttttgaattactgactttggagaacaggactacaaacccaatatgtatctgaaaaatactaaaattacctagtacataaggaggtgctcagatgaacccactggatttttcggtacccactttatagaggaacagaacatcagtacattcctactacgcatgcaatcagcctattcagttcctgacaatacatggcacaccctggcggcccacaacctattcctacacagtgctttgaattcagaaaatctaacatagcaaccatctgcacaaatgacagcagatgacttttatctgctgaagatcactgtcagcagagacaattttggcaaaacccactctttcccagggtaaatggtctttaatcctcagagtttggatatcttcactatgtaggatgtatctgacatttcgacagttaagtcgattttagaaaataagatatgcttcccttttatactttgagtttatgtatttagagttttgccatatgcaatgtgaatgaagagaggaagtaagcaaacagggattcatgcacccactgtgatgccagatccctagaaatctgacccttcagatccatgaatgaggctgggcgtggtggctcgtgcctgtaatcccaacactttaggaggctgaggcgggtagatcacctgaggtcaggagttcaagaccagcctggccaacatgacgaaacccagtctctactaaaaatacaaaaattatctgggcgtggtggtgcacgcctataatcccagctactccagaggctgaagcaggagaatcacttgaacctgggaggcagaggttgcagtgagccaagatcgtgccactgcactctagcctgggtgacaagagtgaaactccatctcaaaaaaaagaaaaagatccatgaatgaagagttaacatcctgcccagaaaaggctgtgggccttactgctgtgcattctatgactatctttgccagaaggtccttggtacttacagcctcatagtctgcgagctccagtcgtgccttgttttgcattgttctcttgcagaggtaaacggctgaaaaaaaaatcaatcatttcttgcctgcttatcaacaccatggcactataagtaaaagtacaacattacaaatcaagggcattgcacttttttcccaagttgtaatttttgatcattttcttagacaaaaaataattatgtaataacattattactgaaattcaagcatcatagtatttatgataccctaataaaataaatatgctaagaaacttggtaacttttttttttcagagatggtcttactctgtcaccctggctgaagcaagtgtagtggtaagatccttgttcactgcagccacacactcctaggctcaattgatcctttcgcctcagcctcccgagtagctgggactataggcgtgagccaccaagcctagctaattttatcgttattattattatttgtagagcagcttctcgctttgttgcccaggctggtcttgaactcctgggctcaagtgatccttccacctcggcctctcaaagtgctgagattataggcatgagacataatcatttaaaaatttttattaaatggtcatcacagtttttagcatcttcaacaaataagaggagaaaacaaaacctcctaaaagggtcaccaaatgaacttaaaaatctatatatccaaataaaatcattttgtgaaaaggaaattatgaattagtggcacattcaacgatgtccagattctactgtcaactgaaacaatctgttcatgtacactgaagacttcttgcatcttcttggcttcatttcacaagagccaatcttccatcgttttgtcactaggagaagggtatcacatcttacctaccttccacagtatttccattttcctgaggagtcgatggcctgggctaccatggaaagtccatctgggcagcagatttataggagaaggtggtgacagcagtgttgcaattgagcaaatttcttcaattatttcagggtattccagtgactctcatgacaaactcaaggcattcacagccctctggtagagtcccaattgccagaacatttttgtcattgtttttcactaaatatgcatgatatttgagtctcatgaaactcaagatacattgtatctgttctagatgctgagtaaatgcattggatgaggactgtcaaatattacttattgtaagtctacctctgtgagtttgccttggaaatatcacctttgcactacacttaccaccccaagttttggataacgacgtccagctggtatcactaaggaaacacactacacagaaaatttaagaccggtgcaaacaggaatactatttactcaatttctgtaaggtttcctgtatgaaagtcaagacgaaggagagagccaaccacagaatgatgctgacattcctacaaatgctaagaacccagtatatagtattagaacacatctttgtacaatctaccataataattttattgttctactaatattagtaatttttaaaagtcagacttcataaacaaaagtgacatgatgtgttcatttcctaattcatcataactgatgctcactcccgaaggatctcttactatagacgccactgtgacttgaataaaatatctaaaatgttctaagcagttgtaaaagaaattgaagcgtaagtgaaatacccctgagggtgtctcttcatgagagaaagatcaaattttcttaaatatctaattgaataatttcagctttcctgtggaattacctctgatgaaatttcaagccccagctatgccctccatcagtcacacctcctgtgtcctcctgcatcagcttctccttgctttattggttttgcccatctaatctttattatttgcaaaatcagctccctttggggaaatgtttctcaccattaggtaccctaatgccttaaagcaagagtgggatgattttattttttacatgactgctcacaaagacattatgtatcttgtaatacaggtgtcctatgatgtgatttttctttaattctctagggaaaaaaatgaaggtgcgggcagacagtgccaggcataaaatattggtatcacaaatatttgttgaatgagtgaattaacaaatgaatgaataggatatcttcagaaggagctatttcgaggtcaaatcaacttaagtgataaaatctccctaaatgtctacttgattctttggtataaagaaagacaggaagcagggcatggtggcttatttctgtggtcttagctacacttgggaggctgaggaaggaggatcatttgagactagtagtttgaggctgcagtgagctatgattgcaccactgcactccagactgggcaacagagcaagactctgtctcttaaaaaaataaaataaaataagaaagaaagaggcaaaaggtacaagtctgagttagcagtgtacagaataatctggtaactgttgaagatacagcaaatatgctcttgaccggataggcccagacctcatcagtctagtccagacacagttgctgtatgatgacaggtacagataatactttttattctttattagcagagagtatcagcattggtcaagatgtggatgaggcagaaggtccaagtagatcaaagatgattccaattcaggaaatttcccaattcattgaagactgacaaaatgaatgcactcatgcatagtcaaaactacagctcaggctgggcacattggctcatgcctgtaatcccagcaggttgggaggccgagatgggtggatcacaaggtcaggagttcaagaccagtgtggccaagatgctgaaacctcgtctctactaaaaatacaaaaaaattagccaagcatggtggcaggcgcctgtagtcccagctactggggaagctgagtcaggagaatcacatgaacccaggagacagaggttgcagtgagccaagatcatgccactgcactccagcctgggtgacagagcaagactccgtctaaaaaaaaacaaaaacaaaaacaaacaaacaaaaaacttcagctaaggcaaggtgcttttgtgccaatcctaattattttggcactgaacatgctctatatggtgctaggtatagacctaggcccagacccaaaagagtgaatcttttataacataaccccgaatatttcctgctgtgatgaaatattgaaaatatcaactaatgatgccatttttggggttctatttaaaatattttctattattaaagatgtaatttcaataccaagtttaaatatatctccctgcagtagttttctgggagatcatcaggagacaatttggaagacttgggaggtcaaacaagtaatttaacaggaggctatgccactaagtgggagaaagtttgggcaggcctgaagtgctactctggctaagaaagctccatagataaggcatagattttggcccaaatgcaacttagaacttagatggaaaagtcaaagtttctggatcccatctttgagtagaaacagaatagaaagtgagtgctgacgtcaggtcttcccctttaatttataaagctctagagaagctggagtggtctctcagacaacactgatgcccatgacaaaggtatgaaagcacatcacacaggtcagcgagaaaatcactaagaccccagtatcaaaatgtggaaagagtaggaatatatcattcaccaagactagaactacaaaagtccaataaatattttaaaattacccagcttacaacccaggtaatgcaaattaacttacattgtcatgctattcttttttttttctcttttaatgtttagtttgtggctaattcttctcttgttcctgaattttaaacagtcaggcagtttgtacaatcttccttctcatgcttgagtaattcaaagagtcccaagttatttgagagatgattgggtcatgaggatggaaccttccttaatgagattagtgcttttattaatagactcgaaggaggtggttcacccttctaccatgtggggacacagcaagacagtgccgactatgaaccagaaagtgggccctccccagacatcaaatcagttggcactttaatcctggacttctcaacctccagcattgtgagaaataaacgtttgctgtttataaacaaaacaaaacaaaagggtaccaagttattaatgagaatgttcatctcaagtaatgatcaaataatcatgcaaattgtgggtgagaagaagtgtgagtggcttctttctcccctccccaactcccttttgtgactctcaccaagaaccatgaactgaggcctctgatcctcctggggctggagtgtaggagaggaaaggggaagactgacatttttattacatttttcattggaatagaactttattatatttgatggagattttgaattttattgctgagataaaaaattaaatctggtatgtaacaaaaataaatatgtgcttcacaggagctttcctttattattttaacattaaaaatttttaaaatattttagttgataaatgagaaattgcatatatttatattgtgctacgtgatgttttaatataggttatacgctttgctatgactaaatcaagctaattaacatttccgtcacttcacattcttaccactttttgtgatgagaactttgaaaatctactctcggccgggtgcagtggatcatgcctgtaatctcagcagtttgggaggctgaggtgggcagatcacttgagctcaggagctcgagaccaacctggccaatatggtgaaaccctatctctactaaaaataccaaaatttagctgcgtgttgtggcgggtgcctgtaatctcagctactcgggaggctgaggcaggagaattgcttgaacccgggaggcgggggttgcagtgagctgagatcccaccattgcactccagcctgggtgacaagagcgaaactccatctcaaaacaaaaaacaaaaaacaaaaaacaaaaaactactctcttggcaattttcaagtattaatggtaactatcatcatcccgctatacaacagtcttccagaacttagtcctctaactgaaactttgcgctctttaaccaatatctgcccccactgcccccaggccctggtaatcaccattctactttttgcttctatgagataaacttttttcagattccacacgagtgacatcacgcagtatttgtgtttcagtgcctgacttatttcacttaacataatgtcctccaggcgcatcatgttgctgcaaatacaagattttttgtatttttaaaggctgaatagtatttcattgtgtatctatcccacattttctttacccattcgcctgttgctggacacttaggttgattctgtatcttggctattgtgaataatgttgtaatgaacgtggaagttcaggtatcacttccaaatactgattttattttctttgggtagatccccagaattggaattgctggatcctatggtagttctaggttcattatttgaggaacttctgtacagttttccataatggccgtactaatttacattcccaccagcaacagtgtatcagggttctcttttctccacattctccccaacgcttgttacctttcatcttttcaatcaaagccattcttacaagtgtgaggcaatatctcactgtggttctgatttgcatttccctgatgattagtgacggggaccaccttttcacatacctgttggccatttgtaggtcttcttttgaaaaatgtctatttaggtttcttgctcattatttaattggcttattcgtcttcctgcttcattgataccaccagggtgatctagcttgccactctctagacttggcaaaagtttaaagctccttatgatttttacggtacctttagcctctctctatgatgctgtttgcccctccagtctgccatgtaggacaggactgtctcacacagggtttagatgatgcctaagagaaacattcacacattttattttttgccttaatagaaggctgcagaacagagccacctccctttcaactcttccacccatagctagacagcctgcctcttgcccttcagaatcccatggcctacaagtctgtggcctattgtgttcccaggggtgcgtgactctcatctagcactctcagcagccccttgaagtctcttatcaggagtgagataaggcgcggtcacccctggctccatccactcagggctggtggaagcaatggctcccaacatcctatggattccagactcggtcttcaagacaatgccttgcccttagacccttgatgtgagcagaaagcaattactgggatcatgcatatgttagtggaacacagcccctttacacctgatcttgacccacttaacactttggctgggtttccatgttaacatcctgttacagaaaccattttccactcagcaaaacagcagagagtttaaaggggaataatccattctggcaaaagaagagtgaaagagagctgctggtgggcaaataaacaggggaaagtctccttggaaaggacgtgagagtgagtaataaagccttaaaacattcatggccataggctgggtgtagtggctcacacctgtaatcctagcattttgggagctgaggcaggcagattgcttgagctcaggagtttaagaccagcctggataacatggtgaaacccaatctctactaaaatacaaaaaattagctgggcttggtggtgcacacctgtaatcccagctccttgggaggctgaagcaggagaattgcttaaacccaggaggcagaggttgcagtgagccgagatcaggccactgcactccagcctgggcaacagttgaatgagactttgtttccaaaaaacccccaaaaaattcatggccataattctaggacttgcttttctaggactattacccaagggaataacaggaaagctagagggctaagaatacactatattaaatatggaaacacaaaggaaattgcaagaaaatcatgaatatctgttcaacaagatactagatcatcattcaaaatgatgtgtacaaattgttctacctaaaaagctgaaataacttgatttgtaaaacccttaattcctcctcattgtaaaagtccagaaaaatatataaagtaaaaaatatacagtaaatatatatgtctaaagtatttatatatttatatatgtaaagtatttatataaatatataaagtaaaatatatacagaaaaaatatataaagtaaaaaatcattataataccatttctgtcattatttggtatatagtttgattttcttttatatatacatctgctaatacacatatgaatatctgtttatatacaaaatctatatgcatatatttattttaagtgtgctcaaaactgtaccacacatgctgtattataaactttcttctttaatagtctgttgtggctaacttttcatatcaataagtgctggtctataatattttttaaaaaattatttcatggtaatccagtgctgagatgtaatgtaatttattttaatgagttcttattattggacatttgggtgatagctattattttgctattatatgctaacagttgtgtgaacatacacgcatgtatatatatgtgtctttatgtatgcatctttatttgtttttgaaattgccagtttcctgaaagggttattgctgagtcagggcccatgcacctttcaagacctgtgatctttataaccaaatttcagaaagtttagacatgagcatatatcagatgcttttcaactctggagagtctattttcagcaaagccatcagagttattctgttaagacataagtcagatagtcagtgtactcaaaaccctcccttttatctactacttcccatctcatctctctctaggaaaagccacagtccttactgccccattaagtgaccctctggatttatctcccattcaccttccaccctgcctgagcctcacaccagatgtcccctatgtcttctctcctttccgtctctggagagccctaccccagagctgaactgaattctctccagaatatcttcccccttctccaccaagcccctttcccagtttttctccacacaacttttcatgtcctaatgtacaacttatgcattcatttatgtagttaacttcttagtttttctccccctattcttcttccctccaccgacccaccagaatgtcacctccaccaggacagaggtttgcctattctgttcaccaatcaatccgcatggctagaagagtacctggcacatagtagatgctcaaaacatagttggggagtgaaaacatttgcctagtgttcattcgaggttttgtgttttcttttctttcttttcttttttctttcttttttttttttttttgctttgatgaattaactaattaactataatttgctgatttttctattgggtatttaacatttttaaattagacttaaggcccattaatacattagagataaaaactaatgttaggtatatatgaggaaatatgttttttccccaggttttgggggaaaagtttactaaacaatgcagaaaatattcagcatacttaagagaatactgatttggtgtatacacacacacacacagaggatcaacagtacatggtctgcaatctgctttttttcacttaaaataacattactgagatttacccaggctgttttcaatagatgtagcttatttcccttaactgctgtagtctatcctatgaatgtagctcacattgattagtcatatccctattactaaatacacaagttttttttctttttattttttcctttttctattacaaagaacaatccagtgaaagtttctctaagcatatattcctagaaatggtatcaaagggttgtggcgataggcacagtttgaattttatgacactgccaaaattgtcccataatacttgtccagtaatgtacaaatattcctaccttcattccagacttgaatttttgccaatccggcttgagagaggtgcattaaagtctaaccctttcagtagatttctgtgtctgttttcttgtatctccaacagttttcatatcacagattttaatttcaaaaatgtctacgaatcgattgtccccttcactaatgtggctcaatttaatactttttaccttggattattttttacttgaccaatattgcaagttcaaattttattttctacatgtatttgcctggtatatctttgcctcaccatttattttaaacgagtcagtgtgtcttacttctctttcctctggaaagatatttgtagattttatttaggatctaatctaaagatacttgttctttttacagatgaatttaaaaatccccattcatttttgaaagctgtttgtattccttttctcaagtcttcatcactctccctctctctgatggtatttcttttgttttctaccttttgttagatggagtgagttttctttcattcctacgtttataactggaaagtgacaaaacttgttaccactccgttagtggccatgctcatatctttgtacaaatgcttaaatatgtatttcttgaattttaatctcagaaactgaacactgcttattattgcttccctccataaatgatggagaaattagcatatcttcactccctccagtctttccaacttttttaattactagaatttatcataaactctgtcatagttttaaaaaataattatagcattcacattccattcagaaaatatttttatcacaattatttagattctgcagggcatgcagagaaagctggtgtcttggaaaattaaggctgaaaattttgtcttggaacagtggtttttttaaaaagtctatatttgctgaaattattttatcaaatctcagatgctccaaaattgggcacttcctatcttattttattattctatttgagacagggcctccctctgtcacccagactggagtgcagtggtacaaccattgttcaccatagccttgacctcctgggcttaagtaatcctcctgcctcagcctcctgaatagctgagactcacaggcacatgccaccatgcctggctaattttaaattttttgtagagatggggtctccccatattgcccaggttgatcttgaagtcccgggctccagcagttctcccgctctggcctcccacagtgctgggattcaggcgtgggccatcgctcctggccctgtgttaagttactcttatttctggtctttggagtttgcttgctcatttataagtgaggctgctacactggtgaagttcaaatagagactaatgctattaatcttgggtttcccatcacggctgttgaccagccactgcagcaatccttcaaggccactgcattgctctcctcccagtgtctcccctctaccctcgagcttgctccccagtgtctgagagagcctgtgctgctctataaactgaggtcacggacaaagctttctcctctggtgccacgctcatgcctaagaaaccttgctccaagatggggaaagcctttctgccctcccaggacccacttatttccagccctcatgcatcaatatggggaattcctactggggttggtcagaattccatccaatgctaatttctcgagaaagtctgacaccaccatgtcccttccatttggctaaattttattgattccagaaaaatgttaatttttcaaatgagtagtgtgtggtaccattctaatttccactctgtgctaataattccttttcctctggttttgctttctttttattctttgcaggaagagggagggaaaaattttggtaaacttctggaaagtatggtgtattagccaattgttacttgtaacatcaaccccaagactcaaatatattttgtaattatatttatgctgaatacacatatatttagaaccacagtgatttttggatttaaaaaaacacatactgcaattattcttattttcatgctaaagaaaaagataattatgttctttaaaaacagcattttcatggaatatgatgcagccataaaaaaggatgagttcatgtcctttgtagggacatggatgaagctggaaatcatcattctgagcaaactatcgcaaggtcagaaaaccaaacacagcatgttctcactcataggtgggaattgaacaatgagaacacttggacacagggaggggaacatcacacacggggggcctgtcgtggggtggggggctaggggaaggatagtattaggagaaatacctaatgtaaatgacgagttaatgggtgcagcaaaccaacatggcacatgtatacatatgaaacaaacctgcacgttgtgcacatgtaccctagaacttaaagtataataataaaaaaaagcagggttttcaaaataattcttcaaataaaggtattttaaatttactgttagtagagtactttaaaatctagcattaatttaaagatttagacattagcaatgcacttataagaatgaaaagttaaagaataatttggagaattttatttttaaaatttatgactcaacagcaactgaaacatttattaagtgcaagggaaattgaatcttaataaaaacaactagcaataatattataaaatttgtttttaattatttaattttctgatacatagtaataaagactgtgttgtcataaagtaagagtaagagttaactactatatgggatcatataccttgataaaagaagatttactaggataagaaaggtgtactatgaacgttgaatactggactataaaaatctttttttttttttgagagagagtcttgctctgtcacccaggctggagtgtcatagtggcatctcagctcactgttatctccacctccctggttcaagctattctccagcctcagcctcccgagtagctggaattacaggcatgcatagccaggcccagctaacttttgtgtttttagtagagatagggtttcaccatgttggccaggccggtcttgaacccctgagcacaagtgatccacccgccttggcctcccaaactgctgggattacaagcatgagccaccgtgcccggcctgtgcaaatctttaaataccctcctgggaggtggtgtccttaaggagaaagaattcctttaggacagttctggaataatggccaggaactattaataggaaaagaattagacctgtgaatttctgtttctcccaaaggaaagggaaatgtcattgaacgattctaccatgagcctacttacaattctgctctatcataaggcggttacatgtattatccagagccttaaattaacaatccaaggaagaagctactgtcctgtttatttaattgatggtaatgatgaaacccagagagctcaagtcctctctcggggccacatagtatgtcggcaagtcgggggttcttgggtctcagtgatcacaaaacagatacgacacacaaaacgtgaaggcagtggcaatgaaggagacaattccactctggctctcagtgctgaaaagggagaaatatgcttctgttctttgaagtgtccatttttcttggggtccattttttttcatttctgagaatatggcttctcctttaagaactgttattgtcattctaaaggtttactgattgaattcagctccctctgcattcatccctaaactacattacagattgtatgttacccttactctcactgcggaaattgctgatgaaacaaaatagagccatttaatttaccctttcgttttaaatataacaatgtcaccggtgtctgatgttccccttcctgtgtccatgtgctctcattgttcaattcccacctatgagtgagaacatgtggtgtttggttttttgtccttgcaacagtttgctgagaatgatggtttccagtttcatccatgtccctacaaaggacatgaactcatcattttttatggctgcatagtattccatggtgtgtatgtgccacattttcttaatccagtctatcgttgttggacatttgggttggttccaagtctttgctgttgtggggtggggggatgggggagggatagcattaggagataaacctactgctaaatgacgagttaatgggtgcagcacaccaacatggcacatgtatacatatgtaacaaacctgtacgttgtgcacatgtaccctaaaacttaaagtataataataataaaaattttttaaaaaaacaaaaaacaatgtcactataacaaatctgaaaggtgtggctgcttttctcacgttcatgcgttttggcaacttgtagttccttaaggtgtgacggatactctcttcttcccaaatgtactttcttcatctcctttaaacctcacattaaatcctcattatttgctgattccctgcctggaaattgcctacttactaaaatttgtttgtagccctcaaatcaataactcatggagctttcacggttattcatggccattcacagagtggcaaattctcaagtcacctaacagtcacatgaccagctgatgtcaaccaagacaatgctcggcctcctgttccagctctcatactgtaaacaaacatcctttttgtgggacatgtggtgccacattttttgcatttatgcttttggttgacaatcttgctatttaaaatggcccctgggcatggtggctcatgcctataatcccagcactttgggaggctgaggcgggtggatcacctgaggtcaggagttcaagaccagcctggccaacatggtgaaaccccgtctctactaaaaatacaaaaattagccaggcgtggtggcacacgtctataatcccagctactcgggaggctgaggcaggagaatcgctcgaacctgggaggcagaggttgtagtgagctgagatcacgccattgcactccagcctgggcgacaagagcaaaaactccatctcaaaaaaaaaaaaaaaaaaaaaaaaaaaggccccaagagtagtattgaagtgctgtctagtgtttctcaatcagggaaggctgtggcgtgccttacggaaaaattaacgtgttagataagcttcattcaggcatgagttatagtgctgttgcctgtgagctcagtatgaattaaaaatatacattaaataagatgtctttaaacagaaacacatatgcatgaagattgtgggttgatccattgacaaaaaaatgtgaccaggggcttgcaggaaacttatcctgtatttcccccaggatcaatgattcagtatcccctaattcagcgttcaaggtaactttataaaacattgctactctggataagaagaatcacacatgtgtttgtgtcttattccctctgctggagaacactgatgaatgtttttgtatactgcagggctacagtaaccaaaacagcatggtattggtacaaaaacaggcacatagagcaatggaacagaatagagagcccagaaatgagggaacattcctgcaaccatttgatcttccacaaagctgacaaaaacaagcaatggggaaaagattccctattcaataaatggtgcgggataactggctagccatatgcagaagattgaagctagatcccttctttacaccatatacaaaattcaacttaagatggattaaatacttaaatgtcaaacccaaaactataaactctggaagatgacctaggcaataccatcctggacacaggaacgggcaaagattttatgacaaagacaccaaaagcaactgcaacaaaagcgaaaattgacaaatagtatctaattaaacttaagagcttctgcacagcagaagaaattaccaacagagtaaagagacaacctatagaataggagaaaatatttgcaaactatgcatctgacaaaggtctactatccagcatctataaggaacttaaatttacaagagcaaaacaaacaactgcattaaaagtgggcaaaggacatgaacagacacttttccaaacaagacatgtatgtggccaacaatcacatgataaaaaggttcaatgtcactgatcattagagaaatgcaaatcaaaaccacaatgacataccatctcacaccattcagaatggctattactaaaaagtcaaaaaacaacagatgctggcgaggttgcagagaaaagagaacacttgcacactcttggtgggagtgtaaattgttcaaccattgtggaaagcagtatggcaacttctcaaagagctaaaaacagaactaccattggacccagcaatcccattactgggactatactgagaggaacagaaatcattctcccataaagacacatgccaatgttcactgtagcactattcacaatagcaaagacatggaatcagcctaaatacacatcaaggacagattggataaagaaaatgtggtgcagctacatcatgggatacgatgcagccatgagaaagaatgagatcatgtcttttgagggaacatggatggagctggaggccattatccttagtaaactcatgcaggaacagaaaaccaaatgccacatgttctcacttataagtgggagctaaatgatgagaactcatggacacgaagaggggagcaacagacactgggatctacttgagagtggagggtgggaggaggaagaggagcagaaaaacattaagtattgggtaccaggcttaatacctgggtaatgaaataatctgtacaccaaacccctgtgacacgagtttatctgtataacaaacctgcgcacatactcccaaacctaagataaaagttttaaaacaggacgttttctgtaacaataacacatacaaaactctcatattctatacctcctaacttcattctttcataggtaacattatttgctcttttgcttatcgtattatttttaaaccaatgcaatatctattttaaaaaatgtaataaagtaagaaataccatactttaactgttatgataattataattctgagccactgttccaagcaaaatggttaaaatatttccatgtaaatgttcatgtaatactttcatgtaaatctcccataatactaggtcaagggttcttaatttctctgtctcttatttaaacatatcaaccaaagtgacaggttctgagagtttgcacctttttaaagtaccacaataatccatccagtggaacatgacacccaatggataagcccagaggagccgtgtgactttcaaaggaaagttctgtcattcaaatctgtgctcattgaatctggactaaaagaatcatggttgaattattcgttgaatattttggtaaatgagacactaaaataactgtatccaaccctgtggcatcttgcttaataaaataactgtctataaaaatgtaaaccccaaatgatcttcaaacacatatttcattgaatatctgaacctgtttccacttgattccttcccattcccactcctcaccgctctctccctttctctttctttttcttctttctcaaataaaaagagagagacataagcagagtgttaaaaataaaggatgatctaaccaatacgagactgagagtcccaaactgctgctaaattactcaggacattagagtcagactatgcctagaatagaaaaagggcaattttcaatctttttctccccaaaaggcccagcaacatggggaagaaaatagtgatcatttgcttaattgtctgatcctctgatcactaatatggaaagacacattcacagatattctagaacatgccatgtggtataatagaaggaacaatggcccatgagtttgaagaccttgggttctggccttcctgttaactatgatattggatgagtctctagaccatcctgatttgctcacctgtgtaatgagaataaagatacttggtgtgtctattccataggactgaggtaagaattcttggagatgatgtgttggagagttctgtgttaactacagacggaaagtaatgtatggaattactagatatattgtactttcaggtcactgcataagtttctactcaaaagaaaattatagcaagttcttttataaatgaaatatccttttgaagatcattttgagtatataggttttttttttttttttttttgagatggagtcttgctcttttgcccaggccggagtgcagtggcgcgatcttggctcactgcaagctctgcctcctgggttcacgccattctcctgcctcagcctcccgagtagctgggactgcaggcccctgccaccacgcccggctcattttttgtatttttagtagagatggggtttcaccgtgttagccaggatggtctcaatctcctgacttcgtgatctgcccgcctcggcctcccaaagtcctgggattacaggcgtgagagtatatagttttatatagagttcttttttaagtgagataccacagggttggacctagagttatcttagtgtctcatttgacaagtgtctcttccttgtagaactgcaatgaatttgcactgccaagatttgtaaacaatatcgattaattacatgtgtctgttgcatcttgaatatactgccaatgatttttaaatatttttttaaattatctcaaaatatatttcaatttaaaacatgtaactagttttattaagtgtttaatggatacctcagtgtcattaaactatatttttaattttctatttaattattaattctttctgttccctcattccttttatttgtgttatcacttatcttgctacccaaacgttgcatacaattaatcagctgatcactattttctatcagtagcttccccatgttgctgggccacttggggatacaaaagattgaaaactactctttttctattcacatatttattcaacaaacatgcactgggtgcctactatattggtgatgggattgggagtatagacaaagcttctatcctcaatgaggttacattatagagaaatactaagcaaaaaatgtcttggacagggcagaaaagacagcactgcagttgcacccgcacaggtgatgtccctcaagaacgcagttcctggagctgggaccacgttaattcttctgtctacctgcagagggcgccattgcaccaggtacgctttcagtctcacctggtaaaactagaagatggcagctttacaaagaatttcaagaatcctaaaacagtaaaggggtcttatgtgggctaattgcatgaggtgctgaacttaagtatcttcagttgctggagaaaagcagaaattctgcgtttaaggggagaaaatggaggaaaagtgagacaggtgtgtgtggatactggatgtattcatttgtttcaccttgtgcccggcttttcctaaggcctggagacccggcgatgaacgcagttggctatcattgctctcagagggcttactttgtactggtctgtggtgtgacaatgtagaataatgtgaataaagtaataacaatgtccaaaatttattgaatgctttccatgagccaagaactattcaagaatttcacatacattatcttgtttaaactgcacagccgcgcgttgagaagaggtgctatcaactttcccattttgctgatgaggcaatttaggctggatgagaggacgagactgagtactactttcttggtggaggcgacagtcaaagccaggcattagaccggaatcgactcagttaaccactaggctgtgtgtgacagctggaggttagggaacgcggaggcagagagagggaagcagcgggtgcaaagggcagagctacttcggattttatgacggtcaaaggcctcaatgaagaaagaggtaacatttgtttttgttttgtttttgagacggagtcccactctattgcccaggctgtagtgcagtggtgcgatcgcggctcactgcaacctccacctcccgggttcaagcgattctccttgcctcagcgtcccaagcagctgggactacaggcgcccgccaccacgcccgggtaatttttgtatttttggtagagatggggtttcaccacgtcggccaggctggtcttgaactcctgacctcaggtgatctgcccgccttggcctcccaaagtgctgggattacagacgtgagccactgcacctggcgagaggtaacttttgaattgaaatctaaattgtaagagggaatcaactccaggaatatctagaggcagagagcaccatcggtacagcaagggggactgccctgagcagaaaataagcagggaacgtttcagaaaaagtccaggaatgggacaccagcagcagggtggctagagctggagggaagggagaggttatgtcagggctgagccgggagcctacggagccctggctaggggctcaggttcgctatcgcaatggaaactcctgggagctgtgagagcagtgatatgatgggatttacacgtaattatttctccgcttctaggaggcgactggatggtaaaagcaagagcaggtagcagacttttaaataacaataataatcgtggtaatgatacaataggaaaacaacacagcattggtgttatcttgatcggtgaaatacattagttttttgttgttgttccaaatcagcccacttggttctgttacttatctaactagagatcagtctgatatgacgcatggtgattttgaaataccagcacagaacatccctgagatgacggtgatctgaaaagagccctggccctgttcttgtagtgtcccctcctccatcgcatgcgcacactagaggctgatggtggttcgcggatgctaccaagaaggtacaaaaagctgattttacagggatttgtctgacccgtgtacaattatctctcagagtttccaccttttgtttcttcactcctcctatttgccaaaacagtcactggtttgcagagacttccctccccacactctgccctcccgtactcagtcctgcaaaacggagcttgtgtcaaatgaaacaatctccgtttcctggtggacatacttccttgatctctggggcttctgcccttcttttttttttgagacggagtctcgctctgtcaccaggctggagggcagtggcgcaatctcggctcactgcaacctctgccttctgggttcaagtgattctcctgcctcagcctcctgagtagctgggcctacaggcgtgcgccaccacacccagctaatttttgtgtttttagtagagatggggtttcactatgttggcccaaatggtctcgatctcttgaccttgtgatccgcccaccttggcctcctaaagtgctgggattacaggggtgagccaccatacccagccttgcctcctttttagaagaagattatgataatactaacaatagcttgaagataataatgagaataatgaaaataagtattgcttaaagttaaaaataatgaaaataaataatgcttgaagagaatgataatgaaaatagtaacagcaacaataataataatagttaacatttcactagcatttgccatgtgccaggcactgtgattgtgctttatagattaattatttctccaaacaaccctgtgcagtgggtgtattattgttacttctatttttcagaaaaggaaactgaggcacagagagtttacaggatttgttcttgttgcacagctaataaatggctgcattggaatttgaacccagttgtctgggaagagccattctaatttggagaaatatttagtacaatctctgatcaaggacaaatcctaaaatgtagcttggagagcagtttaatatccaatggcaagaaccgccattcattttgcaccaacctaatgcatactcctgctgaaaaaaagaggcctacgatattcttgagagtgcaaggaaaggatagtgacatcacctgatcaatgcagaaagaaaggattatagtgagacaaaactttgcaagactcttaagaaacagtggctttaacttcatcaaatttgctacctgctcttagttgagtaacaagtaagtcatctgtcctctctgagccagattcctgaaaaacaggtaatttaattatttttttccagcatcactgggggggtggttatgaaaattgaaggaaattatcaatgtaaaagctttctgaaagcttgtaacatattatgcaaatgtaagattaactatatctgcaatgcaactgattatcagttctttagtgaagtgtaatgataattctaagtgttacttcagattcaaatgaacatataattttagaaataaactagaatttggcctcacgaccttggccataactttcttttttataataaccaaccatatatttatattcagaatctctctataatgcatctatttcttcaagctatatttaaaatatattaagtaagaaattaaaatgaagtcatttttttcaaacgtacaatgtaattttatattaaattttaaagctaaatgcattcattcagtgattaatttgtttaatgtgccaggcaatattccaggcactaagatagagatatataattcagaccaacattcttagtctcctaattccttgtgttaaatggaggaaacaaataagtaggtaaacaataattaattttaatattttgctatacatttcacaggtaagtggataacccccatgactttgcaattcaaatttagtgtgtcagacacttccatatatgttatctcctgtgaagttcagggtagctgtgtgagttaaaagaaccacacatttaatttgttgctttcttattagatggctcagaatggaaaagggttggcgaaagttttcagagctagaagtgacagagccagggctggaatagaggctttagggcaagaagttctgagaagaccccagagactctgagaggacgggaggatcttatcatcactgagcaagatactgccccaggggtggtagtttatggtttttattcctcacactgcttccttatttagtgagcatgtaagttaattaaatcagagtatgtataatgcatcatataactctatgctaatggttcccttagtatatcttatgtttctcttatgtactttgcttgcattctcttctgaggcccctagtaatgacgtgtccttttagaatatgaaattaaaaccaagtattctaaattgctttcatcatctggaaattttgatgtatttttgacatcttacaattatgtcccttaaaatttctctagaggttctagaacaagggctatttttttgtatgctcacttgactgcaatttcaagctatggaaataagtgatcaatattctcccaagccaaaagccccgtaggacaaccataaagctcctcagtgaaattcagaaatggtcatctaaaacgttgcttttcacagccctacatttttctttcttactgctgttaagttgagcctaaagctgtcttcttacatattttaagttgggcctaggggtttctccatacataataaactggaacctaactgtatgtgtaaacaacctactcttgtaccaatcactgagttttggtcaacaaaaggcagctcactgttgaaactgtgtcaaataaggaaaatgtcaagctgaaccaatctggctgtttcttttcctcacttctattttccatgagccgtgttctgttttctgtccataaatctttttcaaccacagtctctctgaacctattctgatttggggctgcctgatttggaaatcattctttgctcaattaaactctgttgaactatttctctaagatttttcttttaactatcaatctgagtatagatacttagtgtctttagagctaaatgtgttgcaactagatcacataataaatttcaagaatcaagaacacttatttattcattcactcaatacatctttttgaatatctagttaagtgataaatactgtcctaggaactaggaacgctaagataaataagatgtagttcttgaactcccaagaggatcaatccagtgaaatagacagctgactgacccagtcctcatgaccaccatctactgtggggccagtgaaaatcgaagaaggctttcctaaactggcaatacggttgttgagtcttaaaggacctagagtgttaacatagccataaactttctacgtgactcagtttttctttgattaacttatccattgcattattaagataaatccattaataatgaatagttgcagtaaagacatctttaagaaaacgattttgcttttaagtaaagcagcaggtgagtttttatatgtaagagctcgtcaggagttaattttctttctcttccctgattcatttagcttatgttaaaccaggcatatttctcccatagtatttaaaaacaaatatttaaccacatttctctgaaaattatttaggaataggtcttaatatccttctatttgaaatgagagccttcccttattagaaaaatcttcatgatgcttagaaagactgcattaaaaaaaaacaaaactccaaaacttgagaatatatagtcctttaaatctgcagttccactgaacaacctaaaaagttctgtgaatacccacagaggaaaaggaaacccagttctattttgcaacttccattgcaatttcttccttgaaatttttaattattttgagtgagattaaaagttactaagcatatgagattgaagagtttttcataactgatatattattgttatgtgtcattttaattccactttgacttgaacttcaaaattaatcattgtaaaacaatcagtgcttatttgggcattgatcaatttcttttatccaaactgcttctcgaatctcattccttttttcttggtttaatttcctgcttatagaaggctatttttagtagatctcttagtgatggtctgtgaatggaaaactctttcaatattggttgtcaaatttaaataatatcatatctggctatacaaatataggttacctgatattttctctcagtgccttgaaactattcttcatttctgaccttcatgagtgcttatacaattttggagataggctacgtatttattcttttgctgctttaaaatcctcctttataaaagtaaagtctctttttccttgagtttcttcaagtttggggaggtgcatctattggcagactttacattttcaccaactgtaactagcgctcagtgtctttcaaaatttgaggatttatgtccttgttcagttctaaaaactacctcaactatgatttcagtaaatactgcttgtttcttgtgctctcctactgaaacccctctcatgtgttctcttctgggtctaacatcctttactctatgtgttttaacctctcttccatattttccatctccttatgcaactgtgcagcattctagatctttcttccaatttacttgtgcactgaggttttaattataacgaccatatttatttgtataatatttgtattattacaaagcctctttggttgtttatcaaatcttcctggaatttttcctgatttttttttctaatattatctagctctcatatcattttttgcgggtaattttatataattttaatggtctaaaaatattatttagattattctaatataaatttcttgtcaatctgtttacttttctttatgatacagtgttttcttgggtggtttctcattttcgttgctagctcaccttcagaagaataggttttcttatgggaattccatgtgcaatggactaggaaacaatattctatagcaattttagctttactttttccaggtgatatagtttggatatttgtccccacccaaatttcatgttgaattgtaatccccaatgccagtgatggggcctggtgggaggtgtttggaccatgaggatggaacagtccgtcatggcttggggctgtcccatgatagtgagttctcgtgagatctggtcatctaaaagtgtgtggcccttccccctcactctctccctcttgctcctgcactatgtgacatgcttgttctcttttcaccttccaccatgattgaaagctccctgaggcttcaccagaagccaagaagatgccagcacgatgcttcctgaacagcctgcagaaccatgagccaattaaacctcttttttctttctttttctttctttctttctttcttttttctttctttttagttatactttaagttctagggtacaggtgcacaatgtgcaggtttgttacatacatatacatgtgccatgttggtgtgctgcacccattaacgtgtcatttacattaggtatatctcctaatgctatccctcccccctcctccaccccatgacaggccccggtgtgtgatgttccccatcctgtgtccatgtgttctcattgttcaattcccacctatgagtgagaacatgcggtgcttggttttctgtccttgccatagtttgctcagaatgatggttaccagcttcatccatgtccctacaaaggacatgaactcatccttttttatggctgcatagtattccatggtgtatatgtgccacattttcttaatccagtctatcattgatggacatttggcttggttccaagtctttgctattgtgaatagtgccgcaataaacgtacatgtgcatgtgtctttatagcagcatgatttataatcctttaggtatatacccagtaatgggattgctgggtcaaatggtatttctagttctagatccttgaggaatcactgcgctgtcttccacaatggttgacctagtttacagtcccaccaacagtgtaaaagtgtttctatttctccacatcctctccagcaactgttgtttcctgacttcttaatgatcgccattctaactggtatgagatggtatgtcattatggttttgatttgcatttctctgatggccagtgatgatgagattttttcatgtgtcttttggctgcataaatgtcttcttttgagaagtgtctgttcatatcctttgcccactttttgatggggttgattttttcttgtaagtttgtttaagttcttcatagattctggatattagccctttgtcagatgggtagattgtaaacattttctcccattctgtaggttgcctgttcactctgatggtagtttcttttgctgtgcagaagctctttagtttaattagatcccatttgtcaattttgtcttttgttgccattgcttttggtgttttagacatgaagtcctcgcccacgcctatgtcctgaatggtattgcccaggattacttttagggtttgtatggttttaggtctaacatttaagtctttaatccatcttgaaataatttttgtataaggtgtaaggaagggatccagtttcagctttctacctatggctagccagttttcccagcaccatttattaaatagggaatcctttccccatttcttgtttttgtcaggtttgtcaaagatcagatggttgtagatgtgtggtattatttctgagggctccgttctgttccactggtctatatctctgttttggtaccagtaccatgcggtttggttactgcagccttgtagtatagtttgaagtcaggttagcgtgatgcctccagctttgttcttttggcttaggattgttttggcaatgtgggctcttttttggttccatatgaactttaaagtagttttttccagttctgtgaagaaagtcattggcagcttgatggggatagcattgcatctataaattaccttgggcactatggccattttcatgatattgattcttcctatccatgagcatggaatgttattccatttgtttgtgtcttcttttatttcgttgagcagtggtttgtagttctccttgaagaggtccttcacatcccttgtaagttggactcctaggtattttattctctttgaagcaattgtgaatgggagttcactcatgatttggctgtttgtctgttattggtgtacaggaatgcttgtgatttttgtacattgattttatatcctgagactttgctcaatttgcttatcagcttaaggagattttgtgctgagatgatggggttttctaaataatacaatcatgtcatctgcaaatagggacaatttgacttcctcttttcctaattgaatatcctttatttctttctcctgcctgagtgccctagccagaacttccaacactatgttgaataggaatggtgagagagggcatccctgtcttgtgccagttttcaaagggaatgcttccagtttttgcccattcagtatgatattggctgtgggtctgtcataaatagctcttattattttgagatacatcccatcaatacctagtttattgagaatttttagcatgaagtgccgctgaattttgtcaaaggccttttctgcatctattgagataatcatgtggtttttgtctttgtttctgtttatatgatggattacttttattgatttgcttatgttgaaccagccttgcatcccagggataaagccaacttgaccatggtggataagctttttgatgtgctgctggattcggtttgcccgtattttattgaggatttttgcatcaatgttcatcagggatattggtctaaaattctctttttttgttgagtttctgccaggctttggtatcaggatgacgctggcctcataaaatgagttagggaggattccttctttttctattgattggaatagtttcacaaggaatggtaccagctcctctttttacctgtggtagaatttggctgtgaatccgtctggtaccggacgtttttcggttggtaggctattaattattgcctcaatttcaaagcctgttattggtctattcagggattccacttcttcctggtttagccttgggagtgtgtatgtgtccagaaatttatccatttcttctagattttctagtttatttgcgtagaggtgtttatagtattctctgatggtagtttgtatttctgtgggattggtggtgatataccctttatcattttttattgcatctatttgattcttctctctcttcttcttgattagtcttgctagtggtctgtcaattttgttgatcttttcaaaaaaccagctcctggattcattgattttttgaagggttttttgtgtctctatttccttcagttctgctcggatcttagttatttcttgccttctgcaagcttttgaatgtgtttgctcttgcttctctagttcttttaattgtgatgttacggtgtcaattttacatctttcctgctttctcttgtggtcatttagtggtataaatttccctctacacactgctttaaatgtgtcccagagattctggtatgttgtgtctttgttctcattggtttcaaagaacatctttatttctgccttcattttgttatgtacccagtagtcattcaggagcaggttgttcagtttccatgtagttgagcgcttttgagtgagtttcttaatcctgacttctagtttgattgcactgtggtctgagagacagtttgttataatttctgttcttttacatttgctgaggagtgctttacttccaactatgtggtcaattttggaataagtgtgatgtggtcctgagaagaatgtatattctgttgatttggggtggagaattccgtagatgtctattaggtctgcttggtgcagagctgagttcaattcctggatatccttgttaactttctgtctcgttgatctgtctaatgttgacagtgggatgttaaaatctcccattattactgtgtgggagtctaagtctctttgtaggtctctaaggacttgctttatgaatctgggtgctcctgtattgggtgcatatatatttaggatagttagctcttcttattgaattgatccctttaccattatgtaatggccttctttgtctcttctgatctttgttagtttaaaatctgttttaccagagactaggattgcaatccttgcttttttttgttttccatttgcttggtagatcttcctccatccctttattttgagcctatgtgttgtctctgtacatgagacgggtctcctgaatacagcacactgatgggtcttgactctttatccaatttgccagcctgtgtcttttaattgaagcatttagcccatttacatttaaggttaatattgttatgtgtgaatttgatcctgtcattatgatgttcgatggttattttgctcattagttgatgtggtttcttcctagcatcgatggtctttacaatttggcatgttttagcaatggctggtaccagttgttcctttccatgtttagtgcttccttcaggagctcttataaggcaggcctggtggtgacaaaatctctcagcaattgcttgtccgtaaaggattttatttctccttcacttaggaagcttagtttggctgcatatgaaattctgggttgaaaattcttttctttaagaatgttgaatgttggcccctactctcttctggcttgtagagtttctgctgagagatcagctgttagtctgatgggcttccctttgtgggtaacctgacctttctctctggctgcccttaacatttttttccttcatttcaactttggtgaatctgacaattatgtgtcttagagttgctcttctcgaggtgtatctttgtggcgttctctgtatttcctgaatttgaatgttggcctgccttgctaggtaggtgaagttctcctggaaaatatcctgaagagtgttttccaacttggttccattctccctgtcaatttcagatacaccaatcagatgaagatttggtcttttcacatagttccatatttcttgaggctttgttcatttctttatactcttttttctctaaacttctcttctcgctccatttcattcatttgatcttcaatcactgataccctttcttccacttgatcgaatcggctattgaagcttgtgtatgtgtcacgtagttctcatgccacggttttcagctacatcaggtcatttaaggtcttctctacgctgtttattctagttagccattcgtctaatcttttttcaaggtttttagcttctttgaaatgggtttgaacatcctcctttagctcagagaagtttgttattaccgatcgtctgaagccttcttctcccaactcctcaaagtcattctccatccagctttgttccgttgctggcgaggagctgcattcctttggaggagaagaggcactctgatttttagaattttcagcttttctgctctggttactccccatctttgtggttttatctacctttggtctttgatgatggtgacgtacagatggggttttggtgtggatgtcctttctgtttgttagttttccctctaacggtcaggaccctcagctgcaggtttgttggagtttgctggaggtccactccagaccctgtttgcctgggtatcaccagctgaggctacacaacaacaaatatttcagaacagcaaatgttgctgtctgatccttcctctggaagcttcatctcagaggggcacccagtcatatgaggtgtcagttgacccctactgggatgtgcctcccagttaggctactcgggggtcagggacccacttgaggaggcggtctgtccattctcagatctccaactctgtgctgggagaagcactactctcttcaaagctgtcagacaggggcgtttaagtctgcagaagtttctgctgccttttgttcagctatgccctgccaccagaggtggagtctacagaggcaggcaggccttcttgagctgcggtgggctccacccagttcgagcttcctggccgatttgtttacctactcaagcctcagcagtggcagacacccctcccccagcctcgctgctgccttgcagttcgatctcagactgctgtgctagcagtgagcgaggctccgtgggtgtgggaccctccgagccaggcatgggatataatctcctggtgtgccgtttgctaagaccattggaaaagtgcagtattagggtgggagtgtcccgattttccaggtactgtctatcacagcttcccttggctaggaaagggaattccccgaccccttgtgcttcccaggtgaggcgatgccccaccctgcttcagctcatggtccgtgggctgctcccactgtctgacaagccccagtgagatgaacctggtacctcagttggaaatgcagaaatcacccgtcttctgcgtcgctcatgctgggagctgtagactggagctgttcctattcagccatcttggaacaagaaccaaaactcttttctttataaattacccagtctcaggtatttacagcaatgcaagaataacctaccacaccacgtattccaagggctcgaaagcctgaacccagtttttatgtttatttattggcttggtgattcctgacatcatacttacgcatagcacaggcttggggttttacttcttctaagatactaacttgtttctctttccacttccttattgcttccctgggttggttggcatagttataatggcttgacgttgaggtcctgtctttcttctggggtctcagtcactactcctcactacgtatggtctccaagtcatgttcactgtcactttgggagcattactcctcattcccactcctagtggaatattaaatccagtattctcccagacctctgcaggctttcaaacttatcactcttcatttaaattcattcttcgtttctcacatctagttatatattttctctgatacacctagtaatgtattgttacatttttagctaccatttctttgtgtctaaagaaatagggcatttgttttagttctgacaaccctttatgttaagggtcaatagagccatcgaaatgtttttctctccagattttattcatcagaaaggctgctttcctttaggaagttgtcccacaaaatggtttccataaattcaatcaattggtaagacagaaggtctcagttgaaaactatttcaaatgcaaactactaaaaccatcagggaggtaaaaatctaatgtttcttgtcaactatatagaaaaatatgtttttgtaaacaattggttgagtttaaactacaaaaaactacaaataagaagcattacaactatttagacatatctctacttactatagaacctttgctgtgaagagctaatctcatggtaatattttgccaagatgatgaaataaaatgttaacttaaaataaatatattttatttggctaccattgttatttctctttttttctggagtacactatcattacatttctttgcacctttaacagggaaattttaggacatgattatatgcatgagccctgggtcacattttaagccacaaaaccagaaagacaagatgtttctaatgtttgatgctgtcccttctattcaactgccatatatgctcatatattttaattttttaaaaatagagacaaacttccactatgttgcccaggctggtctttaagtcagacaaatgcaattacttgattccaagatggtagattactggtttgtttacaatagagagaaactaggaaacaaaactaaatatttaaacaactatgggacatctaaatgacagaacgttatgcaactattaaaacaatgtttttgtagagaattaaatgatattagtaacttatcataacataatatcaagcaaataataggacatacaattgtattttgaagaatatgtatatgtgtttaaaagtagcaaaatgcaacatagtataattttagaaatgctaataattcctaggtcattttaggttgccttgtgttatcttgtattttctttccatactttgaaagttttctacagggaataaaaattacttttataataaaaatccaagaaaaacatattggtgttctgatagcaaagtttaaataatcatgaaggcagagttcagacttttcaagaccatgctgcacagaattatgagtgacaacaacatgggttatgccacaaagaatcagctgtcaaaaagaagaggaaacaaatatatcaaagtaggccagaaaatttgctcatcagtgctgtctgctagaactttctgtgataacagaaatgtggtatgtctgtgctgtccaatatgatagccattagccacatgtggctacagagcacttgaaatgtgactaggagatgaaggaacagaatttttaatttaatttaagtgatatttaaattttttaatttaaatagtcatatgtaattaatggcttccatgttggacagcacaaatctccttcgtcacttaagggttattgcctattcattagtgggaagaataatatatttatatcaatgatatgttaattatatattaaaaataaataattatagataattatagttggcagaactggcctagttattttccccacaacaatgctgatcttcctatgatgagtccaagattttgcaacatttggcttttgctatggtttggatatctgacccctccaagcctcatgttgaaatctgatccccatgatggtggtggggcctaatgggaggtgtttgggtcatgggtacagatccctcacgaatggcttggtgccatcctagtggtaatgagtgaattctctttttagcaaccataagagctggttgttaaaaagagccttgcactttcccacctcacttgtgcttcctctcttgcaatgtgatctctgcacgtcagctctccttcaccttctcccatgagaggaagcagcctgagggcctcaccagaagcaggtgctggtgccatgcttcttgtacagtctgcagaactgtgagccaaataaacctcttttgtttataaattacccagagtccgctattccttcctagcaacactaaatgaactaagatagcttttaattacaacggtggcatctgttactactctgcattctcatcttcattccaggtaagtaaattttaagttttggcttctcttagttccaagacacaacataagtcattccctgtttttgggaggagagagtcaggatggagaaaagaataaaatttattgaaaatttaaaattaagataattaactatgtgaactaaaagtgagtaatataataccttctcccagaaaagatcaggacgggagtgttacaaagctttgacatttcttaaagtgcactctgctgcattttgtgtgtggtctatgtgtaatagctcatcttcaacacacacatacaaacacacactcaagtgtgagaataaaattaacttattttcttatgtaattttggagtaagtttatttagagtcatatgttttgtatttttattgaaatatatgcttgttacctgcagttttgtaaaaggatagcatttattctctctctcttccttcctctgtctctctcaaattgcccagagggattaatcaacagaaatctaaattttagaaaacctgctttaaaagagtacttgttctctattttgagtttatgggacaaatgaaactgttctttcaatgggtgttggcaaagaaggtctggaaaagtttatatgaattgccaagcatggaatattgatcattagccaatcaagctggatgatactggacattatacttagtccacagaagaataatataggtatatggatataaacatatttttaaaatgttgaataagggacagttcagatctttttcaatttcagttcataatgcatggtattttcaatgctccatgcatggctaaatacacaaacatcataaatgattctaaagcatgatagggtgcttgcccttaaaaattaccagtagctaacacttttgccagttcagggtacaaaaaaaataaagaccaggagatgctaaaatgatccatatcactatggttataaactttgaaacttacaatgcacaccttaaaatcaaagtttccaaggaaaccaatgaatatattttaagacaagaataatatgatttgcaaatcaaaatccatttaagactgttgccacagcactatgtgttgattggtgcttgccatatttttttaggaagtcagaaaaaaaaatcttatgttccatgaatccagcaataactaagactgcaaccctgattttcttacccgtctgccttgttaacatgatatatgtcaaacataatgaagaatatgtaaaagaacccttgttaccaacaaagattttgcaatatcttcaatacagagaatagaagaaccagaaagaagcagcgacaggtaggcggagagaggaagggaggaaactactgactgagtaaccatgtatgattgggaataaaatgggatctcaaaatcagattccattttgcacccaaccacaactgagaaaactgaggctcaaaaaagtgaagtcattgacacaaggtgttgactattaattgctgagtcaggatatgaagcccagttagtctgattccaaaacttatattcttcctggtggatcagacagaaggaatgggaaaatgcaatgcactcagggtgctcagtggaagcgttggagtgtggagttcaagtcctgagcgaatgtattcctggataaagaattagtcatcaggggaaggtcatgctggagctacgctgaagggtaaagtttgtttttggactctacctgtttcctctccttggctctaagatgacatgcaccagggatctcacctctaatcccgccattgcatgaagagaatgccttgcacatgactagatgctcaacaagtatttgtaaatgtgcatcttaaaaattggtcatgtcagttacgatgtgaaattcaccagtgaaaatgctagctggggctttgaacctggagctactaatttcccaggttccatctcataccatctgcccggcatagtcctaccacccatattgccacactggttttagcagggcaatcctctgaaagtatttttgctacagtggcttgaggcatagtaatactagatggagactaggaactctaagcaaatatctataaagttcacaacaaggctgtgttgatcactctggaaagaggtggtgaaacgattctctttgatgactcctcctgtgtctgcgtatctgtgctttggatagcccacacaggtacatcattaaatgccctcccagggtactgcaccagcctttgagcaggatttaaccttcagagtgcactcagcaattgcaaagtagtgtgctggtgactccattcccagacgtccctcttgacacactgaactctagagtgtttcatctcgtggtatgaaccaagaattggaacagtcacttgggcagagggattctaggtcctccgtataacctaagcaaagacatttttcttttccaagctagaaaaacatgcctaaaacagaaataagtataagcagtctttgcaagccttaccatttctacctccctctggggaatccaacctgtggtatagcactggacctggacaaatagcacagtgatctactaggagtacaatgtgttatcactgttgcttttattataacagctggcagctggccaaagctttgcaaagaaaccagaaagcaacagcagggcactgggctgccttagaaaaacatttcttggctcaaagaggagcctctttaacaagaacccaacacctcaaacctagcaaaaaagcatagctcaggtcaatcacataaaacacagcttcacaaaatctgtcccataacaaagctagaaatacaatggtgtaataaatttggtatacctaagagcctgagaaaaggtacagctgcttaagaataagttatagaaaatctttgttaaatactctagggaaggattcaggcatcttcctacttatctaactttttagtgtattctaaacttggccaggaaggagaggtgtgatcttggcttggtgattcctgtagatctccggactttggctgcctcacctttacctgaaactgttgaatgggatgctagattccctccagctctgacattccatgactaaagaaagtcaaggtttaacactgaccttgacatcctggggcaatggagagttttagtgtatgcaattgtcatgcctgaaaaaatgtcaaaacatggttagggttcctctccttgttcaggagaataaaatagtatattttaaatatgctagtataaatcttataaataaaatagtataaatctcccttctgttaagagaatgtagaaataaaataaataaaatactaaatactaaatagtattagtatagtaaatagaaataaaataaataaaatactaaatcgtagaaataaaatactaaatactaaaataataaaatactaaagtttgctcaaggaaaagatgaagttagatatgtgtttccttttaaggaggttttcatgaaagaattttttttggcagatcacttgagcttaaaaggagtattgttgtttcagaaatagcacaaaaagctgttccccaacaagggatgcagcagaggcagaatgtttaccacctagggtgttagtgaaaggccctgtctctaaacatcccacgttgagataacttcaatgtttgatcaaaaagtaaatcttatcccgtaataagtgagcaacgttctgtttcccctcacccctcaatattgaagcaatgacaagataagtcctctcctgtagacacatttaccaaccaagtgaaacatggcgtcttgtcggccttaaccgctagacttgagagaatggaattttcatgaaataagagtgccgatccataaaatacatgccattcgttttgatttaaattataaacaatcttatccatggtcttcttttatttttattttttaattttcccttccattctttgatttttaaggagtctccttacaaagtcagaacagtttttgtttttaccatagccaccatggttaactttttctttagaaaaatgttcagtgatatccaagggcagaaaaccaaacaccacatgttctcactcgtaggtgggaactgaacaatgagaacacctggacacagggcgaggaacatcacacaccggggcctgtcgtggggtggggggaggggggagggatagcattaggagagatacctaatgtaaacgacgagttaatgggtgcagtgaaccaacatggcacatgtatacatatgtaacaaacctgcacattgtgcacaagtaccttagaacttaaagcataataaaaattaaattaaattaaaaaaagaaaaattttcaatgaaacaaatgcacttcctgaagttactaagcctacacaaatgaatgaatgaacgaatgtctttcctgtagttcttaagcccacatgaacaaatgaatgaatgaatcaatcaatcaacgtctttcctatagttgttaagcctacatttacgtaaaggggagttgctcttacactgacactgtcaaaaccctctacctcccttccactccctccctgccaggtaaaagctccacctaagatagaaggcaacccaggttccaaagtaattcctccctcacctgtgaatgaccagaattattatcctctaagtgcttctattgtcacttgaaaaaggtacctgcttacctgattcaattaattcacaagaaaactaggaggaccgcttggtttacccaaggaattgggactaggaaagtttgttaatgtgaacaagccacctaaatctgtgattctcaaagaaagacctgaattccattgctctgaggactagaaaacagcccagggctgcaagtgtttccttcaggttgcagggaaacaacatgcaaaaaggttatgctaacatttggaacgcacgaactaaatttgcttgttaataaaatttcctgagacctctaattcggactttcctagaaagtctgcctgtcacatcatacgcagcagaatcacaaagttgtgaatgcacacgtccttggataattgggattccagtaattttccattccaagaggatgttttattactgctcctcagtgttctgagttggtcatgattttcagagactgatgtttatgaatttaagttgaaaatttatgtttatgttatcctcatcaatttagtttgttataagttgtttggtgaatcccatacagtgcaatgaagcatatttgcatcaatgacatttctagactataaacttccaattatttcaccaataaaatatgtatactttacagtacaaatgcgagttatccataccccatcttctgaaacaaatatgtctgttttccttgtatattcccacccctagtctacaattttgcctatatagtgtcactttattattatcgctaagttatttttctacctataacttacctagagtaagataacacagccatggaatcttttaccctacctaaatgtgtcataacaagatgtctttgaaactcagctctaaatgctagcatggatggaaaactatggttccatttgcaaggctggcttacagagcacaaggagatacagttatgaaagggctggactacgacagaagtagtaggccaatagatctatatagtcagctttttgtcatgtaatttattaactatgacacaaatgcatttaagaatatcaagtatttctctggctcttgacacagttgacttaaccttttgctgtctaaggaactgaggctttcctgttctgggtgctactggcaaatgttctagtacttgaagtcgggatgcacagcttcaaccactgacttatcagtgcagccacctgtgtattgcaactggccattaaattaaacaccgagccacctgggtttagttcggtcacttccataagtgtatttagcattggtagccctgctttattaaagtgcagcagacgtgctcttctgtcccttctgtcccttctgtttgtggttctttgggaaagttctgatatttgcttttgttttgtgcttgctttcgtgtttttatatcttgtatttatccctgaacatatttcgaacatttttttaaggaaagaaattcttttgtgtatatatagatacttgcatgatatactgtcatcaagtttcggttcctcaaaaggtcttggagctgtcaggtgtgatgtactccaaccatcaaagttctgtggaacacggtttgtatgtaaataaatgtggggcgtttggcccttgaaaccggaagacattacggtaggtgaaataagccagaaacagaaagttaaataacgcatgtgctcattcatatgtggaagctaaaaaatagttgatcttacagaagcaaaaagtagaacagaggaaactagaggctgggataggcaggaggaagaggggttagggagaaattggttaaaggatagaaatttagagctagagaggaggaataaattctagtgttctgtagcactgtaacatgactatagttaacaataatgcatggtttcaaagagctagaaagaggatactgaatgttcccagcacaaagaaataatagtgtttgagataatgaatatgctaattaccctgatctaatcaccgtatattatatgtattgcaacatcactatgtaccctataaatacatacaactattatgtgtcaattaatttttttttgagacagagtctcactctgtggcccaggctggagtgcagtggtgtcatctcagctcactgcaacctccgcctcccaggttcaaggggattctcatgcctcagcctcccaagttcctggaattaaaggtgtgtgccacaacgcccaactaattttttttatttttagtagagatggggtttctccatgttggtcaggccaggcaatgatccacctgcctcggcctcccaaagtgctgggattacaggcctgagccatcatacctggccaattaaaaaaaaattttttttaaagaattctctagttcattcctactatattctgggcaaaagctaaacatctgtgccagacgcatttattgtctttctctctctcaatctctctcctttcattgaagcttccctttaattcccaaataaatccaactcccttccatattgaacaccataccactgactcagcatcatttacatcttgcagggaggttctttctctgtctttttccccttatctattcatccatccatccatctctttctctcatttcattgccaaatatttgggaaagcagtccaaggttactgctgcctttgcttcttcacctctcatcctctccctgaaatctgatctccctacatctctcattttctctcttgattcttcttctggtgatttcttcttaaatgttaatgttctctaggttccaacttgggccctctttttgtcttagtctacatgtcctctctgaatgatctcatccacgaccatggctttaactataacctgactctagtgattcaaaaatctttctgtccaacaccaatctcttgtctttactttagaattggatagccactgcatactgggtgcctatagctaaacatccagctatctgtaagtcttgtaaacacaacaacggtatggaaatccaactgaaaaacactcatgcccagtggaccatgaatttaaggcaagtctgatggtgtgagaaaagcataaaacccagtcagaaaccttgggttccaatcccagctcaattgtttttagtcatagggcaggtcctctatctatctgactgtgatttttcacttgtagagtatggcttactgtactttaaagattttctggccgggcgcagtggctcacgcctgtaatcccagcactttgggaggctgaggtgggcggatcatgaggttaggagatggagactatcctggctaacacggtgaaacctggtctctactaaaaataccaaaaaaaaaaaaaaattagccaggcgaagtggcaggggcctgtagttccagctactcgggagggtgaggcaagagaatggcgtgaacccatgaggcggagcttgcagtgagctgagatcgtgccactgcactccagcctgggcgacacagcgagattctgtctcaaaaaaaaaaaaaaaaaaaaaaaaaaagattttctgtgagggattaaatcagataatgtatgtaaaggtgtgatgtaagctggtaagtgttattccaatttctgatatgctattatttaaaatgtagttggacaagcaggagtaacatttaaaatgagacaaaaagtacaagccaccagaaatgcaaatatcaaattaatttgtcccagtaaactaaatataaatagtttttacactttaatgtacatctgaaagagcttattaataatgtcaatgcttgagctacagcccagatttaattggttgggaaagaggtcagtaatctttacttcaaaatcattccaattgtcacaggcaagtcagggccacacttcaagaaatagtgaaatataatgcacttgagggatggtcaatcctcaaaatattctaaagacttgtaaaggcttcagaactagttccttcttgagaagcacattgcttcttttgctgagttcaaattgtaatgaatttcaaggcttccaattctgggcttcttacataaagcaatcattccttcctcactcccaacacaaacacataatttttaatatataaataaatatatatatttacatttgcatattctgttttcattaatggaatttttttcctgtatactacatgagtaataatgtaaagacacgaaataaaacagacactaattaggcatgtttgaacatctgttgctaccaaacattttctatttctcttttcatatctctgctgatgggtttagatgaaaagactacaagcctgcatacttacagggaggaaggagccaaactggaaaaccagtagcacaggtcggtaggaattaatctcagcaggctcgcttcagcattcggagacacaaccagcaaaacacttccaagctggtggctcagttaatatgtgaagctatttttagtacaacagagagcatttctagagattgagattataaaccagggatacatcccaaacatattaatatggttttaattttattttacagataccatgtttcagaatattttaatctccatgtgaataattgtttttattttgtatgtatgcatgatgtaagtatgcatacagtacatttatatgcacgagcattattcatatacatgcatacctacatgtaaaaatctgggtaagagagtaaatcagatgttttagtccttgtatatataaggtaaaagccagaccttttaatgacttacacatttgatcaggaagttttgtgttttgaaatgacaaaaacttggaatattttcgaaaggagtagaatactttcggccataattttcatttttaagatgccttaaatgttttagttccttttaataaataatcttacacaatgagttggttctcactgtcgtattaggtaaatgggttttgttgttgttcgtttttgctaaaatgggttttgttgttttttgtttttgctaaaacgaaaaaacttcctttttattaaggaagttatatgaaagtccatcacttccacaaattaggaggctacactactgcaatttggctgaatcagtggatatttttaatgttgcttattttgtgctttaaaattgcagttatcccagagcatctgtaattttgttttttttttattttgaacaaactgttatctgttaaattaacaataagaaaaatgttattttatctatgtttattcattcttcaaaattcttccttttgttttttttgtttttttaattttcttttttttattattattatactttaagttttagggtacatgtgcacattgtgcaggttagttacatatgtatacatgtgccatgctggtgcgctgcacccattaactcgtcatctagcattaggtatatctcccaatgctatccctcccccctccccccaccccacaacagaatgatgatgagatattcctggtaagatgtaatgttttatttttcttcctggatctatctctgatcttgttccagggcacatcaatttagaaacactcatcgattatgatagctttgagaacaaacattggaacattaacatgctaattttgttctttacaggttgatggtagaaaatgtataaagtttaaaaacatgcaagtcttattagcattctgcttagataaatacaatcttattttatttctctctccttttattcatgccctgccaattgagagtgccaggtttctctccttttctgtttcacagcagctccaaagctaaagggaaaccaaggtggaaaataattaccccaaaagagacattttccatgacactaatggctggatttcagatactttccaaagctcattggaaagggagaactcatggagaagaaacaaccaactttaagtatcccattactctcagaggttgactcagagcctattccatgtagaaatactgaagagggtgtaaaaaagaacgaaaagcagaaacaaaataaataaataaaaacaacatagtcatgctttgtttatccttctttcccttgcaaacatctgctctctggagtctgctctggcatttaaggagcttggaagtcatccctcccatccaatctcacaaagaaaaaaaaagctgaagaagtaaaaaccaacaattcctctgaaatccctcagaggattgatgtcagagggcaaaccattgaccccatgattggagacaaagacagaaatgtacagagaatcatgacctagagtaacagaaacctttgggaaaaccaacattgggatagaaaaacttaaactgcaactgattagttgttcgaggctcaatgtggattaatttgagcattaaaaactcctttgaggatcagggagcagttttaagggggctaccacacatttgtgacttttacttccaggagccctactaggtttgcacaatgagggtcagggagaaatttcctaatgcttccaacaaggaacagggaaaaagtaaccattccgaaatacacccaggtcactctgttcttcttatggcctgtctcaaaagaaactgtattacccagagcccaacagactgagattatagcagagcctaaaccaccggggagtagggaaatatccaactccagcccctctatccttcccattgcacctaaagaggaaaaacccccaaaacccaaggagcacatgtggagatcatggcccaggggtagaggctcactgtgggactgggtcctaatcatcagattatacaaagcatcccccttcccctgcaccttaccacaataccagtagggctcctgtataataacagatgaacgcaacggaaagaactgtatgacccatgccttatttaagaagaagtttctaggaaaacccaaagacaacagcggggaataaaaacaaggacatcagaggagatgttagcctctaaagcctctagctacagcaaacagtaaacacagctcaattactagccagataaacataaaacctcacagtaatggcctgtatgcctcatttatttagtacatcacatcctactgtcaacaacaaaaaaaattccaaggcacactaaaagacaaaaaacacagtttgaagagtcagagcaagcatgagaaccagactaaatatggaaaatatatgggaatcatcaggtatgaaattaaaaggaactatgatgaaattcaagaaataaaaaacataatagaaatgaagaatgaaaaattagttcatcaatagactggacatgattgaggaaagaatcagtagagtttggacatgtgtcaaaagaaacctccaaactgaaatacaaagagaaaaaaaagtataaaaaagacaggaaatgtcaggcgcagtggctcatgctgtaatcccagcactttgggaggccaaggcagtctgatcacttgaggccaggagttcaagaccagcctggccaacatggtgaaaccctgtgtctactaaaaataccaaaaaaaaaaaaaaaaaaaaaattagcacatggtggctcatgcttgtaatgccagctattaaggaggctgagcatgagaattgcttgaactcaggaggcagaggttgcagtgagccaagatcatgccattgcacttcagcctgggtgacagagtgagacactgtcaaaaaaaaaaaaaaaaaaatagagagagaaagagaggacagaacagaatgtctaaaaactgtgggggtaattataatataaaaggcataacatacatgtaatgggaaaatcagagaagaaagaaaagaacagaagacatatttgaagcaataataactgagattttccccaagttaatgacagatattgttatgagcttaattatgtcctcctgttcccccagcctcaacttatgtcaaagccctaactcccagtaacctcagaatgtggctgtatttagagataaagccattaaagaggtaatgaaggtcacatgagatcataagggtgaggtcccaatccaatatgactggtgttgttctaagaggaagagactcaggagatgggcctatacagggaaaaggccatgtgaggacacgggaaggtggccttctgaaagccaaggagagagcctcaagagaaatcaatcctgccagcaccttgttcttggacttccagtagccagagcacttctaccctcatatttattgatgagataataaatttctattgtctaagccatacagtctgttatattttgttatggtggctctagtaaaggaatccaccaagccacacaacaaggaaactcaaacaacaccaagcacaataactatcagagcaaccacagacatatcacattttgacttcagagaaccaaacatgaagagaaattttgaaaggagcgagggtggatgggatgagggaaaccttacctggagagaaaaaataaaataactgctttgaatttctcatcagaaaccatgcaagcaagaagagagtggggtgatagatttaaagtctctaaagaaaaaacccattaacctagaattctgtatcttgtggaattatcaaaagtgaaggaaaaacaaagactttcttagaaaaacaaaaactgagagaatttgttgacaaaagacctgccttgaaaagaatgtttaaaaacagttcttcagaaaaagggagaatgatataggttgaaactacataaagaaaggaagactattagagaaggagtaaatgtacgtcaaacaaaatctctttatagaaagtttcttaattgatctgatggataaaaaagtgttcaaaatgataccagcaacaatgcaattggtggttatagcctaaaggaaaggaatgacagcaatattataagagataagaaggagaaagtaggaatactctgttatgggatagttgcattacatgttaagtgtacagtgttacctaaaaatggacttggattcgttgtaaatgtatattgctaactctagaaaaactgtaagacatttaaaaggaattataattgatactgggcaaaaagggaaaacagaattatataaaatgttcatttaaaatcagagaaggcagaaagagacaggaagacaaaaggaaactaatataaaacagttataaacattaatgtaacagttatagatattaaaccaacaatattaataaccactttaaatgtgaatgatatacatcaagtaaaagacagggactatcagagtggatataaaacagaaccaactatattctgtttagaagaaacttgctttaaatacaaagacacagattaaaagttaaaggatgaggaaagatatgccatgctaaaactaatcaaaataaagctaaattagataaattaatttcagacaaagactctagaaaaaacatttttcagggataaatttcttttattgcataacaacagaaggttcaattctccacaaagacataacaaccttaatgtgtatgtgcttaacgacagagcatcaaaatacttgaggtaaaaactgacagattacaaagagaaatggatgaacaattactatcactggaggcttccacacacatatatctgtggttgacagatctagcaggcagaaaatcaggaaggacagaatcaaactaagcagcaccatcaatcagctgaatttaatggccatttatagaataattaatgcaacagcaacagaatctatagtcatctcaagttctcatgacatgcaccaagatagaccacattctaggtcataagacacaccttaaaaatgtaaaagaatagaagtctttcaaagtatgatctcaaacaatagaattaaactagaaatcaacaacagaaagaagctggaaaatctcaaagtacctaaaaattaaacagtacacttctaaacaacacacgggccaaagaagaagtctcgggagaaattttaaagtatttcaagctaaatgaaaatgaaaatacatgttatcaaaattcacaggatgtagtgaaagcagtgcctagaaggaagttgaatgcatatattagaataaagaaagatctaaaatcaataatctaaattcccatcttagaaaactagaagaacaaaagcaaattaaatctaagccaaacagaagaaaacaaataataaaaatcagagcagaaatcaataaaattgaaaatcaatagagaaattcaacgaaaccaaaatctgggtgcttaaaacaattaatattgatgagcctctagccaggctaattaagaaaaaaaaaagaagacaccaattactggtataataactgaaaaggaggccatcactgctgatcccctttatcctaaaaatagtaaaagaatattatgaacaactcaaccccacaaatttgataacaaatttttggttcaaaaatttgaaccaagtttttgaaagatacaatctactgaaactcacactaggagaaatagataatctaaataggcttatacttattgaagaaattgaatcaacaataacaacttaccaaaacagaaagccaccaagcccagataacttcactggggaattctaccaaacatttgaggaagaaataatactccgtacaatctcttccagaaaatagaagcagaggaatattttctaactaattctacaaggccagcattactctaataccaaagtcattaaaaaattaccaaaaaggaagactacagaccaatacttctcataaacatagatgcaaaaaccaccaacaaaatattagcatattatatccaacaatgtataaaatattatacatcatgaccaggtgatatttattccatatatgcaagaatggttgacaatttatacattaattaatgtaacccatcacatcaacaggctaaagaaaaatcatgcaatcatatcaatacatgcagagaaatcatttgccaaaatctagcaccagtcatgataaaaacccttagcaaactagaaatatagaggaatgctcccaacttgataaaaaaaaatgcctacaaaaaacctacagctaatatagtacaaatgaaaagtctctcttctccctgccctcatgcctaagtcagagtctcctaaagaaccgaacagctgaggaagctcttcattggagggctgagctttgaaacaaggtgagagcctgaggggccattttcagcaatggggaatgctcatggactgtgtggtaatgagagattcaaacatcaagagctccatgggctttgggtttgtcacataggccactgtggagaatggggatgtggccatgaatggaaggccacacaaggtggatgggagagttgtggaaccaaagagagctgtctcaagagaagattctcaaagaccaggtgcccacttaactgtgaaaaacatatttgttggtggcattaaagaagacacagaagaacatcacctaagagattattttgaacagtttggaaaaattgaagggattgaaatcatgactgattgaggcaatggcaagaaaagaggctttgcctttgtaatctttgatgactatgactccgtggataagacggtcattcagaaataccacactgtgaatggccacaactgtgaagttaggaaagccctgtcaaagcaagagatagctagtgcttcatgcagccaaagaggtcgaagtggttctggaaactttggtggtgatcgtggtggtggttttggtgggaatgacaactttggtcgtggaggaaacttcagtggtcatggtggctttggtggcagctgttgtggtggtggatatggtggcagtggggatggctataatggatttggtaatgatgccagcaattttggaggtggtggaagctacaatgattttggcaattacaacaatcaatcttcacattttggacccatgaagcgaggaaactttggaggcagaagctctggcctctatggtgatggaggccaatactttgtcaaaccatgaaactaaggtggctatggtggttgcagtaacagcagtagctacggcagtggcagaagattttaattaggaaacaaagcttagcggaagaggagagccagagaagtgacagggaagctacaggttaccacagatttgtgaactcagccaagcacagtggtggcagggcctagctgctacaaagaagacatgttttagacaaatactcacgtgtatgggcaaaaaacttgaggactgtatttgtgactaattgtatgacaggttattttagtttctgttctgtggaaagtgtaaagcattccaagcattccaacaaagggtcttaatgtagatttttttttttcacccatgctgttgattgctaaatgtaatagtttgattgtgatgctgaataaatgtcttttttttttaatgtactgtataaagttagtctgctctgaagccatcttggtaaatttcccccaacagtgggaagttagaattccttcagggtgatgccaggttctatttggaatttatacacaacctgcttgggtggagaagccgttgtcttcagaaaccttgctatagttgaactgatagttactgttgtgacctgaagttcaccattaaaaggaaatagccaagcaaaatcataaaattattggttataaaaatgagtgttggcacatcttatgcaatatactaaattgaataatggtaccagaaaaaactatagatgggaatgaagattgtgtaacatctattatcatgtgtaatcaataaatgatttaattctcttgaagaaaaaaaaaactagatgctttcccactaaaataaggaaaaatgcaagaatgtcccctctcgctactcctatttgccattgtactggagtcctaggtaatggaataagacaagaaaaagaaaaaaagggtatatagtttgataaggatgaaataaatctttgttcaggaagacatgtttgtctaggtagacaatctcaaagaaacaacaacaacaaaaactcttagaactaagtgatcatagcaaagttgcagggtacaaaaaaagtcagcggttttcctatgtaccagcaatgaaaaattgaaatatgaatttcaaaacacaatactatttatgtaagcagcaaaacttaggcatacatctaacaaagtatatagaagatatatattaataagagtacaaaattcttttaaaagaaatcaaagatcaaaatcaatggaaagacataccaaatatgtggataagaagactcaatattattaagatgtgagttctttccaacttgacctgtgaattcaatgcaatctccatataaatcctagcatactttgaggatattgacaaaccgattccaaagttgaagtggaaagcaaaagacccaaattacacaacacaatactgaaggaatgcaatgacagagagttgacactaccaaacttcaaaacttactataaacctatagtaatcgaggcagtgtggtattggcaaaagaagaaaaaaaataaatcaaggaaaaagaatagagatttcaggaagagacttagacaaggtagaaaaggtaatcgaatggagagaagatcctattttcaaaaaatggtgctggaacaactagacctctacatgcaaaaaaaataaatatagactccagattttactaatttcacaaaaattaacttaaaataaattatacaactaaaaataaactgtaaaactataaaacctttagaatataacataggagaaaatctaggtgaccttgagtttggcaatgactttttagacacaacatcaaaagcacaatctatgagaaaaaattgtaagttggaatttattaaaatttaaaactttgattcttttaaatacaccattaagacactgaaagacaaactacagactgggggaaaatctttgcaaaacgtatctgataaagcactggtatccacaatatacaaggaactcttacaattcaacaataagaaaacaacacaattaaaaaatcggcaaaatataatatctgaacagaaaactcaacaaagaagacgaacacttggcaaatatgcatgtgaagaggtgctcaatatcatatgttattagagaactgtaaatttaaaaaacaatgagataccacatctattaaatgactaaaatccaaaacattgaaaacactaaatgctggtaaggatgtggagcaacaggaacttgcattcattgctggtgggaatgcaaaatagtgtagccactttggaagactggaagtttcttacaaagctaaatatactcttaccatatgatccactttcctaggtatttgctcaaatgaattggaaacttatgtcttcaaaaaaattctgtacatgaaggtttatagcagctcaactcgtaattgccatatgtggaattgattaagatgttcttcaatgggtgactggataaactatggtatattcataaaatggaatattcagtgataaaaagcaatgaaatatcctgccatgcaaagacatggagaaactataacaaatcttgttaagtgaaagaagaaaaggctctacactgtgtaattccaaccctatgacattctgtaaaaggtaaaactatggagacagtgaaaagataagtgtgtgccaggggttagggtaggggtatggataaataggcagaacacagagaatctttagggcagtgaaactaaatggtggataaatgttatacatttctgaaaacccacagaatgtataacacaaagaattaaccctaatataaactatggacttttgttaacaattatgtattaatcttggctcattaattgtaacaaacatactatattatggtaagtttttaattataggggaacgtataggtggtactgaggcattttgttggaactctctgcatattttgtttaattttctgtaaactttgagattctctgaaaaaaatgaagtccattaatttttaaaactctgctccctagaacatgattttaggagccactaacacctggcttcaaaaacagacatgcagggatggattcattaaaagtgaatgacaaaggcttggaaagttcttcagaggacaataaaatagaactgtagaggccctcttacagctcttataaaacaagcaactgtgtaaattaaatgccaaatggaatccagatgaaaaaaaaaaaacacacacaatttgtcttaacggaatggatatatttgaaagcactgcaatgttttagataaagaaataaataatgtctacttttagaaaaatgaatttctttcactttccccaatatcttaaattctcagttttctaatattatagataatggaattattaatggattatgcagatatttaaggcactgttattttatcagctattcaaggttcaagacacagttctaaagtcatataggctattaatttggttttatgtgtttatttcaaaattcttttaaattagttcaccatgtatttgatctctttagttggtcataaatcccttgtcatctcttccccaaaacaaaactttggatatggcaagctttctaccaatggtaactgaccaacttaaaatctgtccctgaaggaaaaattactatttatctcaaatctgctataattattttatgtcagcctacaattgctgtggttggccaactagaatactttctttttgctggcctcttattatcatgtatgaaagatgtattgattctcaacatccttttattattactttagtatggttttggcaagtggaacttcatcttgtctagttgtttgggagcactagctacagtctttctccatgggtctgaaaaccttcacaacatactggagaaaagacaggccttccattgaacatttactgaggcataaatcatcaccctacaagataatgcgatgttttgaacaactttaattgtttaaattgggaggttcttatgtggggaacaaatttttccttctgcaactgtcatatgttggttttgccatacacaccagaaagtctgtatctctcccacacacatctctcccttccatactaaatatgtattttttctggctaaatattccttgtccttcaaattcaaaatttaatccaattcaaaaattaatgtggttaccatgatcttgacaaaatctacattgtaattaaggtcttttaagatagcccaagaaccaaatgtaatattaattgtattaccactaggatggcgtgagtgatgcagtcacctcaggtgcaaaatctaagggagtgtcaaaaaactcggtaatcaaaataaataatattttaatgcaatatttgcaaaaataacattaatcaaaataatattttagtgcagtatttgaaaaaaataaaaattaatgcaaaaagttcaaatggacaaggatttgggtgtgatgggtgagatgagtcatacaagtaagtacaggggaggctcctgtcttttttggacatttcaatttcttggagttaaaatcctatttggatattagagattcaacccttgaaaggagccagcctaaagacattgttccatttgtactcatttctttttttcaataataattttaatttttagtttagattcagggggtacatgtgcaggtttgttacatgggtatattgcatgatactgagctttggggtatgactgatcccaacacccaggtagtgagcatagtccctagtaggtactttttcagcccttgcacccctccatcattccccccaccagtacctgccagcgtctattgttctcatctttatgcccatgtatacccaatgtttagctccctcttataagtgagaacatgtggtatttggttttcttttcctgtgttaatttgcttgggataacagcctccagctgtatccatgttgctgcaaaggacatacttttattctttttcatggctgtgtagtattccacggtgtatatatattacattttctttatccagtacactattgatgggcacctatgttgatttcatgtcttcgctgttgtgaatatcgctgtgatgaacacataagtgcacatgtctttctggtagaataatttattttcctttgaatatatatccagtaatgggattgctgggatgaatatagttctagttttagttctttgagaaatctccagacaactttccacaatgactgaactaatttacattcccaccaacagagtataaacattctgttttctccatagccttgtcagaatttgttatttattgattttttagtaacagccattctgactggtgtgagatcgtatatcattgtggctttgatttacagttctctgatgatctgtaatgttgagcattttcttgtatgtttgctggctgcttgtatgtctttttttgagaagtgtctgctcatgtcccttgcccactttttaacgggattgtttcttgcttgttgtattgtttaagttccttatagatttttgatattagacctttgtcagatgcatagtttgcaaatattttctgccatcctctaggttgtctgttaattctgttgatagtttcttttgctgtgcagaaactcttcagtttaattaattagttttatttagtttaggtcccacttgtcaattttggtttctcttgcaattgcttttgaggacttagtgatgaattatttaccaaggccattgtccagaatggtatatcctaggttttcttctagggtttttatattttgaggtcttatattaatctttaatcgatcttgagttagtttttgtatatggtacaaggtagcggtccagcttcattcttctgcatgtggctagccagttattccagaatcattattaaataaggaatcctttctccattgcttatttttgttgacttggccaaagatcatatggttatagatgtgcggctttacttttgggctctcaattctgtttcattagtttatgtatctgttttgtgatgtgtataaaatggtcatttctaggaccctttgtgtgcaatgtgtgtgtccagaggtaccagtaaaaaccctgcctcggcttctgtttcagtttgctacaactgacactgtctctacttcttaccaaagctctcttgagttttcctgtgcctttgtctcgagcccacactgcaagtccttagtgctggatctctcttgatgagcaaatacatctgggaaagcccatttctgactccactttaactggcttgaattagaatgctttttgtacttgcacacaaaataccagaaatcttatccaacttgattttcgaagaatggagtttataaagatataggccttttagtccgtattggcttgtcttagttattgaacagaatcaaaacattccatttttctataaaaccaagataattatgaaaaagtagtttttcatatcaactgatctattgaggcttatgttcagcagaacctacttggtaagtttaaactggggatggaaacaggtcaggatactaacaaaatgaaataaactggttttttttgttttgttttgttttgtttgtttgttttttgagatggagtctcagtcaccaggctggagtgcagtggtgcaatctcagctcactgcaacctctgcctcccaggttcaagcgattctcctgactcggcctcccaagtagctgggactacagacgtgcgccaccatgcccagctaatttttgtatttttagtagagacggggtttcaccatgttggccaggatggtcttgatctcttgaccttgtgatacgcccacctcagcctaccaatgtgttgggattacaggcgtgagccaccgcgcacagccaataaactcttctttaacctgccttatgcaataaagtccctgtgccccaaagttgtcttagaaaagacagcctaagtagttactgtgctttggacttcacagcccaagtacatcacaccatcaatatcctctttaaaagccgggagtgaggttttataaaagtatgctttaaacaaatggcagcaggaaattcaaagttgggtaattcatattgctgctataatttgtttgcacctaaaaagaaaaatcgtagaaaatgaagcatcattgcctgcaggtacagacacgtatggtgtctgagatcattgttattctcttcctctcatttttctcccatatcctcttaatggaataattacattattgtaatttacttgtatataattcaggcaagctaagcacaaccaataatatgtttcttcagaggaaaaaaacccaaacataataattaaagaataaattagttactgtaagtagcaagtattccaggtttggggagaaagtgtaggagatgatcccctcagaaatggacaccagtggatggtaacatgtgtgggaacaagagtgattccatcttggatgctaatctgccatgttggctcctgattaaccctgagtctgggaatgcctccaaggtgtctagttgatgatttactctctatgtagaaacacttatttactctgagttacacctttcctccacaacaacccttgatcttgttgcatacattacccgtagctgtaacacccatagcattctctcggccacccactcattccttccagagcaaatatacttttcctccaggatatataaaccctgggtctggaaggttgtagtgcgaaggcctacctttcttgtggccacccaagaccacgcttctgtctgtaagttccccaataaatcacccttttccaacacactggatttttctgctctgttctttggtttcttggctccttctgtatttggtggacacttcgcatatatgaccctttcacggaacaatgtgaaacttaaacatgcagcattttgggacgatctactttaagagatgttctgtaaatgatctgctgtgtaggccatgacatttcctcaggctcaccactgaaacatcaacctactataaaatgataaaacatgtgctttaaatgtgagcactctaacatatttatgaaagatgacacaacagatgggcagaaagaaacactgagaatgggaattttattttctttataatttttttttttttttttttttttagacggagtctcactctgtcatccaggctagagtgcagtagcacgatcttggctgactgcaacctccatttctcaggttcaagcgattctcctgcctcagcctcccaggtaagctgggattacaggcacgccctaccacaccctggctaatttttgtatttttagtagagatggggtttcgtcatgttggccaggctggtctcaaactcttgatctcaggtgatctgcccgcctcagcctcccaaagtgctgggattataggcgtgaaccactgtgcccggctgggaatttgcttttcaacagggaaaagaggcagtgtatctgccaggcaataatgatgacaagcacaaaacactaatttcaatgtattgagtatgtgagaggaccaatactagtttccttagctgtattaatttgaattattttaacaactttaggaagtcaatatgatttctgtttgaaaagtgagcaaacttaggctcagagatattgcacgcctaaagtcacacagttggtatgtggttatgacagtatttatgttcaggtctgtctgcctccaatgcctgggtttttctctatgagctccctcttagctgttccagtgttcctccactagaatttcatattctttagtgagacaatctccaggcattatcctagcttgaataaaatgctccagaaagttctccaactcaaatctacaaatcagtagtcgttttgtaaaataacttctttctccaaggacctcagttttgaggaatgtgtgccctggatgaagaaactggcattctcactactggaaagaaataattttgtctccgtattaatttttcggtattctggtttttagatttttttttcatgagttatgttagtttcgactcttttgactagagcctgaccattcttggatgatcgactaaattcaagtttctgaaatgacacacatgagagatagctttattgattttctatgaattttcttattttttcttcttataaaaatgtctctccaggagcaacaccaaagaaagccaagctgctgcaaagcttctcactgcctttgtatattatgccagctcctctacctcaaacgcttgccctgccttctcatctgaaaaatctttcctcttaagatccagctcaaatggtaccagttctctcgcaaaatcattctggaagaccccagggaaagtcaatttctcattcttttaaacattcacataattttgcatatatcactctcctattcacttgacactctacagtaactccttctgtataatcctattttcccatctagcctgtgagctacccaatggtgtcaatgaactcagtcccctttgcgaacctagcatcttctactgcactggcataggaagaaaaatactcaataaacacttgcagaaatgacatttaaaaaccatgcaatcttgtctttgaaaactgtactgttcaggaagatctaagaagatgaatacttactaggggctctttttctccttgaagagcttgagtgaaataatggctgttgaaccaagtttgttctaagttcactgaacttgatttattagcattgaattttcttttttagcttttttttttttttttttgcttgtaattggcctcttcatgtttaacacaaccctccacctataaaaatcataggatacttcacagaacagtgagaaaagcggacccttgggacgtcaagggacttactaaaaagcacacagctaagtgggagagttgaactagaactctggttctatgggtctattttttattctttctagtaggccaggttgctatgacaaaacaataacccctttaagcttatttacagctctttaacctaatcagaaggctttctttaatagttgcagagggcaccataccacagagaaagttgtcacgaggtctggtgactttccaaacaaagccgcttatcaattcaatgttaaaaatattggtcccatcctgagaactgtggtttccttttcttaatgaaaaaagcaataaaacgcaagtacacatccatctacacatacaggctgtcaataataaaataatgagagatggcactgaccataatctgtgttttccggctcccaacaatttgatggccaaaaatagggggtctgcggaatgaaaagaagtggaacccagattagacaaataaaaaattagtggagtttctggccagtgaattacatttatcttccacaattctctatattagtttgctatatgttttataatacagaacatgttccaagagagacattgaaaactctttgtctacatgtactttgctgaccaattgctcagcttctaaacatgtgtagtaccagcaagcaggtatttagaatgtcatccctttgctgtaattttacaccaactgacataaaggcaaaaaggtctgattgtatattcaagcaaaaagtattcatccacagagaggactgaaagagtatgttcggcaagactcaggatgaaatatatttaaatataacaaattgttttctatgaatcatgtatttcaacactgcttttggtagctccaaaaagctcaaccaaccgatagactctttctctgagatctgacaatgatttgcctggctccattagtcatataattcagttctcagcattgtccaatgagattaaagcaactttttactctcacttttaaagacatttcctaaattcctcttgtaactaatttctaccatttagtcgtgcaacagggtgactcgagtcaatagtaacttaattatacatttaaaaataactaagagtgtaactggattgtttgtaacacaaagaataaatgcttgagggaatggagatcccattctccatgatgtgatgactccacattgcatccttgtatccaaacacctcatgtattccatacgtataaacacctattatgtacccacaaaaattaaaattataaaatttaaattaaaaaaacctacaaaaaataaataaaaatagaaacatttccttacaaagacacttgtttctctaaagttttaaactgcacaaatcagagattttttttaaaggaatagtgtcttaattgagtgatacaatctgcaataggcagaatccagattctgtagaatctagaaactgactgactaaactacaaagaaaatgtctgaccgagagaaactttattattatcattaacatttatattttctaaaaggactttcctagccctgctagctgaacatgcttggctcctgaccacgaagaaacctgatgatcacctgtctccttatcaacccctagtccctggaatgatgaggcctgcaggactcactgtaacagtgatggcaaatatcagtactgtgggcttaattctatctgttagctaattacactaactaccatgtgcaataagcatatttggagtcatctctgattatctgatcattttcccctctagaagagagactctaaagaagggaaaatgggtagatagggagaactgtttgaatctctacagaaaagtctttccaaactgtctcagaggcccccccgactaccatcacccagggatttcaacttaccctccgttctttcttgggaattacagtagtaaaataaagaaggctactaacagtagttttgtgaacatgagaacaaaatcatcgtaggaattctgaagaaagaaaaaaagactaaactgctagacaaaagaggatagtaagactttatgtgggtcacccttatcaccccaatctcacttgactccataggagatgaagctttgagaattcgatttcttaaaaataaaattgaatcaggattctaggatagccctagggggacaaagtagttaaaactttgctttcatgtagggtgtcactttttttttttttgagacagggtctcactctgttgcccaggctggagtgcagtggtgcggtctcagctcgctgcaagctccgcctcccgggttcacgccattctcctgcctcagcctcccaagtagctgggactacaggtgcccgccaccacgcccagctgagtttttgtatttttagtagagacggggtttcaccgtgttagccaggatggtctcgatctcctgacctcgtgatccgcctgcctcggcctcccaaagtgctgggattacaggtgtgagccactgtgcccggcctaaaaacgattttctgatatgctatttcttaggttttataagagatatatttctactttggtatctttctttttttttttttttttttttttttgagacagagtctcgctctgtcgcccaggctggactgcagtggcgcgatctcggctcactgcaagctccgcctcccgggttcacgccattctcctgcctcagcctcccgagtagctgggactacaggcgcccgcaccacgcccggctaattttttgtattttcagtagagacggggtttcaccgtgttagccaggatggtctccatctcctgacctcgtgatctgcccccctcggccccacaaagtgctgggattacaggtgtgagccaccgcgcccggccggtgttactttctgagatgcttcttacggagtgcattgttccctctgggtagtttctatattttggggagtatatatgtgtatgtataggtgtgtgtgcaggcatatctatttatctaaccttaaaatacctattctactcagacaagacatatacttttttcccacaaaagcacaaaaaatattctcaactgcattcttatatttttcttcattctccatcatttactttagtgagaatttaatgactgtaaaattaaagcataaagtaattttttcttgtgatattatgtggaaatgccactaaaccaatgttcttcactaatatggaagattttttctaagaagtagtgttttgatctgtagtaaacgataatataggagaacaacaaactcttacagttttttttggaatttaaatacatactttcatagttctaccatacattaggacattttaatgcatgagtttcttgatttttcaatattggcttccttagctaggatgaaactcatccaaaactgttcaactgttgttcaataactgttggagcatatactaatgtattgaaagtcatgaaagagagctaaagaattacatcagatctcattttcagttagctaagagaggatgattagacaattgtgactttacggtaaatttaaaaaatcacatgattaagacatgtactacaaatttgagacaaatatataaactgtcatgccaatgaaataaagatttctgtttatctcaaattaatgctttgaagactctttagatttttttattattattattttgagatggagtctcgctctgtcacccaggctggagtgcagtggcaccatcttggctcactgcaaccttcgcctcctgggttcaagcaattctcctgcctcagcctcccaagtagctgggactacaggcacgcaccatcacatccagctaatttttgtatttttagtagagatgacgtttcaccatgttggccaggatggtctcaatctcgacctcatgatctgcccacctctgcctctcaaagtgctgggatcacaggcgtgagccactgcgcccagcctagattcttaatgatggttagactcccaatcattcactggaggatttgtaaacacggcatcccaacttttctactttaatttatgattttaaaatatccttccaaggagttgaatttcacttcggtgtaataaagaactttcgctgcttggaaccaacgtaaaaacagaagtgaagaccttgaataataatttgttttctattattggaactcttcaaatatggactggttaatgacttggtagacattatagtagaaattcagttacctctgagttttctggtgttttttaaaatcttggtttcagaactctaatattattagatttacaaatgtgtttgttatatttagatactatttcaaatatggatgcatcattaaaatatgtaacatttactatttagcactaatgtaattttaatgtgtatatgtatagatagtttattttatatctgcctatctatctcagcacactgaacttgacaactctctgtctatccctagtagttacataattcatatgtcatttgtacccattcccttgctttgttctaaagctcttttaaaaattctctccttttctcctgtgtgtatggtgatcccttccttcacatggcttttttttttttttttttttttttttttttgagactgagtctcgctctgtcgcccaggctggagtgcagtggcacaatctcggctcactgcaacctccatctcccaggttcaagctattctcctgcctcagcctaccaagtagctggaattacaggcacatgccacaacacccagctaattttttttgtttgttttttttttagtagagatgaggtttcaccatgttggccaggctggtctcaaactcctaacctcaagtgatagcccgccctggcctcccaaagtgctgggactacaggcatgagccactgtgcccggcctcggtgcccttttagacccatgagcatgactaagacatgtaaaccttgtctgtctactacattttctgggaatagagatttctttaaaaaaatcaggaagcattagtcacataaaaacaatttatttgctgatcaccaataattcctagttattaaaaatttaatcttggggccagaagttactttaataatatgctattttaagctaccattagtgtaagttttgctgtataaagaataaagctccattaatgtaaagcttttttaagttacgtaatttaactaagtgcttgaatacttaggtcagtatcacagtttcaggatacagctttatttcctcctagctcttaagtccaaaactgtcctacgattatttgccttggaagaaatgagtccaaggaaggggcagtgagactgttctatgaggacaataatctttaaaatgattttttaaagcaaatgattaaagtgatttttaaagcatatttcctctttgttctcagttttcccaaacaaattttaggtactctgattactattcagtcatttatgtagacatagagcatttaataatacttagaacaagtgagaagaaggctccaaagtctgaaagttggactgtggggagaaccctccagcaaatacctcttggaaatggattagagtttgacatccagcattttatgtgccttaattttacaggctagaatctgctaatcagttattaatgagccataatgtctactgaaatgtagaatatactttaggtaaatcaatgtgaactcaagtgtcaaatatacttacaatgactgaaatcagagtccacaatcattgccagaaagaataatagcatctgtgtcatttgcaaatgacctagaatgactcttatcagtttgcaagttatctgaggtgtcctgttgcagttgagtgcacacacacaatatatcatcatgtcagtctttacagatttgtagaagagcctaggatgctgagagtttattaattagctgaatcctatctggagtttcaagcattcctgttaaaatttacttgggctgaagatggtctggatcacaggcaagggtcagacagaggaagactctccggtccttccgaatgccattaagtcactttatgaatttcccttaagcttttcatataaaatagaaattcaatcatcacacaatttagctttcacacatcatcttgactaagcatactttatctttctctgtgtttattgctttttatgtctttagtttaatgttaatcagtttctaactagcctaagtcaaagtaaaataagtcatagtttttaaaagttctgttcaaaagaaacctaactaacaaacgaaatgcgggcttctagtttactgttaaagaacatttctaataaacttacttgaaaccggtaaaaggtgccatcatccttgagtgtgaggacatgatctgagattggaaagaagtagccgtgggcagccattaatgttcccaaatggagcgcctccactgttttatgaaaacaaacaaagaacataaaaaagccttttaaatgtattcttttataggaatgtaacgtttttgtgtggttccttttgtcagatacagtaagttcctcttgaaagatttaatttctgacttccttgttctttgctctcgagataaacttccttgtcccttctcctaagctacctgctctgtaaacaacttctcctaccagtcccagtctgtaactcacatctcttccttatttggaaacagtcctcctttactcctggctacccattctgtaaactgcccctcccactgaaacaggtcttccagccaaaactacacttcctgcctttgccgtgccctgacatgcccaaacatgccttgtaccgaaacggacagcctctcccttcccacctaattagccatattcaattttaaacagtagccaatcgggtcagtttagattgtgtggtacgactccagccaatggggacaggacacagaagcagggactaatagcgttagggataaaaaccccttccctcctttgttcggtgtgctctcgcagtggccagaagtgcgagtggcacccttctgcagaagtaaatttgccttgctgagaaatcctttgtttgagtgctcgttttccttgcgactcccagctcttgtttctaacactttagagtacattcttggcattctgaaaacctggctttgtgctttttcttcttttttcagctctttctcacaagacactaagatggttctagttcctggtagcaactgccatgaccaacctcatccaatgacaacaagtccatgagaagataaagttaagaaacattaaaatgggaaggctcttctcaatctgtagagtatgtctccctcattttatagatgtgtgttggcccatgtgataatgttctctcacaggcagttgcatttggcatttatagcactttaaacttttaaaagttttcacttgcatcacctcattctcaatatcatagcaatctagtaccatcagtaatgtttctaatgatatggaccattattttgtgatgctatgagggaatgttaaggcatcaaggaccatgtatgctgcactattgaatctacagactggtgattgtaaagattgttctagcttttactattctatacagtgttctaaatatggagtaggaagagatttattggacaatgtaaacatatagtctgaaactaaggctgtaatactcatactgtttatagctgccaacaatttcttccaacaaaagggttagtaaaatttggtcaatagttattactgcgtttgtgcagagatgacataaagttttctaacttaaaggctagaaaatatgaaattatgcaaaatagttttctaccccaacaaaaaaaatatatgtacagttgtcccttggtatcctcaggggattggtttgaggacctgcacagataccaaacatcaaggatgctcaagttccccactttgccctcccacatctgtggatttttgatcatgggtggttgaatccacagatgtggaagtcataaatagagagggcctactgtatgtagaaaataccagaaaagttagatttatttatctgtttatgtatctttatgtataattcatttataaatttatttctgtttcttagtcaagaagctaggattcttacagcagttctaggacaacatggatctatctatatctccagccatcaaccatggggagcttttacacctcagttaagaactgagtaactaagtagctagctatggtacagcaaagcataagaatcccatccttttaccccttacacctacataaataaacaatttgttgttaaatttttatctgttttggggtactatgatgccccttgaaattgttatctagcattttgcaaacatttcaattgataacttctacctctgatctctccctgcattgttcttgccgataataaagaacaactgccaattattcttcattctttgccctggctttggaagactgttactaactgctccagccatcatctccaaactcgcagtcaagtctctctgtatagaatgttgttttttgtacagaggagcatttttttttcatcaattttgtgcgtgtgtgtgtgtgtgtgtgtgtgtgtatttccatcatttcaacatcctttcagttcaaagtcaaggccttctcaaagcatgcattgctcatagcaacatgcctacctatccttgttaaaactttagtgccagggtgtcattgtggaaagaacaagaactttggagacacccactgtcttctgttactttcattctctgtgcctcccccatctattaataaaggtcataaacctacctggcaggattgacgtgagaatgacataagcacacttgtaatgaaattggaatcatgcttccagcctagtaggtactatgtatatggtagctactgtgcttcattatttacacacaaaataatttttacttttctacaaaccactttcagagaatctacttccatacatttgccttctgctaggttgagtgaatatttccaacacaaaaaaaacataaaactttgaagtgatagatatgttaattattctgatttgatcattgcacatttcatgtattgaaatattactctgtaccctataaatatctaacaaaagttttaaaaagctaggctgagtgaggaatcctgacagtcctaagcagccacgttcatcaacatcatcttattctctttttttttgactgtctgtaaaattaaaatggtaagaggatctagaaagatagttggcccataacaaatgagcaggtggttatagtcctggttaaattctgaatccctaagtacccctgtggacgagtgaagaatatgccatcccaaaataccccagattgtttcaagttgaaaacactggatgaattgtagtttcagaaagggctagctggcctatctcttcctatatgcagcaagccataaagattcctctgggaggggtatcttgcttttgccagggcaagaaaatagctcttatcaccagagactgggagttgggggctgcaatgaacctgaataaagggctggatgcggtggctcatgcctgtaatcccagcacttcgggaggccaagacggatggatcaattgaggccaggagttcaagaccaccatggccaacctggtgaaccccgtctctactaaaaaaaataaaaaataaaaaacttagctgggcatggtggcaggcatctgtaatcccagctacttgggaggctgaggcatgagaaccacctgaattcgggaggtggaggttgtagttagcagagatcacgccactgcactccagcctgggcgacagaacaacactctatctcaaaaaattaaattaaattaaattaagaaataaacttaatcaagtaacccctactttccactagttttatgcccccaatatattccctagtgattctgctagaaaatttactgccttcagccagattttctttgttctgtcatttttttcttaaatttattattgtttgtctaaaaagtatagaagtgtcttgctttggccatttcttcagacttcacactcttgtgaagatccccatgtacatgtaaaactaataaaatgtgtatgattttctctattaatctgcctggtatccacctggtctccagatccacagaagagcttaggggggttgcagatgatctctgacttccttacacctgttagggaatatagggtggggcaacatgtaacatcctttgtaggtggcccatctgtcttcgtatagccatctttattattttagtcccagcagtctgtggcctgggaagatagtgttagcacactttcccggaagaaaaattaagttacggcacataaggaaatctgcggagtatagatacaagaagggaaaactgagatgcccaggaagatagacagtaagaggagcttctgagttctaagcataggaaagagtgtgactaaaaccaagccaaggaacaacaaaaagcaattgggtgttaaagtgttgatgaggattagaaaaatagagtgaaagtaaatatagagatgctacaaaaaagaaaaacagaagtgagtgatcataagactattcttgactcctgcatctcattaactactaatttacaagttatatacttatagagtgcaaagtgtatgttggcaggttcttcttcatgtaatactaccataattagtcattaataaatgcttgcaaatgagtatgagtgaattagtaaaattctccttccttttttgaggtacaatattttcatttgatttgatgatatgcattctcattttacttctcttctgagtgatacttatgttccataattttacaattaaggaaaatttgttttgatacttttgcatcatgtcatgaatttagtagaaatatactggtggtgatacaggtaagacctagatttaatttctatgtgagtcacacacatttcatatgtcaaggtgaaatcaaaccttttgacttaatagttaagaggactgatcttctcacaatgcttacaaatggttttaagatttttggtcaaatagtaatctagaggtactgaaataataatagatattttgtgttcattacaggatctccagaaaatatagctccagagcaggataaatgcctagatgaaaaatcagaaagttggggtgaattttttgcttcatttaggatgacaagtttagcactcagcatatccatggcaaaagtagcaagtgaatcaatatttgctaaatcaatgaacaaggacatttatgagtaaatgacacaccaagaatattaaaaacctaacactgcatagaaaaacaccaggctaattattgtgtgttataagctgttgaggtggggctattgtagctattttgttgtgagaaaatataatagtgatattaacaagataaatgccagtaagaatggacttggggcagtattctcaagacagacttgtttattgttagggacaaacatggtgccacagttccctgtggtcccactgctccgaaatcttagcaccatcttaatctaataagaatccataagaccgctgacaatcttggaacaaagtgttgaaagagtttactgagtaatctgtcaagatcactctcccaataacggcacaccagatggcccagcagcatcacgcttcacggcaaaataatcgctaattaatcttctcgtacatgtgttattctcttcacccacacagctaaagttcaacaataaacctactaaaaaattccagcttatttttttgtttggatattcaagccatgagcaagctgagaaacaaaaatcaatctccaaacacctctgattaagtgaacagcctagaacagctttgttaagcctgataccaacataggatgatttcaccccaaactctaaaggaatggtattatcaacatcctcggatagcgaagagaattctccacagcataatttgcttttgaccacaacgatttcaaaaagttaacaggatgaaaaccacagtataaaagaggcttgtggaactccaggggtgcaatcggttagctcacggtgcttataaaagaggcttgagtacttgagtgtaaagtactctatatttacaatgtaattttaaaactcagtaatatttttcttacccagaggctcaacttcttgcagcctcctcttcttttaaatacagctcataattttgcaacgattaataaaatgcctctgagtcaagaaagtaatttaaaaacttcactgaatcctgtatttttatcactatcatgttatttactcttatttatgtgcatgtattaacatttttttcatttccaacacagtataagtatcagtagtgtgtggggagaaatattttaaaagaaaatctaaaaagaaaaaagatggcagctgattatattaaggaaacagagatgctaaaatgaagacaaaggtaagttacttaatgataaaataacaggtattcatcaggacaattctgagccataaaaagaagatatgttagacttgttactttctgtttaagaagacatggaagtggtcattttagaaatccttcaaaatattatgctttattttttagaactggcatttggaaaggtaagattattcatgtagaaaaatctcatatgcggaacattttattctccaacaaaaccaagtaaaaatggactattaccatatttagaaatttctgaagtaagtttattttctcaacagtaggagttagtaaaagaagtacctcagctttcatctttttaaaaaaaacatcatttgcatgtaagaaaaatcaagtgccgctttctcaacagcaatcataattcgggatagagaagtgaataataaggtgacatagaatagataagctaaaagagattctatttgggagaaataaaaacagaatcataatttatatcaacattgaggaatgcaataagaaattaatataagtaaacgctatttccaaaaaaggagcagagtacaaaggctatgccagtcccctgcctaggttcacatcccgggtccctcatttgctggctgtgtgacctgagcaagagacttggattctctgggccttggtgccctcatctgtaatcatctgtaagaagttgacaaaataataatgccaaagattagcagtaaggatccattgagataatatgcacaatgcacttaaaacacagtctaccacacagacatgctcctgagatgagagttattatcagttgatacttatgaagtgtcacattcaggagcacttaatctagtttaaggggcgatgggaaacattagtagctagtgttgctctgggtttcccagtcatgttaaacacttccaattcaactctattttaaacgccccaggtgatcaaaccagagtgttttgtgggctgaaatatgcctatgtttttccctacagcaaagaacactaacaaaatcccaaaaagaaattagggacaaacttattatatatcacagggatagccacagatttccaaaggcggcatgctccacacgctaggtttacaaaaccatactgtgaataccagatgccaatgagagacctgcctgctttagaggaggactgatgtgaggacaccctgaacctgacagtagaagaataacagggacagagagagcacggggacagcaatcagaatgggagatgaattcttagggaagcataatatttgcctaggactaaaaaaagaaaatcgacattaaaataataaagcaattggcagtgagagcaacagataatcataagtcaacgatcttttttacacacacagagtagaccagtctagatgtctaatggcagttatgacatcttaggcattctgcatagatgaaaaatcatgctgaaatttgaaaaaatgatccatgtaatactggtgtgaataactggtttcagatctacattatacagcctatatgatattagcatgttcattccccagatttagataggtagttccatcagccaatcctttaacaagattctgttatattatatgtgtgtgtgtgtgtgtgtgtgtatatatatatatatatatatatatatatatatatatatatatatatatatgttaggtgcatagaatagtattcagatgagataaaaatcatgcttacttcatctaagtacagtgtgaggaaaccatcacaatggcaagggccagggcagtaataaattacagtggaaaacaacattccatctaaaattcagtatacattctgcaaaatttccattagttaatctggctgaatgagctggaagaaagtagggcactgaattaactttttagtaggcagaggagtttctacagcatgtatttcttcaaatcagagagagcacacactgccaaacaagcacatgtggaaatcatgggaaaaaaaggctcaactgcaagtcatggggcttaaattctaatcctagtgcctgtaactgcatgtcaggagtaagtcacttcctttcttttgttttgagatggagtctcactttgtcaccagtctggagtgcagtggcgcgatcttcgctcactgcaacctccgccttccaggttcaagcgattctcctgcctccgcctctcaagtagctgggactacaggcatgcgccaccacgcccggctaatttttgtattttagtagagacagggtttcaccatgttgggcaggatggtctctatctcttgacctcgtgatctgcctgcctcggccttcccaagcattgggattacaggcgtgtgccacgcatccagccaagtcacttcctttcttagagctggcatctgtaaatgcagcggggatcactaaagactttttagttctgagtccatgacaagatgtgcagtcaaaacactagctagaagttgtggcagagcagccgccatccttatttttgcctccttgtgtcaaagggaaatggatttttctttatttctcagacattcttgccattgcccatgtcccaatactctaacacgaaagagaaaaatagcccaatacgaaatataaaagctgattttaatttcagttgcttataactcaatcctgatgattctcaagggctgctatagtatagagtttttgtacacagagcaaatgaatgcttattccaaataggaactggttttatgagtgtgttctatttacacattttcaaaaactagttgtaaaaacgcacacatgtcttgggattagccaataacacatcccatgtgccaaaatatcctgaatgcattttgtttgaaaatcaaatatcactcctaaggaataagcaatatagtcttctcataatacctgttaatggtatctcttttaaaaatcactattccttaatatttgaaccataatgaatgataagtctaatttcaaagccacaggcttggtcactgaaacagtcacagtttttatgaaatttcaaaacaaaatcagtggaatgcacttttatctgtattttgcagaaacaaatgcttgaattgagaaaagtgtgtaggacgtcaggactgatgtttgcaacttttgaataatctttacagcaaagtatcattttaaaaatcctagtttataaaagcacatgtatttatcaatttttatttttaaaatctctgtgtgtatatgttggtgtatgagttttagtaactaaaataatctgaaaataagaattttagattttagaatacctaaaatctaatacacaagctttccatgaacctactggatagagatcatctttctcaaaattagtttggaaactagatatgggtaaatttgttaaataagatgtattaaaacattttttctgtttgctgttttaaaaccagcacagtctttcataaacaatttgattgtaattttaaataccacaattaaaattataactactgcctaacaataacaatgaggcaggttcagaatccataatgagtaaattcagatgagttatttaaagtattaacaactcccctcaaaaatccccccctcttttcttcaccattctgcttgctaatttcactattttttgtaattagccagaatttaaacatcagatgtttttaaagaattaaaatcaggctgggcatggtggctcacacctgtaatcccagcattttgggaggccaaactgagaggattgcttgagactaggagttcgagaccagcctggacatcatagtgagactccatctctacaaaaagtttcttaaaaaattagcagggcatggtggtgcacacctgtggtcccaggtacttgggaggctgaggtgggagaattgcttgagcccaggaatttgaggttgccattagccatgatcatgccactgcactgggtgacagagtaagaccccctctttaaaaaacaaaaattaaaaaagaattaaaatcaattagcctccaagaaaatatggtttcataaggttcttttaataaagtacatagtgagacagctttatttccagaattcaaataaattctaggggaggtgggggactgggacaggctggtcaatgggtacaaaattacacttaggcaggaagaataagttttggtgctctattacacagtagggtgactatagcaaataacaatgtagtgtatatttcaggatagctagaagaggagattttgaatgccgttaccgcaaagacatgataaatgtttaaagtgatggatacggtaattgccctgatttgttcattatattatatatacatgcattgaaacatcacatcataccttataaatatatacaactataaggtgccaattataaataggaaaataaattctagatgctgtaggtgatattaacaagaagaaatgtctggagcctcagtggatcagtaatcttggtggacaacacacacatgccccctggtgggaagagtactgcattatatggggcaatggttatgaggctggcctttgagccagactgccctggccccgttgcatcttagcagttctttagtcttcaaaattcaaatttttaccattttcattatgtaataagctttcctataaatgtgatcatcattcttagaacacgtatcttcagactggcttctctcctaaattcctgtatggtattctgaacagcctttgtgacatctccacgtgaatattgaataaacatctcaaattcatcatgtcaaaattgaattgttggctttcatctgaaacccactcttctcgcagttcttctcacctgagttaatatcagtgactttcattccactgctcggaccaaaaagcttggatcgtctgatgtctttctcccattcaccgactccagtccagaagcaccttctgatgatcctgttttgctgtatgttcttagaatctgccctcttatcagccacccacatccaccacctccaccaccccagtccaacctcatatcatcctgtggctgagtcactgcaacaacattcaaactaatttcattcacactttgccctttgctatgatgattatcttaaaacatatattagatcaagtcgctcctgtgcaagccctcaacaatttcccctatttctcaggatcgaaataaaattccttgtcataggctttacaagatcttatatgatctggccaccccagttacttctctgtcttcctttcctatttccttgcccatctttacatatcctcctctagttcacagacctccttgttgctcctcaaacataccaagcatgcgcaggccttaggctttgctaggctctctgcctggaatgctcagaacccttcctccagagagcagaacaccccacttccttccttcagttggattctagccaaagccactacatcagagacaccagccctgactacactggtgtagaagaccgcgtatcttttagttggctttcataaaaaccatttttatttagtactcatcaccacttaccatataacatatttacctatttttttattgattattatcttgtctagtgaatattttaagctctaggtaagtatggacatttttgtctgtttgcttggttggttttagtggtttgtttgcttgatctactctctgacagtgacttaatttctgagatattgcaaccaactaaaaaatatgagagcggaaatggataaaaggatcttacattagttcatagcacaaattcttagaaataaaataggggagccaaaagacgcacatattttttaagtgttgctattttatttatttatttatttttttgagacggagtctgtgttgcccaggctggagtgcattggcgtgatctgggctcattgcaaccacccctccctggttcaagtgattctctggcctcagcctcctgagtagctaggattacaggcacgtgccaccaagcctggctaatttttataattttagtagagactgggtttcaccatgttggccaggctggtctcaaactcctgacctcaggtgatccgcctgcctcagtctcccaaagtgctgggattacaggcattagccaccatgcccaggctatgtatgtctatgttttttaaacgtaatattgttccatctccagatggcatctggagatggcattattagcaataatacatatatagtataacatacatatatattatatatatataatttaaattctcaccaaaagggtataaatgtgttggtatccctgtaaagtagttaaccacttggaattattatttattttctcgttcttcatttgctgggaagaaatggcattttgctttaatttgacttaactggagttatattgaattttagctaaaatgcacagtcttttaatacacagtatgagtgaaagaaaagacatttcaagttgacagggaaggtttcacaaaagggtaggttagactaggaatggaaggattttagactgttggtcaagagggaggtccttcaatttctccccagttctcctaaaaatgctctcttttcttattttctcacctttcaattttgatttgtttcctaggcttatcttatgtaattaattaataaaaatgcattccctttttatttttcaaattctttgctccattatttactcataccaggttttattaatttaccctattagacttcatttcttcagccattcacctgtcatccatccacccatctgctatccactcatccaccatccattcacccatctgctgtccatctaacagataattattcactgtctgcttggttttaggtgcttaactacaagccacagatataaaagtgaaggtgacactctccctctctctaccctcaagagactcacagtgacatggagtatcctgtgctttaaaaagccaaggatgggccgggtgtggtggctcacgcctgtaatcccagcattttgggaggccaaggtgggcagatcacccgaggtcaggagtttgagatgagcctggccaacatggtgaaaccccatctgtactaaaaatacaaaaattagcagggcgtggtggtgcatgcctgtagtaccagctgctcgggaggctggggcaggagaatggcttgaacccaggagacggaggttgcagtgagccaagatagggccactgcactccagactgggtgacagaacaagactctgactcaaaaaaaaaaaaaaaaaaaagccaacgatgacttctggttttaactgagacatttaaagagcttagaagctgtcactctcatcctttcgacaaaagaaaaccaaacaagctgaaaatcaactatttttcctggaccattcagagaagtaaagttgtaggacaaacctccattccaaaatctgcatagacaggctcatccagagacatgaccaagatctacttacttggagcagaagcttttggatccataaactgacagaaacatgaaaatagctcttctgacaaagaacttgagactcagtgtgaactagcttgacaataaggaactcgaggggctcatagtgttggtggggaatggagcacatgccttcatgagctacacttccagaaatcccaccagattctcatggtgaagatccaagaaagatccctcatggctctggcagaagagggaaaagtaatcattgcgaaaaatgcccagagccctctctataacaaaggcctctaccccaaaggaaagacattgtcagacattattctcaccagggaaagggcatttctccaactacagtcccctctagactttgtctctcaccgaagggaggaataaaagcaaacaacattaacaggggcagagcttctacaaaatagtttgggaaagctacagctgggaaaggaagatagtggtgggagacaggggatctatacttctggagaacacttgcaaaggtcacagctccaagggacagactctgaaatgctgagatttcattgaaatattatataattctctcattccctaacaactatccaccatacctataggctatggtataatatcagattacagctgaaagagctgttaagacacaaacattctctgaggtgaaatacttagaggagctcaaagtcacagaagaataaaaataaaagcactagaggaatttgaagcttctgtcatttataaccacagcaaacattaagcacggtccaagtactaaaccataaattagcacactaaaggcctgagttcccattacctaatacaagatgtgcagctttctttcctttctctctctcttttttttttttgagatgggagtttcactttgttgtccagctggagtgtagtagtgtgatcatggctcattgcagcctcgacctcccaggctcaagcaatcctcccaactcagccttccaagtagctgagaccacaggcacgtgcaaccacaccgggctaattttttttatttgcggagatggggtctcaccacattgcccagtctggtcttgaactcctgggcttaagctatctgcctgccttggcctaccaaagtgctgggattataggcatgagccaccctacccagccatgttcagctttgaatgtaaaattacaaggcaggcaaaaaagtaagaaaaacacagtgtgaagaggcaaaacaacaatgagaaccaaattcgaatatgacacagaaattggaattatcagacaggaagtttaaattgtaattaatatgttagggactctaatagaaaaagtgcaaaacatggaagagtagatgaataatgtaagcagaaagattctaagaaagatattcgaagaaagaatcaaaatgaaatgttagaaataatactaaaaaagaaataaagaatatcttgctgggctcattagcaggctacacaactctaaggaaagaatcagtgagcttgaagattaaccaacagaaacctcaaaaactgaaattcgaagaaaaaaataacaaggaaaacaaaaagaacaacaataacaaaagcatccaaaaactgtgggacaatatctaaaagtgtagcataacataattggaataccaggaggagagcaaagacagtgcagcagaagaaatattgaaatgataatggctgaagactctccaaaattaataacaaatgccacactacactcagagagaaagaaaagtaaataacaaaaaaatctaaatctacacatatcttattctaactgcagaaaatcaaagaaaataatcttgaaaaaagcgagaaaaatatccttacctatagagaaacaaaaatatgaatgacagtgcgcttctcatcagaaactatgtgggcaaaaaagagaatacagtgaaatatgtaaagtgttgaaggaagaaaacccactaacctagaattttacatcaagtgaaattacccttcaaaagtagaggagaaataaatattttctcagacaaacaactgaaagaatacattactagtgggcttgccttgccagaaaggttacaaagaagttcttcacagagaacaaataataatatagaccagaaacttctacatacataaagaaagaaagaacatcagggaagaaataaaggtaaaacaaaatctcttatttttcttattcttagtttatctaaaatataactatttgtttaaaataatagtaacagtattaggtgattataaaatatggataagtgaaatgaacaacagcagtgtcgtaaaggaagaaagggatgaattgggaatattctgttacaaggtaccttcatggtatatgaaacagtatagtgtaatttgaacatggagttagattaattaaaatgtatatcgtaaactctagaacagctgctaaaaactttaacaaataagtacaattgatatgctaagagaagagacaaaatggaattatttaaactgctcaattaaaaccagagttggctgaaaaagaaggggggaaaagacacaaatgaacaaatgcaatggagaaaatgcatgttttgtccaaatgcattgcaatacaatgaacaaaatacatacaaatatgtaagaagaatccacatatatcaataatcaccttaaatataatggtctaaatacaccaactaaaaagcagagattatctaagtggattacaaggaaaaagacctgactatacatgtatataataaactaattttaaatataaagactcatatatgttaaaaggggggaaaagagataccatgttcacactaatcaaaatcttttgaaatagtatctaatacagaagcaatattaagtttaggcaaggcagacttcataacaagcaagtttatcagggataatggaaagcattatctaaagagatcaattcttcaacaacaataaattgattatgaagatcacttttctattacaatcctaaatgtgtaagcacttaacaacagaatgttaaaatacataaggcaaaactagagagaactgaaaggaaaaataaactcattattacagttacaaacttcaacaccactttttcattaattgacagaccaaataagcagcagaaaatcaagcagtcagaatatagttgacctgaaaagtactatcaatatataaattgatagtatatcaatgatataaattgacatttatataatgttctatccaacaacagcagagtaaattattctaaagcatacatgaaatattcatcaagatcaaacacatcttgtgtcataaaatagatcttaaatctaaaagaacagaaatcatacaaagtatattctcagatgcaaaggaattaaactagaaatcaataaaagaaaggtagttggaaagtctccaactatttggaaattaaacaacataatctttagtaacccataggtcaaagaaaatgtctaaagagaaactgaaaattatttttaactaaattaatatgtaaatgcagttgatcaaaacaggtggactgcagcaaaggcagtggttaaagggaattcatatcattattaagcattaatgcatttattacaagaaagatacaaaattaataacctaagattatacgctagcaatattagaacctagagaaagaagagcaatttaaacctagagtaatcagaacaaaagaaataataaaattacatcagaaatcaataaaattgagaacaggaaaacaacagagaaaaatcaacaaaattaaaagctggttcttgtaaaaggtcaacaaaattgacaaatctctgcccaggcaaaccgtgtgaaaaagaaagaagactcaaattaccaatatcagaaatcagagagtggtcatcattaaggatccatagaattaaaagataataaaggaacactatgagcaatactatgcccacaaatttgataacttagataaaaaatgaacaaattacttcaaagacacaaaccatcaaaacttgcataagatgaaatgggtagcctgaatagctctatttctagtaaattattgattgaatcaataattaataacttccccctcaaaaaagcaatgggcctagataattttactggtgaattctatcaaacatttagggaagagatgattccatttctccacaatgtctaccagaaaattaaagcacaggtatcccttcctagctaattgtaaagccagcattaacttaatactaaagtcagataaatacaggaaagaaaaacgacagaccattttctcttattgacatagaaacaaaagtccttaacatattatcaaatggaatttaacagttaataaaaagaattatacaccacaaccaaagggacttattgcacatatgcaagcctgatacagcatttgaaaatcaattaatgtaattcaccataggacaagctaaaggtgaaaacttatacgatcatatcaatttgtgacaagaaatcattagacagaatccaaaacttatccatgtaaaagaaaaaaaaactcttagcaatctaggatcagaggagaactttctcaacttgatgaaaacatctacaaaaatactacagctaacatcattactaatggtagaaactggacagtttctctctaacatcagaaataaggcaagagtgtcctctttcacacttcatttcaacattgtattggaaactctagctagttcaataaggcaaagaaaaaatgttatacacattggaaaagaagaaatagttaaaattgcctttgtttgcagatgattataattgtctacgtagaaaatcccaaagaatctacaaaaacactcctgaaatttaaaaggtagaatatcaagtttataggatacaagctccataaataaaagttaattgctctcttatttaccaaaaatcaacaattggaacttgaatttaacaatgccattcacaatagcagcaaaattggaaatagtgataaatctaacaaaatatatacaaaatctgtgagaaaaactacataacactaattaaagaaataaaagatttaaaaatggagagagtccatgttcatggactggaatgctcaatgttttaaagatgccaattcatcacaactgaaaaactgaactaaagattcaatgctataccagtcaaaatcacagaaagctattttaaagatactgaaaaaatgactgtggagtgcatataaaaggaaaaagatccagaataaccgacataataatgaaggataaaaacaaagttggctttaggaggccgaggcgggcggatcacaaggtcaggagatctagaccatcctggttaacacggtgaaaccctgtctctactaaaaatacaaaaaattagccagacatggtggtgggcgcctgtagtctcagctacttgggagtctgtggcaggagaatggcatgaacctgggaggcggagcttgcagtgagccgagatcatgccactgcactccagcctgggcggcagagcaagactctgtctcaaaaaaaaaaaaaaaaaaaaaaaaaaaaaaaaccgatttggaatatccacactgatttcaaaacttagtttcaggctgtagtaatcaagacagtgagtactggaaaaagaacagagaaatatataagtaaaacagaaaagagagtccaggtatagacccacagagtcaattgattttagacaaaggagcagaaacaattcagtagaaaaagaatagtgtttttcatccttatttgttgttttaacacaacacaaccaattgttatgtaaaaaagaaaggcctgacactacacgcaggtcttattagttttcacaataattaactcaaattgtattatagacctaaatgcaaaatgcaaaatcagaaacctactagaagaaaacataggagggaatctgtctgaacttgtagcccacgatgggttgtcaggtatagcactaaaatcactagtgcaacatgaccttacataccaggatgagtttgtagagatagcactaaaatttagaattaccagtattacaaaatgaacctttatacatacgtatttcattcttaccagaacagtggaaacacttgcacaaagctaacgcaattgtcttcatttcacttgatgcacacactctctacctttggctccctgatgagtaagcaagggctgggaacaaaagcaacaatgggttgccctatctgcctttcctgtggaagagaagcaggagccaactccaagagttcccaatggccaaagataaaaccatttcagaaaaaaaaaaattgaattaagtaattttatattttgagattatatcccaaagtaccaaaaacaaaaaacaaaaaaacaaaaaaaaaacccactatgggttcatgctgatgtaaataaataattgaataaataaatagaaacatcttccctgccaagaattccaaataatttacgtagatactttagcctgaatgaggtggagcataacactccactccttcagtgggggccacatttagtacatttagtaactgtttttccaaaaagtatacaatgacaaagggaaaaatatgagtcactttacaatatattttacatcagcagtgatgtcatgtttatagtgtacacacttaaatgtatattattaactgaaagaagccactctaaaaagcctatggagtgtatgactccatttacatgacactctgaaaaaggtaaaaagagatggtaaaaggatccatggttttctgacgtgatgacaacagcactttccctttgtgattttcctcccccaaacccataacctcagactaatcaggagaaaaaaaaaaacgttaaacaaatcctaattcaggggcattttacaaaataaccaagtagtactcctcaaaacggttaaggccgtcaaaaacaagaaaagtttgagaaactgtcatagtctagaggaccagaagaggtgtgatggttgataataagtgtcaacttgattggattgaaggatgcaaagtattgttcctgcgtgcgtctgtgagggtgttgccagaggagattaacatttgaggcagtggactggcagaggcagaccaccctcaatctgggtgggcaccatccaatcggctgctagtgctgctaggaaaagcaggtggaagaaggtggaagagcagacttgctgagtcttccggcctccatctttctcccacgctggatgcttcctgccctcgaacctcagactccaggttcttcagcttttggactcttggacttacaccagtgctttgccaggggctctcaggtcttcggccacacactgaaggctgcactgtcagcttccctccttttgaggctttgtgactccgactgagccactactggcttccttgctcctcaccttgcagatggcctatcatgggacttcaccttgtgaccgtgtgagtcaattctccttaataaactccccttcacatatacatctttctattagtcctgtccctctagagaaccctggctaatacaagaggcatgacaactaaatctaatgtgatgtcttggatggaaccctgggacaggaaaaataaaggaaatcagaaagtattgacttcagttaatattaatgtatgttaacttctttaatattaactgacttagctaatattaaccagtaccaatattggttcattggttgtgacaagtatatcgtactaatgtaagatgtccaataatgagggaaactggggggtgggatatatagaaactttttgtactattttgtgatttttctgtaaatctaaacctattctaaaataagattttttaagagcaaattacaattaaaaaatcactctactgcataacctgtagtgaaggtctgtgcagcatctcaaagaaacacataggatgaagaagccagagacgattttacagacccagtgacccttcttctcacggagacttgaagaattagtaggagtccaatgaggaagaaggcactgaaaggcagaagaaggcacaaaaaggcccctaggcatgtggtggctgggcacccctgataaagtgcagttcatctggcagaactacaagttgagaaagcctcaggccggagaaggatgcaaggctgtgtccttcctgaaagtccttattggcatttgttcctctgagaaggcgaaatctttgcacaggtttaagtgggaaagtggcaaaacaataagagcctcattcatttctgctgtgttccagatacgatgtcagatttttcagcttcgttatctttgatcattacaaaggatccttgtatttacaaggttagagtttgttctttaggagatcattctccaaatctggagactagattgaaaggtagcaaggctggaggctctttgcggaagtaactgacacatcttttcatcacttcttgtctgttggcttttgtcagtgtgcttgaaaataatttcagctgtttcatgtcatggaattagatatgctttgattacagtttctgctttcttgccttcacccaactcactccttagtgatgctctgcaggacgacttttattctttctctataaagaaactgctcctctgaactcaccctgcccaagccctgcctttacattatgtatacgagttcttccagtcaaactggatcacttagtgacttggagcaggtggcactctcctccgtacctctcctttaacatttatgtatatgtcaaaaagcttccttcttgcttttcttcactgggtataattctgtccaattccctgggtccacccaaatacagccctccctcatgagaccttttctgacctcctagagcaatctatccctccaatgagccctaaatgcctgatatcttttactgtagctaattgtgtgctgttattagcctttcctatacttttcataaagatcttgaaagacaggcaggcacgctgcttaaactctgtttgcctggccgtgcacactttacacctggtataagcagaacgtatcatttgaactgaaaataaagtaagaaaaagtaaatttaactttaaaataaaacacttatttcagagtggttctttgatacttataataaatgctcactttgctttgatactggatatgactaaagtttactttatttggacggatatattacctttgactgctgaattaaaagaatcaatgccttgatttaagctgtgcagctaacagtagctctgagaataaacaagaggaaaatacagccatgtatctcatgcatgagagatgcatcttcggtgatttcatcattgtgcgaacttcatggagtatacttacacaaacctagatggcacagcctactacacacctagactatatggtatagcctattgctccaaggctacaaagctgtgcagcatgtgactgtaccgaatactgtaggcaactgtaacacaatggtatttgcatatctcaacatatctaaacatagaaaatgcaatgcattactctataccattatgatagctacagtatcactaggcactaggaaactttcagctccattataatctcatgggaccattgtcatacatgctgtcctttgctgaccgaaacgttgttatgggatatatgactatatataatttttatgtaagaattttacatttattttttattttaaaaaggacacttcaccataacatcttgataatttattaaattgcaaatacataagatgataaaaaatttcaaatgtcatcttctctatttttaattaatgcctagtgagagcataaacattatttcaacctaccagtccatattttaaaatacaagttcacgcttaaatacatttggagtgaaaaatgtctaaaacatcctaggcatggtggctcacgcctgtaatcccagcactttgggaggctgaggtgggtggttcacctgaggtcaggagtttgagaccagcctggccaacatggtgaaacctcatctctactaaaaatacaaaaattagccaggtgtggtggcgtgtgcctgcagtcccagcctctatggaggctgtggcttgagcctgggaggtgaagattgcagtgagccgagatcacatcacagccctcctgcctgggtgaaagagtgagtgagactccatcccccaacaccaaaaaaaaaaaagtctaaaatattgatttgcttttcttcttcttcctcttcttcttctttttttttttttttttgttgttgttgttgttggggttttttttgagacagggtcttgctttgtcacccaggctggagttcagtggtacaatcatggctcacttcagtctcaacctcctgggctcaagccatcctctcacctcagcctcccaagtagctgggtctacaggggcacagcaccatgcccagctaatttttgtattttttgtagacatagggtttcaccatgtcacaggctggtcttgaagtcctgagctcaagtgatcttcccgcctcagccttccaaagtgctaggattacaggcgtgagccactgtgcctgggctgttctttttttttttttttttttttcccagaagtctttgaatccaactttaaaagccaagtgaaaacctcagaaaacaaatgaagcctgagatgagactcatggaacttgattccttacccgacctatttagaagacattccttaacctatgtacagtcacttaattctgcccatgaaaagcaatgttgcatttcctcacagctgaaaatacttttaaaagaaagtaactataataaattctgaaagtggaaacttaatttataaaagcaatgaagcttgagacctaactttgtgggaaaacaatgcaggtatcttttttcacattaaaaatgttactaatgaactttagtctgattacaaagctatctgaaggaaatagcatgccaagtgcaattatgaatataggtaagttggataccagaatctgttttaattaagtaaaattatgaaagtgggataaaaggacaaaagctctgaaaaacaaatggttgattccagaaatttttattcagataatgaataagacagctaattatttggatcatttagttattgattaaaatggtaaaagtaataaaaattatctgtaaagtaatgtatataaatatagccaattagaaaaaaaaagagcaaagttgctggaagaaataatggcatcaaaaaaattaaaatatcaccatttccttcagctaaagattatgcaatggtagaaaaacatactataacagagaaatgagtttcatatcaatattttacttccttttttaatctcctctgccatctcctcctcatcagataatccaaagtgatgtcatgcaggggtgacagtttgtacatatggatgaataacatcaatgtatccaccttatataaaataatctattatcagggagctcaatttagctttattggggtctttagaaatttactattaatatgtgcatgtttattttcacttacttcaaatgaaaattgctttttcaaactattgagatgccaaaatataccagatatagaccagaaatgtgtagcaatttgctacctattgtcatactctagctaactttaaatttctaacaacccctgtgaggtctacaatggcaatgcgcaatggggaatgcaaaatggcttaaatggcatttggcattgaactggtacctttctgaggacaacagtttatagggggaagaacagtttcaaggacattaagaggcagcagagagttgcaaattcagaagttttatcaacattgattctgagattccacattctatctttaattgatgattatattgtccaaaacttttcactttatgcaagctcagagagaaaaagagagaagaaagtgagtaagggagggaagaaggcagagaggaaggaagggaggaaggaaaataaaaagagagagaagaaagagagagagagaagaaaagaatctgcccttaattttgctaccttcctaagtgcgaccttattgcaatttgctccccttccttttgagttcatgcctcatgaaagagtattacacacgtatgttccttactttcaactcccaaccccttccttagctcaccgtacttgtcttcttccggcagaagtctactgaatctgttctctcaaaggtcaccaatgacttcctagtagaaaagttctaccacttccccactctctcccagtcttctctgcttaagctctggtgaatctcccttcctggagccctctatgtggctgctgtcacgctctgtctactctgctatctttctctccggctcctgacctagttttccctaccttctgactcctgctctctatggttaaaagtctcttaaaaatctatctctgctgtagcttcccctttcctttgtttctctctatattctttcttccttggcaagctcatctaatttaaaaggtctgcttaccaaatgtgtacctcagtcatcatttattcaatgtaggagaacaaaacccactagacaaggtgccagctctgtctataggaagtcagtagtctatttaataggtgaaactggcaaatcaacagacacttaactacacagtctaataatttcaacagggaaaaaatgcagtgtgttctggaaaaacattaaaggaagatccaatctaatcttgggagctcagggagatttcctggaggagttgatatttaattcaagttctaagtaaaaagacaggagtatgaagcaagagaaggttccaagcaaagaaagcagcatatgcaaattattgtgattagggatataatgtcatttgagaaaccactatcagttgggtggcttgaagacacagcatgggttgaaaagtgatctgagcagatgcaatgatataaatatggctatatcaaaaagggttttaaatataagctaaaacgcttgtttgaacattatcctgaggaaaatggggggatctattagttattgaacttcagaagagacatgattagatctgagttttggaaagatcattatagatgcagtgaaatgaattgactggtgtgggaaaagaggaaaaggaatatgaggtagaaaacagtggcagttcctagtgagatgtgttgatggttggaatgaggagtgagatagtgggagtagagagaggtggacagatctgatatttaggaggcaaagtctgcacagatttggggatagaagaatttcgtccatttagatttgttcagtctatgagatgcccatgaaacgtccaagtagagatctatagcagacaagacagttggccaggagctcagaagagagtccagaggtatatttgtagtggttatcataccaacaatgggcaaaataaggaagtgcataaactgtgaagagccaagaaataagaaatctcatgcctgggtctccaaaaccctgaaagttaagaggcaaatagagaaatctgtgaaaggtactaagatggagggtgatgaagttatggcacaacaaagaagagagtaatggaagctaaaaaggagtgaaaaatgctgcagtgaggccaaattgaggactgagaagtaatcattgaattttgcaacaagaaaaatatcagtgatcacagcaaataaggtttcagtgtataagtgggggatacacaccagattccagtgaactgagaaataaacttgagagagaggaattaagagacagtaaatgcagctgagtttgtgaaaataggagagacataggagaatagctagcgtggaccatgaatcaatgtaagagtgtattatgatgggagagaactgtggtgagtaagcctatacagatatggctggttaagatataaaagtgaaatataagaatgaaatgttgggcatggtggcccacgcctgtaatcccagcactttgggaggccgaagcgggtggatcacttgaagccaggagtttggggctgcagtgagctgtgattgtgccactgtacttcagcctaggttatagagtgagaccctgtctcaaaatgaaaataaaaataaaaagggatgaaacaacactgaggtggtgagagaggatggggtaagaagcacagggaagctcaacacagacagcaagagaagcaagaatgggtgcacacagagtcaaagtgtatttgtaaagcagagcgagttaaaacattagagacatttcctccttgctttctatttaccctgaaagattatggtctgatattgagaatgactgagaatgtagcatgccagtagaggaagtggagaaagctttgaataatcatcccactaaataggagatcgatccgattacagaaaggattgccaggaagtcaggaaggcctgattgaggttgggaaccatgacatcttggtagcaataatttataggattgagtgacttttcaacagcgacgtgcagaatttcagatagacacgggaatacaacaagattgatccaggatcagaaactctcttggtggatgcactgggaaaccaagactggaggaagttgagagcatttgtgagttgtagtgtctgatcgtttttgctgttggtgtaatgatttctttaatgtcactcttgcctgtaagaggggcagtgatgtgtttattaatcatcactgtacctccagtgcaaggatggggacattttgtgtgtgcattaacaatttattaaacgcatcacagtcctacctgcaaacctgatttatttggttactattttatcaccctatcatattgcagagattttttaccttgtgaccaaccaaaagtgtattttattcgaacttaaggcaaaacattttgacatcagagatgaagagacatcaaatctattttttaaagaggtcatgaaaagaacatccctttgtctttcccgacactccatttatattacatacattttcctttcggacacttgttctgttctgttctcttgggtaagtgtcatgtgtggtttaaactcagggctcttccttctttgtggaactttatcagatacgttgatggtgactaattagatgtttcaacttcaaacaagttaatgtttcaacttcaagttgaaaagattattgcattgaactgtactctttacctttgcttctctcaagaaaatgtttatggccctattttcttattctcatatgtttgcttcttaactgtttaatgatgtcactgcctctcaatcaactctctcctaggcctctactgtcctcattaattgcagaatataattccacagaagcccctttatgatgctggagaattttcacataatttgtatgatagagtctaagtaatacctatgtttctgtcccactctttactttgaaattttgcacctccctgccagtttgcttgcatctttttctctgactttgcatgcttgaaatcgattatttggtaaaatgcctcaccttccaggtacagaagtgtccccaaccacacaacattatttgacttttagtagtagttccttaagacatgtccccagtatttccttacagcaagtgctcacgtaaagcagacgaatatttgacaaaatctgcaggagacacaggtggagagtgaacgaggctcacaagtggctgccatcagcccttccttcccggcagcagtgtggaggggccgtcagctgccagacacttcacactccactgtttgctcccgtttctcttgtaaagggctgggtgggacagcaggggtgtgatgacatgattcccagtgacagaaatcttggctcctgttggctctaagctggacagacaagaaactggataaaaattcttttaataatttgtttccgtttacagtaccacgtcagtgaccacaaatttattaggctgctcttggacatctgttagtaaatcgggcacattcatcaaatgtgaggccccagatgggagctggaaagcattaataaaatgcagccaatgttcacgaaaaggcaaggcagtggaaatttacctattgtagagggaggaggtgctctctgtgcttaatagctcttcgtcgtatacccgactgagcagaaatatctcagtggagcaattctgggatttatgtgatgcaaccacctaccatctttgtcttatctcttacttttcacaggcatgaacctgtcattctagaaacactaacctactcattctccctaaactatataaaaaaaaagtctggatatgctatttttctaagctggaagtaaatgatccgaccttgaattgtgattaaaaaaagattatttgcaggatgtcatgacactttacaatggcttaaatttttgaaaaacttaggaaaaaaaaatcaaagtataaccgaaagcagttgtttcagttaatatgacattattttaggtttagagataaatttccagcagaagaatttgtctctttatgatttgtatgaattcttgctatggccttgctgttcctctgcttgggttttctctttatgatttgtacgaattcttgttatggccttgctgttcctttgcttgagttttccagaacgccacaccatttcagtccacaaataatggtttgtttctaagaggagctactatttgctcataaaactcattttctatggaataaaagcagcctgtttaggctgattcagaacctgtagaacattttcctgtagttgggcaaccgctctccttgcttttacttagagaaaaaattgattaatcgaaacctatggataatagctttgggaagtttcattttctatttgtaactaaacattttctatgtcatgaagggtcaagggaacctagggtttttcactttaaggtaaacctccagttacagcttaaactatgaacgtggaaatgtctcctatattgttaagtaaaatatgcaagataaaacaatctatttttttaatgttaatattctctgttaagtgcattcaattcaacaatgtttactggttacccaacatgtgtgaaacactatgtaggggttagggacaacacaaagaacaaagtccttctacttataaagctcatattctagtgaatatgtggctcagacttcgggaaatgtcctaagtcagaccatgatgtgtcagtgtgggacagcccatgcccctgtcaacaggggtggtgtttgtcatgtcaagatatccttggaagtggtcaatcttaaattgttcttgaggtcaatctgacagtcggatatgagactttagaaagcgtggctaagagtaaaatgaagaaactgtttactctttttcttccactaggagtcacttgagcccagactctgggcctaaatatacctacaagattttagtgatattggccactgtcctgagacatgagaagagcctcagagaagtagcttctaaaagacacaaggatagatctgggctgggaaagggtcgtagttaccctgtgtgctgtgtttttcttcttctatccctggagctcaacaaaaccttgtgaaaagttagagtctgagagatcacggaggaagtctgtgaagtggtacaggctgcgtaataccccgggcacaagcagtgcccttggctagggtcaaagtgattgtgccaagaagtgggggggggggggaaaaggctgtagcaagagtatgggcttcacaggccgctgagggcaaagagacatgagatactggttcacgagaggcccgagaaaatgaccacatatggggagtaggaaagacactgagtggggctcgttccaatgataaagccagagtgggctcaggccttcaaagaagactggacagacagatgtgctagaattttagctatggctatctcagggagcttttcgtgagtgctttttattttcttctttttatttttttcatgtttcccaaattcgaaattacaaaaagcaaattagagttattgcttttaaagaatccaaaatgttttaagaaaaatgtatacattataagtaactacatgtgacatttgactcctgtccctaggcaggggctgctgaaacatctaccaaccaatatccatatccaaacatccaatatccaaacaaccaatatccaatatcccaggaagacttggcagatcagttcgtgagggccaagggttcactgatggtgctgccaaaagtaagaataaagatggggtgcacccatcacttctcacacaggaagcccatgactatccacacatacccgtgttcatggatgaaccccagcagaggaagaggtgaatgtcatgtttgctaaaacaaatgagtaagcctcaggcctttgaaaaccagacactccctcttcctacgggcattcagtagaagcaaaatgctactgatgcctggcagatcccttccaaaatttggtttaaatcaaaacagcagttattacccgaaaataacacaaatcacaatctgagcatgtgcctcctgtgaaatggagataatcagaattcaacatggtgcgtataatgtactgtaatgggcctcaaagcccaggtattagtgagcacggcaggaagcaggaattctggataattcaagaggccccaatcacttgaatttaatataactgcaaaattaaaaaaaaaaagcattttagtctcattagacttgcagcctccctcacttaaaggggaattttcaaaatttgaaaatcgtatcagatgttacaattgaggtttttagactcattatttttaaaagggtgaccttttactgtacagcaggaacctgtcttgtgtggtttgagacaaatgacaatgaagagatggatatgttcctaggatcatatttaggctataaaacatctatcagtgcccttatcacactttttgtactgctgtagttagcatctcctatcattattagctgtgataaaagaaaatgtttcatgaaatatgacatagaaatagaataagcagcattgttctcaactgaaatacaggagggggaaaacctaactcattcctcatctgggaaataagaaataccgcattatctttaataaaagataaagggacctgacttttcagacagctcttacacaactatctatggccgcttctgggtaacagatataatcgtacatttctctgtcattttctgagtggctaccctgatgaataggcacatccttagatgatatcttctgctctaggccttattagctttatccagtgctttttacttttcttttcttttcttttcgtctattcttcttcccttcttcctttttaaggaaagttgcttatgtcttatttctttgccaaaggaaattcaagtcggcttataaaaggaacacatatatgcagaaaggaaagtgaggctctaaaaagaagaagaaagcaaagaggccagccagctactggaagaatcagacaatgccacaggacaattgtgcatcgtccatttggtctgtgtagccatgttcatttttgttttttctagtggacagtgtagaaatatcaagctctgctgtaataggagatgttcctgtgtgtaattaaacacatctccaaatgtccattgaaccctggcctcattatgtttgttcaagttctacaagataaaagacagaaattctaattagatttccagctgccttttgtattttccttaatagctgacaactctaataaacaatatatatttaaaaaaccaatcagataaaaatgagagaggtcacaaaactctgggactggcatttatagatgcatgtgctgtccagcaaaaaccaaaaatggaattaggacagacagatcacctgctggtctctaacaaacgtactgtgttggcatgatgccgacacaccaggtatgaatcccagctctgctcctcggttctgctgggagtctcaggggcttcatctgtgaagtgaaggtgacatccctcgcctggagcagtgttcatgcttttaaatcaaatgtatctgggtttgaatactggttatctctcctattcgcttcatgatctgagacttacatttttaaatatttcttcaaattttctttcttttctcttggagttcagaataatatatatcaagttctcaacatgatgttcagcacatagttgatgctcagtaaatgtgagctttcttgcccccttcctacttacaagaactaaatgaaaggacaacatccagcatggtacctggggagacccaattgattaatgctcatgtgtgatagttcttttttgctggaactgcaatatagtgatagaggtgggaagtgaaggcagccagaaactcaaacctgaaaaagcctttatcaacgggaaagatggtctgaaataatggcagacatcctgggggaaataccccctactttggcaatgaaaacttcaacgtatggccttcatgaagacctttcagtacattctaggtttggggactttgttgtgcagagcaattggataattatacaagtcaatggaaacaacagtcactcgttgcattacagaatgcagtatttaaatgcaaacgcaacaccaaaaacaaataaggtggggagtaaaagaaaagagtgtggctagcttctaggttaaataagacagttggtcccaacaggttggatgtgacgggactgcactggatggcactgatcactttgaatggcagacatcacagagcaacatgtgcagacttctcactttctgtacactagagcattcccaagaggcaagaggccaccaaaagagagattcttggtgttgttaaatgtgtaaaatatgccaggcagagtggcttacacctgtaatcccagcactttgggaggccatggcaggtggattactcgagatcaggagttcaagaccagcctggccaacatggtgaaaccccatctctactaaaatacaaaaattagcgtggtggtgtgcccttgtaatcccagctacacagggagctgagacaggagaattccttgaacccggggggcagaggttgcagtgagctgatattgcaccgctgcactccagcctgcatgatacagggagattccgtctcaaaacaaaataaaataaataaataaaataaaaataaatgtacaagataccataattttggtggctctgctgtagactgaatgtctgtatcacccccaaattcatacgggaggtgattaggtaatgagggcacagcccttatgaatggaattagtgcttttataaaagaggctccagagagctcgctctccccttctaccatgtgaggccacagcgagaagacagccatccatgaaccagaacgcagaccctcagcagacacaaaggccaccagcaccttgaccttggacttcccagtttcccaaactgtgagaaataaatctttctgttgtttgagccactcagtctattgcattctgttatagcaccctgaatgaacatagatagggtaccaacagaatataggcaaaaataaattcctcccttctaaagaaaagctcctaatacgctgaaatgaatacacaaagaaaactatagttcttgctcatctcacatgaaataagtagaactacatataagattccctgtgtacacaactaggaagctccagctgcagtagccagggtgtgggatgagagcaggtacccaaagatatgaggactttgtttgttccttaagcattatttataatataaaatgcacgtttgcaagatgaatgtttgggtaatatctattatcttgaaactaggtcaaatcaatcaatcttgttagatttatacttaatggctccaaactatgacttcttgcatattatcatcagagtgttaaatatatctcagaaacctagaatgtttttatatagtggtctactagcactggaacgataataaagcggtcatttttattgatctcctatggacatgacagcttgctcagtggacaataaaatatatattttgtaggtttataggtttgtaagggtcttaatggttatttgcaagggatattttaaatgcttctaccgcttccctctactgaagcaagattgttgtttgaaacaatttgaagagcatacagaaaagatctgtttttattgacctgtaatatacgagttgaaatacataggaaattgctctaacaaaatggagtatccagaatgcaacaggtaaatataacatcaaatccaaggaaatacattactttattccaaaagacattatgtaatgtacctttgggtcagttgggtccatgcctctcttatggttgcccgccatttatgcaaaagcagaatccaggtctgaaatagttgttcaaaaaggtgcaggacacgtatgtttattgcggcattattcacaatagcaaagacttggaaccaagccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagatcacatggacacaggaaggggaatatcacactctggggactgtggtggggtggggggaggggggagggatagcattgggagatatacctaatgctagatgacgcattagtgggtgcagcgcaccagcatggcacatgtatacatatgtaactaacctgcacaatgtgcacatgtaccctaaaacttaaagtataataaaaaaaaaaaaaacaaaaaaaaaaacccaaaaaggtgcaggagtctggtgcagtggcttatacctgtaatcccagcaccttgagaggccaaggcagggagatcccttgagaccagagtttgaggccagcctgggcaacaaccccgcctctcaaaaaaaaaaaaaaaaaaaaaattaaaatcaactaactaaatgaataaatatcagctgagtgtggtgatacatgcctgtggtcccagctattcaggaagcttaagcgggaggatcacctgggcctgggaggtcaagggtgcagcgggccgtgattgtgccactgcactccagcctggacaacaggagaaagactccaattaaaaaaaaaaaaaggagcaggcacacagggtacaggttgtacctactgtgcttttatttcaaggtttttgtgtgactttagatattcacaagtttctctcctgttaattttctggttgtaaattgatgagatatctgcctggctacttcatgatattgatatgataatcaagtaaaataatttaattaaggctgggggccatggctcacgcctgtattccagcgctttgggaggctgaggagggcagatcacctgaggtcaggagtttgagaccaacttggccaacatggtgaaaccctgtctctactaaaaatacaaaaattagcggggcgtggtggctaatcccagctactcaggaggctgaggcaggagaatcacttgaacccgggaggctgaggttacagtgagccgagatcacgccactgcactctagcctgggtgacagagcaagactgactctcaaagaaaaaaaaaaatctaattaaatgatttggaaaagcataaaacactttataagtccaaaacattatcaaagataacagagacattcttttttttggagatggagtctcgctctgttgcccaggctggagtgcagtggtgccatctcagctcactgcaagctccgccttctgggttcacgccattctcctgcctcagcctcctgagtagctgggactacaggggcccaccaccgcgcccggctaatttttttttctattttcagtagagacggggtttcaccgtggtctcgatctcctgaccttgtgatccatccgcctcggcctcccaaagtgctgggattacaggcgtgagccactgcgcccggccagagacattctttactttctcagttctgatgcaccctcatgttcctagggctgtaatttcattggcagtttaactaaattcgtggaatacaaaggccatttgtaatggagttttattaaattaattaacaagatttagagcactttcttcttcagaagacttgtggcaggcttgggaggcagatgacagactctataatggtgtgcacaatggattgatttaattcattcggtgataattaagttacttgatccagttgtttgatggtgtgtaagcaaaacatctggttgatttgcctgaatcttgattttcactggtatttttacaacagatattgcttctagaggaagaaactttgcaggtatttgtcattaagtttttatcctagataaattatatttatccttaatcttattcttctatctgcattttaagccattttgtttacactgggttttgtttagataaaaaacaattcatttaaaatttctttctgttcacgttctcacatccatttaagagagcacaaactgaatcatcagttaccataaatccgatgccacttcagtgaattcccatcagtcaaaaaaacaagtgattattgagaattgattgaccgtggcacttcatttgatggctggagagggtatgtgtcctctgccattatgttgcttagattcaactgaagtgatgagaccaacatacataaaataaaaaatataagataattaaactaagcaacagataaagtagtatcaaatggaaatattctttcagctcatggcaaagaaaagccaatgggggctgaattatggaagaaaggctcatggaataggctgtatttgaagactagtataaaagttgtatgcatttctaaaaaattcaattcagttaaatgtgcttgcacatattcagagttttaaaaatttggcctacataaaaatacaattaagattctggcccacttgcatgttgattcttttaagtatcacaaaacatggtattaaaagcacttttcagaggaagggaaaaaaaaaaaaccagagaaattaatttgcccaatgcctgtaaccagtaagtgcttgaaacaggattgaagctcaagcatgtctgcaaagctcatgaccctcttcaatgccaggattcctctcaaggaatgctgaaaactcaagaagcatgggatgatggagagaaggaaaaaagatggagcaaatagctgccactcaaagaacacagaaatgcggccgggtgcggtggctcacacctgtaatcccagcattttgggaggccgaggcaggcggatcatgaagtcaagagatcgagaccatcctggccaacatggtgaaaccccatctctactaaaaatataaaaattagctgggcgtgctggtgtgcgcctgtagtctcagctactcaggaggctgaggcaggagaatagcttgaacctgggaggcagaggttgcagcaagccaagatcatgccacttcactccagcctgggcaacagagcaagacttcgtctaaacaaacaaacaaacaaacaaacaaaaaaacacagaaatgcataacgttccttgatacccaggagtgacagcaagactcatttcaaatcttagcctactcattagattgagggtcttaaagtactattctccctggtcagcatcactagatgagcttagtcaggatgactcttacagtgagaggcagcaaggggcacaaatgagcaaggtcatgtcaaggaattactgatatctgtcaataattttgtgaaggatccagactttcttgaagctttttattttgataaatttgctcaaaatattatccataattaatatgacatgatattagtcataaagcatgtttactaagaaaacaataaatctgttctggaagataaattttgcaaactcaacccgaaggatagtaggacttatcacagaagggcaggtttaaaaggcagaggaaacacgaacgtggaagaacgttgccagtaatggccccaatttgctcacacagtcctgcgtctgtgcattgtatagtccttccttacagtggctttggacttgtccaggggatttgtcttagtggatgaggcaatagcaaatgtgacacaaacagaaactcacgttgtgcttgtaaccctgagaataccattgtaagaagccagtgctagaggctgaagggcaagagaatgaaaaatatttagctgacagcttaccaagtgccagatatgccaaaaatctaagggagcaatggagttactttcatgtaactgagagtaaaatagcaaaatagcacagggctttcagaagcacagcacagtttcctactttgaggtctgattagttgctgtgcccccagagtgagcctggctaaagcaaagagtgtcaatagctaggaaggggctctgccaatgggaacatgtaacaacatggaagcaatggggtggactgtcaacagaagacattagtggtggatgctatgcttcttaatgggtgctgtgatgaataactttatacgtcaacctggctaggacactgtaccctgatatttggccaaacaccagtctagatgttgttgtgaaggtatttttggatgagattaatatttgaattagtagactttgagtaaagcagattactcttcgtaatgtgggtgggcttcatcccatcagctgaaggccttaagagaaaagaaacagattttctccaaggaagagggaattctgccaccagacctccttaaacatgaattcatgcctaggtctccagcctgctgtcctgctctatgaatttcagaagtaccagttctcaaaattgtgtgagcaaattcctcaaaatctctatctatctatctatctatctatctatctatctatctatctatcatcgatctatcatctattatccatctatctatcatctatctatattttctatcatctacctatcatttatctatcatctatctatctaccatccatcatctatctgtctatctctttatcatctatcatccatctattatctttctatcatccatctatcatctatctatctatatatctatatcttctatcatctatcatttatctatcatctatcatttatctatcatctatcatttatctctatcatttatctatctatcatctatcatttatctatttatatctatccatcatctatcatctatctatccatctgtacacacacacacacacacacacacacacacacacacacacacacacacattgctttgtcctgtttctctggagaaccttgatgagtactaaatttcaacaatgtagacgtatgttcaccaaggactaaattcttccttccaatccccctgcccttatccaatgattgctgcacattaattttcctccctatgaaatcaaagtagccattttatttaatctttccgccacagtccaattgtaagactaatgcaatttattctgtgttttgcatttgcatgtgaattatatatatatacacacatatgtgtgtgtgtgtatttatataacacaaacacacacacgtaaatacatatcttttagattcttactgatatgattgaaaggtacaaatcaaaatataaacttttgacatgatggcaacatgaagtttaactatcaatgccacaaacaaataattgacacaaataaaaatctgcattggcactataaattagggcagcacgtggtctgaaagtctaaccaatattccatatataagaccagattgcaacattctcctgagacagcaccacagtactaagtagagaagactctaggagattactcataaaaccctcaatgccggagtggaaacagcagaatatatgtgagaaggcggcacaacactttgaatcccattcactgtagtacatcaacagtaccaaaaacagctgcagtggggctgcactaatcaaaccactgcaaatatggacagcttctctccccgcagtggagggcaaacaccacagaagaaatcagccatggccatgtcttggaggcagcttggcaatggacaatgttgaatataggacagaaatgtgttccaacgaagtaagtccatcacactcagtgacaacatgatatcatggtgacatcctgaggcaaggattactcccaggtccagctcgctccccaccatacttagtctgtcaaaaagctaacttattaatgcaaatttacattaaccagaatgccaactccagctgcaaagtggagacgatcccactgacatatacatacattaagtaatctaaggagaatccatccaccctgtcaataactgaagatcagttccatgtagagtccttcatgccagagacaaagtaaatgagaaaaattcacaaaacaaattcacaaatatttctaagacatgcaatggcataaagattataatagtatctatatatacctaaaatactcaacttaaatggcatgatgtaataaagcaatcaatgaaacataacttacaagagaattttatgcttagagtctatgattagaagagaactttctaaaggaaggtagaaatagagaactagaaaaaaataagaaaatgatgaaaagttaaacatgcgataatagatatattctctattagcatctgtaaagggctgaatcggcagtgaagagaattagaattaatgttatgatgtagaaacttaaaaacttaatctggaagagagaagggagagagaaagctaaaaaatgaattttaaaacagagaaaataataatcgagatgtagaaaagagtgaagcatatcagtaaatgttgtttcaaaacaggaaatgagaacgaataagcaggcatatagttagttacaattattataaaaaatacaaaaatacctacaattgccaatcaacattttctgaactattatgtaagagatgtggtaataactgctttacactgtatgtaatacttattaaaccctcaggaaagcactaagtagtagatgttattattatatgcattttataaatgtagaaaatgagcttaaataacaaaacagaaaaaaattttcttcaactaggaaaaacctgaatcaacagacttaaatcagtcaccaaatttgtaaatacatcacagaacaagcaacgaaatggcaatggcccatttatattttgaatttcaaggaaagaaaaggcattacaggtatctaggcaggataaaaaatcagttttaaaaaacagcatatgcacaggcaacaaaacattctgccaaataattaaaggctttgaacaactacatataatcctaataaactgctgggaaaagtattgtagttttccaataagttagttaagatttcttttaaaaaaagatagtgtagcaaagagatgacacattaaattagcatatataaatcaatcattttcatatatgtaaacaataaaaagtatatataggaagaaaagacccacatataataataacacataataaaataaccgaaataagcttagtaagaaaagtgcaaagtctatattttaaaaactttaaagcactcctgaaagaccacatatcaaaattgaagacatgaaaagatagagtatattcttggttagaagacaactctgtaactgagcttgggattacaataaggagtaggtttgagaagtggaaaaatcggggttccattttggttgtgttgagtttgacgtttcggggagaggccttaggcactggagaagtgagtgtggagcactgtggagaggtcagcatgaaagttatgaattggagcattctcaacatatgtcacttagcaacagcgtgtagatgcagaaaggagaggaacctaggacagaaacctgaaccttccaacatttatggattagctgagagtgaaaagccaccacagaagactgagaccaaaccaaatggccagtgaaaaggatggaagagtatgagtgtgaaattctggaagcaaaggacaatcaatttgttcaaagagagaatattcattctgtattcccagtgcctggcccatggtaagaactcaataaatatttgttagatgaatgaaagtgtgaaagaagaaatggaattttcctagaaagatatattttataaaagtgtactcacaaagcagaagaaaaacattttagactaattccatatatgtgtattatacatatatgtaaactaaaaaaaatccaaaattttaacaaaaagttcaaatccatctgtattctaaaataataacaaaatatgactacatgtctaatggtaccaaaatctctgataaaatattcagccaaatgtgtcctggattgctgtaatagaaatgagttattaagtgctcattgataaaatactgaacactaagtctgcaaataatatagactcattggtcttaagtatggtcctgaagatcattcagccttctcctcctgtcttcaaatgggccatcagaacctgctcccatacccagaattagtctcttcttccatcttgccacaaaaccctctttcagcaaattattgacttctagaacatcaaaccatccctagagatcttcaaacgaccacttggctaccagagagcacacaagacagaaactaggcatgggtttctttcttattttaaaacatcttcagggagtttttgatagagttaaaactagacttggcattataaccacttagtctcccttcatgaccagtttcaaaaggcatgattggtttcatataggcagccaccaaagtaactttcataatatcagctacattattaaccacatcaaattgggatcagaatagccaccagattgattcattttccatgtgcacaatctgttacatattcagaacaatcattaatgtttcttaactcttcttgaaaccagtacagagccttggattttgtctagggtgaattacttcattcaaaaaaacaaaccaacaaatcagaaactaatttttcagcctgtcataaatatgactacagaacatgtatgttccttcctggatacatttgacttcatcttgtcataacagcttctaatgaatcttaaaaacttcctcaaagtgttcagcaagcaaataaaatcagttttccatgcacattatagctaaaacaagatcctacctgtaaattataaacaatgattgtttcttactagcttatgatatctgtgaagatttttcctgtttcttagatttttactgaactacaccttcaggttttttttgtttgtttgtttgtttgtttcgagacagagtcacgctctgtcacccaggctggagtgcagtggtgtgattttggctcactgcaacctccgcctcctgggttcaagtgattcttctgtctcagcctcccaagtaactgggactacatgtgtgtgccaccacacccagctaatttttgtatttttagtagaggcagggtttttcaccgtattggccaggctggtctcgaactcctgagctcgtgatccacccacctcagcctcccaaagtgctgggattataggcatgagtcaccgcgcctgacccagtctttaccttacagaaataatactcttttaaatctacttcacctctgatccttaatagtctttgccaatcagtagtttcctgattagccatgactgtgtcaatctattttttagcactgggattatttgtctggtcctatagttttaaaaaaacaggcatgccactgaagtgaggctgaaatgtgaacttggtaagactgtagcttcccttcctattaattatctcccctttcacctggtgataatatgatgctggcaatagctgctttgtctttacctaattgttttaataccacttaatcttcaacaatgagtattttaaaagctcatgtagcaaatgagctgggggtgtacacaggcctttatggacagaatttgagctgcatcttttgatggtattgctttataaagctagcttaaaatgagaaaaaattaaaaccttgcatcttcgtatactgttaattctaaaccattttaaggcaataattaccagaggcaggaaccacagctatgccgagttcctctctatcgatagaagggtgtgttacataggttggcatatcactgaccttttctgcagtcactgtaatgccagcttttcataactattgttttctgttttctcagaatcttctctgaacaatatgcatcttattttctttcagtgatgtgaattgtttgccacgtgtgaaaggttttacatattttaaaaaagccactaaatgtagctgggcatggtggctcacatctgtattcccagcactttgggaggccaagtgggtggatcacctgaggtcagaagttcgagaccagcctggccaacatggtgaaaccccgactctactaaaaatacaaaaaaattagcctgatgtggtggcacgcgcccataatcccagctactcgggaggctgaggcagaagaattgcttgaacctaggaggcagaggttgcagtgagccgagattgcaccactgcactccagcctgggcaacaagagtgaaactctgcctcaaaaaaaaaaaaaaaaaaaaaaaaaagtcattaaatgctttgcatatgtaggatcttgttccaggcaatgcaaagtgtgaactcataaaaattgttcccttactttggaaattagttttctgctacagaatagacacaatgtccaacatggtgaacaggtttatgacttaaatagagcgtttctctctctctcacacacacacaccatgtaggcacgagaaaaaaaatcagaattacaaataaaatactgatttcaaactgtatttaaagatgtagttaaggcaaaattataagttaatgagatgtatgtgtcttatagaaggaaagttcattaattcataatcacttgccataaattatatgtacaattattttatggacatgtatacagctgatccagtctaacgatcaccgatgacctgaatcaaataatatggcagaattaaggatgtgaaaaattgtacaaatatgctaactttcagtgaaatatgttttgactaccataaaatttatataaatgttaaaagcacagttcaaactgaattataatttttcaggaggtttgcttgcgtgccatattaaaatatccctgatgaaacatatttcttaaaaccactaagaaaaaagttcttgcaatgggaaaatgatttatttacctggatcttctatagttaagttctttatcaaccattgaacaatgtctgaacctagaaaaagaaaaaagaaaaacacaaacagatgtgaacattttgtttatacatattaactttaagaattctccacctttggtgctcatattagaaggaacttttctaattgttacaatgacagattaaggatctaccccagatggaatgctgaaaacacaaagtatggatacttagctgtccatcaataaaccaaggtgtaaactagtaaattattaaatatgaaatatgtaaatggaaataaaatttactgtactagtagaaagtgatttgtttactaaataagtgtttattaagcatctcctatatttcaggtacaagtcttagcacagcataaccagtattttataaggtagttcctgtctcatttttggttgtacccacctcatccttgtatcccctctcaagtcaaaccaaatttgtttttggttttcgaaccctcttacgtatttcaagtctctgtgtctccacagcagtactctccctgaccgaaatgtcttcccactatttttaagacactcaagattcactgatatgacagaacttgccttggcccttcccctcgtccactgagttcacagtactgtccatgaaacctcattggaacccatgcagtcttttattgtcgtgttgatcacacaccattgccccagctgtttatttgatgaatgccccaaagtaagaaccttgaagcagggtgtcatattcatctttgattatttggagcatagtaagtgcttaacaatgtgtgatgaatacaaagtatgagcaaatatgtttctacttcacacagaagagacaagagaggtctgcagaaaacaatgtttgagctagattttgaaggatgtatttttatctatgaataagagagaaatttagttgctgaaggggcctacgtaaaaactaaaaggtggaaaagcagtcaacagaaataatttactgcacactgtctatatgtaagtgctgggaataatagaaaattgaaagtaataatggagtgcacagtatattcagcaggtcttgaattctaggctaaagaattaaattttctttttcccataaggaaagcagagaaagagacatgcaatatttttgagcagaagaatgacattatcaaagtaagtttgaggagtatgactggcaatatatatgaaatgccttgtagtcaaaaagaaggcaaggcagtcgacatgtctactagttgcaatccaaggatgaagggaaaaggtcttagttcagtgtacaaaggaatttcttaaaaaattacagacttctttcaggactttacgactaattaggtataaaggttataagtaggagagattaaaaaagaagtcaaggtttctagcccggaagcatagatgaatagaatgatgaaaataagagcagaaatgggagatttagcaactgatttgcttgagacattcatttgtatttaaaattggttttctgcataactcttttctacacaaaataggaaaaatatgtatgtgaattgtttgcatacatagtaaactgtgttatgcctgcgtgaattgaatcaaacttcagtgtgaaccaagattccatttcagcctctcctggaggctggctagagttgctgtctacccacctcggagatttggcaaattaattacattaacattggcaaaataattctagctgcttgaattaaaccagttcaaaatcaatttaagaataaatttgattactaaacttgacaataaagtcccaaaagttatgagaacattcatactcaatgtcaatttcagcatgcatgcatttaaaaaaataactccaagtattgacttgaacttgtgttccttttacagctgccatggatttaaatcatttgggaagacagactcatccagatcctaaaggaagttttactaaaacagctctaagggtcaaatggaaaggagatcattctccagaaggcagttgaccgtgtcccggtgttgtgttcaaccttatagtcttaggttatctggaagcacgatcttcccattgaaaaagaaaaggagaactcagcttttcacatatacatgtagtgatccttgaccaatgtcgattcccagatacacaaatcttccgcacaagccccaagcaccctgctcatttttcagagttgagcatctatttgtggaacatatgtgagcagccactggaaattttccattcttttgaagacagccaaacattcattccaggactatacatattttttattgtgaaaaatgacttgaaaaatgctcttagagactaagtttttaaaaatattctgttctgttacgctttctttccttttctttttttttctgggcagaaagaaatacaaagaagcctaatttaaaagtatgtttaattcagagaataggaaactttctttcttagcctacttttgagtatttctgtcacaagtgtattctcagttcagctctgaaggagtcaatttaattggacttgaccaactgctagtgccacttagcagatgctgtagtagtttttttattgtgtgatcgccccagcatatttatggttttaggttatggatttttaaattgttaaattcttacccagactcaccatgttaacctatgctccatctgtaagagtaagacctcaactccttgaagagataggtagagagagaaagaggaaaaaaatccagtatcttattggaaccagaagactgaaagagaaacgtgctcctatagagtcatcttgagaagcatgactcaaatttaaaatggagcattacagtccagagaagtgtagtaggaatgccacctttacagcaattttccagctttatattaaataaataaataaataaataaataaataaataaataaataaatggctgggtctgctgaagtttttcacatataatgtatatgtagaaaattgtagcattctatttaccttgattttggagccctcaaagtaacctgtggaattttttgaaatcacactttcactgtagcctatggaaagtttatacaggcatatgtcacttttagagttgcagagctttgtgctccgtctgctcagcagaagcagtagaggttttattactgtcgaatcctagcagtatattatttaaaatgaaaacaagcaaaaacaaacaagcagaattcttcctcatcacactgctcatagttttctacctgctatactgtttcttccttccatgattttgctaatgctcttctatcttcatctctttttcctgtggtgaatcccaactgaggccataaagttcaattcaaacattatctactccaggaagcctgttgtgcccacccctcaacaaaagattgaatgaataaatagcaagactcccctccccaaattctattttcacagagtttaaaaagaatagtatccttcatgcaaagaatattctactggcatgtaatttaaacaccactattattttttttttttttttttttttttttttttgagacggagtctcgctgtcgcccaggctggagtgcagtggcgcaatctcggctcactgcaggctccgccccctggggttcacgccattctcctgcctcagcctccggagtagctgggactacaggcgcccgccacctcgcccggctaattttttgtatttttagtagagacagggtttcaccgtgttagccaggatggtctcgatctcctgacctcgtgatccgcccgcctcggcctcccaaagtgctgggattacaggcgtgagccaccgcgcccggcctaaacaccactattattaaacatgatgttaaattgatcttaaacttcaacattattttttcacccatgccacggatctgaacggcaaacgagcttccttacctgtgccccctgcagagtgcaaaggcctggaccaggctctgtcctaagcctgtattacttccattacggtccacgtctgcacccctccccaggattagagcacatcctcagctacaagtgtcacctacagctatccacaaactaaatctgaattagaggtgcacaaaaatattaagcattcatgaaaaaaattgcaaaatatttgtaaatataagatatgaggactctgtaagcaagcaaaatagaacacatttgatttgcatcctttacaaaactcaagtattttcataattttcagctaaagacattagtgaaaacttgagctcttaatcaccatagaaggtgcgcaaattattcctgaggcaaagacgctgacctttgcaatgtttctctttcagggaaatggaaaagctctttgtactgcccaaatacctttgctgaagcctcagaaccacatagacacagtgctgacaatacaaatatttttatttagtgaatatcataaataatccttaatccatgatttttgatgttataactattcttctttttttttttttttcctttgaagacagggtctcactcaggctgcaagacagtgcaacaatcacctcatcgcagcctcaacttcctgggctcaagcaattccccctgtcccagcctcccaagtagctgggattacaggtgtgagccaccatgcccggcaattttttttaattattattttttggaggatggggtctcgctatgttgcccagacttgtcttgaaatcctggccttaagtgatcctcctgcttcagcctcccaaagcactgagattacatggcatgagccaccaggctcagccaactattcttagaacctctcactaaatagaagactttctatatactaaaaatcatttttccaacattattctttgttccttgaagtaggcacaataaatgtttattatcatcaaatagcatgtaataaacatctattgcgtttctgtagaagtttggctgaggatctgcactttaaggaacaagaaagaaagaatgtctagcgaagcaaattaactgatctgtcagtcccttgagagaagaaacgacatcatactcatcacgtttccaccattctcttcaaagtgcttcaacacagatcatcgttaaatgtttactgaaggcatgagtcactatttatggacatctactctatacagaaaagactccaaatgctgaaaaagtcagctctaatggtgactccatctagtatgttatgacaccacagtgtatctctcattatcataatttaaaaagttcttcatgcaattataattttaactcaatttaatttaaaacacggcagaatttctttaaattaaactcaattgaatttctttaatttttaaattaaactcagtttaaaacactgcagaatttctgtaatttaaaacactgcagaatttcagtttaagttaaaacactgcagactttctgtttgagaaatgaagtgatttgcttaaagctagcatattacccttttgtaaagctgaattaatgaactaaatttctccacaatctttccaataagtaattgctaatatctaagaataacattttgtttatttgagtacttgtgtcctgtccagagccttaaatatgattgcacagccattgtcacatctgagggttcaacaaagcaaccttcaaccaaaggagcaggagagatgaactccagcccagctacagactatgttctctaaccccttgatctaagaaatctcagcaatggcaaaaatctggatatcaccaattaatggccggtgtcctagttctgtctgcctttggccaaaagcgggtactgaaaaaagagaaaagcagccactggcttccaggaactggctgggcactcacagctatgtcttggtgcttccttggtaaatatgaacaatttcttagaagaacattaacaccggacaaggccactctagaaccctcataggtcaagataaaaacaagaccactctgtaatcagatctgaacacaaacaaaacatgaacatgggctgagccataaaatatcaaattccatcctggataacatgagcgactgctgcttctttatcaatgccatatttagtcttgtctaatctgtcctcctgtagaaaaaatgtattaagatacccaatcaggccggccacggtggctcacgcttgtaatcccagcatgttggggggccgaggcaggtggatcatgaggtcaggagatggagaccatcctggccaacatggtgacaccctgtctctactaaaaaaaaaaaaaaattagctgggcatgatgttgcgtgcctgtaatcccagctactcgggaggctgaggcaggagaatcaaaccagggagctcgaggttgcagtaaactgagatggcgccactgcactccagcctggcgacagagtgagacactgtctcaaaaaaaaaaaagataccagataatggaattgtccctacttcctgacagcacccaatctagagcaaaggcccacttcctcagatcctctccatgactaccaatgccaaaatcctgtaatagattcttcctaaaaccctattactgagacaccccatggttcccgatggcgtgcattctccctaccctcaagaaagaataaagttgacttgttcgactataggcgtgttcctggtggttttgggctagaggcatcgacatttttttaatttaaaaaaattgctaatatctattaagattaatataacaacaacaacaaaatttaagttacttcatcagggcgcttttggttgtaaagagtgatctttgagggaagtataaaaacataaacttatcaaagaaggaatttgcaaaaaggtacccagaactaaagggaaaggatgtatttaggcctcaaggactcatggaggcagagactgtcatccttgctcctttctggacatcttcatttctctctaggaaacaacctttgctattttccatccacaaagtgggtcatgaaggctcacagctcctgggttaaaatctctgccactgaagacggcaagacatttgaggctgaaatcttttagtcctaagtcttaattcctgatgaagggtctcagctgcagggaggtgcccattcctgtatcagccaactgtggcaagaaaagatggatcactgtgcataaaaatggtcatgctggcgagaggtatcgatggaggcattttccagaaagaatgagtgctttgcagacataacaatgggtgtaaactacagcttccttccagtttgtaaagcttttatgtttcatcataaaaaaaaatgcagaaaagagaggaaaagtggaattcaaaagcaaaatgtcaaattttgaatgaaacgaatatgttattctgccttgctatgaatataaatgtgttttgttctatgaacttattatagtcccgtaaagcagagtaggaatacattgtttttgtgtatgtgaatgaaaccacactttatgtgcactaaaacagctactcaaagaaacttcgtgatgtgtatatgattttgtgtttttatgagtgggcatatttttaagtaaataattcactttctaaaatgaataacatgtaattgagtattgttacttctggatttttatacatcaggtatatctagagaaaattattcagttttcatagaattaaaaagattaacttctgctcacagtttgaaactggatcaaacttatgatataaagcccttcttccaatattccatagctaataacacctatgaaatctcaaaggtcaatggaaacaaaataatcaaaacagatatgtttcctttcagtaaacctcagatacatttgaagcatttgcctacgagactttaaaaatgttgttcagcagtcatttaaatgcatttgcagatgtcatggcaaaaagcaaattatctggttgattacattttctttctaggttgttgctctttagagttctctgccccttgccctaagagcagagtcacagaaaatgttgggttttgttgatataacttgaatcttcaaatcaacaggatagaagcccgatattcactgtaattactactactgtgttctgaggataggaaaagtaaaaatatatttccctaccctctggcaaggtacaatgaaaacaaattagagttctgtggtagagctccttggctgttccttgagcagacattttctcaagatcatggggatttaactagatttttaatctttgttgtgtaagttccagaaatcataaaaatatctcttcagacgcaaagcaggcattttgtctctcttcaaagcccaagaagctttaaacctaggcagcaaaaacagcaaggcagcaaagatgacaataatgaggagataaaaggtaatggagaccaccctcaggattatttcctgccctctactggagctcaggaggattccttatcaaccagagaagcttttcccaagtcgcattcagagaaacatcacgtctgcctcttgtgtgggatggtgacagtaagtgtgggaaatgcggagttaagagaaggaaggaaaatagggttccttgatgtgcagcctttattttgataaagcaagttgtagaaaaatcaagagaagactaagtccgcagtgtttccttaggatggggatattggatccctttttaaagaccattttatatttttatgttttagttctatggttctttagactcaaagaaaataaaacaagtaataagtgtgtaaaatgttcagatataactatgaattttgggtcagctaccatattggaacacattagaataaattatttattaatcgattaatcaattccatatgctagctggtaggcataaagaaaatcctagtggatcattcttgccctcaacacatatatttttttccagctacacacaggccatgtctaactgtctaactgcctctatgaaggacataggagataaagaaaatgtttattgatcgataaattaaaaacttgctcttgactggataggcacagacctcatcaatctagtccagacacagttgctgtatctgttgacaggtagagataatactttttattctttattagcagagagtaccagcattggtcaagaggtggatgaggcagaaggtacaagtagatcaaagaggattccaattccggaaatttcccagttcattaaagattgacaaaatgaatgcacttatgcatagtcaaaactacagctcaggccgggcgcgttggctcatgcctgtaatcccagcactttggaaggctgagatgggtggatcatgaggccaggagttcaagaccagtgtggccaagatgctgaacctcgtctctactataaatatgaaaaaaattagccaggcgtggtggcgtgcgcctgtagtcccagctactcaggaagctgaggcaggagaatcacttgaacctgggaggcagaggttgcagtgagccaagatcacgccactgcactccagcctgggcgacagagcaagactccgtctcacaaaataaacaaaaacaaaaacaaaaacagaactacagctaaggccaagtgcttttgtgccaatcctaattattttggcactgaacgtgctctatatagtgctatgtatagaccaaggcccagattgaaaagagtgaatctttttaaaaataaccctgaatatttcctgctgtgacaaaatattgaaaataccaattaatgatgccatttttggggttctatttaaaatgttttctattattgaagatgtaatttcaataccatgaggtattgaatgatcacgaggtcaggagttcaagaccaacctggccaaggtgctgaaaccttgtctctactaaaaatacaaaaaaaaaaaaaaatattagccgggcatggtggcgtgcacctgtaggcccagctactcaggaacctgaggcaggagaatcacttgaacccaggaggcagaggttgtagcgagtcgagattgcatgactgcattccagcctgggtgaaagagtgaaactccatctcaaaaattaaaatgaaatttaaaaagaaagaaagagggagagcgagaggaggaaggaaagaaacagaaggaaggaaggaaggagggagggagggagggagggaaggaaggaaggaaggaaggaggaaaggaaaggaaaggaggaaggaagggagggaaagaaagaaggaaagaaagaaagaggaaagaaggagagaaaagaaaggaaggaaggaaagaaggagaaagaaagagaggaaagaaagaaagaaagaaaaagaaagaaagagagagagagagaaagaaagagccaaactattttccagagggcctgagccattttacattcctaccagcgatgtaggagtgattcagtttcttcccatccttgctaacattagtgttcctattttttagttcaacctttctgatagtatgtgttgattttcatttgtgtctgcctggtggctaatggtattgaacatgttttcatatgcttttttggtgtaggtacatccttttctgtgaaacgtctcttcatgtcttttgaccattttctaattaattttttttgctattgttttttcagttctttttatattctacatactagtcctctcttggatatgtggtttacagataatttcttttactctgtaccttgttgttccaccctcttcacaaggtctttttcagaaaaaaaaaaagtttttaatttggatgaggtccaatttatcaactttttatagattatagtattaaatctaagaactctttgcctagaccaagatatccaataatttctcctactattttcctaaattttttttgttttaattttccattttgtattagtgtttgtataagttgtgagacttaggtggaacttcctttttgcccgtgaatgtccaatagctctagcaccatttcttgacaaagctatctttcctcagttgaattgcttttccatgtttgtcaaaaatccattgtgtctatttgtgtggatctatttctggattctctattctgttttattgatctacatgtctatccttctaccaacaccacacagttctgtttaccacagttatataatgtcttgaatatataatataaacataaaataaattcctcccacattatttttctttcaaaattgttttacctgttctacttcatttgctttacctataaatcttagaattatctctatatctacaaaaaaatcttgctggggttttgaaaggaatttcattaaacttgtgtatcaatttggggagaactggcttttatacaaggttattcttcatggatttgaagtatgtctctccatttatttacatcttcttttatttctttcaccagcattttgcagttttcagcatacaagtcctgaacaaactttatttgattaacacctatttaatttttgggcaattttaaacagtattgtgtttttgatttcagcatccacatgttcactgttagtatataaaaatgtaatttacttttgtatatttattgcatatcctgtaatctttctggactcgattcttagttctagaaggtttttttgcagatattttgggatttaacaggtaaatataataccatctgcaaagaggggaagctttaatttcttcctttctgatctgtgtatctcttatttccttttcttgctttattgccctgactagaaatttcaacattatgttaaataaatcctcaccttgttctcaattttagaggaaaacattcactcttttacaactacatataaagtaaacttattattattactattattatttgagactgtgtctccctctattgtccatgcttggctaattttttaaatttttgtagaaatagtgtctcactatgttgtccagccaatgatctcaaactcctggtctccaagtgatccttgcacctcagcctcccaaagtgctgagattaaaggcatgaaccacagcacctggcctaaagtttttgtagatgttctttatcaagttgaggaatttctcttccattcctgttttttgaaagtttttattatgaataagttttgaattttgtctactagcttttctatattggctaatatgatcatgtgatttttctattttatccagttaatttgctggattacagggttaatttttgaatatttaaccagcctgcatctctgaaataaacccacttggttatggtgtataattatttttatatattgctaaattctatttgttatattttgctaaggagttttacatcttaatgaaggatactggtttgttgtgttcttttctctacgttatttttctagttttgacatcagggtaataatagcttcataaaatgaattgagagatattctctcctcttctgttttctggaagagactgtgtataattgaatttttttaaagtctggtagacttttccagtgaaaccatgaacctggagattttgtttttagagatttctaaattatgaatttaattttcttaatagtcattgattgcgctattcaaattatccatttcatacagggtgagttgtaatagtctgtggtttttgagacactgatcagttttgtataagatgtcaaattatgtgtttaagtttatggtattcttttatcctttagatgtctgcaggttttgtagtcatttcccctgcttcattcccgaaaatggcaatttgtgtcttttctttttttttttttgtcttgttacagaactgtcaatttatcaatttttataaagaaccagctctttgtttcattggtttttaaattatttgaatgttttcaattccattgatttatgctctttattattttcttacgcttgcttgctttgggtttattttgctcttcttctatgttctagagtttggagtttagatgattgatttggaaattttcatcttttctaatgtatacatttatgttataaatatttctctcagccctgctttagcagtgttccacaaattgacatgttacattttatttttattgttttttttttattttccagaagatccttcaatgatattatttaaagtgtgttgtttaatttccaaatgtttggagattttccttttagttttttctcattgatttctaatttgattccattatgatcagagaacatacttggtataatgtctgttttttaaaacttattatgatgtgtttaatggcccaaaatatggtcttagggaatgtttcatgggaacttgagaccatgaaaagcaaaacaccatgctttttgctgttagttggaatatcctgtaatcaggtcaagctgattgatcatgttgttcaggtcatctacatccttactgatttttctgcctgcttgatctatggatctatcagttactgataaaggagtgttaaagtctcagctctaataatggaatagtctagttcttctttcagttctatccatttgcctcatgtattctgaatctctcttgttagatacatacacatttaagtttgctacgtcttcttggaaaaatgagctcctcattattatctaatgaccccctttattgcttccacttttccttgtggtgacgtctgcttcatatgaaattaatatacctattccaggtttcctttaatcaattttgcacaacacatcttttttctattcttttacttacaacctgactatgttgttatatttgaagcaagtttcttggggatagcatgtagttgagccatgattttatccactctgctggcctctgtcttttaaatagtatatttaagtaattacttgtattaaatgtaattaccgatatgtgatggtatatttaatgtaattactgatagggcttaagtatgccattttattttttgtgggttttttttcttgttcctgccttccagtggattgcattaatattttttaaaatccatttcaattttctaagtttgtttgtttgtttgcttgtttttacagtcttgctttgtcacccagtctggaatgcagtggcatgaaaatggttcactgcagcctcagcctcctgggcttaagtgatcctcccagctcagcctcctgaagagggaacacagatacatgctactatgcccgactatgtttttattattattatcattattattattattgctgttattatttagagacagggtcttgttatgttgcccaggctggtctcaaactcctgggctcaagtaattttcctatttcagcctcccaaactgctaagtatgattacaggtgtcagccaccgcacctagctctaaatatttttgaatgcattattgtgcagctctttttagttgatgataaaattatattcacacaacttattatagccttccggtgtaatcactttaccaatttgagtaaagtgaagtatggaaccctatgtctcttcatgttcctttactctccccaatttttaatgttttttagctaattcctctatgtacatttagaatcatatcagacgttgttacatttttttcttcaacaatcaaaacaatcaaaaaaattcagaaggatgggtgcagtggctcacacctgtaatctcagcactttgggggaccgaggtgggcagatcatttgaggtcaggagttcgagaccagcctgaccaacatggggaaaccccatctctactaaaaatacaaaaattagtcgagaagggggcacatgcctgtaatcccagctactcaggaggctgaggcaggagaatcacgtgaatccaggagacagaggttgcagtgagcggagatcgtgccactgcactccagcctgggcaacagagcaagactttgtctcaggaaaaaacaaaattttcagaaaatcagagaagataagtctattgtatttcttacatgtttgcttaccacgttttgttcttatctgatattccaaggttccttttcttatcgtttcccttttatttagaaaattccttttaatcattctgttagagttcgtcagctggtgacaaattctctcagttttccttcatctgagaatgttttcatttccccgttatgcctcaggaaaaatgtttgctgggcagaggattacggattgacagttctttcttttcagcaggaaaggaaaaattttgtggcactttcttctggcatccacggtttttctcatgagaacgctgctgtggtttgaatcatttttctcttctagttaatgtgtcatttttccctgactgctttcaagatgtttgttttgtggttgtctgcagttttcaaatgtttattaagtggcttggtatgcatttcgttgggcttatttatcctatttgggcttctctcagcttcttcaactgaaggtttatatctttgctatgcttgtgatgtttttaagccattatttcttcaagtactttttttttttaagttcagctttttattgaacacattataaaagaggtttcgtcaaaaagaccaaagcccatgtcaccatcagacttctcggattcttctttctttgcttccactttcttctcctcagctggagcagcagcagcagaggcgggcagaagctcctgctggtacagatagagccagctgctggaccaggtccaccagcccctacattgcagaggaggctccccatgttgactttggccaggcctttgcaaacaagccaggccaaaagggttcaacatttacaccggctgctttaatgagggcattgatcttattctccgtgacggtcacctcatcatcgtgcggaatgagggccaggtagatgcaggcgagctgggagacgaaggccatggcacgggtgagtgtggggctggcgctgccggacgcggatggaccgagcaccttggtggcagctgaggaaaggttcttcaagcacttttttagtccccttatctttttcctatcctttcataactccaatggcaccaatgttagatcttttgttataaacccacaaaagatctccatcccagaggccgtgctcctttttgtcagtctgttttctctccgctgttcagattaggtaatttctgttgttctgtcttctatttcactgacttagtggtttcttccatcttatcgattttgccattgagcccatccactgagttttcctttttgatgttgtccttttcagtcctaaagtttccatttttttataacttctatttctttgctgagaatttcagtttatttcctgaggccttctagtttgtaatatgcttaaagcatattattattattattattaaataatttttatcatagatcaggggtgtccaatcttttttggcttccctggccacactggaagaagaattacacataaaatacactaacactaatgatagctgatgagatttttaagaatcacaaaaaaaacaaccaacctcataatgtcttaagaaagtttacgaattgcttttgggccatattcaaagatgtcctgggccacaagttggacaagtttgtcatggatacttcaaaatctttgtaagctaatctattaactctgtcatctcaatcttgaccactattgatatatatattttttccatttagttagaggtcttcctggttcttggtacgatgagtattttgttgttgttgttgttaatacagcgtctcactctgtcacccaggctggagtgcagtggtgtgatcttgtctcagtgcaacatctacctcccaggctcaaatgattctcgtgtctcagcctaccaagtagctgggactacaagcatgtgccaccacgctcggctaattttttttttttcccagtagagacggggtttcgccatgtcggccaggctgttcccaaactcttggcctcaaacaatccacccacctcggcctatcaaagtgctgcgactacaggcgtgagccactgagcctggcctgatgaatgttttttaaaattgaaagctggacatctttgtattttgttatgcgattctgggttgtcgttggcttttgatgacaccactcctccggaagagggaaatgctgtttcatgaccacctgctgagggtagaaatttgacactgcagtgagggtggcctggtcaccactgtttgatggcagaagtctcgatgctcccttaggcttcttctgacaccactccagggtggagaagtggggtgttattactaccaggttggtgtgggatatccagtctcctctcgtgatcttcactgaaatgtggatgggggaaaggaggtctcattcctgacaagaagcagaccagtggtgactagggatggggcggggtgagggaaaatgaagaaaaatgggtttcaaaaaggcacaaggaaacttttggggagaataaaaatttctactattttgattatggctgtggttttagggatatattcatgtgtccaaatgcatcaaaattttatactttacagctatccaggttgtgtattaattatcccttaataggtataaaactcaaaacatctgaaaacaaagaaggaaatattttaagtctccttactcatgtcttcaatgtgaattaggttgtaagatggtaagactttctttttttcagcactgaatggtccagaactgtactgttcaatatgttagccactagccatatgtagctaattaattcctcatttatttcttttcttttcttttcttttcttttttttatacagagtctccctctgtcacctaggctggagtttaatggcgcaatctcagctcactgcaaacctctgcctcctgggtttaagtgattctcatgcctcagcctcccgagtagctgggattacaggtgcgtgccaccacacccagctaattttttttttttttttttttttagtagaaacagtgtttcaccatgttggccaggctggtctcgaactcctgacctcaggtgatccacctgcctcagccttccaaagtgttggggttacaggtgtgagccaccgtgcctgactagttcctcattttcactagctacacttcaagtgctcattacccacatgcagctagtgaccaccttactggacactgcagatatagaacccttacatcattaagaaactcttggacagcattggttcaggtattacaatattatgggaataattatctggatatgtgtgtgtgttcatgtgtgtgtgtgttttcataggctaatttttactttttcaaaatgaaattatgaatgtgaaagtgaatagtacaggacctaacacaatatagctatacaacaacaataaaaatgttagcatctcttccatccagtttggaaaatcttttatttgaaataagagtaagaagtcaattgagagaattccaaaaggtgccccaaagcaaaaacaaaagattgaggtttaaatgaactgtacggtataaaaaaggcaacaattttaaaagtaagatagtaaggataaatagtaaaatagtaaggctttctaattaagatacaaaacctagcagccataaaacaaatggctgataaatatgaattcacataaatttaaaaatttctatacagaaaagaagaaaaggcactataaacaaaataaaaataaataaataaatgactggtatacccagacaacaaaacatcattgagttctaaaaagaaatgaactaccaagccatgaggagtcatggcagaaccttaagtgcatattactaagtgaaagaagtcaatctgaaaaggccacacactgtatgactccaacaatgcgactttgtggaaaaggcaaaactatggagagagtaaaaagatcactggttgtcaggggtggaagagatgaacaggtagagcatagaggattgttagggcactgaaatgactctatatgatattccagtagtggattcttgtcattataacccatagaatgcacaacaccaatgataaaccctaatgtatactatggcccctgtgtgataatgatgaaccctgtgtgataatgacgcgtcagtgcgataatgatggcccctgtgcgataatgatgcatcagtggaggttcactgaaccgtaacaaatgtactactctggttgggacttgttggtagtggaaaagactgaggtatatgagagtaagaggtatacaggaaatctctttacctttctttcattttcctctgaacctaaaactcctctgaaaagcatagtcttaaaaaaataggcccggcgggatggctcatgctggtaatcccagcactttgggaggccgaggcgggtggatcacctgaggtcaggagtttcagaccagcctgaccaagatggtgaaaccccatctctactaaaaatgcaaaaaaaaaaattagccgagcttggtggctcatgcctataatcccagctacttgggaggctgaggcatgggaatggcttgaacccgggaggcgtaggttgcactgagccaagatcgagcctttgcactccagcctgggcagcaagagtgaaactctgtctcaaaaaaaaaaaaaaaatggtaccacactgtgaagacatttttgcaatcaactgaaaatggaaagtgtattcttccatgttgtctccccagcactcatcattttgctgtcacattttatatttactgatattagattttatgtatctttgttttaattgcccacttagacacagttcatgagagcagtgattttatttgtcttgcttatgcctgtatcttcagtgtccaaagtagtgcttggcatatgataagtggttggtgaatgaatggaaaaactttgagaaattgacaaagagaccagaaaaccaatagcaaagcaggcagaaatgtaaacaggatgttcacgtaaaagtcaaatacaaatgattcatattaaatgatgaataatctcattcatacttcaataaattctaattaaaacatatgaatacaagttttcactcaatacattcgtaacatgaaaacaaaaaatttataatacaccactttgaagaagagataggcagcaagagttttcatacacttgttagtttctttgtaggatacttttacaatacttataaatttatagttattacttttataactcagcacatgcactattttaaaaatttacactattggtatactcgcaaataaatgtgcacaaagatatatactcacacacatacacaaagatacttattttatcattgcttataatgacaacaaaaaaagtgctgtgccagccgggcgcagtggctcacgcctgtaatcccagcactttgggaggccaaggcaggcggatcatgagttcaggagatcaagaccatcctggctagcacagcgaaaccctgtctctactaaaaatacaaaaaattagccgggcgtcgtggcaggtgcctgtagtcccagctactcgggaggctgaggcaggagaatggcgtgaacccaggaggcagagcttgcagtgaaccgagatcgcgccactgcactccagcctgggtgacagagcgagactccgtctcaaaaaaaaaaaaaaaaaaaaaagtactgtgccaatacaatggatatcatgctattctgatgatgtgagcacttccctaagtgccaaccttactatcagaagaggacttggttgggaaggataatggaattccatcaagtgttttatcttcactaaggattttgagtttgcatcaaaacctaattactgcaaaaaagcatcaggacccatttccaaaccctcatgaaggggctctcccactcctgtatctgcctccagcaaagcactactgggatccactcaccagattatttatttatttattttttgagatggagtctcgctctgtcaccaggctggagtgcagtagcacaatctcggctcactgcaacctccgcctcctgggttcaagtgattctcctgcctcagcctcccaagtagctgggattacaggcatgtgccaccatgcccagccaattttgcatttttagtagaaacagggtttcaccatgttggtcaggctggtctcggcctcccaaagtgctaggattacaggcctgagccaccgtgcccggccactcacctgattattaaaccagattcatttaggactctgctgggcactgcgagggaataacataacagaagcatcatttctacccagaaggacttcaccgcctactaaggcaagctgtgtatagaggagaaagttaaatcattctgactactgcctttaatccaagactaaggcctgaaatcctgaagaatttacaaaatgcttagacctccattataaacttgcagttgccatccccagcctttcttactgctgcttggtaattcattttccaccaatttgttctctccttttgttcattccacaataatgagtatacatcgtgtaataatggggatactggcactgtggagagacatggtaaaaagaatggaggggtcactcttaagaaacctatttgaacagtatctgaagtgaggaaacagataaatagatcatataggcatgaaggaaaagcctctcctttgccctctgaaggttcattgaaaatcattgacaagaggcagattaataggagaaaaagcacacgaacttaatgtgtatatggaagccttctggatgaagacccaaagatatagaggaaattgtccatttttatgcttcgagtcaacaaagtctggaatatgactggacagaaagggaatgatctaatgctactagactgagtggggaagcccagcaacgcctgtccctctagattcttctggcctctctgagcagcattccttccttctgggtatggggcagagctctctctggactgggggtcttaggacctacagtccaacaaggcaggtcagataacttctttatgactacttttacggctggctttgaggagaaggggttctgatttccatgacccgcctcgggccagagggattctagtctctggggagaatggaacaggtcaggagaaggtcagagaaaaagtttgcttctgaggctgcttcagggtattgcattcttagtcccaacaattccaacgtggtaagtgctaggacagacttaagaacagccgcctacaggctcacatacatgaggtgcccaacacagactgagagagaaggaaagggaggaaacactcaggaacttgagtttatggtcagcttcctcccccattctttatggtgactgttccaatctttcaccatggttcaatttctcaatcacttctatgaagttgctcaaaacaaaagcaatatacagaagtttaactaaaaggtatagccctatttgacagagggataatttatacatacagttttgcacagattatatgcacagaattttagtccaaaacttgcaaagttctgacaaatgtatgcaccacgtcgattaaggtataaaacatttccattgtggtaaaaatttaaatgccctcctgatctttcacaccaagatcaccccatgccctgacaaaaaaaaactaggattctcatttctgtcaccacgttttagttttgcttttatgaaatgaaatctcacactatgcacttgctagcgtctggcttctttttatttactttttattttttgaaatggagtctcacactgtcgcccaggctggattgcagtggtgtgatctcggctcgctgcaactctgcctcccaggttcaagcaattctcctgcctcagcctcccgagtagctgggattacaggcatccatcaccacacccacctaattttttgtatttttagtagagatggggtttcacttacgttggccaggctggtctcaaactcctgacctcgtgatccacccgccttggcctcccaaagtgctgagattacaggcgtgagccaccgcgcccggccacgtctggcatcttttgctcaacatactgcttttgattgtcatccatgtcattacctgtattcgtgttccaagttgctgagtcacttccactgtatgaatctactacaatttgtatatagaccttcaaattttttccagtttatggctcttataaaaaatgctatgaacattcttgcacagagcttattgtagacatatattttcgtttattttggtaaatcccttccctctgcctttggtagacatataacgtagtattctgagtcttaaaagttagaaggttaggataaaaaaaaacccagtggtaaaactgtatcaataattctcaatctgatttttaagtggcctcagttataatcttcccttgtctctcacttcaattagaaaatgaaggttagcaaatattaatgccatcaatatacagcctccatacacatttatctgtctttatagctcctttctcctgttttctgttggactttgaggaaaaggtttctgttttcctgtccaaggcaaatccctcttcatcttattttctaccatctcctcaggagctttactgtactttgccctcaagtctttttcatattaaaaaaatgtctatatcaagctcgctagacaagaacatggcacacacagtctggcaaacaagaaatatatataaataatcctacaaacagttacataaagtgaaaagttctgtaaaggaaaactagagggaacaatgaaagattaaaacaacagatcctgatttagtttggaagctcaagagacttctctgaacacttggatagaaaacgttgaaactacagatgagagagaattataaataaggaaagtacttcaggagataggacagaattagaatcaaagtacagttgatgcttgaacaacacaggtttgaactacacgggttcccttataggtggactttcttccacctctgccacgaaagatagcaagaccaacccctcctcttcatcctcctcctcagcctactcaacctgaaaataataatgaagccctttatgatgatcagctcctacttaatgcataggaaatgcactttctctttcttcttcttcttcttattatttttgagatggagtcttgctctgttgttcaggctggagtgcagtggtgtgatcttggctcactgcaacccacgtttcctgggatcaagcgattctcctgtctcagcctcctgagtagttgggattatagacacatgccaccatgcccagctattttttgtatttttagtagagacagggtttcaccatgttggccaggccagtcttgaactcctgacctcaagtgatccacccatctcagcatcccaaagtgctgggattacaggtgtgagccactgcgcccagccttctttctttagattttcttaacactattttcttttctctagcttactttattataagaacacattatcgtaagaacacagtggtactttactaccacttcaagtatgttgaatgctcttttattcttggatatataataatagggcataatatatataatgtacaaatatatgttcatcaactatttatgttattagtaaagcttttggtcaacaataggtcattagtagttaagtttttggggaagtcaaaagttacagatgggtttttgactgcatgggagttggtgcccctaaactctacgttgctcaagactcaacggtgtaaggaatttgatttaggtagaaacagagtcaaaaccctttttctgagatagaaagaaagaatttgactagaaagtgaaatcagtttaaaagcgtggtatgagtatgtgtattccttatttttcctatgaaccagaaggcctgacaatcttttgagggagctgaggatgatacttgaaatttgaaggaagtggtgagaagttagaagtgctactataagaaatgagagaggctgctggcaaggaattagtaaaaggtttgctgagaggtcctgagggcccaggtgagggtggaaagcacctgtgattaaggcgctgcatcttgtacctgcaacacccaactgtgcgggcacatgcgcacagggacaacaggtggttttaaggtgtgtctggcaaaggccctggaggctattcaatgggaggaggaagtaagaaaattgttaaaagaatgaggacatttaaaagtcttgaagcgaaaataaagttaggcaaattctgccttttctgcctccacacctcaaatatacagatatgggacctgtatgcaaagatccgtccctactttatatggcaacaaaagacaaacaaacaaacaaacaaaacaaacaaaaaaacaataacaaaaactgtccttcaaaaaagaccaagtttcttttaaggccaaaaatctaaaaaaaaattctaaagagactgagcctgtaaaagagtttctatatatagcaaagattcagcaactgagataaaactctattttttctcctcttaaaaaaatggagatgccagaacattacctagacatgaacttctcacatttcaatgtgcgtataaatcacgttgttaaaatcttgttcagatgcagattctgattcagtaaacctgggttgggagcctgagattctgctttttaacaagctcccgggtaatgttgctgctgctggtcctcattgagtagcaaggatttagatcacctgaggagtgtaaatcaactctgagtgactcaatggggcttctgtgtttgaaaattgtaaaaataaataattcaaaaccaaagctgttgaaactgtaaatttttttcagccttaatggaatgtggccgtgtgcagaggctcacatctgtaaacccagcactttgggaggctgaggtgggcccatcacttgaggccaggaggtcgagaccagcatggtcaacatggtgaaacccatctctactaaaaatacaaaaattagctgggcatggtcgcacatgtttgtaatcccacctacttagtacgttgaggcaggagaattgcttgaacctgggaggcagaggttacagtgagccgagattgtaccattgcactccagcctgggcaacagagcaagactctgtctccaaaaaaaaaaaaaaaaaaaaaaaagaaatgtgattatgacattcagtcataagacagacagctataacctaggcagctgtaacctttgtttctctgattatagattggcctttactttacttacattgtttcgtaaaatgtaataaaggattaaagggcaccagagaagaccccttgcctcttcattgttggatcttcattatagattaacttcccttttacttcttttatacaaagacctcatgactatcacacagtctgaaacattaaatatacccttctaaactggaaaagggaaataaaacaagctgtaactaatcaaattgctgtaactcataaaccagccttgtatggaaaatattataatccggttaaatttctttgttttctgcctgtataagcaagaccttaacttttcagcttgggagcactgaccccattcctttggaatctgggttacttacatgaccattctcagctttgcacatgaataaacacttttaacctggattctgactctttcatttatttcaggttgacagaatgtaggaagagaatctggcagatctcagataaacagcaaaaggaagagagaaggtcctttgggtccctgtggtgaaggagtctatagtgacctgaattatgaaactgccccatagccttggaggttagagttcaaataggaggtaccattcagatttcccagccattactgagttgaaaactggtggcatcaactggcaccctgtagataaactgacacacgactgtaaacccagaaattggaagtgaacacttctctcactgttatacttgaatgggcatgttagaaggcatactgcaaattgttggaaggagagtcaacaatgagggacaaactagaaagtggaagaaataggtcagatgaaagttcaataacaaagcattaagttgagatggtatttggggtagtacctagtaagacgacttaagaaacatggatgaagctggaaaccatcattctcagtaaactatcacaaggacagaaaaccaaacaccgcatgttctcactcataggtgggagttgaacaatgagaacacatggacacagggaggggaacatcatacaccggggcctgtcagcgggtgtggggctgggggagggatggcattaggagaaacacctaatgtaaatgactagttgacgggtgcagaaaaccaacatggcatatgtatacctatgtaacaaacctgcacgttgtgcacatgtaccctacaacttaaagtataattaaaaaaaagaaaagaaacatggtatgactttctgggcttgtgtatctgaaggaaatggctctgaagtgatggctgtgctggtgctgtgaatgaacacctgatcatggtaccagtccacagtctggatgcttgtggtagagccaaagaattagaatttctctatggattgacgtttccaacataatacacatggatttaaacagttaaggcaaaagtgtttagcaacatatgctttcatgtcactaacctaaatccaccaggaaaaaaccccaagtggatcaagaactctgctctgtgatgatctctccctgacacattcagcacacagaaaggaatcattgctgatcgtttgtaacatgccaagaatgaaactgcattttgggatactttattttgctctcctccttagaggccaagagagaaattaaattaaagtccatagatcaaaagcataacttctcagctaaaaatgcagctacacattagttaacattcagaagaccaggccctttgcggttttgtgactttcaagttaatgtcttctcagccaatgcactaatttcctgctgatcctatcaatgggtcgcgtctgggaatcacagcacctacaatgtcaacagggagaatatgcagatgtctctggtggaagaggtgataagctccatcaaagtcttgatcctctcatcagaaaggctatcaccatttttcgtcccacatgggttttcccctctgtcaatatggccccgtgcctggtaaatctgcataatgagatggttttcataaatcacgtgcaatcaacacacagatttttttggacctctaaccaagactatatgtgttttaactagactgaatacataactctagtgaaataaaaagaaagtttgtctcaagcagagaaaagtcttcaaaagatggctgcaggagtatgcttccccagggagctaatctgtctgggttaggataagaaataaaatgattttgtttttcacatttttaaaaaagttcttgtggttgcaatatccaacaaaatgtactgttgactgcctcaaatggacagtgcatattcttccaggatgggcttggggactgaaaggcagaaggacatacgtgccccttccttcctggcagcaggggaggaaacggcctcatagaatggcagagagcaaagtagagcagcctcatgaaagaggccatggatgctgacatgcttgctggagaagatgaaagagatccagaaagttcctgtggccccttgagtgttagaaatgaaaaccaagtaaaaagtaagaattaagttgtctgctgggggctctccacagtgtggattgagggacctttagatgatggtgtcaaaggcattcgaaccagagtgactccatcttgagtaagggctagggaaaaaatgaggctgggacttgttgggctgtgttctcacaaagttaggtattcctagcctctaggtgcttactgttaagaaaacagattgataacatttactaaacagacccagacttaggagtgtcctgatatccccataccttgagaacagaagcattcttaattttgctttaaaggtaataatatcgattcttacaaaacatagtaattaagaaaattaatcctatatcacaaacccatgtagcacaacacatgatcttttgatatatatatatatctatctataaactagtattgtacctaaggtggatgcattcctccccttacttttggcaacgccctactctgtctatggagtagctgttctttattaataaagctgttctttcttaataaacttgcttttgctttgcgctgtggtcttgccctgaattctttcttatgtgagatccaagaaccctttcttggggtctggactgggacccctttctggtaacatcactagccagttatagacaacagtagtaatggggtggtgtggaggaagggagaccttacattgactatacccagagaacagaccgtgagctatatcaatgcaggaatattgaagagtgaatgcaaatagggcagagggcaacacgcagatacacaataggacatgacatctcaatgaagataggtgagaccggaggaccaaatgaggaccagaagccagggaaaagtccaaggtccctcatgcaaaggcacgagggcacacaacctacttgccttacaccagagtgctgtgcaagaaaaggaaggcagagggaaagtagatctgggaagaaactttccccagatgacagtaagtcaccagacagtggcaggataaccaggaagtgttcagttatacataataggcaagattaaaccacatttccaaaatctctcattatcccccttcctgacccttcatcagtcaataaaatagggctcatgaggacattcgggtcagttatacagtgaaggggaccaaaatatgtcacccaaatatacttctttggcatatttcaagatggctattccgaaaggctgcagacagaaatagtcttgcaaagctgccttttgtgctgcgagatttgcatctgtagagaaaatctacattggtgaaataaacacccaggctctctctgagtcccccttaaccagctctaggaaagattaactcacagtaaaaggagactaaaagtctgggacttttaaaggtctagcagagaaacttttaccactggctactaactgttctttctaatggctgggctgctacccgtgaggtttcatctgcataacaagatagcctttgcttgcaatgcattcctctctcactcttacataacctgtgatgctacctcctcccagaagccctaagcccctactcttctgtaacttcaggctggtataaaaatgtcagccatctgacccctcctttttttttttttttttttttttttgtgaaacggagtcccactctgttgcccaggctggaatgcagtggtgtgatctcggctcaccgcaacctccacctcccgggttcaagcgattctcgtgcctcagccttcccagtagctaggattacaggtgtgcaccaccatgctcaactaatatttgtattttttctagagatggggtttcaccctgttggccaggctggtcttgaactcctgaccccaagtgatctgcccaccttagcctcccaaagtgctgggattacaggcatgagccaccgcacctggccctgatccctgcttcgagtctcacactttgtgtatggctcctgtgtccacatgaatgttcacacatttgaatacctttttcttcctgtgactatgtcttttcttccaaaggtgtcccagctaagaacttgcgagggttaagaaaataaattatgtattttttctccccttcaacagaaataaaaagatgtaccctctgctagtgtcgtggtgttgttgtggtcaattttaaacaagctgcactagggatctgaaagggcccctcctccatttcatagctcagaaagcttgactgttgccttcactctgctggtgagaaaattagctcagcaaatatgtctcttcccactcaggcaaagcaaaaagaaatgacccctgtcaaggaatttaaaaagctgttacctaaaaggggcacaatgaggacattacctatctccattgtcttagtgttaggctacataattaaaatgactccaccatatcatgttcgtaaaagacataatgacaggaggggacagagcaaggtaatgtcgctcccaagagtcagcatattaatggggcctttcagtttgataatgtaattaaccttcttaaatcctactctcagtaaaattccaaggagcagaagctacaagaataatgtccttttcaagtaaccttactagcatcagggcattcacttgagaaatggtggtgatggtcaattcctgataaaagactttaaaacactgtttctaaaaaggtctgagctgccaaatatcagattcacatgaccaagcctatgttttcatcttcttctcttgatgaaaataatttctcctttctttcacaacctttcattttctacattttattgaatttgaagtcttgaaatgcaaagactagagagtcccatggtcgattctataaaatccaaatcatctccttcattggatgctttatgtctacaaccagccttcaatacataaaacatgagactgtccaacaaccaggtggcattggttagatagtatctctatgtatttacaatattattcttttatgcaatgttacttaaaggccaaattttaaacattaatagttcagacagcacttcaccagttttaaatccactggactgaggcactcaatgttacttgtctacaggtatctacagaactaaacttttgcaagctctctccagtcatttcgactgtggcccaatgatgtcacaggactgttgagacaacagaaatcactggatcagtcatgtaactaaccagtcattccctaaacatggaaactgctcaactcatttattatcatcctttgaatatgtattatgttccaggaagcaccatgatccttaccaagagggaagtaaaatatttccataaatatctacagttaaaagtttccatataagtggtagaaacaactatgaaaatcttgaggacgaatacatcattcctggatctggtgatcggaaaaggcatttcagctggccatgaagaataggttggtttccgtcagactgagagacgagactcttacatagagaaaaggattctccatcacttacatcaaaggaaaaatttttcatgggattgacaagtcatccagttcagcctagatacagggaaatagcgtgaggtaacactaaaaaagttgccaggtttcagaaaaccccttcagtctccagtgtgtttatgggcattgaatcacaaattgaaaaattctcccatttcatattcacaattaaggtacttctaaatctaaagttgcacagtttcaaaaagctttagttttcatctccaggctgtcaaagaaagtccaagatcttctaagataatcctttggaagctgagaaatagctataacttccaatgacagatttttattgtacccgaaatttcaagtttcattatgttcatctgtcgtgtactttctgggctaattgttctgctgtagcttagaacaaaaaatataatgcagaaactattcaataaaacctctcattttcacagttagggttcttaccattttttcttggttgctaatgttttcaatttggccatttgtttaaatttgcaatttgttagtaatttgcgtaacttaaacatctaatatataaacctttaacctattgaccattatagcttcatttcatagaagcatttataaacaaagtacatactagaagctgaatttgctcccccaaaagtttacagtcttgtgcattttagagtaaatgattggtcttgtactgattgatggtaacaaataaatgtcaacctcaattttgtattccaattttaacaaaattttggtacattgcttttaccattactatcaagtgaatttatgtaagttaatctaagaaatggcaatgatattttaggataatttcatttagatattttattcttttaaaaactaagtatattctctttccagtgatcaatataagataatatctattataagaatcaagtcagatcaaagtaaggcattgacttttttctgatctcccacattttagttgcctaaattgaatatttaccaagttctgtggcttgcactgcagaactgcactacattaagataactcccattaaacaaattcactttagtgtgtaatttaatcaagctatttgttcagtttgcaaccaggtcttaatttattgtttaattcagaggttactagaaaaatgctcacctaaaaataattaacctagaatctggcaaacttaccttataagaatattggcagaaatcctgtgtggggtgtgaggtacgatgggataacatggatgtgaaaaattatgaagatttggagcctgcctcacaccaaaccaggtttaaattccttagaaaaaattttacataaaaactcatgtctgggtgcggtggctcacgcctgtaatcctagcactttgggaggccaaggtggtctgattatgaggtcaagagaacaagaccatcctggccaacatcgtgagaccctgtctctactaaaaatacaaaaattagctgggtgtggcggcatgcacctgtagtctcagctatttgggaggctgaggcagaagaatcacttgaacccaggaggcggaggttgcagtgagccaagattgtgccactgcactctaacctggtgaaagagtgagactcaatctcaaaaaaacacaaaaaacaaaaatcaacaacaacaaaaaccaaccaaacaaacaaaaaaaaaaccccataacaacgtgagaacaaaagaaaacaagtaccagaaaagtgaccgtgtaatctatatcaatttagggagagacctgggactagagtactaatgtctctactgtaatacttctgtcatgtagcatttatcagagtctaaatttgaagtgggtttttttggagacagcatattgtggtctaattttttagtgcaatctgccaatctctacctttatgtggcatgcttatactattcacatttaaattgattattgctatattcagataaaaatctatcatctgtccacttgttttctactcattgcatttgttgtgcattttcctcttcttttactgccttccattgatttacctgagcattttatatgattctattttatctcctcttttggtgtataatttatgctgatttttataactttttaaggagttgccatagatcaacaatagatatttttaaatgatctaaatctatcctcaaataactctgtactcgtttattacaagtgcaggtacctaataacaaagacttcctaattcctcccttcccttgcagcattgctgtcattcagttcacccgatacattgctactactattgctttaaatgaagttatattttagattaattaagtggattgcttgaggttaggagtctgagaccagcctggtcaacacggtgaaaccccgtctctactaaaatacaaaaattagctgggcgtggtggcgcacgcctgtaattccagctaccagggaggctgaggcaggagaattgcttgaactcaggaggtggagttgcagtgagacaagatcacaccactgcactctagcctgggtgacagagcaacactctgtctcaaaaaaaaaaaaaaaaaaagtgagaaaaagaaaatatttaactttaccttcaattatgccttttttttatgttgcttctttgtgtatatacgagtttagtctttatttctctgtcacctttgaaacatgttagccagacatagaattataggttggcagatttttctttgaatacttcaaagatttttctccattctcttcttgattgcatagtttctggtgaaaagtcttctgtaattcttatggatgttcttctatagtttaagtgatttctatccccctctggttttctgcaagattttatccttttcttgatatgttatactgtagcttgaataggataagcctaaggtttttggttttgttttgctgttaatcctatttacccttttggtattttatgttgtctatttttttcatcagaggctttaacatggtaatcatagttattttaagtttcctgtctgttaattccaacatctgtttcatatgttagtcgggttctgatgactgctttgtctctctatttctttctttatttttttgaggtggagtctcactctgttgcccaggctggggtgcagtggcatgatctcagctcactgcaacttccatctctcaggttcaagtgattctcctaccttagcctctggagtagctgggattacaggcatgcaccaccatgcccagctaatttttttttttttttttttttttgtatttttagtagacacggtgttttatcacgtggccaggctggtctcaaactcctgactcaagtgatctgcccgcctcggcctaccaaagtgctggcattacaggcatgagccaccataccctgcctcgccttgtctctttagactgtgttttttcctcatgttttcgcatgccttgtaattttttgttgaaagccaggtatatcatatcaggtaaaagggactcaggtaaatatacctttagtatgagattacctttatttatctggctagcagttgggtcatgtctaatgtttgttgcagctatagataccagaggctttaaattcctctagtgtttgttttgtttttgtttttgtttctatttttttgtcttttttcttgatttgggggatattcttggtacaagtcttcaagaatgtgtcttgcaggtctttcagctgtaatacattgttactatactggaggcttattggtgtgacggtaaggtggagcggaggtggggggcattctataaacttctgcataagtctcatttagtgagactttttcttggggctgtggccttcacaggtgtttctgtccctccctcctcaaggggtagaggtttttcctctactttccctacttccattcatcgcttcagtgttctcaatccatttcctggatgtcatataccctgataattaggatttttcctttttctttaggtgagatatgctcaagtggggcagaattccacttcacaagctgggataaggtttcaaaattgccctcaggaaaatttattcccctggggactaggcctttgttaggcacaaagtataggacacattctctttcctttcccctgcgaaggccatgaggggatttttctcagagcctaaccatgaaaatctggtgctgtttttaaagggaaagcctacaatatgtgaggctatcccatgaccagggcccccaggagtgactcactctaatgctggtctgccctcagtttccagaaattcatcacatttactatttaaatgttcctgctaacttacggtgtctagcatcttcatttaaatgttcttactaacttatggtgtctagcatcttctgctccaagtaaacaattctttctgtactgtatctctctgaaggagtctgttgctgcagacttttttctttttttagaagaattataactttattttatttatttatttttttaaattatactttaagttctagggtacatgtgcgcaacatgcaggtttgttgcataggtatacatgtgccatgttggtttgctgcatccatcaacctgtcacctacattaggtatttctcctaatgctatccctcccccagctccccaccccgcaacaggccccagtgtgtgatggtcccctccctgtgtccatgtgttctcattgttcaactcccacttatgagtgaaaacatgcggtgtttggttttctgtccttgtgatagtttgctgagaatgatggtttccagcttcatccatgtccctgaaaaggacatgaactcatccttgttttatggctgcatactattctatggtatatatgtgccacattttctttatccagtctattattgatggacatttgggtcggttccaagtctttgctattgtgaatagtgccacaataaacatgcatgtgcatgtgtctatagtgttgctacagatttgaaaatgatatgttgacctatgacttcagttctctgatgggtagaagaaaagtcattgaattttggtttgtccagatttttcttgctgtaacaaagatttccaagtgatgacttaaaaagagtgatgacttcaaaagagtgatgacttctaagttctttgcatattggaaataaaagtggaagtctcagctcttctaatctgtgagaatgttagcaagttactaaatctctatgtgcattagtttttatcatctgaaaaaatgggtataagatgccttacctaatgaagttgctacaggggataacttctaaaaaacatctactgcaaagtctggtatgaagtaggggctcagtcagtgctatttgtctaataaaacacgcatgtattcatttcctagggctgtcataaaaattattgcaaacttggtggattaataaacaggagtttattctctcagaattctggagtctagtagtccaaaatcaagatgttgacagggtcatactcccttcaaaagctcttgggaataccctccttgccttttccagcttctagtggctgcagacattccctatggctacataactcccatctctgcctcagtcttcacatggctttctctgtcttctccttctaagatttatggcccacccagataatctaggaagatctcatcttgagatccttaacttaattccatctgcaaagatagaattttccaaataggtcacattcacaggttctcaaaattaggacatgaacatatttttttcttttttgagggaaagaccattcaatcttctataatgtattagttaagtcagctgttgactgaaccaaactatcagtttggccaaacaattaatcttaaagttccatataaacttctatattgccctagaagaatagagagtagtgttttaatttctttgtccaatagaatagattccacaatacaaccatcagtgccagacagtcaagaaaacatgatctactgtatcaacttactgtttttccttcaaggggatcacaatattttatccacaaaagcaatttgggatcattcctttgaatagagaggaagcaaataatatggttcttatgttgtaaatgggaaattaagacagaagggtaatccagttaatgtttatggtttaattaaaaatgctgacagaaagactcacgacattggtagaacttcttattagtgttgtcaacatagctgtactgcctcatcttcttattttctttctcaaatttcaatctccagaaccaaagaagctctattttgcatgcatcagtaacaatgagcaatttacacttagcgatcctcctctgtcacacaacagcagctgtctgtgagtcctcattctactgtgagaagcaggtttgctgttttattcctctcttattcagtgcatatgcaaggggtggggtggagggctgggtacagaggacagcaaggagacaataatttatcatttccaaacaaacaacaaaggttgtttcaaaaatccagcttactgtttttattttcagtctgtaattcattttcaaaatgtttggacataaccctttggctttgcttctgagcatttacatgacatttagacagtgaacacatctccgattggtgcacagctatgggcatatggcacagcttactggaaacacggattcacaagaatacgtatccagtttcagaataagaaccaagtatttgctgactgagtgtcatgtggactgttttaaactccctatccataactttcaaacctactctggggggcggtcaaggggaggaggtggaagggtagactgttggctggaatctaatgcctttcctttactattaaaaatctatgtgaaaacattcctaatgggtatggtaatataccactttcgtaccttataaaaacctatttacttagtttactcagtttacaagctgagatttgaagcactaaccactcggggtcctatcttgatagccctggcttacttaccaatataggagaatgtgttctgttcaacctgagaaaaatggtgggagaggaccagcagttgaacacctggcccatctaaagtgaggatggtaagaatgataaaggaaggtgaccagttgcctcctgggttctctgatcactgcatgtttagctgtgcggttaagacagcagatttaaacgcaatacagggtcctacgatgacaatattatctgccattgattgaaaactgattatatacaagggggttactattcaaaacctcattattccttataatagccctattaggtaggccttttcaatctcacatcatgtattaaaaccacctttgcaaaaattataactgataaaattattacagtgaaagaggtctgacctaaccaacttggtcttgcttttaacctccaagctgtccttgttcattcctgggtgtagagtgaactaactttgggagcaacgcagtttagagtttaactttgaaacataaaataacagtcctttcccgcaaccaaccctcttcttgcctttgttagactgcctttgcagtactaacaaattagccagaagactagaaattatagtttaggagtcactgttgtaaaacctgagattagtgtttgagatactttgcagagtctacattctaatgcaccagctgatgccacccagatctataaactgcctcatctggtcttatggcccccatccaggaactgactcagcgcaagaagacagctttgactccctatgatctcatctttgacctgtccaatcagcactcccgactttctgacaccctacccaccaaattatccttaaaaaccctgatccctgagttttcaggaaaattgattagaatattaactccatctccaacatggcgtggccagcatcgtgacacttaagctcttcctttactgtaatgccatggtcttagtgagctgattttgtttgtgcagtgggcaggaagaacccattgggtagttgcaatatgatcaaagtgaggcttaaaaggttaggtaacttgctggtggcctcactaaacctcactaactccatgctccctaccatggagataccactactaataattaataataactaataacaactattgttgttaaaatgatactgggtaaaatcatgtaaaataacaactatgagatatagttgttataatgattaaataggtaaaattgtgtagaataacaactacagatatagttgttatagttaaatgaataaaatcatgtaaaatttacaatcgtgtaaaataacaactatgagatatagttgtcataatgattaaatgggtaaaatcgtgtaaaatgctgaccaaaacagccttaacattttcctcagtttgactaaactttagttcagcttcttctggactcaggcccctgaactcccttgttttagagcgcttactttagaaaactcgtagatgtacattttctctctgctcctttaggtgtaaatctttttaaaagcctcttgccagttttgtaacccagcactgtccttctcaaggacctgagaaccattcctttgaaaagtcatcatcaatgaagacagtgcttcccagtctcccagggagggcacaggcttaaattgtcctagttgtaaaactacctcctgtcacaaagatatgagaaaattaactttgttttgggatcacgccaattggcaaacatggatgccctgtgatacgccccactccagttcttgaaactctaaaaactctaccatcctttattccttgagctctgtcttaattctgatttatcttccctaatgcaatagccttaaataacatcttccttgcctgtttacattgtcgagtgccatttttgtttttacaatgcttttcatattgattgattgattgattgattgatcaagatgtagtttcactcttgttgcccaggctgcagtgcaatggcgcgatcttggctcactgcaacctcagcctcctgggttcaagagattctcctgcctccacctcccgagtagttgggattacaggcatgcgccaccatgcccggctaattttgtatttttagtagagaggggtttctccatgttggtcaggttggtctcgaactcctgactcaggtgtggtcgacctcctgcctgccttggcctcccaaaattgttgggattacaggcatgagccaacacatccggctgacaatgctttttaataactgtttcaaagatgagaaaacagaagaacaaagaaataagctaatttatccaggactgtaacccaggccacctagctttggcggtcatgtctgaatcatcatacttcaaagggaaataatatattcacacagtgataaggaggcatgtgaagcctagcaccttcacttaacaggtgctcaaaagctggaagctgtgataatggagaggaaggaggaaaacaggactcaggacaagcagatctattttggatccaggcaatacctcttagtaatcctgtatccttgggagatcacagtaatagtacctgagatttgtgcttatgctatttccctgcagctgaatggaagtacaagtgttctcattgcctaggtgggttttgcacccactcttgattatccagcaggaagcacaaacatctttgaaggatgatgagctagtataccagtgacattctggaataatatctcattatattattattaagggcaagaaagaaatgtgaattgactcttttaaagacaatcaaatcaaatataaatgtcattaaatagacttaaggacgccgaatggaagaataaattatggagcagaaagtcaaggttagtcacagaaactaacaaacatagggagaacaaaggaaattgtggagagagatgtatattgatgctcaaaaagacactgcagatcattgatttgaaatgcttatgtattaatattaactggggataattcaggcctgttttgtattgtacccagattagaaaagcagatgtgattctcccacccctttatcaagaacgagagtaagtcaaagagattgctgattgcaaattaaaatgttaatttctatccattttaatttttgataaattcttattgagagctactaattttagaaactttcaagtaccgtaatagctttcagtctattgagtccctgggaatttgcctttggggccaattgctttctgcctccattatgaagaaatattaaatgctatcaggaagcgcaaaagccacccttggtagagagacaaatttcaatttatgaaaggcaaagtattttaggttatgtaatatgctctccagtgcaaacaaggagttgaggatactagctttcaaggaaagtacaaaatacacaatggtgttgaacaggacaggtcagtggttagcagaagtagtggcagcaacatcagtagaggggtagtgtggtaattagatagtgctatctaagctttactgaatgcttattaagttcttatcacagatccatgggctttatatgtattaggcattttaatccttacaaaaattattttagatattatcattatctctggtctacagccagggaatataaaacaaagagaagttcagtcatttgtccaaggtcacagagctgagaagctgagatctgaagccacattgtgaccaccacctccagattcaagctctaactacttggcatgcctactgcctaggggctgtgcagggagcttttcatattccacattgctgagaactgatgaaactaaatatgggggagggaagattgtctttttgctttatctatgcctcaagaaccacagagatgaaacatgtacaaaaatgggaaattctagaagctttttttttttaatgaaggatattacagttcataagaacaaagctatcacaggaatcattttcaatggattcagttacctgatgaaggtactgaagggaaatgcagaatccaaattatctaacagataattcacaaaatatgattgacagtggactcactttctggaagttagagcaggctggtgctaaactgaatcataatggaatgatatattccctcaggtgaaatacagtctaaatcttcatgctgttcgtgcagcacatagcattaatagaacatagtaatgtggacatactttctaaagcagcaatacaaatgtatattggcaaattgtctctttaatatattgtttaacttctccatagcactcaacacaatgtgtataattaactgagcaattatttatttagtgcctgcttccagcactggaatacaagctctgcatggtcagcaactacacatttttcttattatattttgccttcccagtgtctagtggtgtgcctcacacacagagggaactcggtaacatttgttgactgaataaatgtaaggtattttctacataatgcagacttgttaatttattctgctattaataatttattgccgggtgcggtgactcctgcctgtatttccagaactttgggaagccgaggcgggtggatcacctgaggtcaggggttagagaccagcctggtccaacatggtgaaaccctgtctctactaaaaatacaaaaattagccagacatggttgcacatgcctgtaattccagctactcgggaggctgaggcacaagaatcgcttgaacctgggaggcggacgttgcagtgagccgagatcgcgccactgcactccagtctgtgtgacagagtgagactctgtctcaaaaaaaaaaaaattattgagtgctgtttatctgccaggcactacactgggcactggacagctaacagtgagccaggcaggaagggccatgctctgggggtacttacattacagtaagagagagacacaaccttgagcaatgcataaataaaatcattctagatattgttaagtactgtgtgaaaatcaaagagtctggtgagtgagagggactacttggtgagcggggtttggggcatccaatgttaaactaagtgggcttagaggatctctctgagtgatcataagacatccatgatgtcttcaaaggaatcaaaggaaagggttttgtacgcgtaagaaatggtaagaggagaggtactgaggctagaatgagcttggcatgttttaagaaaaaacaaggttccagcctcagcaacataaaaagaccccatctctaccagaaattaaaaaaaaaaaaaaaaattagccaggcggggtggtacgtgcctgtagttccagatgctcaggaggctgaggcaggaagatcacttgagcccagaagttccagtctgcagttagctatgattatgtcattgtactccagcctgggtggcagaatgagaccctgtctcaaacaaatacaaaagaaaagaagaaaaaaaaaaagaaggttcatgtggagtgtggtggcagggagtggggagggaaactggaggagaaacttgggaagtgagcagagattctgtaataagatcctgtaataagatcctataataagaaagattcataataagaaattcgttttaattctaactgcagtaggaagttggtgagtgatcttaagtaggggaataatgtgatgtgatttgcatttttaaaagatgactttggctgctgtgtggagaatggcttgaggaagaagaatgaaagccaggagacccactgctgcccagggtgcgtggtatatgtactccaggggaaagatgctggtggcttagcctagcgtgatgaaaagggagatgagaatgagcctggttttgagattcttctagtgacagaaccaataggacttgatgatgggtgaagcgagggaaagagagacagatggaggagagcctaggtttgtatttttacaactgcatgagaggaggagccggcagttgagaaggagaagtatggaggaaaaacaggtggagagaatgggaatcaagaattgggttttgtggaacttaaatttgaaacacatattagataaccaagtagaaatgtctagtgtgtaggagaatatagaaatactgaagtaactagcatctagatggcatttgaagctacaggattatactacctgtgacaggaaatatgtgatttattaatttagtgcaagtgtaggctagctggctcgttttgaattaagatgagaggaaatagctttaccttgtggaaccactggagagaaacgtgtatcagctctatgagcatgattactgggcatcagccatgttgagtgctggacttcagaaaatgaagatcgggacagcagaggaccaagaagccagtgatgttcactaagcaggcaccagccttccctccctttcaacgtttggatgttgtagttacataaattcctggccacatagactcaaccatagagttctcaagaggatgccgatggatagagttttgaattggattgggaatccaaatcaaaagtacaagaaatctgcttgtgaattgaatttacctgacagtgtcaacattaagttgtctgctaggaaagagtttggaactcatattcagtttgtagaaatacatacaattatagcttgtgcctatccaaagctttactgttgcaatggtattatgcagtgagggaggacacagaggtagagacaagacgcacagtacacagccccaggccactgggttcacttcatcattagtttttgttggagaaagagactgagatgccggtgaaacagggaggaggagagccaggagagcacgggatgaaagaagcccatcaaagaacgtgtttcagctgaaagatgctgctgaagaggcaggcaagatgcaggcagagcaatggagatcagcgagggcccagggaggcgcagggactggagctgagggcacagacacccttaggataagttgaaaagcaaaggacaagtcgagacacaaaataatcagcaacaatattcttatgcttgagaggatcaccatctgggtagtgaggcaggatgagctacatcataatgacataaatcataaaaccgatgcgacgatgactaccaaggccacctgttgacacagaagacccaaagggaatgcgaactggggcagccagaaagggcttcaaaagatactgtgttcctatttcgaagaaactaagaataagatgaatggtgagaggaagaaaggatgttccagccaagagattggaccaacgtgggcaggcgggagaaatcaatacgattgaagaggcgaaaatcaaagggacaaagagatttctggaggctggctcggtagggttgtaggttgaggctgttgatgtaaaaaagaaaaacaaaacaaaaacagaaactagaggaagtcactctataaagcagaacaaatccaagaatttcctgacacaaaattaccatggggggagggggagggaagtagccatctagcaaaatacattacacccactttcttttagcttcaggcacagccaccaatacttattttcagcacccttttataaaaatttaaaaccccatgtaattatattcattcattttaaacataacccctcgaaatctagctttgtatttaaaaagaaaatctgacgtggggtttggaatcatggttatagatgaatttggtgacaagtcaaacattttggaaatgagtttccacacatctgctaaagaaccttttgttgccctttgagcagaatattctgggtgtagtgacatgtgcaaaataagaaatttaatatttttaagccttcaagatgaatgttacaacatctgaacaagaataaatgccatgcttattcaattaccttgcatcccagggtcttatttaccatcagctttctcagcatgccgatctatttactgctaaattgaataattccgcctaaaggagataacatactcttactgacagcttgtccctaaactcccagatttcacaacatcagtacacaaatatacaatatagaaatggttgcttatgtgcattagatctgatgtaaacaacagctgccaaaaagactgaattagcctgatcttatttcatttctcttcttatttcatttcttttcagtgatatttgcctttttaaaaataatcagttgtggcaatacgtgaagcggagaggcacagataacaggcacctccattacaccaatgacggttctgcagtttttcctaaagtctttctagaatgacgcacaacacattatagcttccgtgtttgctcaagattatttgattaaactattacactgagagtaaagattactctttttaggttgtcactttctcactgatgcttggcaatttacttaagggaataagctaggtgtaggtttgcaccccttgctctatcaagacaatggcaaatattgattggtagtaagtaaggcttagacgtggtttcctttttcttttacatcagccgtgggctgttgagatacaataggtgcagccaaaactgactgataaatatggatttctaccctcccacagggcttggaataatgattgagttgctttgttttttccagaacttatagcatatatatatatacatacacacatacatacacacacacactatatacacatatatttataaaatatataaatatatatgtgcaatatatatacacatatacaaacatatatgcatggtatgtatatagatgtacacacacacacacacacacacacacacacatccttctttgatggctccacttcccatccaattgctcaatcccaaatctggaattgccttgacctatctctcttttcctctgttactcaaagaaatcttaaaacttggctcattctcatctctcctgtcgaccattctagtctcagccactatcatctctcccctggactataccactgcaatctgggaaccagtgggtttcctggcttccattcttcctcctcaagcttttctctgtatagcagctgaagtaatcatttaaaaatactcctcttaaaaaaatcctccccacatggtattacacatggaaactgacagtccaaggctgtgatcaggcgatggtaggctcaactgggccagtccaagtgacatccctttgaaaggagcatagggagtgccctgccccaaaacaccccccaacacaaaacattcagcaacttcttttaaaaattatttgtataaatttagggagtacaagtgcagttttgttacatggatatattgcatagtggtgaagccccggcttttagtagaaccatcactcaaattaggtacattgtactcattaagtaatttctcatccttcactccccttcctgcttcctcccacccttccgagtcttcaatgtctatgaattctatagtcttgtcttcacactgttttgctcctacttacaagtgagaacatgtggcatttgacttcctatttctgagttatttcacttaagacaatggcctccagttccatctgtgctgctgtaaaagacattattttattatatatttttatggaccagtagtattctgttgtatatattatagtataccatattttctttctccagtcattccttgatagatgcttaggttgattacatatctttgctgttgtgaattgtgctgtgataaacatacaagtgcaggtatcgtttttatatagtgatttcttttcctttgggtagatgctcagtattgggattgctggatcaaatggtagttttattttttagtactttgaaaaatctccatactgttttccatagaagtactaatttgcatttccacccacattgtataaacgttcctttttctccacatcctcgccaacatctcttatttttttgactttttataatagccattcagactggtgtaagatgatatcttattgtggttttcatttgcatttatctgataattggtgatgtctagcattttttcacatgcttgttggccatttttatgtcttcttttgaaaaatgtctgtttgtgccctctgcccactttttaatggggttatttgttttctttgtcatcgttgattatttaagttcctcgtagattctagatattagtgctttgtcacatagtttgcaaatactttcttctattcttcaggctgtctgttcactctgttgattatctctttttctatgcagaagtttcttagtttaaatgaatctcatttgtccaaaatagtttttgttacttgtgcttttgaggtctcagtcatgaattctttgcctacggcaatatccagaagagttttccccaggtttacttctagtatttctatagtttcaggtcttacatttaagtctttaatctatcttgaagtgacttttgtatatggtgaaagatagagatccagtttcatcctcttgcatttggcaaccaaattttctagcaccatttattgaatagggtgtcctttctccagtgcataagtttgtcaacttagtctaagatcagttgactgcatgtatgtagctttatttctgggttctctactctgttccattgacctatgtgtctatttttataccagtaccgtgctgttttgattattgtatccttgcagtataatttgaaatcaggtaacagtgatgcctccagctttgttctttttgcttaggattaaatttggctatttgggttcttttttggttccatatgaattttagaattgttttttctaattctgtggaaaataatgttgggattttgataggaattgcattgaatctgtagattgctttgttaagtatggtcatttaaacaatattgattcttccgatctatgagcatgggatagtttttcatttgtttgtgtcatttacttgtgtcaatttctttcatcagtgttttgtaatttccctctcagagatctttcacgtccttcgttacatatattcctatttattttattttgtagttattgtaaatcagattgacttcttcatgggttctcaacttcatcattatttgtgtatacaaatgctactgatttttgcatgttgattttgtgttctgcaactttacttaattcattgatacaatcaaatagtcttttggaggagtctttaggattttataggtataagatcatattgtcagcaagcagagataatttgatttcctcttttccaatttggatgcgttttattttttttctcttgactgactgctctggctaggacttgcagtattgtattgatgaattcttcttacggaaaagtggaagttctgctatatcaaaaagaaaagggggctgggtgcggtagctcacgcctgcaaccccagcactttggaaggctggacagatcatttgaggtcaggagttcgagaccagcctggccaacatggtgaaaccccatctctactaaaaatacaaaaattaactgggcgtgatggtgcacacctgtggtcccacctacccaggaggctgaggcaggagaatctcttgaacccaggaggtggaggttgcagtgagccaagattgccccactgcactccagcctgggtgacagagcgagagtccatctaaaaaaaagctggctgggggagcgggggaggaaagttccataggcaaaaacaataagtctctattatatattcatgatgaaattctcattggtccaaaatgaaatgaaaaatataaaaatgatatattaaaatttttatacaattcattatgagtttttatattttatataaaaatgatattttgaaaatttttatgaggctaaatagggttaatttttaaatatttattttttactgccctttactattcttttttagttttggtgataaaatgtcctttcatttaatatgttatggtgatatcagtttacagttatctttttatgtctttacttggcaaagttaggttaacaactctatgacggtttcctaatatattgtttaaatttatttgttcacaatatccaaacctttgggaatccttaatctagagcacattttaccaaagtgccacctaaattgcagttggaattgcttgcaagaaagaagggtgggagaagtttactgtcgaatatactcaggatgctgagataagaaacttaaaaaaaaaaggaaccttaccacagaacttctcacagccttaaacatgctgatgtagatggtgaatccccaaaatgaagatacagtatacagcatatcccacaattatttgaccaaggaactcttgcacgaagaagcatcttagagacttgtcctggaaagtgttaatctagagactcacaaaatacttcaacaaatattgaatattggctggcaaatagaaatgcataatgacacttctatagaaagaggaatccaagggacataaaagaaattaagatgagaattcagagatttgtgccatgtcatcctcgactacagccttagtattttcaacttactggtttcttagcttggtctgcatatttgtgaaagaataagccccattcatacgcttatattttcccaaatgactttgaaatgtcaagccattgtatgaatttgaaacggcatctttagacctttactgaagttatgttactgttgccggagtaactaacaagtatcacagggcaggggaaggcagaaaaatatcctttcatttatcaagcactgaataaagcaagaggcttagaaatgtgcgatggaacacgatgttacaaagctattgttcctgtacctgtaaataaaaggtaacaaggtccatttgatgacaaagagtcatgagacagctacacagctcctcttcaaaaggaaacaataaaaacttttaaaaataccaaataacattacacttcttgctctaaaagtatgctggttatataacagaatgcaagtagatttataattagcacttgtttatagatgtcttatactgtgtcatgcatggaggggcaaaagaggttctgatggctattcattcagatagaagttatcgaggccataggaagtgagagcgccatcatactaatgttaaatagactgaacaatgggaaatttacaaccagcacaaggatgaatcagttgatgaatatcacattgttgatagaaaacgattttgagagagtggagcaaaacttatttaggaagttagaggcatctctcctattctcttcttccaaccctccacttcttctcgtatttaagattaatagataattagggtagaatggatgctctttaaaagagaaagcactgaacaggagagattgtgaaggttttttcatgctgtggactcaggatgcaagaggggctgtaactctcaggatacaatgagaagaggcatcatcctttctggggtaacatttggcagtatagagctagaatagcaacattaagggtagcaagattaacagcaagaatacagggatcagaaagtctgaagctcgaaaatgctctgaaatcaagtgaagtgatgtaaagggaatatctaagttcatttctataatttctaggccagatagtttgttaaaatatggaagaatgcagggatgcaaaatttctccaggtatataaacagcataaggaagtaaaaaaaaaatatagtactctgagataatttcaaggaaacatctataggaattcggagaagggaacatcatttctggttgggataattatgaaacatttcggaactgggatatagctcaaaatacactcaaaataattatgtggtgggctttctcgatgacatctctcagagtggctgagaattctaaggtgtgtcaaaattctgtactaaaatttatggccaaatcaacttatttgatcaccaatactgccattgccatcagcatcaccattaccaccccaacactgctatcaccatcattactaccaccacttccacccttatcagcaccactatcaccattatctccagcaccaccacctccatcaccatgaccatcattatcatcatcattacagctaacagttatcgaatgcttactgtatgcttaacaccattctaacccctttacatgaataagcaaatgtaagctttcttcaaaattccaggtgaaatgctattttctctggatatgccccacttcgttgaattatcttcccttcaatgaaattttctctttctctgtaaagttctttaatggaaaaatcactttccacattatactatagatgtaagttacttatttcccttctttaaggacagattatgcctgattccacttcaagcctctcaaagtacccagcccactccttactactaattgctcaataaacttatttgtgttaaggaacaaataaaaagataattcctacggatacaatatttttaagattgactctcattttggaatacaaacatgacattgtatacaaagcaagagtttagttaccttcatccatgtcaaactatgtctttaaaattcacagaaaataaaagaaagacaagttacacataaaccttatgtcagttgtgatgcaaaaatatcagatgatcatttacacattgaaagaaacacaagtatagaatagttgcattatcaaatatttctacaaaatattattgatttataacagattttattcataagtcctgccactgctggtataaaggcaaagaaatatcatgtaggaaatatttcggctgcagttgttggttgcttgctgtggtggtggttgttggccttagctacatttattacatccaaaatatagagcagcgccaagatctgtctaagtcccatgcttacacaattagcatgcttctcattctaaaaatacctttgtccagtgctgtttgagaaaccagcagagtttttctaataatcttgttaaattacatgataagtaatccattgcttcaccttacaaagggatagttaggaacaaggattagatggtttgcctaagtatgttgtagtagagactagctgaaactatcttcttggatgcataggctgcatatgcctagcttgccgtgcagttagatggggccacatgactgagtaccagccaatgtaaggtgaacagaaatgtttagtccttctctataaaaaacctccaaggtgtcaacctccagttatttttgcctgttgcactccactaacaagaatggtgattgtgggagctacatacttaagttgaaaggacccacaagatgaaaaaagcttgagcccctgagtcacaacctggaagagaactgactagggacataggtttaagactttatatgagtaagaaatatgcttctgtcataataaatcattatgatttgaggatttatctgttaaagtagctaaggtatattaactaacatggacattattatcttgaagtggaatgttgctctaataaaagccttcaataggcttagtcgttatggagtacacggctaggaaatacgtatcagaagctggtaagatagagatgtgttatttggagacaaaacatttgttaagtctatcatctgcaatacatgttcctacatgtattgaccaactaaatcttcaattagcctctaactctgggagaagtaggtagggaaagttagaatatctgtttgtatgcatatttataacagcataattcacaattgcaaaaatatggaaacaacctaaaatgcccatcaatcaacaaatggaggccgggcccagtggctcatgcctgtaatcccagcactttgggaggccgaggcgggcagatcacaaggtcaggagttcgagagcagcctgaccaacatggtgaaaccccatctctactaaaaatacaaaaaaattagccaggtgtggtggcaggcccttgcaatcccatctaattgggtggctgaggcaggagaatctcctgagcccaggacgtggaggttgcagtgagccgagatcacgccattgcacttcagcctgggcaatagagtgagactccatctcaaaaaaaaaaaaaaaagtggatacagaaaatgtggtatatgtacaccgtggaacactactcagccataaaacagaacgaaataatgacttttgcagcaaattggatggagtcagaggccattattttaagtgaagtaactcaagaatggaaaaccaaatattgtatgttctcacttataagtaagggctaagttatgagcacacaaaagcataagaataatacagtggactttggggacatgggaggaggtgggattgaaggataaaagacagcattttgggtacagtgtatactgctcaggtataatgggtataccaaaatctcagaaatcacaactaaagaacatattaatgtaataaaatgtaataaccacctgcttcccaaaaactattaaaatcttttttaaaaaaatcagtgtgtatttgttacagttggctgctgttggtatgttattgccataaaaatagataaacgaaaaataaagatgttcttaggaaagaattggctacttctctagctgagttagaagtgattggagatcaagccccttgtagggttagaaaatccagactgtttatatatatcaaatagcaaatagtatcttggagtaaaaagatatttcagttgaaagaaatgattcagccctgcaacaaagactcatttaaaaacgttaccttcccactcaagcttgtactttcacaaggccacaacatatccataattatgttgagaaagaagcactgggcaaaagaagcaatgaaagcagatttgacaagtatagttaatagaaagtttgggtataattgctgacatagggagctgactgaaagaacaaacatcagaaattcctaagttcttgagacaattatgctgtcagaaaatccctgagcctggattttgccaaagcagttgacttcttgaactctaagacaacacttaggtctgccaatttgtaccagcctgagaagtgggcaatgaacgtagggtagccagcctgatccactcatgcctgtgatcctagcactttgggaagccaaggtgggaggactgcttaagaccagcctgggcaatacagcgagaacctgtttctacaaaaataaaaaattagtagggcatgcatttgtagtcctagctacccagaaggctgaggcaggagaatcacttgagctcaggagtttaagggtgcagtgagctgtgatcgcaccattgcacttcagcctgggagacagagcaagatcctgttgaaaagaaatagaaagaaaaaaaagaaaaggaaaagaaaaaagaatgaaagtcaggcagctcgtcaaggagagaatgtaccacaatgcccacttccgatgttgtgaccacagagaaggacagacaaaagaatacatctgtgtgtgaagatctaatcaacagatttcccccatttctgaagttgacacattcaggacacctgcccagcaagaatctgtagttgcattggtccagggaatgctgtctgcctcccattcttcacttttcctaattggaatttattagtgtgcttaacctttctctactgtgggatcaaacactgggcatgaggtgtgggttgtgaggagagggtaactaactggtccttctgttcatagataaaccacaaggcgccatatctcgttctgacagatggctgcacatcactggaaggatcttattcgttgaatcagacacagaagcagaatgggatttggggttgtctttggcacatgggtggtttataggtgtgttctatgtgtgagaagaaaaatgaaacagatatatggaaaccagaaggtagatttagaagagattggtcagttgatcactgaactcatttcttttttttttttcccccttggcatgcagcaagacagaatttctcatgctccttcacagttagttgtgatgtacaaccgagtttcaacacttggaagtaagtgaaatgaaatgggctgctttctaggcctggataggaaaatcccctgcccacgattctccatgctctttccccatttagcttgatgcaaacaagccagagaccttgaaggctagctggtgacgatggcagagccataacatggaaggatgtttgatctatgaatcgccacttggagaaccgacttgctgttcaggaacacccgctttggaaattacatgttcaataaataaacctgtgttaagacactaagattcagggactttgctgttagagttgatgggattaccttaaccacacacccacaactggtttaatagaagattgaatgtaaaatgatttcaagtgcccaacggctgaatttcttaatatgctatcctaagtctcatcatgatgatacactaggaatgacagaaatcagtcatatggactctttaagacagtttttccctgcaggaaaactgtgaagagtatcacctgaggtggccacatctcctttagacccctctcagcctttcagcgttttctgtaaataaagtccattcttcagaaaactttcaactaaactttgatgagatagagccaccagaaaagaaaaatcatgtatgctgtaaccactagaccaaggttcttttccaaagaggtttgtcgattttgataaatgtacttctaaatatatttgacatacataggcatcgggtgtttaatgaacagctttttctgctaaacgtcattttttccaaggttctcttacaaggagcttgacatgtgtagatgattatgagaatatatgtagactcactttttacttttctttttatttatttatttatttacttatttatttatttatttaagactgagtttcgctcttgttgcccaggctggagtgcagtggcgcgatctcggctcactgcaacctctgcctcccaggttcaagtgattctcctgcctcagcctcccaagtagctgggattacaccatacccggctaattttgtatttttagtagagacagggttttaccatcttggccgtgctggtcttgaactcccaacctcaggtgatccgcccacctcggcctcccaaggtgctgggattacaggcgggagccactgcacccaggcttctttacttaaaaacaaacaaacaaacaaacgaaaagctttctattctcagaagtgttcttgccctggctattataaattttccctgttctatctaaccaacagaatgtattactcttccctgggaacatgcacgtgcaactccctctcatgtaaaaattgccatattatccaagaagagtgtgtacgggtgcataattcaattaaatatgtagttcagaagcaaaagtaaatataagattgtgctaaggttcatgaattcaaagtttaaatactgagactctcagaaaatgtaaaatgcttttaaatgtatatatttattctgattattaccttttgaaaatgaactgaaaaaagacctacttaggaaacagaaatacttctgagatattgataagcggcttattatttttattgcttcaatttttagttttatgaattactctccaccacaacatattactggaaagttaagttttactgcggtgatctttcactaaagtctaattcattctaatcatttcaaaattcagagtttggtgttccatatttttgtcttccttgtcagttcattttgtatattatttacttgataagctgaggcttgaaaaaaatactcgcaaaagcttgtctgtacttatggccctgggcaggagtacaggcactttctctcatgagtattttacataggaatgatccagagaagagatgtggccctgtctctaccttgacagtaagctccaaatgctgacatttgctgaagtaaaaattctccctgtctagtggcaaaggtgcccccattcctttgaccccaaaactcccacttcccccaatcttcccatgcagatgttgtctgcagaaatgaagccatcaggcatcagaccccaaagcagacttaggtcgcatttacacattttctatcacaagcaggataaagacagactcaagttacccattacatttaggacttggggctcttagcacccaggctcagggttttaactcaggacacttacaatgaactaactcagtactacctttggtagtactacctttgagaactaggttccctgctagactttgaatttcttgaggattgggggcacatcttatttgttgttgtgtccctggaacctaccaagtactagagcatcgtgggctggctgtaaatgtctgtgggatgacttagtaaatgaggaaggcgagacatccttgaccaaccatagtgactaagatactgcagtggaacacctgctgttcctagttaactaagtaaatatggatctcccatagtatatagagaaagaataactctaaggaagaaggggataatggctgcgattccttccaaaagaacgctgtcacatgtgtgggggcgctgtacatatgtatcatctcttaactacaatctatgcatgtagtttgtttacagagatatttcatgcatgctgtagaaaattcaggtcatataaaaagggattataataaagctaaaatcccctaaaagttcaccactcagaagaactctcccatcaacatttgtatggggatcacccaaggtcaatctttctgggtatgtctgtgtttatgcttcctataatttattttgatttatgtttttgctgtatcacttctgcttctcaccctttatgacatgatggagatatgtctcttttttattttactagtagtcacttttataactttaaatagcatattttaacaaagttcttaatatattaagtacagacataaaataatacatacagaaaaaaaggcacataaaagaccaggaatagcttactttctctcatcttcattttattggagcatgcttcaagattatgtcccttggccgggccgggcttggccgggcgtagtggctcacacctgtaatcccagcactttgggaggccagggcaggcagatcacctgtggtcaggagtttgagtctagcttggccaagatggtgaaaccgtgtctctactaaaaatacaaaaattagccgggcatggtagcacatgcctgtaatcccagctacttgggaggctgaggcaggagaatcttttgaacctgggaggcggaggttgcagtgagccgagatcacagtgagccgagattgcaccattgcactccagcctgggtgacaaagcgatactccgtctcaaaaaaaaaaaaaaaaggattatgtccctttatcctagtgtaattattattactttatattgtatggtatacttgctttcttttgtacagccaatatttccaatagatattgtgaataattgtttgctcaaatgactttaatctcattactagtccactcattctacacgagtttttgaaattattatcactttccagttcagtagggtatatctgatctatttcctgagtctttaaaatgttctgaatctttgaatatttattcatatatttctattttctttttatatgagctataacttaactggttatataatacttttgttacactattttgtctcaaattgtgtagctgttgcttcattgtctttgggacacaatgctgctaaggaaaaagtctggatccaggctaatttttttctctatgatattgttgaccctatattgttactttgtatttttgttatttgcatttttcgttgttgtgttcttattttttccccaatattttcaatctatggttggttgaaacccgctaatatggagggtcaactatgatatgatattaatacatatatagatatatcatatataatattatatagttatattttatatattatattagttatattttatatattataatattatatagttatattttatataatacatattataatacatagttatatttatataatattatgttatatctatatatagatatgagaaaaagcaaaaaacaagaacaattaaaaaatataaatacaaaaacccagtagagtataacaactatttatgtagtatttacattgtgttaggcattataagtaatctagagatgttttaatgtataagggaggatgtgtgtaggttatccacatatattatgccattttataaaaaggacttgagcatccacggatattggtatcgaccagggtcctagaaccaatcctgtgcagatactgagggatgatgtatattcttttgcatgtatgcttgtagaaatatttctaaatccttgcatttcaacaacctactacaatctttgtgctacttgctttgtgatacacatgcttagaacatcttgcctcatcttgatctgcagatttgggtttgaattaatttctttctttttgttttttttgttttttttttttttggtttgagatggagtcttactctgttgcccagggtggagtgcagtggcatgatctgggctcactgcaaccccgcctcctgggttcaagcgattcttgtgcctcagcctcccaaatagctgggattacaagtgcacacaaccacgcccgcctaatttttgtatttttagaaacggggtttcaccaaattggccaggctggtctcaaactcccgacctcaagtgatctgcccgccttggcctctcaaagtgttgggaatacaggcatgagctaccgtgccctgccctgaattcattcgtttgtttgtttggtttttaagacaaagtctcattttgtttccctggctggagtgcagtggcacaatcatagctcactgtaacctcaaattcctaggctcaggcaatcctcccatctcatccttttgagtaagtgagactacaggttatgccaccatgctcagctaattttaaaatttatttattttttttgtagagatagagtctcgctatattgctaaggttgatcttgaactactggcctcaagcagtcttcccacctcagccacccaaggttctgggagtacaggtggtaagccaccacacctgacttgtttctgttgttgttttgatattatcttcaggtataacaatgatccataagcttgatatttatttcgtgcctccatatctataatcttctcccttattaaataagttaacacaagaatttagagcaatgctttacacagaatatatgttcaaaatataaattattataactgattaattgttttaactcttttttccctaaactctggctgattttctcagtcttctccttcctatcactgactcagctctgtagtgctgattctgtacttcgagtttctaaagagcttttaatttccatgatggcaattactttctcttcagtttctttccttaatatggctagctgcccttaaagtgaattcacttaaattatcgtctcatctttgatctcttcattcagaacagtagatgatataccttaaattttattaaattcctccatgttggaaaacacttgtctaaaattttcttctaattccttgagtgtgctttcctccaaaatgtgttcctgaattaatcttctgcatgctagactttttttcttttaccctttggctaccttctcttttgcataaatttaacataggcaagatattttatgtctaggtgtctttgtatttacttacttatttatttatttatttttgagacagagtctcactgtgtcgcccaggctggagtgcagtggtgcgatcttggctcactgcaacctccgcctcccagattcaagagattctcctgcctcagcctctcaagtagctgggattacaggtgcccacaaccatgccaggctaatttttgtatttttagtggagacagggttttactatgttggccaggctggtcttgaattcctgatctcatgtgatcctcctgtctcagcctcccaaactgctgggattacaggcatgagccaccgcgcctggcctgtctaggtatcactgaacagtgaacgctattctacgcaggcttgccttttgcccaaacataaaatgggtggattctcattgcaactcctccttgttttcctgtaccttgcttgaaaaatctcatttgaaaaggaccaggaagtctccctgtggtttctattctctttaaagtatttcaagagagaggttttcagggaaggcaaaggggccctggagttctattcaggggattcctctcttctctcccctccatcagttggtctgaatccccagtaatatgggccagcttcacacaattgaaggtgtgccctggtctatggaaagtacctttggcatttagactttttttctctttggagtagggctgttatgcttcctgtgagatccttgtggtttatgagtttagggtttttttgtttgtttgttttgtttttcatatttcctaccaagcattttgttttctgctgagatttggggtagatccatttttcaaaaaatttcaactttatttcaggttcagtagtacatgtgcaggtttgttacgtgggtatattgcataacactgaggtttggggtacaaatgatcccatcaaccagggagtaaacacaatacctaatgggtagtttttcagccctgacccccccccccttttctagtcatccccaatgtctgttgttcccatctttatgtccatgtgtacttaatgtatagctcccacttccagaaaaccaaatactacatgttctcacttataactgagtagagccattgatcctcaaagatttgtctgtttccttagttagccaaaggggaaaagtggccaaacttttgatatcattcaagtgaaggccttgaaaaaccatttgtcttcagtggggaaaaagaactgcaagtgggttattctacatcttttcttcaacggccgacacctccattcttggtcttaacaaattttgaggataccagtcagcgatgatgagtatctgaatatatgtgactctctcatgggcaggaaaacaccctactaatctttgtacacttggtgcccaggtgctatgcatacagataaattctcccttaaagggtaatttgaatgccatatatatcatctgtagacagatgatttttctgcttgtccttagccacttaggttttgtctcttcttcttcaatctggcaatttcctatatatgaaatgtacaccagccagtagtgcaatttcaattcataaatgttacgttctactgcccatagatccccaaatgagctcatgaggaacttagagtgaagcgaaatgccagtggacctcctccaaaggcttgttcctccaacagcagcaaattttgtgagcagtccatgaaccccaagtctgagagatcagtctcagatctatctaattgcagggggctgtagagacttaaagcctgtatttattatcttaattaccttttggccagggcaaaaggagatgttatatagacaaccagttgctttgaggtttgcactgaatccacgtatctccgtagttgctcccaaccaatgatgaagcacagcccagtgactaaaatgggctatttctgggaaacataggatgctcccatggtgattttagcttcatagtttccccacagccttgctgaagttttcctggagctgtgcacaaatctaaaatacttgatccaactccctttcttttcctctttctttgtctttcccggcttcctggtatctttctttccctcccacctttcttctctctctcacttggggttagaactgaaggattacctgttaaacacgtttaaacatgcttttatgataatacagttcaaatgcttcccatatctacattataacctttattatactctctaatgtacttcagcattatgaaatacaacataacatacttcaacagggaacttgactttcaaatgtcactattagtacttactaaattgaaaggaaatgttctcctatcagcaagtaaacacgatacacttgaatattcatgccattgcaaccatgcactattcaaatcttctctgtcaaataattgtttacaatccttttttttttttttttttttttttgagatggactcttgctctgttgcccaggctggagtgcagtggcgtgatctcagctcactgcaacctccgcctcccaggttcaagcaattctcctgtctcagcccccctagtagctgggattacaagcgtgcaccaccacgcctggctaatttttgtatttttagtagagatggggtttcaccatgttagtcaggctgatcttgaactcctgacctcaggcaacccacctgccccagcctcccaaagtgctgggattataggagtgagccactgcacctggcctgtttacaattcttaattgcctgtcagtggtgtagatgtgtatgtatgtatggcggggtcacgggcattattaccaagtttaaaaggaaagagtctaaaaatagttcccatgactcaggaggaaagtgtccctgtgttgtcaccttatttccactttagatccgtctatgttcgtaaccctgggacaggatcaatgatctgtaaaccaggctcagcctccccctggtgagcctaatgaggcacagaaataaaatataaaagtaagttcaataccaaatcttataccctcctaagaaatagtaagagttggaaaaaataaatactcttttataaagagtgaaatgaatctgttttcttcatatctcccccacccctaacctttagtagaagccagcataaatctggggagagaagccctccatgagtgctgggccttccagcctctcacccacaggccatggtgtcactgtgactatagttttactaataatactatatggcggctcatttttctattcaaactctctggaagatattaaataagtctgttttatttaatagataaatcagggctgcgatgttctcaccaaccaattaagaagcccagggaaaatactgacactctccttctgaggttcctctgtgcctcctgaggatggcatatgtaaagttttctgtttccctggtcttttcatcccattcttatgcatcatatgagctttctagggttgtcatgacaatgtgccaccaactgggtggcttaaaacaacagacatttattgtctcatggttctggaagctacaggtctgagactgatgtgttaacgggaccacactgcctctgaaatctgcaagggcgatctccctgcctcttcctagattcattgggtttgctgacaattgttgacactcctcggcttgcagctgcggcacttcagtgtctcccttcattgtcacacagtgttctcccctcttctgtctgtgtcttcatctcctgtttgaataaggacacctagcttattgtattatgatccaccccggtgatctcatcttaacttcgttacatcttcaaagaccctatttccaagcaaggccacactcacaagtactagggggtagatctttaacatatcttttttggggaccagttcaacccataacactaagattgaaaacctggcaacatcgacttaaatatatttgagtgtgttagtgcaaacctggttttggtgccttttacattcaactggacattactggtgttatctcatacccctctttacagagttctgagttgtcttcgtgaattcttatttacaacatagatgcattagacacacacacaaaaactttattttgtttgaaaatccttgacctttggaatacatttaaagatgaaaagaactatgtagtcaactcaaatctctagagaccctgtagtcctcatccttttgttaaactttcctcatgactttgctacagtgggtagtcaggagaaagggctttcccctacctttaatcacaattgtctgtggacaacttttgtaatatatcccaatgttgtaggagtctcagcttgaccataaagaagatgctaatgggtatgttggacgaactgttggtgcagacccaccaggaactaagggatcttcctgtaagaagttcttgcaaggaaagatggaatttggcataatggacttctacagatatcaggctttggtcatgtaaaagctgaggagctgctgaacatctcaataagtttaatgtatctggtttgtctccaggcccttgggacagacgcatgaaatctgtggtagtcaggatgggtcacactgtactaacccaaaaaggttacagctattttataaacaccaagagatgcttgacaagacaataaaacatagaaagtactattatttgagtgccctcggtacttttctcacacctggccaagacctacactttgtagggccttttctagcttcctctagttatagccttctccagaggttaaaagttctacatagctaaggggctgtgtccaccaagcatctttgcccccaattctcgcacacactgttagaatccagaaatttccttccctaaagaacgtgatcccattatcaagaatctccaggtcccttccccaggttttttatcctgaagatagatggcacagccagtatgtgtagatcaggctcaaggggtgcctgaggggtggctattagtggggatggtgtgaatagagcttgggcatgcagactggagcatccatacacttatccaagaggctgctgggcacacaaggaaaatcctcaggtggaaagggaaacaggagtaggctagaggctggggttaggtactggaggctggctctcccaggtcactatgttccatcatgggacactgaggagtccaagaattccaaatatgaatgtggtctttcttgtaattatgaaggtaggcttgtcaaagagggaagatagtacatatattattgaacattttcttagcttgattcataactttgaagtacaagtgacccttgaaccacatgggtttgaactgcacaggtctgcttatccctggattttctcccacctctgccactcctgagacagcaacaccaacgcctcctcctcctctttctcttcctcctcctccacagcctactcaacatgaaaatgaaaaggattaaaactgttatgatgatccacttctacttaatggatagtaagtatatcttctcttccttatgactttcttaattttattttttctagtttactttattgggagaatatagtatatgatacatataacatataaaatacgtgtcaatcaaatgtttatatgattggtaaggcttctggtcaacagtaagttattagcagccaagcttttggggagtcaaaatttatttgcagatttttgatggtgagggagattggcacttctaacccccacattgttcaaaggtcaactgtaaaatcctaggttatgagggtctctacttgtactcttgccctacaaatgttaggggtgggtctgggtgcctgtccatcaaagtatatttccagaggccaggtgggagggaggcagtagctgcagatccaaggaagcacagagaaaaatagtagataagcagccaagatgagacagtggaagctcaatgaagttatgtcacttatctgtctgaaaccttaattctgccttgtcatggaaactggcatattcacaggttctggagataaggaaacagacattttggagggctgttattctctctgctacaggctttaatcacctgcaacttggttataaaaactcgtttagatgctttatcaggtagcagtgattcaaatgaattacactctgtagttaccttgaaaggaacccctgaaaaagggattgcagaagccaaccaatatagcaaagcacagacttcacgtcctagctttttgccttgacttctttatttggtcaaagaatctctctctctttctctctctccccgcaccccccaacccaccccatcactcctcttctcctctgcctttcctctccttctcttgcttaacaactgattcacactgtttaaataacttccgtgggtagagagaacttgaagtacaaaaactaaatagattttctaagtcacacaaaaaatctgagaaccaagatgcatgcatttgcttgcatcaacagataacggctaacttgcattgagtgtttctctgtctgagatactatactaagcacttgacatgtgttatcttattcactccttctaactgccttattcagtaggtgctataattattactatctcatttcacagatgaaaacactgaagcttgaagaggttaaagaacttgtccacaaccgtacacgtatcatgtggcgcagtcagtcctcaaacccagcctctatagttttgcactgagccccttcaccaccatgactgtatctaggaatccttgctaagcttccccagagatgtgaacaccttccataaacatgttatatacagcagacatgaccacagcttgttcaaatcagtagaacattttccaagagcctaacatgtattgggtcccgtgttcaatgctagggatacaaatataagtaacaaaatgcccatgcccttcagaacctcagcttcctggggaaaatggaaataggaaatgtcaacgcagcaagtgaagtgctatggtagaaggcattacagaagcccagcagaaggctgcaagcgatcaaggttgttaaggagaaaagaaacaggctaggaggggaggattaaaacatttgaggtggacgttaacagatgaatacaaataagccagatgaagagggtagggaaggtatttccagtcagggataagagcaacgtgaaggccgagcagtatgggaaggcacggcccatgcacagtgtcatgtacctatttacaccacacactactactctgaactctttgccataatacactctggaatgctgtatgccttagcttgaccttctctatttctataaaaagcgaaatcactcctccctctgatgacccatgtcaaggttgaaaaaccatctactgtatttcaaaattttctgagttgatttggccttaaggattctctaataagcctgatataattcttaacaattcccccccaaagtattgaactaatagctattccctgacgcaaagcaattttctcggaggaaatgatcttagaatttttctgcatagcgtggatgctttttttttttgacagaacactgatttctgaaaatgaatagaaagcagctgtatagctgagcttaaatgtagcccaatcatgtcatccgtgtgccagaacaagataatttttccaccctaattcccatcatcctctgcttgatttgaaagacacctacatatacttgactaagttctgggtgcttcaaaaatgtatactgtttcttcctaaaggaatatgaatttggaaggggaatcccttatcctaaagcaatcacactgaaaatatctcttgacatacatttagactttcaggaataaaatgaagattgatgtcacagtgaagtggttcaccagaatccagtaaaacttggggctaaggaaactttgcaatcaaaaaagcctatccagctcttcttgttcttagatgtccctcctcatttcttggccatgctaaacaaaatctcaactgttatctcaaatatctgaacagaggttattctgaacagacacccatgctgtagggcaagcaggcccttacaggccttgcactctttatcgtggccttgtagatctttgcttaatttgctttagtaaatattctaaatactgaccctcaaagtaggagacttttcctagagtttctcctgtggagggggaaagtcataaagctaattttggcaatttgaaaacaaaattttcatcactatcaacgaagaatatagcaaattttaataatatgacactgtgtcatttgaccacctgttaactctagatggcaaatatatttaaatgattctactttcatagatcttacttagcaataaggtgctcactattatcatcgtaagatttttggtgcaaaaagtatatactagacatctgatatggtttggctgtgtccccacccaaatctcatcttgaattgtagctcccgtaattcccacatgttgtgggagaagcccggtgggagataactgaatcaaggggggcagtttctcccaaactgttctcatggtagtgaataagtctcacaagatctgatgattttaaaaggggttttctttttgcttcgttctcattctttcttgtccgctaccatgtaagacatgtctttcaccttctgccgtgattgtgaggcctcctcagccatgtggaactagagtcccttaaacctctttttctttataaattatccagtctcgggtacgtctttatcagcagtgtaagaatgcactaatataacatctattcttctgtggtcagaagcgctctatgacctatgggtgtcacacccaataaatatgcatgaattaatggcctgacagtaataaaataagtagaatagagtccttgatctcactagatttatgatgaagttaaggaaagaacatataacactgagaattcataaacaaccccagaacagtattaaagacaactacgtgttaaactatgatagttcagcagaggagaagaccagtgtgcaacagaagagtcagagggagctacactgagagatggctttgtccaaaatgcaaatctcataacacagaaggcagccaaactcctgcgtacctccttcctcctcagacagactttaaatactttaaaggctggagtttcccagggtttgattctcatttctcttttcatctccatctccactgtctcctcaggtgatgttatccagctccatggagctcatagaatgaatgattctcagttaatgtcatggatactaatctcccatttgagcacctgatataaagatccaaccacttacttgacaactcaacttccatatgtaataggtaattcaaacgtataacatgtccaaaatagaacttttataccctacttcctgacctgctacttcctcaatcaaccacacatctattaagagtgccaatattcactcaggtgcttggaccaaatcccaagaatcaaccttgactcttctattttctttcttgcccatatctgatttgtcagcaaatccaatcatgtcttatcctttccactgtttccacctttgtataagccaacatcctctttctcctgaccaacaagtagagttatcttcctaaaacttatatcactactctacttaaaacactccagtggtcttccagtggtttttcaatgctaatggaataaaatccaaactttctaactatggtctgaaagaccccagtctagtaaatcaagaactattaatcatgcagtttggtaaatcatgacaacattaaaaaaatagagtggaataaaaatgccacagtgcaccatatgtagtaagggaaagtattttgtgatgctttttaattttaaatattaaggtataaaagataggaaaaaccaacaccactcaacacaggactactgacaccagattctccagcagacatcagttggatgtcctttcaattcggacactatctacccggtggtagcctcagatcccacaggttaacggctcagcccacaagactgcctcccaattctgatggtaatcacaagcatcaggttgtgacttgggcttctgactaatgggctataaattggagttcctacaacattcttcttaggtttgattaacttgctagcacagctcacagaattcagggaaacactttcacttatggtcattcattattataaaggatattacaaaggatacagatgaacagcctgaggtaagagatgcatagggtgacacagaattcagggaaacactttcacttatggtcatttattataaaggatattacaaaggatacagatgaacagcctgaggtaagagatgcatagggtgagacaggcaggaaggggcatggagcttccgtggcctccccaagcatgccaccatccagaaacctctgcatattcagctatccaggagctacccaatcattttggatttttatggaggcatcattacatgggcttgattgattacatcccccataagtggggagtggagatgaaagttctaactctttaattacttcttcagtttccctggaaaccagcccccatcctgaggctacccaggagcccccagccaccagtcatttcctttgcatacaaaaagacacttgtcactttggagattccaagagttttaggagctatgtgctagaaaacaagaggaatgccaaatgtatttatcttattataaatcaccatattaagttaggctatgtgtgtatttgtttgcaacacaaaacatttttcttaatatgagttacattcaaaaaatgtttgcaagcccctgacctgtatgatctggcccatgactacctctctgatcttttctaaaaccacactataccttgttcactgtgctacaacctcactaacattcactctagccctcaggcaggcaagctcacccctgcctcaggacctttgcatacattattctctctacttggaataatttatccttagacattttgtatgtatgcttctttcttaccattcatatctcaattcaagtattacctcctgctaggcatcttatctctaaagtaacaccttccgtactgttcatctcaccacagctatcttatcaccctgtttcagcttcttcttagcactgtacccatctcatctcattcatttacgtttttgtgtgtgcctttattttctacgtatttctcttagaatgtaaacctccacgagttcagggaccacatttctctggtttactactctatctttagtgcaaagaataatgtttatcacacaacaggtgctcagtaagtatttgttgaatgaataaagaaaactgaagacataattcccctctgttaaggtataatgggaaacctttggtctctcctgggcttctcagggccccgtgtagaaaagtcaaggctgtagaattagtattcaaaactcctccctttggctttgtgttcagtccaagagaccattcatttcagcacattaaactgttaattatggagtctggcttctcctttctttatgtggaaagaataaatagttattactaaatagtcatttaataggcagtggtttctttcagggcaaccattattaaaattgcacaaacatgtacataaataaagccatttacttaaaattaggacagactgacttaatggattccacttttcttactgtcctgggtactacctgcttggaatacacagtccttttttgtccttcctctcactttatttcctagctcttgccaatatgtacaccgttgatatatgactatttattcatggtaatttatttccaagactttttttttttctggggttactgatttagttaatagtatttaaaacacaaagtaattttttttggctggggagagatagccaaattgataattttatattatgtatgtcgtatgagtatggctttccctgaattttcactgcagatagacagacagaacattggtaagaaataggaacaccagactagaagtcagttatttaacgttccagtcccacctctcaccttaaccagctgaaatatttggataagtcatttaaattccctgagccttgggtttctcatttgtacaataagagggccagtttaggctttaaaaattcctgttatgtattcagacttattacattcaaagaactattataaattatcagttaatctttgcaaaaaacttacaaagtcggtactattatttctcctattttacatatgaggagaatgaggcagagagaataaataatacacattttaagtggtggagatggtttgaatctaggtagtctaaagccagaattcaaactcttattcttcttactgtaggatctctgttcctatttatctctgagagttaaatttatagctgggcatggtggctcatgtctgtaatcccagcactttgggaggccgaggtgggtggatcccttgaggtcaggagttcgagaccagcctaatatggtgaaaccccgtctctactaaaaatacaaagaaattagctaggcacagtggcatgcgcctgtagtcccagctacagtgagccgggatcacaccgctgcactccagcctgggcgacaaagcgagactctatctcaaaaatagtaataataatttaaaaaagagttaaatttataggttgtgaatccttggatctcatgttgttatagtaggtagatagtcaggcatgagtaggggaggtgaggcttcccctcatcccactaggaatgtcaggcaaccatcaggtgatggtcatgcagttgtcacgctgcctctctaaaataataattggtcgcagccagcaccaggaaaggcaggttccatatagatagaaaaagcacctgaaactggttatcatcagtctcctgatgagatctcaggatttgggcaaatgggctcaaacatgtgcattaagaggcaaaatggcagagtttcactggtatgtccatctgggggcgttccaccagtaaagggaagaatgagtcaggtgagcataagtacaactctagtaaacacactgcccatgctcacctcccaagtgctagcaggccattgtgtatgtgcgcagctcaccccaagggaagaagcaagggaaaagggatgtaagacaccagaaacatgccagcatagaaaaccctaagtccaaggtcaaatagggcacttgtcctctgagatgccctcttggccctcttccaagggtactttgctttctttgaattcatttgctttatttgaattctttcttctgaagagggaagaatcgaggttgctgaaaacccgtaaggattcacagccggtaacttgggtacccgccacagctaacatattttgttgccatgtgactccaataacttcaacctatagcaatgttagcttgtctgtatcttatttcaccagcaggctggaaactacttaagtgtaaagacgatgttcatctttgaataacctgagacaattagctccaggccttgcatgcagtaggcattcaatatttacttttaaaatgatgaggagttgggatggattcatgcaacaattttgacattaaccaggtgaaatctaaggtcctttctgagagtgtgtgattcaggcattgactgaatactcttcttgaaggagttggctgtgtctgcacagattcacctctgatttgctcctcaacttaatgcaatctggttttcagccccactgatgccactgaatctctgcttgccaaagtcaacaacacacttcgaaaggcatttcttgtcctaacctattgcatctcctgagaacatctaatattgttaactatcccctcttccttaaagcgctcatttcccttgaactggataacacagtgctgctgacttctctccatccacctctcagggtgctatgctttgtcttcattttaggatctgctttccttacctagatctacaatgttgggatctcccaagggtctgtcactggtccttctcttctcgctttccacactatactccttgggctttcccacacatatgctaaggatttttgaatctatagctccagcccagatctttctgttgagcttcagacttggtatagtggtaaaaagtgataacttactttaaaatacttccatatgaacagtatatatatgtagagtatattagtcagcatttgaaatatctaaatctggaatccacactctaggaatggataggaatttgcagtacctaatcagggatccatattcagagatggcttcaaaactgcttcatactgtgttaatagtctctcccagaaggccaaattagacagcaattttagacataatttttcgtttgtggatgagtgatacatgaactatatgtttggctataggaagggggtgtaaagacccaggaagcccagcagcctatgcctttgaagcaccactcagcgcctggcttcctgattctgtgtctctctcttcacaaagaactctgctacctgtggttgattggtcccaccacacgcaaagctcaaggctcactgtatcttgaacatctattggatagcaccttacacatcaagttcaacaggtccaaaatggaactgatcctctttgcacaaaattgatcctccttctatgttcttttatacagtaaatggatctacactcactcaatgggccaagccagaaatctggacattagtcttaacttctcccattctcatcatatccacagtcagtcaattaccaaattccatcaacatcatcacctaagtcattctcaaattcacccatttctctcccactccacaggcacctcccaaacctagggcaccagttcctctctcctgtccccagctggaccccttctactctattctttatacatcagccagagtgactcaggaaatggaaatctgtagtttaattaatatattgtagttacttataggaaaaaaaaggctgatagagaaaatatctaacaactattaaatagtataggtagcaacaagtcaaaagaaatgccaaaccacttacagtgaaaaatagttagaaaacaacacgttaaacaagccaggttattgctgcaattatcctaactttgttatgttgtagattgggcatatcactgttaacctttgtttcctctatgccaagtaatgcttgacagacagcaggctcttactgaaaaaaatgaaagaacatgaatgggaaaacattcaatcaatcaaccttttttttctccccccaacttccactcccagttttcctcttaaggaaggagtatgcctcaaaccaagaaactgagaagtttccctaaatcctattgattggtaccctggacttggaagcaactgacttcttgattttctaccagggtttagttaactccacatagtatactctatgagacgtatcattgctataaggttaatgatagttatagggcccagtcaaacatctcacagggcctatattctgtgtcacttagcagtatgatgcatcttggcccagggatttgcaaccttggcctgggaatttccaggagacaagactacctcagcacagatgcagttctcataaaccttaaaacaaagcttagcgttacaagaatagcttaaactccctttgtgaaagaaacaccttgtaactgacccagaaggaatacaggtataaggaaaggggaagaatccccaaaactctaagaatggtctctggatggaaactctcctggtcaatgggtcacctgcccctcaggctgtgccaggcccatgccaccacctgctcccgctacctgtcttttaagggttctgccagaataaactgcgtgagcatcagatgctgcctaagactcagctttgatgggaatcaaaccaatggaaagaagtttcccctagaaaagctggttacctagagtcacccaagacccccaagactgacagtccagctcaacaaatgttcattgacaatctttagcaattataatgatgaatgagtcataccctctttctcttgtaaaggtcactgtattttggtggaaataaacatgcgtttgagtcatttaagtaaataaatgttgaagctgtgttatccaacaggcagagtaaactcatatttaggatatcagcatagcaggacactgaggacatcaagaaaaatttagaagagttcgacagaattgatataaaaaaccaaagcaatcaccaatggacaagttcagagctttacgatctccttacccttatgttataatttaatatgatttttattatgtggggttacacaatagtttggtctccccaataaaagggacctcttaaatcttaatctattcctaataagtgctaaaatagatacataaatagggtgcttgggagcacgcaggaggacaattaaataggctaaggcaggggagagtagggaacaggcgaggagaaggcagcgtcaaaaggagggatgcctgagctaagtctaaaggggcaaattaaccaggtgaaggtttgggaagctaggagaggtatactgttcctctggtgggacccactcacccctctgagctagacctcccaatacttcctgctagcctagaccatcatctgttagctccctattatctattacatctgccccattgaaccttgactctgtgaaattctgagtctgtacctcccaagaggtctacctagctgcaagctccatgcttggtcgtatctcaacactcaagaatcacaacatatttattccattccaataaggctaatttgctcatggtttctatttttgtttttccttcagtgatcacctacacttctgttagtcattaaacaaatggcagctggcatcatcgccaactttcaaaaccttattcaaaagtgatcttctataggaaatctttcgagtggttagatacccacatggaaagggcttccttctcatgaaaagcaaccaatgcactttgtttagcattgtgtattcataaatatttatccattaaaaacaggcatctgtatggcaagtcccacaaggatgatttaaccaagactgcaaactcctcagctgaccacatcccatctctctttgcttcacatcatcctgctagcccctcaaatgcttggccggccaacaaccatactgtacagtcaaaaagattcatcaagtcctcacttagtttttattcaaccttattccatcacaatttctcaccaacatcagattaccggtgaaaatttgatcagagagactgaggtaagagagactcaaattatttaaatctctcaatggaagttaatagttttgaagaattagagcatttcatatgggagcaatgtcaaaataggtgacctagaactgaagtagttttccccagactctgcagttactgaattgactccccaggctgctcatattttccggctatttctgaaaagaaaaatatacaaatgcaatacccctttttttccccaaaggtctttgcttccctataaatactaaagtgtgctccttaacccacttatcctgtgagatgcctaaaaatggcctcttggatgaaataacttcaggaaacaccgtagagtatagccctggtttgaaaattcactatgaacactaacgtgttaaagaccctattacttctgtaaatagcctagttttacttcgttaactcttcctttcacaagtgtatttgggcacagatcaagtttccccttcccgcaatattatcaacaccactccatacaaaggagagttggaaacagccatgttactcctccactgaattcacacacacacggatataagtcttgtgtagtctgaggtgttcatttcaaccctggatagtaattcaaagtagcaaacagctttttgatgtttgctttgtttggttgcagaaaataagctcagggtagacagttcttcaatgacagttctttacttgcataaagctagtatggattatcccaacttttataatgacagtagttaccactgggatgcaaaagaagcaaaaagaaaaataggagttctaaggggcaggagtattagcattgcactataatgctgcagtctaagcaggcattccattactgggtcgatggtgaatacgaagtggaggttcaatcactacacacacttactcaatagtctcctctaaaaaaggcagtaaatgtcttgtttttggctcagatgaaggcctatcaaccgtcagaagtgcaggcttccacacagagattcagagcagcactacagccgctcagcatgtgaatcccaagaggcaggtgatttagtcaataggccccagagcagctattttaaacacagggcctgttctctttaaaggtacaggatttatttatttgtgggccatttaaaatttcctgctttcaccggcttttgatctggactcaggtattatatcttgtcctattttccaacatgtaacaattccttacaattataatattcacccatccatccatttggctaacattattgacaacctattatgtaccaagcactgctctgttttttttttattgcatgtaaaaatgatggtgatattataatgaatgaaataagcatttgtttttgcaatccaagtaaaatttacctgtattgaagaatgtagaggatcttgtcaggaaactaacgacactgccacatgaaggaaatcaaataaagccgggcgcggtggctcacgcctgtaatcccagcactttgggaggccaaggtgggcggatcacctgaggctgggagttcgagaccagtctgaccaacatggagaaaccccctctctactaaaaatacaaaattagccgggcatggtggcacatgcctgtaatcccagctacgagggaggctgaggcaggagaatcgcttgaacctgggaggtggaggttgtggtgagccaagatcatgccattgcactccagcctgggcaacaagagtgaaactcagtttcaaaaaaaaaaaaaaaaaaaaaatcaaataagagaaaggtgctgtgctttttgtaggtcagtgtttttcacaagacaccgatattgaaatccctggaagtacctatttaaaatgcagattctgctgggtgtggcagctcccatcggtaatcccagcactttgggaggccgaggtgggaggattgcttgagcccaggaattggagaacagcctgggcaagatagagagacccagtctctaccaaaaaaaaaaaaaaaaaaatcagccaggcatgctcacacctgcagtcccagctacacaggaggttgaagtgggaggatctgcttgagccagggaggtcaaggctgtagtggttgcaccactgcattcatacctggcaacagagcaagaccctgactcaaaaacaacaacaacaaaaaataccaaacatttggccaggtgaggtggctcatgcctgtaatcccagcactttgggaggccaaggcagtaggatggcttgaacccagaagttccagaccagtcgggcaacataagacctcatttaaaaaaaaaagagacaaagaaagaaaaaaaagtcagaatccaggaatctggatttttagcagtactctggatgttctttgtgcatccgtagtgccatatccatccctgtcatgaaggaggagaaaagaggcacacattctctccaatagaaacacctccacattcatgtcttttatttattgggtttcctgtatgacgtcttcaaaaaaaaaggatgcaagaaaaatatcacttcttttaagtgtagcacattagaaagtcacacctatgagactctttagctgcctcatcattgtattttaaatgtggcctcacagagaaaccatggattttagaatcgggaagatacacctccaccacttattagttatgtaaatttaacaagctaatttgtctgtgtgagtcttgattttctcagctataaaatggggacaatagcaaaaaataatgataagataatcagattaaaagatatatcatagagatatatatatattatcttttaatatatattaaaagatatattaaaagatatatctgtaatagagatattacagatatattatagatatagatataatagatatatgacagatatattatagacaaacacctggcaaatgagtgggcttacactgggtactccccaaaatttacccccaccccttccaaattctgccaaattttatagagtagctatataaaaattatttttatgtgttttcttaaatgctcttcttaagacattggcccttatgttgtaggaaacacctcgatgccaggttgaagttcaatacttacgttaacacattatctttctattttatatcaatgggagttatttaaaccaccatatttcttttcagcttaaattatcagaaaatttagatgtgaaattaatgctcaaaataaaaaagtgtttctcctctctatattacttatggttattcttaaaaacaaatcacccatttacttattcaacaaatcattttggccatccaataaatttattgagagggtatatcctcaagaggaagagctaagtcttatgcctgcatgtaatacactttatttattaactgagtgatgatggacaagctatttcttagcctcaaactcctcaaatgttaaattaggctaataatagtatctcgcaagattgttgcggggattacataaatcatgtacttagaacaatacctggcatttggcatgcactatagcaatgttatttagtattatttaccaaagaatagttactgaagatacacagtaaaaaagcatcttaaaaaggtaaaaagagtatataaacttacctaagtggaagttaagtgtagcataaagtatatcttataaatgaataatggagtaaatgaaattcttattcatctcatctaatgcaagaaaactcaactaccaacattatggaattttgatttgatatcactcctaactctattttcactctccctgaaggtgttcctcattttccctccttgagtctgtctatatgcaagaatggatgagcaatcagaaatgtgtgctcactgatatgtggatatagacctctgaagcatctaccccattctaagatggtccctgctcaaagggatcatgctgaagaaaggtgacccttccagctcaggtttgctctgatctccgtagcataagcaacacaaataaagaaactatagtcataggactttcgttaaatgcttagttgaagatctcaatttctgtttgcttctccttagccatattccaagttcattaccattaaaaataaaacaacatgtaatcttaatatatacaattagcaacactgtgtgctcaacgtgtctttcttaagttcttgcagacttctttcttttctcctaagaaaccccatctctttagatgagcccaactattcacactctttcctctcgctcctcaaattataatcaccgtcacatcaaagacccactaaaaggcactcactgaagcttttaaattaaggtacttgaatgacttagaaataggaatcacaaaacaaatctatttacatgcatttgtgcagaacattcctaaatgttcaggtgacactgacctactaggccctttagctcgctatgtgaggaaataagatagaatcttcaaagaagtttggttgtcaagaagcctctgggaccagtgaaacaaataattaacttatagtggaaagagaggacaagaaatgtttccctctgggcctgaaatacagtgtgctctactttgcataagttaacatcgggaggtttgaattttccaaagggcttagtggctaattagctgtgtgaagttgcccatagtgtgtccttaagactaaacattcccatttctcataaaaagctgtaatagttacatgaagcaaaagaaattatctctactatgtgtttggggtttgtctttcttgtggcctcctttttacttctattacaacacttacgacacagtactatgaagatcaactctctcttccccactacaatggaagctttcgaagtataaggattgtgtctgacttaactctgtattccatgctcctagcttgacatttagtaggctctgtattccatgctcctagcctgacatttagtaggctctgtattccatgatcctagcttgacatgtagtaggcattcaatcaataatcagtgtttttcagataagtgggctagtatgaagaccaccgagagctatccttccagggctttaaacacctctatactcagctagtagaacattcaagtaaaatacagaaacctactgaataatgagatttttttttttttgagatggagtctcaatctgttgcccaggctggaatgcactggcacgatctcggctcactgcaacctctgcctcccgtgttccagtgattctcctgcctcagcctcctgactagctgggactacaggtgtgtgccaccccagctaattttttatttttaatagagatggggtttcaccatgttggccaggctggtctcgaactcctgacctcaggtgatccacctgcctcggcctcccaaagtgctgggattacaggcatgagccactgcacccggcctacaatgagatattttctaagaataatacctgcaagtagattaattattataggcataattttaatcagaacaataaaaatttatgttttctaactagtttcgggcctaatagtttagatgcataaggaattgctcccatctgaatgtagacagagagtatgtgatgggctgagtccaagaaaatgaaaccataaaaccaaagtcctacatttaaaattttaaaaagcagcaagacagaatggaagacagcgactgaaacacatgagttttcctgctgaccacaagcaccctagcagtcagaagtgggatgaaagctaataacacaatactcagctgcattaattcagtgggtcagtatttttatcagagagagtaaactttactttgcttttgggttctatccataaattgtgtgtgtgtgtgtatatatatatatatatataaaatattgtgtatatataatattacgtgtataatcatgttttaaagacctatatttagttgcactaaataatcaaagctaaggaaatctggatcttgtgaatttcctctagcttcttctccttattctgctctatgatagctcacaaccatagctaaaacatcctgagcatcttctatcagcagtcaggtactacagtaatacattacctatattcactcatttaagatttacaacaactattattactctctttactgcagatgaggaaacagaagcaccataaaactggggaaccagtccaaggtcaaaaagtttatgagtggaggagctgagcttgatcaagggagtgtggcatctgagtctgaatcctgatccctgtctcacatcatcttttctcgagacagacttggaaatggaagacagagggaagcagtgtagtttattttagtcttggtgagtgggagaaagatgtttaaaatatggatgcagcttagacgttgatatagtttggatgttgtccctgcccaaatctcatgatgaaatgtgctctccagtgttggaggcggggcctgttgggaggtgaccggatcatgagggtggatttctcgtgagtggcttagtatcatccccttggtactgttgttgcaataggaagggagttctcatgagatttggttgtttgtttaaaagtgtgtagcacctccccctcctcttgctcctgcttttcacctgtgtgtgtctgttccccttttgccttctgccatgactggaagctccctgaagactccccagaagcagatgcctccatgcttcctctacagcctgcagaaccgtgagccaattaaatctcttttctttacaaattactcagtctcaggtatttctttacagcaagaatgtcctatagagatgtggatacttttttcccccaatcttggccactatcatgtcctttaagttatcagagatatataggtgtgttttcaaaccagtagtgtatttttgtataaataagaaattagcaattgattctcacttattccatttctccagagatacaatgctgacacatcccgaatttaaaagcattttaccacctagtggtgggtaccttgagaaactgccagatactccaatagctcagagcaataaagaagaacgggggaaaatttgctaacataaattttaagtggaaccatttacatcttggtaaatcttccctatatgtcaataaaagaaaaataaaagcattatattaataataatcataatgagaagaaattatacagtgatatcaatttccttggggagggtggatagtagtataacacgcttctcatttatttaatttttcatatgtggctttttgtactactgaaatggtaaaccatccatgagggtgtggctgaaagggatgtttagtttatgtacaaaaatgcaggagaagcacacccctagtccttcactgacatatttccgaaacatcagaaaatattctaatcaaaaccgctgttgattggaacaggataatagaaaattcaattgaaacaaaagtaaatgaaagaagaaaaacaatcggagtctctattaaagaagaatttatatgtcatgaattccttctattttactgggtaccttatttgatcatttaatacttgcaacaatgttgtgagaaaggtattggtatcctcattttactgatgagaaaattgggtttcagatactgtaggtgctcaatgtcacacacaagttaggcaggtttcaaagaggttcagatgacaaagcctctgcctaggatgacacctcatctaagaaggacagcagtcacctgctcacagggaggtgatccacacttgtgctctgatgccaagtgtcaggtggacagaggtgaagagacataacatctggaaacatgagtagaagaaagctcaccaggagcagcagagctggttattttcgtgaaagataaattgatgggttgcttgctgatagcttgcagtgctattccagataggctggtaacccaaataacttgtggaattctccacagctgaggagaaatggaaaaaaaaaaaaaaaagcactagccaagaagtcattcgattatgctaaacaaaatcaattcatttatgacttttcactttcgtaaggtggggaatgagtggtttcttaacgttcatccagcaattgttttctagcctcattgcacgactgctttttaagttcaccttgacctaaaggcaaccttacaaaatgctttgcaaagttgtggaaatgttgcattccacatggttgtgaatagaaagagcttcttgaggccttgattagagctgggtggagctaagcctgaaacagatgatggctacactacactgcaggcccagctgccctgcccatgggcacaacagcaaacccagagacagtgcagggaggctgggaatgggtcaagtttaaattaggcacaggatttggcaagccactacataaaaatacaacagcccaacagaaggccacgtttgggtagccagccgtcgtcaagtgcaatgtgggaggcgccctgtctggaagagaaaatgggaaagaatccaccataagaacatgactcaaagaggtcagtgatgggcataaaaatatgtccattgcttctcagaaatcttgccaagaggactggatttctaataccagcaagcaccaagaaacagaataagaagaactagattgtcctcctttttctgatgtttactaaacctctattttctaactatattggtggcaggtagcattttctataaaaacctagctttctctggtacttttactttttttctgcctctatagaaatttcaccttagtttatagctggaggaacatactcttcatttaattttcctatctgccttgctgggcaggtggttttggactgaactgattacattttaggtaacaggatatttctcagagacagcatgtcttgctgggtattttgggattcatggaaaataaaaagaaaaaatgaaaagaaatccattcacctttcatggcagtgatttagtagacattctgtggtctctattaggaactgacccgaatagaaagctagattagcctaaaaaaataaaaaaatgtagaatctggtttacaaaactccttagtttctgtttttatgccttagagaacatgtatgagttcaaatataattacaaataagtaaaaatatgtcaggcctatgtttaagtgttttttttttttttgtatttactagcagtgatgtttttgtcaaaacatttttattctctgatctttagtcactttactgtaaaatgaagatgaagtcagctctgcttatctcacaagtcttttgaaagactccaataaaacactgtgtagaatcttcgttaagccttaggtgttcagttaattttaaggtataattttactatctctacaaaaaaatttaaaaaaaattagctgggcatggtggtatgtgcctgtagacccagctacttgggaggctgagatgggaggatcccttgggcccaggagttcaaggctgtagtgagctatgatcacactattgcactccagcctgacagatgacagagtgagaccctgtcaaaaaaaaaaaaaaaaaaaaacaagaaagaaagaagaggaaagaatatactatgtgatagttgttaattagaattttattttgtcttattgaaaaatttcttctcactttgaaatttactagagtaagttggaattattagtttttcagaaacagagagagctggaaagccatctttatgacatccctcattacagaccaaccaccaagtgatctaactggtacatataccttgaaagacatctgataaacacagagcacacctgatgagttaagccaggtggaggtaaaagctacatttttcattaaaataccacagtgctggaaatttctaaaagaccttgagtggtgatagttgtaggggatgccctggccaaagtggcctgtggcgttgcatgctcccacaaaagccatgtaggcaagactcaatggcgttggaaccgtgtctgggcagaatgctctgttttcctttctggaacatggcatgatgagcaagctatccacggctgtcgcaggccatttcacatccacctccctatcttgcaggaggctctgtgtcctgccgaaggttgtcatgaggctctttcccatcaacctacctggtaccagtgaggcatggaattttccccctcgcccttcttggatacagctgcggaccgtaaaaccattcagctctagtatgaaattgacttctcaactacagagtggctcactccctgtgatgcgtgttttccggtccctccaggttgatggtgtcctgtggggacagggatgagaccctgaagaagtatatgctgggttactgaagctgaatcaatgcttttctccaggtgtgtgtatttatgcacctgtcttttctcgaggggactccctaagctcccagccaggtaatatgcacacgatagcaccagaggcaggatggagaaaggaggtcaagctctccaagttcagtaatataggcatgtatttacatgccttttctatcccaggtcttgccactgtctggtgttctcaagtcaggagcttctcagtattttcaaataataaacctctgtggcctccctgggaggctgcatggagtaggggaagaccctggagatctagcttcctctagatccattcttacaataaatccatctctttccagccctgttcctcaatctcatttctcatggtgctgagttccatggggcaaactggttcattaatcacaggtatctccatgttgagagctgggttgtagctctatcctttctgctaaggcaattactgctcttccatcacttcccttcctttattccaaaaaaaaccccacatctttcattcattatttccttctgtcctgttctccttgtccttgtggattaccacctttcgaacatttctttattgcagcttctattggtttggggaagaacgggagactaactctactggccagttttccatctgtaatgataaattcccagcacaggtgggtggaatatgcatccttcttgtattcttagtgcatttcacagaacctgactacagaaggtgctcaaaaaaaaatcagtattgaagaggtggctacatacaacaaatgtacactttggctacaaagttagataaactagcttgttcagcaaacattttcagagtatagtattctatactaggacccttgacactggatgccagggcagataaaacacaattcttattctttattgtcagtaatgtggtgaaagtcccttggaatcgggtgaatctgcaaaatttcagtgggaacaagagcatgcaccacccaggcttatgtcctagtctttccagggtctgggagtaagaaaaagatacagaaacctgattacagtcatacagttaataagttaacagacaacaccctgtggaattaattcacctttcaatattcattataaatgccgtcttccttctttgaatctctgcaattgtggcaagccaagtttatgccgtaccttagcgataaaagtagagatgattaactgtctttctgtctttgtctcttcgttcctttttttttttttttgatagagtcttgctttgttgcccaggctggagtgcagtggcacgatctcagctcaccgtaacctccgcctcccaggttcaagtgattctcgtgcctcagactctcgagtagctgagattacaggcatgtgccaccaggcctggctaatttttgtatttttagtagagatggggttttgccatgttggccaggctggcaaactcctgacctgaagtgacccacccatctcagcccctcaaagtgctgggattacaggcttgagccatcatgccctcctgtctcttagtttgttttaattttaagaggaacaatggtgctttgttttggtttatgccacccaaagaaatagaagtatgcaactttaaaagaaaattttcagccaagggtaaaaacataaaaataaaaataaccaaattggtgtcagatgcaaagaatcccttgaaaattggtgaggattgaggaatagagaaggatactgaagagggatctattattcaaaactcaattaccagaaacccaagttaaactaaaggaagtgggaatttaatgtctcagtagctgcaaagcttcaggtacagctggagccaggtattcaaacgcaattgttaggttcttccctcttctgtactggcttcacgttcagacagatttcattctcgtgtttacacctaacagcttagcaatcagtgcagaaatattctctttccccaacagttctagcgaaagtactggccacaagtctctgacttgccaaacctgagtcacattcctcctcctcaccctcactccagaggactgggttgccctgctcaaaccatatgaaccgagagtcaggtcaggttgttacacaaaggaaatccaaggaaatgttgccaggaaaaggggagaaggcttttaagccagtatatgcggtagctacaattagtgtaagataatactggccctggagttttggctgcatcaccacttaaaaaaaaatttaagttttgaattaagccaaattgcttagcacagaaggctggtttggagtgtagctatttttgaattatttactgagcttcccactgcatttgccccccacaactcttagcatccatctcttgctaaaaggccacctgaccagaatgttaagagaaatatccaatagcctctacagaaagagtagaatatttatttttagctttatgatatttgttcttaaatgcttttcagcctggaatgacttcaatgagatttgtacatttaaaggctgccaaaaaaagaagggggaaaagtcgaatattaaagaaaatctcactcacatccaaaagtggaagattctttaaacttttaaagaaaatgttagttctatttttaactcacttttgggttgtctaaggcttaagactaacataagaagaaataggtcgagcaacaaaaacttgaaaaccaaaagattttatacttgggaattaaccttttattaaccctaaccctaacccccttttgacgaggagaaaaagagagagaaaggagacccttctatgtgcaattcagggttcagtcatctcagaattttccatatacaggccctagatcaggggtgtccagtattttggcttccctgagccacattggaagaagaagaattgtcttgggccatacataaatcacactaacactaacgatacctgataagaaaaaaaaatgcaaaaacgtctcatcatgttttaagaaagtttacaaatgtgtgttgggccacattcaaagtcattctgggccacatgcagcctgtgggccatgggttggacaagcttgccctagatgatttttctaaaaggaaatttgttctgaaagacagtagtcagtatacctttacacaatttcatgaagatgtctgggttatgagaattgtcctactaggaagagctaccaaaatagctcatcaccttgaggtactgtggagtgaaagtgaccaggtgctttacatcaagtttacaccaagctttactttccaaactttttaaactgtcagtacaactccttttgaacatatcttctaggttggctcttggagtgatacatccatcaccccattctactccaaattcatttgaaattggcaattttcaggttccaacttgcgatggcttaacactccaggcctccctaagatggcactgaacatagggcagccctcctggaggaccccacagagaggccatggagcatgagagtgagctgtacctggcatgatgtatgcaacgtggcttattctctttgattcaggttttacgtttctcgaatggagcctcttctaggttgctatccatttacctccccatctctctctctctttgccttttcctggttgagtccttcccgggttaacccagccctcctgatggcttcccttcactttgaaatccacagacaggaacaactctacatttaatgataaactgtcttacattcctccctaattagttcaaattgaaagtttgctctcacatttggaattttagtatggctatgataaatacttgtgggctcctcactcggagcaatctctgaacagacgatctgaagctagatatacaacattctcatatagtgttcagtgtgaatcaatatcaaagtttaaattcccagtgatattaatgaaagaggtgagaatttgttgctcatatcaataagaattagacctaaaatcacactagtgatctttggacttaatttagtgttcattcatttagatacaaactgagtgtatagtttctgtttaaaggaagagtattttgtccgtgatcaccggtgcacccaatggccaattgatttctgtttacattctgataattctttgcttatcagatcatttcacatgagaatcaagccctctgcaataagcagtgggaaaaattttagtcggtgagaaactccaacgcctcaaaagaaagagtgtaactttcaaaactgtcatttttgttctcatggtaaaaatctgactttgtgtcaatcattccccaaatcttcagttgaggaaagaggtcatgctctacattaattacagatgacaagctagagacaaaactaaaagtccaaccttataacttcgcttttctgcctctccctggtcaaaacaaaccctcttataccaactattcttttttatcacttgagtgctatgtacagggtaaaagtaggattacctcagaataataatttcacacataatttttgtaagaaaagggttcatgataatacttttaaaaataaacagctagcccaaatattcctccataacaaaatgtgacaaaaggaagttagaacaaaatcttaatttacacagaaagtaaaactgtttccctgtaaacaagctgggctgtcatgaaaatggataagggttcacagaaatttgacccaaagaataaagaatgaacggatgacacaaaaatggctaactggataaaaatatgttctgtgtgattaataataagtctccaaatcacagtacttggagagaagggatgggcatactactgtggaattctggatgtgtcaagatctggcctgggttctgggaacactggatctctttgttcctctctctgctgttcagggacagtggaaggggaggaaaaagggatcgtggtccagtgtacgtggctcagggactgggcctctggaagccacagggaccagcgatagtcacacttcttcagccctccagcgattgctctctgtttctgttctgttttcacactgttatccttcagcacagctctgtgcgctgtttgcctctcctccactggtggctgctctctgctaaataagcatgccacttgttcactgggtaaagtgaaaaagacgttgcttgtaaaataattgagtctccaaaaaaagaaaaagaaagcgtctggatcactatccgtgtcacccctaccctgagaagtctcttaccggggtgacttttcttcaaagaaagcattttccaaactaagtgcagaatgaagcaaaaaacaggaaagaactcagattattttatgacgtcacatgatgctgaattacagggtggaaagaaacagaaacacagaccactgacttattggagagagagagatatatataccatgtatacgtaatattatatgtcatataaaatatatttaattacatataatatatatttatagatctccatggcctgtgcttctatggaatcaaattgttgtgtatgcatctatgggcatatacagaaatattatatattaatatataaataatatatatgttgtttagatggagagagatcagaggagcactgaccatggaaatatagataatatacaatatatataaaaacatataacatatttttcctgtgatatgtgcttctggtctctgtgtgtgtgtgtgtgtgtgtgtgtgtgtgtgtgtgtgtgtgtggcataaactgatactacaaaagcacagatcaccaaaatagtatatataaaatatatatacagcatattatgtattatataatatgtggtctgtggtcctagatatctatacacacataatgcacacacacacgtaagttatgtgtgtgtgtgtgtgtatatacacatacatatacatatcctaatctggtagcacttttgttgttgttgtttagattcagggggtacatgtgcaggtgatctgtattatttattcttccttgttccatatatattagattaaccaagatttaaatatcagctctattactaacagtaacacctggaccaagttatttaacttctgtttacttataagaccataaatatataaattaatacatttaaggaatacttactgaatgctggtagagtatgagcacttaataaatgctagtagttgctgacagcacttatgaccaaaacactttcacaatcatatatgcatcagagccagggctgccgtttaaaatataatgttctcatttgcaacgggagaaatggcacgaaaatccaggcccctctaccaccggtatgtactctttccactactcagacagaggaatacttacatttgaatgagaatatccaatcttctaaaaattaactgtaaaccaaacgacaaaatttaaatggagagtgtttggggggctctggaggaatttgaaacttgtatttaatttcctggctcttcatcctgaaatgcgtctaagctagtaacagacagcaaaaccgagttcctatctctctagtgttccctgctgagataaaagcgatgtgcagcaccggatgccaacagagcaaataattacactgagtgctctttccacagccaatgaatcggaaagtgaaatttttgtggatgcacctgagtgctggggacatcagctgtcctatgagaagtcattaacattttctgaatgtctactgtgtgccaaacactgattactaaagaggacgcaaattgaaatgagagattattcttgtactccaggtgcttaaagccgttattaaggatcatatcacatgtccatcgagaataaaatgtcaggtaagaaaaattccatgaagaagaacagagtgctaggaaaatgcaagaaaaggaatgattaatgccagctagcttggggagggggctatgatgagagaaaggctaaggacagggacagtgagacagggacagttctctctcctagaattattaggaggtaaaaatttggagctcttctacttatgattaaacagaaagaggcatgaggagaaaaccaaatgatgtcatcagaataaaaaggcactgcaaaacagtagattatacatgcaccttgaatgtgctgtctgataaatcagcattttacaaaaacacatccggactagcaattcagaagaaagcaatgttaatgcattaattcaaagagagcaagccatccccaccctcaccccataggcttttatttatttatttatttatttattttagcagcctataatctctaggatttaaaaaaataactcaccaatgaacagaattaaacttctcaggtctgttgctttaaagaatagccaatatttgtgagaaacaatttcaagagaagattactacaaaatgaaaatgtaatatgtctgcatcagttaaatctcccaaaacaaatttgcaatattgcctctgactttgacgattttattctttcagtaacagtccagatggcatccaatgagtattgacatcatcatcataaaaaaaggctaagaaagtcaaaatgggatttatttaggacaaaaattaatatcaatagataatgatcttaaatttaaaggatgaggcatgaaaaaaacaattaataaaccttttatcttcctggaagatttccatttgatatgtatagtcatttgttgtgaggaatagaaaaaaaaaaagacacattaaagagtgtaaaaggctataaggtaccttgagaatgtagaaaataattattatttaatgaaagtgatagctaagaattcaaaaaataccctttggctatctgataagaaaacctatgccgatactatagcaaatctaacataagtaattttttggccttgcaatagattaactacctaggacgtaagaaaatgtctaaatctgggcttaatccaagcctctggaggtggtaataaagtcattaataataatggtaaaaactataataatcttttcagtttttgctcaccttctatgtgttccatacaccagttagaaatactgaattgtccagtgacatcaccataaaaaataaggataaagtccaaatataccatttttttcttgttcatctgttgtgtatgcgttatccagagtcactcttttagaaccatatatatttttaacacatgactggtaacaagttctaccttttaattacataggctaagtaaattactaacatctcttttatgtctgaaagcttccttttcaaggaatgccttcttatggaacctctcaagctctgtgaagtctgcctgaagactggatttaaaaatagcataaaatggtcctaatttaatttatggcctgaggagcccatattcacgtggtttcgaatatgggtaggattgttttctttttctgtccaatatcctcccacctcactcaagaccttacgtggtcttattgatcacgggagcacactggagcggtgactttatgaactaggctatccgtgacccttgggtccctttaatgggccttaactgttagtgctgaacctgccctcccaaaagtcacctttgcattatttttcataaatgtattattttctatgtgggtcaactggatctctcttgataactttctgttcttcacatatctcaatgttctcatctttttttctttcttggcttagatgcccactttttagtacagtctgacataatctgcaagtttgaaaattccagatgcctataaagataacatttaaatgctagctaagataaaactcaacaccagctgggatcccccaaacttccagaaagttgtttgtttatgcctgcactatgtttgctgccttttatgccactccttaacctgccaaaacagtcccaaacactgccatggagaggcctatttggggtagaaatgtattagaggtttggggaaacactaaataaagtacatcgatttcccctttcctcaaagtcaagaaacaaagttacaatcttagtgaagttcaatatttcttcatagactcttggccttgtgcctgcacaatgaatggatcacgtcaggttcccatgtagggatgagagaacaggaagttcattcctatgattcttggagtctttttcagagagtacttaaggataggcaaacagtattctgtaggcacagtgatatatgttgcagaaaaatgtgcattttggtccatcattaatgatttactgttgagtacagtttacaatcttaagtaaaataattcatctccagagatttatttactgcttttggccacacagcaataaaatgatttggttgtactgagaagaatttccctttaccaaggccatcacagggagaaggtatggtgttccaggtaaaggatagcataatagaaccatttcagtcaatcaacacagttggtagtcagagagaaggcttctttgtagatgttgatagacatatttatgtatttggaaagaattttccctttatggaatagagttattcagaagacaaagggtccagctaagtttgggaataagtcgatacacctgagttacttgcacagaaatatctcaaaggaattattgtaattatgtaattattgtaattcccttgagatattgtaagtcaatggaagctgtgaaggttttattttcccaatccaaaatcacctccagtcccaataatattcactccaaatataaaatggcaaattcacatgttcagaaggcactacacagaagcagcaccacaagcgacagctatctaggaaaagaaaacagtccctgagactagaatatatggctacaaagaaaaccaaagctaaaatcaaagcatttagatattgccaattttgtactgttccttcgaacattctggtgaaaataagtcagagcttgtctttcatcttggtcgtatcagatggatccaaccacatttaaaaacaaatcatttctctaattactgtgatggttactagaggctgggaagggtgaggggtgataaagcgaagttggttaacaggtacaaaaatacagtctgatagaaggagtaagttctagtattcaatagtacattatcgaaattacagttaacaataattgttgtgtatttcaaaatagttagaagagaagaattgtaatgttcctgacacaaagaaaagataaatatttaaagtgatggatatcccaattaccctgacttgatcattacccactttatatatgtatcaatatatcacatgtactgccaaaatatgtacaactatgatataagataagataaattatttctctacaaatacaatgagaactttgtcattgcccagcaggatttagctattagaaaaagaattatattaggctgggtgcagtggctcatgcctgtaatcccagcactttgggaggccaaggcacacgggtcacttgaggtcaggagttcaagaccagcctggccaacatggtgaaaccctgtctctactaaaaatacaaaaattagtcaggtgtggtggtacctgcttgtaatcccagctatttgggaggctgaggcagaaggcttgcttgaatctgggaggcaagaggttgtagtgagccaagatcatgacactgcactccagcctgggcgacagagcgagactctgtctcaaaaaaaaaaaaaaaagaaaaagaaaaagaaacaaaacaaaacaaaacaaaacaaaacaagacaaaaaaaaagaaaagaaaagaaagttttatgtcagagcccaagtggttgagattaacattctttactatttctaaccacttcaaggtgctaatttacaataaggaaagagtaacaaccattaggggaatatagactctttcatagcaaggttaattgaagtgtccatttgactatgtgacatctcactttcccctcttgttccgcagctcgattggctatgtagttattatgtgcaagttgcatagttactcagttctgtcagagaggatgtgtgaagaagatgaaaaagaaaggactagctttttgcaaattggtcatgtctcttgcggatctagttaacatttcctgttttctgcaagaattaatttttttcctaatgaactttaagaactaccaatatttttagtatactctttctttcttatttatttgtacattatctgtttgtatccttgaattttctctgggatgttataaaagaaaaatattacaagcataatttctgacacaatgttttataactgttttcaaaagcaatctatttctctcttaatttctatagaacccattttagtcattcctatgatgaatgaaaaaaaactcacaattagttgtcagtttcagaaaggagtctcagaagcatcttagaaccacctaggcggtcttataggcgtcacagaaaaatattccaccttacttattcttatcttcttcaaactgactccaaatataataagcaggcttaagttatataaggttccttaaaagttgttctcaaaaacaattaaatgcagactgtcctcagtaaaacttgcattggcccagtccattttaccaagtttgctccttcttacatgtacgactgcccctgtgacaagtttaagcctacgttaattaatcatctttccataacactgagacatattcatccaaccctgagagggataaggggtaacaggcaagatatattcaaattgtgacatttaaggtcaacttgactttaaaactcatatactgctcagttttcatatacgtggctgaaaacaagtcatcacagagaactggtcacactgttagaggaccaaaatagtaaaatatgaacaattcttccatatttaatgatattaaatataacaggtcctatgtctatgcaattgaagtcaacatgtcactaattagggcttcctttgttatcaaacttgctgagaagatagaacagtgaggaaaaaatagcaggaattgagctgtacagaattaaagacattcttatgaaccttaagacttaaggtcagtcacactcatatgacatttggactattagacaactcttctgacctcaaattttgctcttaccagttggtgataatcctttggtaagagagcatgttaaaagtaaccaaatcagataaggactagaagtcaaatttcaacagaagagggcaatgagactccgtgccttaattatcaacatttttatgatgaagaaccttcctaaactaatgaaaaatacaagacagaaacagatgaaacacagaaatggctgaaaagaactccctattaatttctgaccattttcttccctattaacagtgcttgatgatctggagtgaatacctgcctttttggctcctgccaattagttcaggaagttccatcttcaaacacattcagtgacctgatttaataggggcctttttatttgatcgccgccaacaggcagtcctacagacttttataatcacagtgggctgctttacaggcaagtcaaattccagtttaatgaaaacctacatcattacaaggaattgagaagggaattctggtttcttttctgctatggcttacactggaagcatagtaactttccaatgaatccatgcaggagaatggaattcatccaatagggaaagcctcatttttctctatggtagaatggtagaattaatgaatatcaagaacacgagaacattttgtaacatcctgctggttaagtatgtttcattcctagctaggttaatatggataggctgggggcagtggtggtggatatttccagagatattacctgaagtttaacaaaacattggttttaagcttgtacatcatgaactcggggacagcttctctctcacactctatttatttatttatttttgagacagagtctctctgtcatccagactggactgcagtggcgtgatcttggctcactgcaacctccgcctcccagggtcaagcaattctcctgactcagcctcccgggtagctgggattataggcccgcaccatcatgcccggctaattttttatattttttttagtagatatggggttttgccatgttggccaggctaggctggtctcgaactcctgacctcaggtgatctgcccacctcggcctcccaaagtgctgggattacaggcgtgagccaccacacctggcctccctcatactttcttatgcaccaatcatgacccattttgaaagaggcagagtggtggaaggtttggacttcatgtgctgactggttctctttgttaagactcaaataaaaccactggagtcctatccactgaatgctagatctcaagacatagcacaatgggattcctggttacttacaagcggtctttatggttccccagaacatcttcccttgagcctgcttcccttgctgctccaagtgaactaaggccagaaactaacagcaagcacacaggaactgtgggctctgtgctcccctcggtgtttctgttccatagaggcccatcatctttagcgacttgattttctcattccacacacaactccaacaggtatctcatgtattcattggtttcaaatatgtgtgtgaataaatccctctaaatttcagacctgtatatccaacagtttccagggcatctcatctggttgttctacatacgttgcctgaaagtgaatatagccaaaacatatcatgccttcgtcattctctccatgaagaaagaaaggaagagagaatctcttgtgtttcccaatgtgaaaggcatagtggtgcattcattgtcaaagtcatacatatgggtgacatcactgttggtagggccttctcccttaactcacctgcccccctcacttcccgcaccaccacccctaatcctcccattgagttagtaatgaagtccttcctatgtcctgaaagtctcccgtgcatcctattttttcttaaatctcactggcctgccttgggtcaagccttcatcatctctgctctagactacagccacagtacccagccttgtctcccttttctaccatctgatgtttattctctacatttccccccacccagaggaatatgtttggaaaaaaaaaaagaaaaacaaatactgctatttccctgctcaaaattttcaatggctctttactcttttcaggatgaaatttgaactcctccagattctaactgttgtcttctgccttcctctctggagtcatccctctgcactttccaaacacctcatcctgtgcaaaggtcacgcgacaatatttggagttcccagagctcgccagaccctttcacaccttcgagctgttgcacaggcgctcctcttttccctggctaagtctgactcaggctttacaatgaagctctgacatcaccatctccaagaaaagcctctgaccccaggaacctgagtgaaattccacacactcctgcagccctctgggtttacctctattgtggaaattatctcactttcttgatttgtccttctcctccctagactgtgatcccctcgaggacagacagcatggcttaattctctgtatcgctaggcctgacaaaacgctcacacacagtaggctcctgaacgatgtttaatttattgttaacacataggattccacagatcctgaggtacagcagacttcagatacccacttcaaagaaaacaagggagtaatgcctaggttcttgttcctatgatttatactgtgaataaaataatttcagagaagttcctttattcacttgaacaatatttaaagggcaaaaaaaattaacaaaaggtctttttaaaaatgcaaataatttacatttgttgataaagccatacaatcacaaaagtgaccatatgaatgcaaatattccttctaaaaagtataattattattcacccatctaacaaatattaatgaacccctctgatgttagatgctctttatggtacaggggttagcagagtgggtacatggaagcttcctgtagtttacactatcatctggaaggcgattaatcaaatactacttactgttcatgagtttataattataaaatggagggaaatactctgaaagagaagagtgtggttttataaaaccatataagaggctgggtgcggtggctcaggcctgtaaccccagcactttgggaggccgaggtgggcagatcacttgaggtcagcagtttgagatcagcccaggcaacatggcaaaagcccgtctctactaaaactacaaaaattagctgggcgtggcagtgcatgcctgtaatcccagctactcgggaggctgaggcaggagaatcgcttgaacccagaaggcagaagttgcagtgagctgagatcatgcaactgcactccagcctgagccacagagcaagactccatctctctctctctctctctctctctctctctctatatatatatatatatatacacacacacacatatatatatacacacacacatatatatatacacacatatatatatatacacacacacacatatatatatatacatatatatatagaaactggcttagacctaaggtgagtgggtctcaactgggcataggggaaaaggagggaaagcattttagatggaggaaaaaacagggcagggataaatcttcaagaccagagtggccatggaaaagtcacctctataactagaatcaagagagtgagagaggaagtgataccagatgaggtctgagaggcagggagggactgatccaggatgctgcttaagggtgaagaggatcagaacacgccaccaaaaaacataccattttggcatactgattattctgaggtaaaggcaattgagaaacagaaaatgcatgaagggctctccacctttcccttttctgcctaaaagcaggacataggtaaacgtacccttgccaaaccccaaaaaccagagactaaaatgaaacacagtcagagcccagaaatcatattttaaccatgaacaccccaacaattaccccctgattgacgtaattttcctaaaaatcttaagcccctccaactaaattaatcctccattttgtataacaaatataaaaactaaacttccaccgtaatactaataccttcagcatatccctctgaaaatgtgtatgtttctcctgttaatctgtcttttgttatcttaattagtaagaaccataaacagaccataagagagaacaggagcactttgggaggaagaggtgggcagatcacgaggtcaggagatcgagaccatcctggctaacacagtgaaaccccgtctctactaaaaatacaaaaaattagccgggcgtggtggcaggtgcctgtagtcccagctactcgggaggctgaggcaggagaatcgcttgaacctggcaggcggaagttgcagtgagttgagatggcgcgagttgagactgcgcgactgcactccagcctgggccacagagcaagactccatctctctctctctctctctctctctctctctctctctctctctatatatatatatatatatatatatatatatatactggcttagacctaaggtgagtgggtctcaactgggcataggggaaaaggagggaaagcattttagatggaggaaaaagcagagcagggataagtctccatgaccagagttgccatggaaaagtgacctctatagctagaatcaagagagcaagagaggaagtgataccagatgaggtctgagaggcagggagggactgatccaggatgctgcttaagggtgaagaggatcagcacaccaccaaaaaacataccattttggcatattgattattctgaggtaaaggcaattgagaaacagaaagtgcatgaagggctctccacctttcccttttctgcctaaaagcaggacataggtaaacgtacccttgccaaaccccaaaaaccagagactaaaatgaaatacagtcagagcccagaaatcatattttaaccatgaacaccccaacagttacccctcgattgatgtaattttcctaaaaatctaagaccctccaactaatcctccatttttgtataacaaatataataactaaacttccaccctaatactaataccttcagcatatccctctgaaaatgtgtatgtttctcctgttaatctgtcttttgttatcgtaattagtaagaaccataaacagaccataagagagaacaggagcactttgggaggaagaggtgggcagatcacgaggtcaggagatcgagaccatcccggctaacacggtgaaaccccgtctctactaaaaatacaaaaaaattagccgggcgcctgtagtcccagctactcgggaggctgaggcaggagaatggcgtgaacctgggaggtggagcttgaagtgagccgagatcgcgccactgcactccagcctgggcggcagagtgagactccatctcaaaaaaaaaaaaaaaaaaagagagagagaacaggaaaactttttttcttccatagggatcttgtttggaatttcggtcttaatcctaaaatcaaagatggattttaattggacaggtttgcaatttgaaaatagtagtgtggctgccctttggagaaaggcaggatgaggtgcaggtgcatgtggagactagttaggaatcaatgagatagttcaggtaagcggagataagattttgcagtagagaaatacaagcatacatggtccaagctaagctgacagcacttgtggatgcaacagatatgagaagagggggataagaagagtcaaggcgaccccggcatttctggcatgtgcaatttttactgaggcagaaaccagggaaggggctgagggtaagacaatgactctcatcttggacatgtgcagtttgagacttctttgacatacccaagcgaaaatactgtatacacagttgaatttactggagttcagagaaaaggtctgaattagaaacatacatttagaaatatttaatttaagccatgagacggatggcattgccttgagaaaaaaaaagtagagtgagatttccattgatgtgttgctatttcaattaccttgtaaatagtctagtttattattatcttatcctattaattgttcttccactctttctccttcactgggttctctgaattatagaatttatgcagaaaacaaacttggagatcatcagatataatctccaaattttacaggtgaaaaaactatagtgggttactcaggatcacactgctccttagaggtaaaaatgaagacaaaagctcaggtgtttttgatgagtactccacaggactacatctggaacaggagcatgttgggagatgaatgtaagagtcccaggtacccagaatcctaccaattctgacatgcgtgtgcttgtcataatgaaacaacacaggacatcatgtgaaggacaactaacgtggggttacccatgaggtggtgagaaacagaatgggattttgcctcaaacccactgtggtttacacattagtaaactgttcaaaatggggccaaaagcttgaactctctgaccctctatttccttctctaggaaatggagaaaagcaatcattaccttgaagtgttgaaaggaataaaacgaatgtatttaaagccactaaccacatagaaggtttccaaattactaactaatattttcctccaaagtaaagaaaaaaaacagatgtcatcaaaataataaagctggccgggcactgtggctcacgcctgtaatcttaacactttgggaggccgaggcaggtggatcacgaggtagggagatcgagaccatcttggctaacacggtgaaaccccgtctctattaaaaatacaaaaaattagccaaatgtggtggcaggcacctgtagtcccagctactcgggaggctgaggcaggagaatggcgtgaacccaggaggcggagcttgcagtgagctgagatcacgccactgcactccagcctgggcgacagagcgagactctgtctcaataaataaataaataaataaataaataaataaataaataaataaataaaaaagctggccggatgcaatggctcgcatctgtaatcttaacactttgggaggaagagacatgaggatctcttgagtccaggagtttgagactagcctgggtaatgcagtgagaccctatcactacaaaaagtttaaaaaattagccagatgtgttggtgcatgcctgtagtcccagctacttgggaggctaaggcaggaagattgcttgagcccaggaatttgaggctggagtgagccatgactgtgccactgtgctccagcctgaatgacagaatgagactctgcctcaaacaaacaaaccaaaaaaccaactttattatttaaaaaaatctcaagggctcattgaaattatttggaaacattaaaatattttttaaaatattaaaaaagcaattattccggtcatcagggtttaaagcctatttattatataatgcacctaaaatttataaagcacccatgattatgaatcaaaacatctatatccaaatagtatttgatattattatactgtaatgtattttctagaatacagcacacaagaaaccacgtgctatttcaatatcttgttaagcaagtgaaaacctatgttgtcagttttaattcactcaaatatgcctgtagccaaggtaaatggtatagtttaaaatagtaccacaaatgaagcaactatcttacaaatttaaaattaatcatttcctcttttattcataaacttttatgcttcatctggatttggatctctattcttctaaaatttagagttttaagtacaaaggattttttagctggtatgagtgttatagtttgctttaccaaagattttcagatgagagaatgaataaacattgtaagttacaggatatgaattccagggaaagagctatcatgcaagaataagacttatggatttcatttacagaaaatcttcagcaaaatctacaaatatatttttagctatatagttattttttcaatttgaagacataatggtgttaacagtgactgagcacttttatgaaactctcatggaataatatttgaacttcatctttttctattgtggtagagcacttgttcaaagccaagatgtatatccccacttgtatggggcagattccgggcaaaaccactccttaccacaaagcagacacttctcagatgcctcttcaggatttattccttacctgccttcaaaatatgatttgaagcaatttacaatatagcccccaacaaacttaaaagaacaacaataaaagatagaaaaaaaaaacaattagaagacaaagaaaggcagatatgtcagggatgaatcacatgagaaaaagaaagaatggaacattaaatttagcagtgaacttcttggcaactacagaaaaaaggaaaaggaaaatacaaattatacattattgtttttaaaaaggaaaaagtaaagtttatcttcaaagacacaattttttagtagtttattataaaatacatttattttattgtttttttcattagaaacttagagaacatgaaggaaatgtcttttagtacaatttcgcagaaatcacaaaataagatacaaataatcatctatctgcctgctctaaaggctttgatactattatactcaaacttcttaaaggtttttttttgtagttaaggacagacaattcaagttctttgttgaagatgagattacaaagttatagcctttaaacagttctgttcctacacctgactttttaaacctctgctaaaggaacttaccttggttcctcgtacaagttagttacacgtttattgctaatgtatatgtaatctatttccccagcaacggtaaaatactagcccacaaaacccagtatagttactggaacatagtgagtatttgatcaatgttcattgcattgaattaaaaatataaagaaaaacgtagttagcatgcatctaagaccagcagacaccaatcccatatttttaaaatcagcttaaaaatacatatttctataacctgagcttaatatttaatctaggggaaaaaataaataaaataaagtaaaataaaaacaaaaattatagattccctggttccatctcagcactaatgaattagaatatctgtggtttgcatttgaaatctgcattcctaagaccttctccagagaatttattgcagccatactccagagtggcatttcatcaatcccaaatattctccttttataacatttttcatgtacactccttttttttttgcaaccataaatactttgtgtccaatacatgtgctatgggggatgactcctaggtataattagaagaaatattgagatgggaaaagtttaagctagaaaagggaagtcgaagtcgaaaacatagtgaaacaaaaggtagatgttttactgtggaggattgaaggagatgaagaaaccagaaggaagtttgtgcagactgctggactgtgcctgaggactggggcaagagctgcaaagctaccagtaacccagtactctctgccttatcttctctgcttctccttccttacatgcttcactgttctcaactgcagacaggcttcctttgctgctctctgcacaggggcattacccagcccctaggttacattgcctcagtgccagacatacataaacacacacacacacacacacacacacacacacacacacagagtcacacacacacttcaccaaagttctgggaatctcaacagaagcccaggggagagagctgttagtcaaattctataatgtacatacaccactgatctcattccctggccctgagacaccaggtcacatacaacctgtgcagctgcctgagctatctctgcagctgagaaggcacttctggagaagaaggtaatgctgtgactggatgcactcaaggacatttctcatctcagagttcaaggaaatggcatagaggaattatccaaagatactgtcctatggtcttgggactatggaaaccaggaggttgaaatcaacaactctaaaaccaaaacaaaaacaaaaacaaaaacaaagaaaagtcttagatgtttcactggacaaaatgcatttagcaggaaaaacaaaaacaaaacacaaaccctattattaggtagattatatttgtcattgcattctttgacatgatctgggtctggattgcagatgttgcagggggaattggattatagcatcactttctcaacacagctgttttcacttgaggtggatatgggcattacttggccaccatgacctatgttttcctttgaagcatgggagttgtctggtggagttgggtagtgttcattctcccacaaagctgttgacagctatcaatcttaggggcaacagagactctcagcttgggagtaaaggaaggagaaagaactagattattcttcctaactgctttttccttccccaagtaaaattttttttaaaaagtcattagataggctggggtggccttgattgaggccagactgcagagatgattagagcccttcaaagaaaaagattggcacaagcaaggtggccactgatcccagagctctcaataaaacaagcatgctccccggagctgcccagcttctctgggtgcattttaaggcaatatgtcttaaactttagtgcacaaattgaggttctaatttagtacatctgggggtgggtccagatactatattttcttttaaaattaacaaataataattgtacatattcatgggatacatagtgatgttttgatacaaataatatatgatggctgggctcattcctataatcccagcactttgggaggccaaggcaggaagatcactggagcccaggaatttgagactagcctaggcaacatggtgagatcttgtctctaccaaaacaaacaaacaaaaaattaaaaatcaaccaggcatggtggcaggtgcctgtggtcccagctacttgggatgctgaggcaggaggattgcttgagctcaggagggtgaggctgccatgtttgcaccactgcactccagcctgggtgacagagcaagactgtatcaaaaaacaaaacaaaacaagaaacaaataatgtatggtgataaataatgaaaagtgagaaatgataaacatttatcctttttgagtaattaacatatccattatcttaaatatttatcatttctttctgtcaggacggctcaatgtcctcctagctatttgaagctacacaacatattattgttaactatagtcattctacggtggcatagaacactggaactatgtggctgtaatttcgcattctttaacacatctctccctgtaagtttccaagtgattctgatactaatggtccatggaagtaatgaggctttaaggagcacaaattggtaacttgagaaagttagatttacaacatttgcgatccttccttccgtgtggaacagtccatagcaaagattgactccagtctgcaacaactgcactaccctcctttcacatatggcaggacttcatcacaatggtttctggttctactaagggcaataaagtcagcggattccttgtttcattagaagctctgcagtagaccatgaaacatgctcagggagagaagggggaagctgaaagagctgggaaagccagcagtccgttgcgagttgggccacaaaagaatagaggaattaacaatccccacagattataagaaaaatctggggagggatactaactagaaaagactgaaaacttctagtaaagtgaatggagcttgagaacattataatttgggaatattaatataaagaagctgataagtgctagacataatactagatataccaactaaatccacgacaaagcatctaattgaacctacgaggcagagcacgcctgcaaagtttccagggaatataaaatgattacttggacctaattacattaacgtgaaaaatgtcattgatattctctttattgaatagctaccactgttattttacagcagtgaacattaaaacaattattagagattcccaggttaattctcaatctatatgtccaatcttatttttcaattaaaatcttaatgttgtcaaccaagaattcttccaacagcttgctgttgagatatttgctatctgaagaactcaatcaaaaattttagactccactagagtgggtatcacaaaattgcagccaaacttaatcagatgagcaaagttttttgtttagcctatgtattttcataattcctgaattagaatgcctctaagcaggccatacacagtggaactgaccagttcccagtgcaggatggcaacgtagtgcatttatctgcctgaattctaaaggagataagttcacccctttcattagctcatcaatatatatatgagtaacatttttatatgcgtgtttagatgtggagttaactctgaatccttgaccaaatggagcttaaggtttagctagggacatgtgcaaaataactctaagacaaagtggagcgtacaagagatgcaaaaaccaaggcctttgagagcacagaggcaaaagcttcaggagagttttcaccaatgagctctctgaactgactactgaagaatggatggaatttaacaagcagaatggcctgtaagtgggacggtgaggagaggagaaatggagtgaagccacagatgtaaaaagtgcaaggcatcattgagaaaaagcaagaaactagaacgaagtgggcataagagggagtaacagggaaaaaagaagacacattttgttagagcaaaatgtcattccacagtagctctcctcagctccaagctccctctcttctctctgacagcaacacaggtatcaaaccccgacacggaggccgcttccctattattcctgtcctgatctctaccctcttcctaggcttgacagcttcctgatcatgaatattctcttgatcctggtcatgaggaagcagcctgcaacccctgtacaggaatcccatgaagcacccttcccagccacactcagcatcagccgccttcttctccctcctcgctgctgaggcttcgggctgtctgatctcacctctttcctaagctgtgccaggccatgccccagcacatcccaggccccaaaactggcactttcactgccccctggagtcagagcacagaggcttatcttattactcttccttgtgtcttgggtttctccagtcattgccaatcaaacccgcgggggttcctcattttggataatgattctttcctctctcagtctcctcattttaaaataaaacaccaacaacaaaaaaatgaaatccattgggctatgtcttttattctgcatgcctagttattcactaaaccctcacgctctttcctctctattccttcagcccttggatatcaggacctgggcacccaaacctgttcctgcaacagccttacccttgtcacagtgctattgcccttactgaatgccaatttatcccgagcactttcatcacaatatcctctgccaaacattttaaatgtctccatatttccccttttatcagaattagattctttggctagctttcacagaccctcataacctgacccaagttctctacagtttggtcactgtcgagttcggtgagcacagttggtggtgacagcggtcttgagcgagtatggctcttcctcatctttcaaacagctcaccactgctctgcagaaaccctttccttactccccatcagtcaggaaaaagaaatcactgatttttttcaccctcctaatttccatatacaaccttcataacattgttttttatacgtctttatttattttaatattgttttacttcgcatttgttcattcggtctttacaaactaacctagagcagggtcatgatttttggcgttttgttttactatcatttcaagtgtttcacatgataaatataccacaggcattttataagtagttactgaataatggattagagacagagtttcaatagtgaacagctggaatcagttttaaagagttatctaagaggtacaggagaaaacagaactgtgctccatgcagacttaccagagaagacgctaggtatcttggaaagaaagcttttgaccgtacgaataggaattccatttttttcatcttgcatccgtgctatgacgtcttccatctaaacaataataacataattaaaacctttataaagttgaacttttttgaaaaaaaatcagctctcataacaattttgtattcctgttttgcccaactaagaacaatgccgtattcttgcctttctagtttttgccacattaatagtttaaatactgttaaaaagagatggaggaaacagcaagaaaaacagccatgttagggcccattaagctaccaataggaattttgtgctttgaatattgcctttctcctgatttcatgtaccttggttataaaggttaagatcaaagagtgtttatttcacaaggttttagaaaccattgtcatagcacattcatgcttcattaatgttacctctactgaaatcagtgcaaaagcaagtagagccttaaaagcatctgcttgaattgcttcttcaagcaagagaatttccgtgattttgttttacaataaagttctaaaacctgcctagaaatccaggactgattgccaactactattacatctcttgcccgggtacttactgaagtgtgttatgaaacaaatacacacacatacacactctcatgcacatacactcatgcatgtgcacatacactccacacatgcacatgtacacacacacatatatgcacacaagtacacatacacgtgcatgtacacacacatgcacacacacacatatgtatacaataaaatgaatgtaacaccacagccttctgtccgtttactagattcccctttatctttgtttcaatctcattagtacactctcttttacttttacaaattgctggtaattctaaagggctgtgcttcacaaagtcaatgtggaatttagttttgaagaacattcattcattcaaatcatagccacagacattactcatgtgcttctaaacctgggagatgcagagacacacaaacatacccaagtggtagtatgggacttaaaatccattcatccatttactcattccacaaccacttatcactaactctacaccagacatatgactgggcaccgtggatatgaaaatgcatacaatacagttcctaccctcaaaaaattcagtcaatagtgacaaccaaggtgaaatctgagtaaagtatgtagtttagctaatagtgttgtactaatgttaatttcttgttttgataattatgccatggttatgtaagatattaacattaagggaagctgagtaaagagtgtatgggaattctgttatcttttctttttatctataagcctaaaattatttcaaagtaaacagttaaaaaaaacacagtctaaactttatattaatgaattatcaaatttccattggccgggcgcggtggctcacacctgtaatcccagcactttgggaggccgaggcgggcggatcatgaggtcaggagatcgagaccatcctggctaacacggtgaaaccccatctctactaaaaatacaaaaaattagccgggcgcggtggcaggcgcctgtagtcccaggtactcgggaggctgaggcaggagaatggagtgaacccaggaggcagagcttgcagtgagccgagatggcgccactgcactccagcctgggcaaaagagcaagactccatttcaaaaaaaaaaaaaaaaaaaaaaatttccatcaacatagctttagaatggttttcagctaagaaatctaatgttcttggtatcaacggatgtattactatgttgtaatcacactatgaacagatgtattactatgacaaataactggagatgtggaaagaatgggttttaatgaaacacaggtttgtatttgactcttagctcttgtaattattatctatgttctttgagtaagttaaataacctctctaagactcagttttctgatccataaaatggtgataataatacttgtaataatttcttcatagcgttcttcatgggattgcattgggcctagggtggggtaaagtattttaagggcaaatgatacaacatatataaagcctggtacatatatagaacaacaaatattagaccaaatgtccatgcacacccacgatatctggggatgcttattctccaccttcatgtttctttccatgtggaaggagcgccattaccctaatccccttgccttgtctctgccccctaatttactccaggggagctgagctgacttatcagacagaagagctgggaatgagaaactggcctgcagggcccactctttttctcttggctagaagcccacatctaactctgctgatgtagagatgcctgccctagtgggtaagcaagtctattcaggattgtgtttcaggattaacagtgacttgtgcacaaacattcttccataatacctttatcagcaatcagggtgatgttgtgacccctacgtgcctgtctttatggttatagttctcagttggctcagaaatcaagtataaaaagaacatgatgctgggcacggtggctcacgcctgtaatcccagcactttgggagaccaaggcaggcagatcacctgaggtcaagagttccagaccagcctggccaacatggcgcaaccctgtctctactaaaaatacaaaaattagctgggcatggtgacaggcgcctgtaatcccagctactcgggaggctgaggcaggagaatcacctgaaccccagaggcagagcttgcagtgagccgagatcataccactgccctccagcctgggagacagagtgagacttcacctcaaaaacaaaaaataaataaataaataaaaaagaaagaaaaaaaatgattttatcaggcctgtaaaagaccccaacaataaccaaataccaaataccccacttcttttgtaataaagatctgtaataaagatctctaagtatagaaacatgaaaatagacatactctgatgactttttattttgttactatttgttcatgactgacctgccacaatgttcagaaatgcagaataagctgctttgtcctgcctcatatcagcctctaaacccttgtattatctgcttaacggtttaaagcaggctggattagagggacatggaaacctctctgactcacactttcatctcagcacctagagatgtggcagcagtcacctctgcttcgggctgaatttaggtgcgtagctatgagtggcagtgttttctttgtatagtctcatcccctctcagttcatgggatcccaaaggagtgagaataggaggctggaaagtaaaagtgacttctgtggttgtattccaaaatattccatttttctgagtcatcatttccacaagagaaaaaaattttaactccaagtaaaaataggattggtgttctagactgaaaacgtgatcatgtacatgcattcagctgtttttatctttatccagacataatttatccgtgaaccttctcatggcctagaatgagacaaaaacaaacaaaagaaaacaacaacaacaaaatgaagaacaaagacacataaaaaaaacccctgctttctaaaaactaaaatcaattaaaaagaaaaagaaaattctagccctcaaatgactgaagggaccccctcttggctaacgggaccccagggaaaccctggaagctaagttcatggccatgatgggatggggggtgggacacacctcgttgtaccccttcctcactaaccactatcagcctttcttccctaaggggcaaacagaaactgacccttttgaaagactccacattgataatgttgattaatgacttatcttcccaggacagaacaaagctaaaatgagatcagtcattccttcactcctctctgggatgtctgctccctccattcccttttttttcaaatgttcaccttatcttatgtaaaaagtaaacttacagggcactaattaaagtctcgcaagtatgtaatcattcctctcactgttgcctcctcttttttaaggaaaatgtataaatactaaacctcctaagaacctctgggaaaaacagccaaacaggcatccataacttgtcctcaagctggctcaacaagcttcagtgattgagatttatgtctcaatcactcattttggttgtcacagtcaccaagtccacataaaaaaacacatgcatcttatctgttgatgttccctcgagcattcactcagagtctattaatttttatattaagcatgacttgaacatgcttgatggtctgttttcccactattagcaacagcaattggatgagaagaaaaatgctacaagcaagcaaaaaaaaaaaaacagagcaagttagttagacagtaagaggtatgagggatagtaaaaagcaactccaataaatatgaaaatatttggggcaatttagtctaaggccaaaagactcaggtacctcaagtatcccatatatatatgtatgtgtgtgtatatatatgtgtgtatatatatatacttacacacacgcatatatatgcatgtatacatgtgtatgcacacacatatatgcacatgcatatattcattaaaatgccattgagttgtgtgttttcacttccataagcctgtttctgagggtgaggaaactgggcatgggagaagagaacactagacgatgggcatgggcaggagagctggcatgccttgggtcaccgaggatttttctgaaggctattttctttactcttaagaagttcaaagtagatgatctgtaagacttctcctagctacaaaatgattgaagtctggaaataatcatcagcattcagaaggaggtaagtttccacactaggtcaaagagccaattccctgttacagacaaatagatgaagctattaaattaaataaaaccaggccaggctcggtggctcacgccagtaatctcagcactttgggaggccaacacaggaggatgacttgagctcaggagtttgagaccagcttgggcaacatggcaaaactctatctcttaaaaaaaaatatgaaaatgaactgggcatggtggcaagcacctgtgatcccagctacccaggaggctgaagtgagaggatctcttgagcctggaaggtcaaggctgcagtgagctgtggtcctgccactgcactccagcttgcgctacagaatgagactctgtctcaaaaataaataaaataaaataatcaaacaagaccttatacaaatgtatttgcttccaattgtcagcacattttagtttcaatgcaagacgtagttattaaaagcatgcatttaggccggttagacctgagtttgaatcctgactgtactacttacaagccatctgaacaggtgagttaatttaacactcaaagattcggttatctcatctgtaaaatggagataatcataaattgtatacatcttatcaagggtgagaattagtgaaacaatgctaattaaatgcttactatgatgccaccaccaacaccatcatcatcatcatcatcaacataattttcttccttcatcgttgtactaggaagatacggatcctttttcttttataattcagccggcaaagatgctgtagttaagtgcaaatatttgttagacgcaataaattgtcaagcaataagtagtcagagatgcctatacataagctctgtctttgatttcctgtaaaaaactgagttcatgttggcccctgcaagacaggagatttgatttgaagaaatgtcaggggaaatatttgtgcatataagcaaaggctatgtaagctatgaaaaaaatcatatttagaaagggaaatgagatggcattcacttttaacaaaatgaaaacgtctttgctgtcatcttttcttgacaaatttgcctcttgaagttatttagattaaaaattaaattaaattgagtgctgtttgcaagacttaattttttaatgcaaactgattcactatgcgtgataaaagtaaaagttaaacaagtgtattttacaaagtaattttgagaatatgtattgctgaactcattcaaaactttttatgcttctgttacagaaccctccatatttcattaactagtaaaactatctgttttcccttagatgtaaacttctggaggaaaaaattcttaccttactcatctttgcattgttaatatataaagtgtctggtccataatggaggctcactttaaaaagagaagaggggattgatgtatttttgtttaaggcatatgtttgcattttctgagagcctcaaaacaaaagtggaagttaatttaagatttggtcttgagatgtttgatatgtttttttctttgtatgtaacttttgtgaaaaatacattatcagcatcagaaatagtgacacagagtagctcagcgtagggcaggttaaaacactcttatccctcttattttttctgctctatctaatgcagatactccagcttacttgttagaggaatttcttcctttatgctctatctaatgcagagatacttcagcttacttgttagaggaatttcttcctttaatgcaagagagtaaatcagtggctgttgatgaggctgtcttcttgcttgtagatgtgacactcaagttcattgccatgtgtaagccctcaagatgaaaggcactattgaacttcaacaccctgctcttttctcaggaattcataattagcatttcctttggaatagtttagatgtcacttcaagcttgtgatgtatttcaaaaaggctcaggttaaacagttcccgcccgaacacttggcggaatgaaagaaggagcatattacacaggtccatcttctttgaagagagttactaattattcaagaggggctgccagacagggctcccacatattgatgaaaacaaaatcactgccttgaaacctttccagttctctaatgttctaaacaattatgggagtttaattaaattaacttgtagctatatttgccggaactttaccacaatatcattattattgatttcattaagccaatcgctttacagagacaccatgactgtaggcaaaacatttgttatgaagtaaagctaaaacgttttgtactctgtaattctgaaaaagaaatgaatcaatcaaaatttcagaagaagttttccaactctgccttacaaccaccattaagcacaggcatttggagatataaatgggagactaagtgggcagattgaatggcttttttctatgtgcacatactttcaaattatggtgtgtactgtcattttaagtgctagctatgaaaatgggagaaatgatcactgaagcgcttcttggatttcttgggcagttaggtggtggcaggttttcataatttaaattcgcctataactctttttacttcagaaagcctttcgaatgcagaaaatcatttacacttctgaattcatcagtgaaaacagagaaagtagagtcagtctctaatgaaagttaaattaagaataatgagattaaaatttgcaagacaaactgttttctgctgtaataattcaattaaagctgcttctaattgatatgatttttccccatgttatagtttattgcagtcagtatcttaactcagaattaattactcttttcatattaaaaaactgccattttcatgaataatcgactaaaaatagaaactagtaaaatcttattgcatgtaaatctgtcctagtttaacttaaatatagatttatttatttaaaaaacagtaactcagtgaggcatggtggctcatgcctataatcccagcacttgggaagccgaggccaacggatcacctgaggtccggagtttgagaccagcctggccaacatggcgaaattctgtctctactaaaaatacaaaaaaattagtcatgtgtggtggcaggtgcctgtagtcccagctaatcaggagtctgaggcaggagaatcccttgaacctgggaggcggaggttgcagtgagccgagatcgcgcaactgaactccagcctgggtgacagagcgagactccgtctccaaaaaaaaaaaaaaaaaaaaaaaccaacaccaccaccacacacacacacacacacacacacacacacgataacataactcatttgaaagcttagaagcttagaaacttagaaattttatccttttgtgattttgcagaaataaagtagaggttttttttctaatttatagacgtttctgcttttttttttttaaataaatcatttctctcattcatctcaaggaatataacctccactgaaaataaataaacagataaataaacaattatgctcactgtgtttgttgggattacttgggttgacagaatcccaaattcaattgtcatgaacaaagaaatgtgttgtaagtactgtgggatgtcttctggaactcgaagacgggcacataagtgggtctcataagcagcccgcctttagggcatgcttactgccccctccactctgctccttgtggtgagcccactttttcttctcggcctagagtcctctcttagttcttcaatgcacagaacagcaaaaatggctgcccttactgcttgagttttacagtttgtgaaattaaataattccaatttaaagctgttggaactttaaattatttgagctttgagaaaaatgtgactatatggcctgagcacatagcatgcagctgcaattcctgcttctccgattacagattacagtatgttactcttgtgctgtggatgattaggaaaggctgaaaggtgccataaataagagtctattactcctccttataaaatgtcgaatcagtcttccttggaatgtagtaaactataactaatcaaactcctgtaacataatctaagaattggtcttgcatgaaaaatgttgcaactctgttaacatttctgtctctacctatataagtgaaaccttacctccacacttggatgcactaaccccattcttttggagtctgtgttacccaggtggtgacagcctcaaacgttgtgctcaaataaattctacacttaatcatattttctgaatctcattatttaatgctgacaagtttatatgaacccaaggagaaattccttctctaatttccatacctgaattttggggcaaaaactttgatttataacactggaggtggagttggaaggggtgctgggcagagaaactaaaggcattcgttatcaccttattcaatataaaaacccattgaacgatacatggataaagttatatagcagaaaaaagtgtaagaaaagcagtctcaaaaaaataagagtgggtggttgctgaataatgagaaagagcccaagggccaggtgcggtggctcacacctgtaatcccagcactttgggatgccgaggcgggtggatcacaaggtcaggagtttgagaccaacatggtgaaagcttggccaacatggtgaaagccggtctctactaaaaatacaaaaagtagctgggcgtagtgacgcgcgcctgtaatcccagctatcgggaggctgaggcagaagaatcgcttgaacccgggaggcagaggctgcagtgagccgagaacacaccactgcactccagccagggcgacagagcgagactccgtctcaaaaaaaaaaaaaaaaaaaagcgccaaagaaagacaaaaattgatgcagaaaagaacgttggacagacaagtcaaacaactgaatgagatttcacagctatgaaagacagaaagacggaagtagcatgaccaaataggccaagtggttaattacattgcactcttcggcatggtaagtatttgccccgaggtagaaaataccaacgatgctaaatgtatgtgaaagagtaacttaggtttccagatttcttttttgttcctaggaggtatcacttctttaactctcaaaaggagcctcgtggctaatttttattgcagtcaaagttcaaataggagagttgtcaatgtcccctgaactatttgggaaagacttcatgggaaaagtaagattaagctgatcctagagggtaggcaggatagagagctataaaggaaaggaggaggcagagcacacgaatactttaatcaattgcttcatcttcggcgtcaagatgggaatgagtaagactcctgcacagaataatgaattctgtcagaatccttctccttctgcctctccaacttgacaattttaacctttctggaaggtgtctctgtagtcattttcaaacacaattccacctttgctatcaacttagttcacatactgcctgcttgaaattctctcttatacgaactccttacctcctgatcccacttgagctcacatcagttcgctcaagtagcaaaccccagaattaacctgggaacaagtttaaatatttcatctcttgtttaaaacttccattggcctgacaaccccatgaattttctgtaagcgaaatgaccacccaaatttatccacgatatgacgcccaactgtcattctagcgttataacttgcttcccacatgctcagcaattgctcctgcctgcctcaccttctcacatacacttcctcatgccagctgcgcccttcccttttccatctgtgcctgtggaaattcagctatacttctaggatcattccaaattgtaatttcctactgacgtccgtctttatccctccccctacctctctcatcccaacagaatatgatcatattctctgttaaactacttgagatctttatttttagtttaaattttttttaccctaccttactttacatgacttacatgtaagttatttattaacataaatatcattctctttagattataaaagctttggtaatttgcattagttttgctatctgtggcatggtccatgaggaattatcaccccccattttttactttacatacttctttgctgtgtttgtatgttcaccaacaggacgtattacttttataattaatattattttctatttgaaataattaagaattctggccgggcgcagtggctcacacctgtaattccagcactttgggaggctgaggcaggtggatcgccttagttcaggaatttgagaccagcctgacgaacatggtgaaaccgtctctctactaaaaatacaaaaattagccgggcttagtgttgggtgcctgtaatcccagctactcaggaggctgaggcaggagaatcgcttgaacccaggaggcagaggttgcagtgagccgagattatgccactgcactccagtctgggcaacaagagctaaactccatctcaaaaaaataataataataataattaagaattcccactttaatagtattaaaatattaaacgttaagttctttattcaaatgtctgttgtaacacatttgagggttaaatatcgccaactgctctttacaatatactctctgtaaacattctgtataattgctattgactttcaacaactaaactagtctacctccaaattatctctttttacaaccttttaaattcagagttaatgaacgaaattgtttacattcccttttttcttagtcacatctccaataaccctggaagtccgaatcaatagtcttatcatcggccccctttcagatggagagaccacagttcctgacagatgaaaggcttctcttgggactttttttaattgacgcaggtgcttgatttcagacaagcccttctattctagcttctggaatcaacttgaaattcagcaacctctatgtgtaacaaaaatggacgaatcattcctctaaaaaataaatgaacaatgatatttagcaaacaaaatacctaaagacaaccattgatttggatgagtgaaaaaggcagagaatgcagaagatgcctgggatttagctaatctctgagattccggcaggaaggacataaaaaaagtcaaagggctcttggctgagtttgccattttattttattatttcatttttattttattttattttattttattttattattgagacagggtctcactcactctttttttttttttgagacagagtctcactctattgcccaggctggagtatgatggtgcgatcttggctcactgcagcctccacctcccaggttcaagtgattctcctgtctcagcctctcaaatagcttacaagtgcccgccatcatgcccagctaatttttgtatttttagtagagatggggtttcaccatgttatccaggctggtctcaaattcctgacctcaagtgatccacccgccccagcctcccaaagctctgggattatgggagtgagccaccgtgcttggccaagcttgccattttaaaacattcttactaaaggaaaggggtctcacaatacctccacggagtataatagatttaaaatagctttggaacataagaattactctaatgtttcaattctttgatttaaatcccagcttctctttgtagccatttatgtctttgttgtttataaattcatacaaatatttcggaagccacttaagtttcccacctccttgggtaataaattctgtatgtaaattatctgctagttgaattcatatctagttcctattatttaattcttgcctcattcaagctcaaaagaagccccaccattttacagtatgagaatttagtgactaacaccttgtttatcctattcatggtattcgtacatccataaatgttgatccacactatctcctcctccttttcgtgagcaacagacccagtcattctcatagttctgtatggagcacatccttctacaattgtctgccccgcttgatatttgtgagggaaacctggccgaggccagataccatggttcatgtaatctcagtgctttggaaagctgagggagaaggattgcttgaggccaggagtttgagaccagcctggacaacatagcaagaccccccctctctacaagtaaaaaaaaaaatgaaaagacaagtgtaaaaacaatccagtctattgatggccactgggcatcacagactcgtttccagatattctccctccaacaccttcacacaactccaggactgatggtgggaagaacagccttatgcatgcttacttccatcctaatcctacactgcaaaccaggaaataagactgaatgtgcactgtggactaaaagcatctctgttattcccataaactgactgaaaacaataaatgtacccattgttgaaaataaggctctgtcatcatgtgttcagtgacgcagagcctagaacatttcagagtatcatgtaggtgattcttctctcaattctttcaaggctggtacaggactagtggcattccaaacacataggagagaagtttatttattacacacaatagatgcctcaggtcattcgagcttaatattcttatgaaacctgggcaggacctgtcagagtatgaaatgctccatctgaagccacaagagaaagcactactctgcttccactgagatgaaacatgaggactttggattaagtgtaggcagaagggctaaaaatatatatttttaatgatgtgatatcaagaaatgttacttaagtaatttatttttatggtaacatacttataaaatgcagcccagagatgtctctgggatggtcttagtagagttcttccaagagtaattaaagggatgacctcacagccatcaccaccgtatatatgatagtgctttgcctgggtccatccagctggcttagtccatgaaacaataccatgtttctaactaccattttcaaaatgaaattaaaaagggattataacctgaaggtagggcaaaagcactttaaaaggacaaaagcatcctcatgccaatgaagaagatttatttcaggtgtacacactaaaactaaatataagtatggtgatttatttgtcttaggtgtttcatggttttcaaagttttaaagtggtttctgcagctgctgaatctgacctttttctctgtgtaacactcttggtttacttattttgtacaacgatttttaaatttccagttcctagaattcttttaagatcaatgagtaaactgtagaagggcaaaaggaaaagatttctactttaattgtacccttgctagtgttgccgattcaaggcactacaacgttaagatggattttatttttcagaagtatttgaacagtgatgtcgatctttctaacccaccgaacaattagttttaaagcagagaaaattcaatgtgacttttctgacttgccttttatatggggatttggaaaaaacacctccttctggctagtccatctatgaaagaaggttctgcacaggacctagtttcaactactccttcattccacactgttctcaagagagaaattaggatgaatggtggacgaattcatacaaaatcccaaggcaaagtaggtccaagccttggcacacaaacatataacttctagtccaataactggctcttttatatccaccacaattttgttttccccacgagtgccaagaaaatcagaatgtctagttgccttcttcctgacaacgattctcaatgatcctatgaagaaatgaataaaaaataaaaaggtacctcacttattactagatatctgtgactattatcttatggctagaacacgaacatcagaaggtcatggcagtgatgttgaattatttaaaactatttccccatttggtaattgttaaagtcatagagacacctaggtagtttgaaatgccctccattgaaagccagcaatttctatgtgtctccaccagccaagaggaccctgtagagctttactttctatagctggaataatgaaaaacaataggttttttattgttttaaagaaaaaattaaaatactgactatatttttaaaactgcacctgctcccttaacgttttgatactcgcatggataaacaactttgataacctctggtgtaaagaacgtggcctttgttgcttagcagagccatgtgcaaatctcaggtccgtcatttgatgaatgatgttaggaaaataatttagcctctctgggctaggtctttgtactccttccctataaaatgagaatgctacttccttgataaaacatgtactttacagcataagttccccttccttctttctgtgcaaactctgagatgacgctatttctaagagtgcaacacttggaaatgaggtgtcttcttttctctggagctattaagactttctttattccctacttatgacacactctgtattacattatagtcatatgtgtacatgtcttatttcttttgttctcttttactgaaagtttcttcaggataaatattagtttaattacactggtttaatcactgtatcctgaatagtatcttttgggaaactgagtatacagagacaatggctagaccacatatgagcacagaattctgacccacagcccctgcaaccagcctgggaagccaaaccacaagctcagcagtagtaagtccaaaatggtcaagactcaggcaatgacaaccagcttccctaatttttgcctctgcctataactctggacaaaccagagaaagctagacactcctcaatctagttatattagatacccactttcagcttccccatgcaacaacctccagtcagagctcgctctttctctctctctctctttctctctctttttattataaagctttcccactcctctgcctgcctttgagtctttgccagacacaagtggtggtggacgattaccttgctacagcaagtgctgaatacatagcctttctttgttttcattttggtgaccttcatttacttccacattaaaaaaaaaattcatgtacatctcactgcattcccaagaagaatctggggtaaatccttgtccagaattatgtcttttatagaagcaaagtctccttccagttctaatattctgtgactaatagatgttgaggtcgaataaaatgctgatttgttgaacaacttttcagaaatagattattcctgtgtataagaattgtcaaaataagtaattcaaaatctaaactgttgaaactttcccttattttgagccctaaaagaatatgattatggggcctgagtcatgtgacaggcagctgtaacctaggcagctgtaacctttgtttttgtgattatagattagccttcttcctatattgttttgtaaaatgttgcaaatgactgaagggcaccagggaagaccctttccctctacgctgctgatcttcattacagattgactttcttctttcctttctcacacaaggactttacttgactatcacattgtctaagatggaatgccaaacatacttttaaattggaaaggaaatgaaaacaagctttacagaaaagaaaacaaactgtaaccaatcattacattgctgtaacccataaaccagccttgtatagaaaatgctgtaatcctgttaaatttgttttctgcttacataagcaagaccttaactttttacttctgagcactgaccccatttctctggagtctattttctgatggccattcccacctttgcactggaataaactctttaaaactagatctgatccttgcagttatttcaggttgacagaatggttcatgctgaacctccgaattaagttgttggtttaaatttttatgcaagttctaaaagaccaaattaacctcccaccacatcatacccagcaatattatactgcccagttaagagccatgggtataaaattacatgatttctttcaggaggcatttatccttctactaaatatcagttcattttttcaaaaatccactcgtccagctttgtgggaactgaacactaagaattctcaataggggaagaaacaattgtctcccccattgtatgtgtattgatttgtaacataacgtggggcgaatggtttgagcctggcttctccttctcttcttgccaaccctggtcccttgttttgggatccgtttcccttggagaatataaacattctttatcccacttcttgaaaggccatccttgtctttctagttgatgttaggaatgaactgacatggacgacaatgactatgacctatgtaggaaatctgtgaactgagtaagtagtcatatgaaaccaaatcttatgtgacctattgatatggtttagatttgtgtccccactcaaatctcatgtcgaactggaggaggggcctggtgggaggtgattggatcatgggaagggatttcccccttgctgttcttatgttaatgagtgagttgtcgcaatatctcatggattaaaagtgtgtggcacttcctccaacactctcgctctctcttgccaccacgtgtgcttcctctttgccttctgccatgactgtaactttcctgaggcctcccagtcatacttcctgttaagcctgtggaactgtgagtcaactaaatctcttttcttcataaattacccagtcgcaggtagttctttatagcagtatgagaatggactaatacacctatatttacactactctaaaacttgcattatacatgtaattttagaaatttttattgtggaaaatcttaaacagatacaaaaataaatagaatacagtgagccacaggtactcatcacccacctgtaaaaatcttcagtttattatgccaatttatgttttaaaaggaataccaactctctctatgaaaagtatgacttaggaaaaggtaccgtatataggtttttctattagtgtgaatttcccatgcataaagtggttgctctctcctagcaggctctggctgctggcttcccggcctcccttaatgctgtggatacctgtgacacaagacctggctttccttaatgcctatctaacttctttatttcctataagactccaaacttatgaaaaaaagagggtgacagacaacagttcatatactaataaagtaaaatttgacctctatttttatatacattctgtaaattttttttagttgacatataataattgtacatagtcatggggtacatagtgatgtttcaatacatgtaatgtatagtgatcagggtaattagcatatccatcatctaaaacatttgtcagtttttttgtgttggaaatgttcagtatcctccttccagctatttgaaattatatgatatatgttattgttaactatagtcatctgacagtggtatagaacactgtaacttatttcttctaatacacattatttaatttactcctaaccaccatgtaatatagataatgcaatcatgttaatcattcctttttagagataagagagctagggttctgagaattaaaccgatagatgtaaggttacacagttggtaagaagggggccctctacgaggtagtatatgggggcacatttgcaaagcattacaatggaagattatatttcaaaaaaaacacggcaaaaatgcatgtcagctttcttttcaaataaaatataaatgtccttgaacacagtccactctcaggggaaatttgaggaaaagacatatcatactgactatattccatttgattgcacacagtgatacaatcctttacatttcaaccaagacattgaaatgctcctacttcaagttctgattgttcacatgcattctctgggaactgctgcctggatgtacaggattttttaaactatgcagaacctacatcattcattctatatggcagttgttgaaataaacgtttagtgattctaaatacctcactaaagtagctagtacttattgtgaatctaccatgtagaagtgctgaatgcctgttgtggattgtggatggtgacaggaaaggaggtaagaaatgacttcctctgggagggatctttgatttgtgctttgaacactgagtgcaaatcagataaactgagtggagggacttaagcagaactgcagcaatgagaaaactcctggttaatttgacaggaaaagattgtttgcagagcggtatctgtgggataaagtggaagagtgtaatgtacaggcttgagtggaaatagaacatggataacaaagaagaaacaaccctaggaaaaagtaaagctgcaatatatttcttatcggattaatctaagatcagtgtggagaagccaacagagacataaaggacctcgtgtaagaaatcagacaatggcactggggacaatagccggtaatgcagagaatcaagcaagataagcatgaagtcagaatccaggcataggctggactaacacaatccttacctgcaaaatctgtaaaacttttgatagcaatctgcactaaaataaacatttttcatcatgacccagcacatacatgtgtattccaacatacatagatttaattgaaacaaaagttttacaaaacaatagctattctttctatggtagtgaagcctactatttttattctattccactgaataaaaattaaaatagattttacaaccttcttaaatgtttttacaacccacaactggaacatgattcaaccagcagttcataagagactattgggtacattccatgaggaaataaacatacgcaagaagtttccatccttaaacaagtttccacccaattaaacaattaaacaaaccaaccaatcacagtcctcctctggcaaccatcttatctcattttatttaatgccaaacctcttgccttccgcaaagagctgtctaacctcatagttttaaaactttttcgtctcaggacaactttacacttttaaaaattattgagaatcccaaagagattttttttaaaaaatcaaataggctgtacctattaatatttaccaattttgactaaaaacaaaactatcatttgaccctgcaatcctactactgggtatttacccaaggaaatcattttataatataaaaaagacacttgcactcataggttcatcacagcactatttacaatagcaaagtcatggaactaacttaaatgttcatcaacagttgacagaataaagaaaacatggtatataaacaccatggaatactacacagtcttaaaaaagaatgaaattatgtccttcccagcaacatggaggagagggggccattatcctaagtgaactaacttagaaacagaaaaccaaataccttttgttctcacttataagtgagagcacaacaatgggtacacatagacataaagatgaaaatataatagatactgaggactccaaaaggaggcaaggaggctgagggttgaaaaattaccagttgaatacaataatcactctttgagccacgggtatactagaagcctactttcatcagtatgcaatatacccatttaacaaacatgcacatgctcccctgctcacccaaaatgtaaaataaaataaaacaaaacaattaaaaattaaaaatttaccagctatgaaataaaaaattaaaataatcagtaaaaatatatattaattacttcattaaaatgataataataagtacattacatggtaacatgaatatctatcacaactaactatatttctcaaaacatatttggtaagaggaatgacgttattttacagttttgcaagtctcttccatgtttggcttggaagacagctggattttcacatctatttctgcattcaatcagttgcaatatgttgttttagttgaagaaaatccatccttgcacagaaaatgctttgaataggaagggatttttagtagccttatcaaacaatgaatgatactcttctctgctactataccaaaactccacaggtagtagtcagtgattacctgagatgtagaatctgaaacttttaacaatgaacttttcatactcctactgtactaaaattcattctcctattttggactttgaatggatctttttacccaggaatggcatgtactgatgacttggaaaatactgatgcactgagttatgcagatctcttaaatgctgacacaattcatcatacaatatccaaaatgacatttgttaatatcaccactgatacaatgagaaaagccttttactattggaaagctcccaggctcatcgtgacaatcacaagttttccaaaattataactttcactcacaagtttgttattggcaactaatactgtcagttgttttccttgaaatgacggtcttatttttttccattaaaaaaaggtgtgccaaatattcatgtctgaaacagcagagcttgtctttcagttattctttcaagtaacaatgactagctcagtttgcaactcaaataatagcacatcacacttttgtatgcagcgccttgatctcttcaaagccatcttccacactgtggtccgagtggcgtgttgtaagtaaatctcctcatttttctctcttattgaaaatacattggttttctcttttgactttaggataaagctcaaagtacttggcatattatgaggccctgcccatcctcaatgcaatccccatccttcccacactggagtttttaatcattttcccaggtgagccatcctcaggcctctaaggcattgcctgcctacctggttaaaatgggcttaccttccaagattctgctcaagttcaggggctttgagaagccttttctcatacaccttgctctctacataccactatcatcataggtctacttatcaattaatgttgtatttgtaattttttttgttttgttttagagacagggtcttgctctgttgcccaggctggagtgcagtggcactatcacagttcactaccgcctggaactccagggttcaagcaatcttcacgcctcagcctctcaagtagctgggactacagatctgcaccaccacgcctggctaatttttatctgttgtagagatggagtcttgctatgttgcccaagctggtctcgaactcctggactcaggtggtccacctgtctcatcttcccaaagtgtgggaattacaggcatgagccaccgcgcctggcctaaactgtgaaattcttacagggggaaattttgtactgtacagagatctttttaccagtacacatatgtgtccaaaatgatctcaggcctagaaaagccacggcctctagatagagaggaaaatagggaaactagctgacaagtaaagggtcactcctgatagcacagcagcaggctatggagtttggtgtccacagtttaagaaatggaggatagagggtttagagtggaggtgcacgagtgaggtgcattttaaataggttaagtaagcctgcttcacactacaatttgaactttggagaaagactcaaggcgaggacaccgtacctatatttagaccccagaagaaagctttgctccaggtctaacaggttatctctccatgagatagcctccacttctctctggattatgatctcacttactccttactccattactccccttgcctgggctcctgactctgaagattgcttcacagatttcaacagtaaatagatgatatcaggaaaaagaattcagaggccaaattgtaaaatattgggtgaaaaaaagtactggacagatgtcaaaaacctttcagagattttacttttctaacttgctccaaatatctctaaaaaggaattatggtttgcagtgcttccaaaagagcatagctgcagaaccttgttttgcaggagaatttcaagggctaaggtttagtgcaatacacctgggagagaccttgaggtatgtatgcatctaggttgagcgatgaaaggacaacaaaaggaaaagaaacaaaaacaaagtctctaaagagcagcaacaataaaatcatcacttgaaaacttgtttgaatatgtatgttataattgatgcagcctcacataaaaggtgacaagctatggttccaggataatatgtctgggagtgagggtggatgacagagagggttgtttggaagcttataggagaatatactgctctaaatttcttatcatgataaacttggaactttgaagtttagagaagaaagagtttatatatatgctagtctatccacctgtgttgcaattgttctttttttttttttttttttttttttgagacagggtttcactctggtacccagtctagagtacagtggcaagaccatggcttactgcagcctcaacctcctagctcaagcagattctcctccctagtagctgggacctcaggtgcgtgataccacacctggctaacttttaaattttttgtagagatgaggtctttgctgtgcaggctggtttcaaattcccgagcttacgcatttctcccgtcttagcctcccaaaatgctgggattacaggcatgagccactgtgcccaggcttaattctttttctgaaggtaattattaagttcttttccaagactgctttattacttttttgaaaaatcacttatacattgcttttgttatgcaaatgcagctgctatcttcagtgacattgttcagtaagttcacgcaaaagtaattcaacccttggcacttcattcatcctgttggcaagctgaaggagtagagagtgaaaaattaaatgaatatgtgatctgtagttagtacctataccttctatttagcattctcgttactctccccaatctggatgcctagtgtgtaccacagataccacagggttatgtcctgataaactcatcataagttgaaaatattgtaagtaaaaatgcatttaatacacctaactgtctgggcatggtgtctgatgcctgtaatcccagaactttgggatgctcaagctggtggatcacctgagatcaggggtttgagaccagcttgactaacatggtgaaaccccatctctactaaatataaaaaattagccaggcacggtggtgcatgcctgtaaccctagctacttgggaggctgacgcaggagaatcacttgaaccccgagaggcagagattgcagtgagctgagatcgcgccattgcactccagcctggccagcaagagagaaactccatcacaaaaagaaaaaaaaaaaaaaaacacctaacctaccgaacatcatagcttagtctagtcttaccttaactgtgctcagagcacttacattggcctacagtttgacaaaagaatctaagacaaagcctattttataataaagtgttgaatgtcccacttgatttgttgactcctatgctgaaagtgaaaaacacagtgatcatatgggtagtcaaaatacggtttctactgaatgtgtatctctttcacaccacggtatagttgaaaaatcctaagtcgaaccacattaagttggggaccatctgtaaacataggtgcttgataagtgattgtcagacacatgaataaatgagggaaatttcctgctcttgtgcaatcacagagacctctggaattcaacatagctactctcacaagtgctcaggaaccctagaggacatcaacaggggtggtgtcaatcagggctttttgatgacttgccccagagcctgccctgctgcagaccccaggtccttagcctcagcaacacccttggctctgaggacttcagtgtggctggaccagcagctccctctttttcatcactcattcattatttaatcagcctatctacctcaccaaggcctccccaacccagctgctcctttctgtccataaaataactgccttagttcaggcagttatggctgggtgaagcagagacaatgccactattcccaccattctaattatgacccacatcctggcaagtggattctccctaagatacaatcactcaaaggctcaggggcaagaaaagagaacatgggccggacacggtggctcacgcctgtaatcccagcactttgggatgccaaggcgggtggatcacctgaggtcgggagtttgagaccagcctgaccaacatggagaaaccccgtctctactaaaaatacaaaaattagccagctgtggtggcacatgcctgtaatcacagctactcgggaggctgaaggaggagaatcacttgaacccgggaggcggaggtggtggtgagctgagattgcaccattgcactccagcctgagcaacgagagtgaaactccatttcaaaaaaagaaaagaaaagagaacatggctttaggttttggtatcaaataagcccagaataatgctcaacccagaatgatgcagacctatgtcctagtcatggtagcatgggactgggtatccccgccatgctgtccaccctcaccttagaagagggcctgcccctggagaagcaggagaatgtgttccctttggcgaaagtttgaccaaaagaggaagaaaaatgaaccaaacatactcagatatttttctgaaagttactgatgaaatgaatcactccaatttcttaggtcaagcattaataaaggggtggggaaaagccagggatgtgcttagagagtatccctcttaagaagaaccaggatgggcatggtagctcaagcctctaattccagctctttgggaggccgaggcgggaggactgcttgagaccaggagttcaagatcagcctgggcaacattagtgagacctcgtctctagaaaaaaaaaaaaaattagccagacatagtgctgcacgcctatagtcccagctacctgggaggctaaagtgggaggatcgcttgagcccaggaggttgaggctgcagtgaactccattgcaccactgcactccagcctgggtgacagagagagaccctgtctctttgaaaaaaataaaaaagaaagaaaacaagaaccagaaaatgcatttttgttttcttctatcaagctttataaaagcattggtcaacagatggaagagtggttttgaggatagccctattccctcttaaggctgggatagagggttagggatggcattcaaaggaaaacgtctacctttagtacaaggcggttctattaaaactgtggaggcattagatggaagccagcagtaatgctttagaaccattctgggcttcctgcagagtggtgtctgctgggacctgaatcgtggcaggagatgcccagtgcacggggcccatttggtcaccagcagaaacaggaagggccccctgggagctgagccaattgtgtggacatgtgagacatatctcgggacctcccaggagagctatggaagtagtgataggacactgtaggcgctgcaggtaggcagaggcaaaagccagcgaacttgttactcatcaatggattctctctgtactaactgctgaggcctgaagaaacttggttatatacagaagtgtgaggcctcccttggagactaaagcatttgctccctcccaagacattaggcagaaaatactacttgggatggcaggttgttttgcacggtcatgcccttttacttcatgagctataatctagatgtcagctggggactctgtgtcctcatggtatatgtaggattgctttgaccctcccattggacagtgtgaagaagtcttaagccaactggagatttgtggtcattcttttcatggcttagctctatccacacaggcggtcattttctgggcctgcaccatgcagagtccaaactcagttcttccaccagtctccataacaatgctactcgctctaagcattttatgaggtttcctagaattcatgtaatatttaaggggataacaatgagagggctatatctcactgcacagtattccaatttctctaggtctttgaccctttttcctccaatcatctagatacccgacatgcacaaagacatggacacacacacacacacacacacacacacgctgaattcatcctccctttgatccacagaaaaccaagggttcctcctctgctctcccacagaacagcatccctcccactcagctttcagcttctatcctaaatatgctctgcaaggaatttgcccaacaaaggcacttctctagttagaaaaaaattatcatgccagttgctaaaacaaaaaaaacactctctttttctaaactaatttagatgcatagtaggtgcttagaaaataataagtgtgtaaatatttattactctaagtaaggtcctcttcagggtgaccctgtacagaagcagcctggggctgagatactccctatctaatttataaaggatcagggcaggcatacattaaatccttttttctacctcgatcttatttcctcttaggaactgaaagtgctttcagacattatttcagtaatccttgcagcttcccccaatgagaggaaaaaatgcccttatctccagtgcgcagatggagcccagagagatggaagttaagtgactcccaaggttgcccacagggagcacagagaagaagctaagctgcgacctggagtcttggtgaccccgttctagagttagaagataacgttgccttacaaagagttttcaaatgtggcagcttttgctctttgaaatgggaataattgaggtttcccatttatatttatttatttatttattattattattattattttgaggcagagtttcgctcttgttgccaggctggagtgcagtggtgcaatctcggctcaatgcaacctccgcctcccgggttcaaggaattctcctgcctcagcctcctgagtagctgggattacaggcatgcgcaaccacacccggctaattttgtatttttagtagagatggggtttctccatgttggttaggctggtctcgaactcccgacctcaggtgatccgcccgccttggcctcccaaagtgctgggattacaggtacaagccacagtgcctggccccatttatattttttgctctgtaatggggcatgggagttcatgcaacgggctctagatcaagcctgcttgggtcaaatgcgcagctctgctactctctagttactgaccttgggaaagttactcagcattttgttgcctcagcttcagcatctgaaaaacagatgtgctaaatacaacaatatccttctcacggagttattatgaggatcaaatgagtttacccctcctacctccagccccccatacacccactagagaggttaggaaagtgcccggtacagagaaatgctacataaatgttagctataattatttctccttttcgaattgtgcattctttatttagcaaccttaagttgattttttttttttttggtctaggtgacagcattgcctaactatagaaaccaaccttgtagagtcctaggcatataattaaacctaatatatcaccatactattgttcacttctttctttccttccttccttcattccagaaacactttccaagtgcccactatgtgaaaggtacggtattagattaggtacagtagtaaaggtaatttagaagataaatttggccttagcatcttatggtctaaggagaatatgcacataaacatttaaatttcaactcaatgtcaaggtaatatcatagagagaatccagaagaagcaacatctaattctgcttgatactatcaggaaagccttacctgaggaggtaactgagtcttgaagtagaaataggagttattctgacaaataaaaaatccttgaaatgtttgggcaatttgttcagaatacatattttttaagctcacatacaacaatataaaaagtaaccatatattagtgataaagcacgtctcaacacattttaaggattgaagtcatacagaaagcacaattctatgaagctaagaataaattactaaatccgtcaataatccctactcgacagccatcattctcagcaaactatcgcaaggacaaaaaaccaaacaccgcatgttctcactcataggtgggaatcgaacaatgagaacacatggacacaggaaggggaacatcacacaccggggactgttgtggcgtggggggagcggggagggatagcgttaggagatatacctaatgctaaatgacgagttaatgggtgcagcacaccaacatggcacatgtatacatatgtaacaaacctgcacgttgtgcacatgtaccctaaaacttaaagtataataataataaaatttaaaaaaagaataactttccattttatcaattgaaattaatagaagtaaaagtttaaatagtgttgactacaaatattagtatatagatgtatgtatttgatgtaaaaacatagttttggagattattctcttcaaatgatttagtatatttcagaaagataagaggatgataaatttcaaccaaaaataataacactgagcttttaaaagtatacttgaaaaaaaagtacagttgcatagatttgaagaggaaatatagagcagtatgttatctaaaaagttcagaaaatgggtcgggtgtggtggctcacgcctgtaattccagcactttgggaggctgaggtgggtggatcacgaggtcaggagaccgagaccatcctgactaacatggtgaaaccccgtctccattaaaaatacaaaaaattagccgggcgtgtggcgggcgcctttagtcccagctactagggaggctgaggcaggagaatgacgtgaaccgggaaagtggaggttgcagtgagccgagattgcgccactgcactccagcctgggccacagagcaagactccgtctcaaaaaaaaaaaaaagttcaaaaaatggccaggtgcggtggctcacgcttgtaatcccagcactttgggaggccaaggcaggcagatcacttgacatcaggagtttgcgaccagcctggccaacatggtaaaaccctgtctctactaaaaatacaaaaatttacctggcatggtggcggtgcaagcatgtagtcctagctaccagggaggctgaggctcgagaaacgcttgaacccggggcggaggttacagtgagccgagattgtgccactgcactccagcctgggtaaaagaacgagactccgtctcaaaataaataaataaatttaaaaagttcagaaaatattttataatgtcaaaaatataaattacacagtatatgtatatatgtaaatatatacaaataatttacatctctataaaatatttcaaaattattttataaagcaacttcccagaaattgagtatttaaatgctatttggacatgcagaataataggcaaaaaaaaaaaaaaaaaaaaaactcttcagaggaataagtagggaatttcatacaaaggggtgataactcttaagatattttagctttggattaatttacatttccctaccccgtaatgatatgctcccttggggctagaaagaaagcaaattaaataccagttgaacaactaaattgattattatattgatatcccttcttcaaaatgttaacggaaggacaactactatttatacacaattagcatggaggagagacgtaattaaacataactttagataatttctccaaattatactcctctaacattttgaaaaagtttttaaaacagaagtgatataaaaacaggtgagcttcttaccctcagcctccatgctataagtaacactgaaattcaccataagattttcttgcaaaatgccataaatgaccttgcgtgtttaagtgtaccactgaggggatattggctactagaaacaaacaaacaaacaaaaaaaaaacggaactcaaaacacttcaagcagtaaaaggttttttgtttgtttttaaatttcacaaaatgaagtaaagtcccgaggcaggatgatttcagatttggttaagtcagattctttccgtattctgactctacattcatcagcatgggaccttcccagccacgacattatcacatttttacatgcctgtgcccaaaggcaaaaatagcgtcaacctcttacttttccttcctctaactagcaaaaaagcatcgccagcaccctcacagaagaaatctctttaggtcacaacagctagaattgcattaagtatattttataagccaataatcaccggcagagagaataaaacagacataatcaaccccctaaagagcagcagttctcaaacttgagtgagcaccacagttacttggagagtttattaaacgagatttctgggtggagcccagaaatcagtaggtatagggtggggcccacgagtctgtatttccaaaaaacttccaggtgttactgatgctgctggtccttctacaaaccccctgcactgccctaaagcacgtgggagcatcttagcaaaggggtgggggaggtggctcaggtaatcaaccaaagtgcatctgagatctaatattattttaaaattgcttttcaagaattcctattacttcaaattaaagatgtaactgagtgtcttctgagtattttagaattgcaaattttgatattctaccatcactatgctccacctctctgaagccattactagggcaaggatatagtgagaaagtttctgtcactgctaagcaagtgcatccttcagattgccaatgtgtcattgtagttggagctattaaacttctatgtggcatgaaaattgtttggctaactttaaaaaggagaaaaaaatggaagtggaggttagaatttttctagcccagcaagaacccacttggtaaccacttttagataaaaagcccaaaaataatatacttcaccagatgttcctttaattttccagggattaatttgagagtcaattacctattttaagtgattaacataaattaaaaaaaaaaaacactaggctctgaaccaatgcttttaactgtatgatggaccattgttcatttccgatacttttaagaactaggatgattttgacacattaaaaaatgtcctggaatgaatttgctattctgcttggcaacatttgaggaagtaaatactgctacaaatcctttaggtagctttcaattgtccatgtctgttagtgagaagagggacagtaagaaaaatgctaaggtcaaattcactcatgacttcatgccaaaaaaaaggtatttctgagttgataactctaaaatctttttctaagtagggacaagaattactaataacaaacagtggaaaacatactgaactaaaacacaaaatatctgaattttacaggtcatttaacttccctgagcattgctttcttatctgaacctctaaggattggatttggtgtttggtttcttttttatttttataacatccctttcagatataatccaaaggtgacatctcctttctctgtcctatccatctttgatgatatgtgttaataacagttaaatgcaaaataataggataaaaggcttaattacaaaaaaaaaaaaaaaaaaccaagaggccagataattctactctggaagaactggctgtaacatcatgatgatggcagcaatttagaaagccacattaactttgttacagagatttatttaacgccagtttgaagaatgacgtctttatgccgatgacatgattcatttttttttaatgagtaaaatgtgtttttctccattagactttactctctgtaccttgaaaataaaaatacctttccagtgtcatgcatgagtcatattgattctcaaattaaactaaacacccatagcacataggaaaaaaaagccaaatgacaatttagaaatgtaagggaatttgaatgtctactcatttacttgaatctaatcattaagatgaggatgttatttcactctttctagaacaatagttttccaacttgagtttgcatcagaatcaccaacaggaccagtaaaaacagacagctggacccaacttccagagttgccaagtcagtgggactatgtagggcctgaaaatttgcatttttaacaatttctcaggctacactggctgatgttgctggttgggaaccacactttgagaactactgtttgtagaagactggtaaaaattggtaggtgtaagaaagatattctttttagatatatgtctgggagctgggggcaaagtagaaaagcatttaaaaagcaaaaatgagagacacctgaactgtcatgcatttaccagaattttctctcataacgtggcagccttcactgtcctctttcctttttactattctaaatcaaaacattacaaatgtacaagctggaactgattatgcataatagctgatgttacttcactgattaaaaacaaaaaagcaataaactttggctccctctgcaagctgcccataataaaatgcagaggaaatatttattaatcaagcaaagactgaaagacatttcgttaatggtctgcctcatcacatcagtttgaatcacattacacatcccgttaagaagagatgatgcttaaaaatacagaaaactaaatgtggcattatcatccatcccaactggaaaatgtgatggattgtccttaatagaaagagtggtagtctattcatgtggtatgtctcgcaaaggaccgccaggctccaagagccaagtattctgatcactttttccttaatgagaggctcccataaacacaatttaatcctctttgaaaacctgagggctattttgtgtttaagtggcatacacagagatcattaaaatgtaaaagaactgtgcagggaggcccaatttttttccaggtggccatgcatcagaattttgttagaatgtaacatggatttgattgaatgattctcccatttccacatggagagtggagcccagagaattgtttaatcatgtatccatgattcaatattcatttatggagcacctatgctgggccagaggtactatgagtggggatgacaggatggatgtgacagacaggacccctgtccccatgcagtttacaggctatatcagtaattaacaagaactaaaatacttggcaaagaggaatgcttccatcaatgtttgtttaaattaaaggaaaaaaacaaaccccacaacgaaataatcaatacagttgtcacaagtgcacaggacagcatgaaagcccatgacacatattttggagaagaggtacttccattttttttggtgggggaggtacattagcctcaaatttcacagaatacatgcaatctcaaagttaaaaaatgggttttactgttaaggtctgtcaataattcaacttattatttgtttgtttgtttgtttgtttgtttgtttgtttgttttagacggagtctagctctgtcgcccaggctggagtgcagtggcacaatctcggctcactgcaagctctgcctcctgggttcacgccattctcctgcctcagcctcccaagtagctgggattacaggtgcccaccaccaagcccggctaattttttgtatttttagtagagatggggtttcaccgtgttagccaggatggtctcgatctcctgacctcgtaatccgcctgcctcagcctcccaaagtgctgggattacgggcctgagccactgcgcccggcaattcaacttattaatactagaatacattttctacagaaaaagttgtgaaaaattgtgatataattgtattgtagtacattgtaaaaattacaatacaagtgaaatgctttttatttacatttataaagaatagaaaatgtaatcataagaaataagagaaaaaccatttttacataaaattgaatataaacagcaataaatgaaatcgactatatatcaatttgataaaccacagagaaaaaaataattatttcaaataatttttgaaaatagttctttgacccattttaatgggatgtataagtctaagggcaaaaaaaaaagaaaaggtctgaaagcataccttaaatttattaatgggtttgttagtagtgatattctaattttgagacaatattgtagaaaactaaagagataggttgataatattagccaccataattttttttctaagggaaaggagatacaaatataaaaaaaaagaaaccaagaaaaagaacactcataatattaattttctcccacttaatttttctgtaatactaaatttgaattgaaaaatatagtgtgaaccaaagattataaacgtaatttcccttagggtttctactgaaagggtttagaaacattgacacagtagcaacaagcaaatttagttccctgatcctggtttctaaataccattccttacagaaacaacaaacaaacaaaaaacaaaccagttaataccaagtttaggtttggtcaaggtgaactggtgacaatttgttgtgccaaacactaatttaaatcaaactatgtgaaagaattcaaaaactagcttcaaaaagcattcatgagttcacaataagaaacagggagagagagaggcagagggagagaaagagagagagaaagggagacagagaatgaatgagatgccctccagcaaaggaaagcagtaagtccacgacatcatctatccttgccaaaatgtctatcctggatctaataaagcatcccatcctgcactgcccaatatggtagccattagccacatgtgactgtttagatttaaatttagaataatttaagttaaacaagttagaatttcttttcctctatcatcctagccctctcacatatggctggtggctactgtattgggtagcaccaacgaagaacagccatcctcacagcaagatctgtcgggcagtgctgctccagacctatcttccaaattatatggaaaccaagaaaccaagttaaatgacactacggggaaaccatatgacaaatccagactgacagaatgccgtgggacttctactagactattagcctgaactcttccaaaagtaaattgtgtttgtgtgtgtgtggtgtttgaacacctacatatgtatataaaatgcaattattattgtatactacaaagatgtaagagaggtaacaaccaaatgtaatgcgtgaatctggactgaatactgaattagaaggaaatctggagaaatctgagaatagaatggatattagatgactatccccacacctacgccatagaagcggaagtcactcttgttgtttataaaaggcccacgagggaaagtgccctactttttcccagagaggggaggggcttgcgggaaatgaatgggagagagttgaagcagagtgctgagaagagggaaagatttaccataactggaaaggaaaaggagttttactagttcctcactgaaagattgtccccggggcctgaaagcttgaagagatgagaaactcctcccctttcaggcccagtcccaaggcgcaaggccacttacagtaatcagcagcgtgggtcagcaagacagcggaagcaggacgacagccggccggaagacacctaccccggccggaagacacctaccctggccggaagacacctacctctgaagatggagaaggaggccgtccgggtactacgtagcagtcaggtcagtctgggacatttcctgtttacagaggactataaaacccctgtcctgtcctcatttggggctgacgccattttaggcatcagaccgcctgtgcccaggcgctcattaaaacagcatgttgcggccgggcgcggtggctcatgcctgtaatcccagcactttgggaagccaagacgggcagatcacgaggtcaggagatggagaccatcctggctaacacggtgaaaccctgtctctactaaaaatataaaataattagccggatgtagtggcgggcacctgtagtcccagctactcgggaggctgaggcaggagaatggcgtgaacccgggaggcggagcttgcagtgagccgagatcgcgcccctgcactccagcctgggcgacagagcgagactccgtctgaacaacaacaacaaaaaacaaaaaaagcagcatgttgctccacacggcctcgtgttgtctgttggcgtgctcttgggttcgagctgagaaccttacactcaccacttccgggatgcctcccctatctttttgcaactcttttttgagggaataatggcactgggtttacctagggagaaaggatactaaactctggggctcccaggtttggcaggctcttgtggaaaaaaacctgcccttgaaaaacccctaaccaaagagctttgaacaagatgatctgagtgggaactccttctcccacgtggtgtggccggcctcgtgtctattaaactctctactacaatgtcagtggcctttttttattatttttttttgagacagagttgcccaggctagagtgcaatggcgggatctcagctcaccacaacctccgcctcccgggttcaagcaattgtcctgcctcagccacctgaccagtagcctttctttatgcagtgacaggacgaatcccttgggtggttacatgataatgacaaaaaaaaaaaaaaaactagtttgttattctaagaaagacatatttgaaaaatgagaaaatttgttgactgtggacaataaaagacagtgttacaaacaatatatgagtctttttaagaggaaataaaatgtatcaaatcagatctatcgtccaccacatccctccttcactagccggtaggtgaagctctttcaagtgggtgagggtagatggtggaggaaagataagttttgttcaattaaaaaacatgtatagacagtctgcagtgtcagacactgtgctaagctcctcattacttcaggagcttgataaaaatactgatttcaaggcccagctcccagagattctgactgagtctttttctaaggtggggtccaggaatcctcatctttgaacattggtcttcaccctttccacaaggaatcacagtggagactttcattggatggcaccttgtgaaaacctgccctagtgttttggagataaggggggggatgttcatggggtagaggggagtgtcactctggagcactctcctgccttgtgtggccacagcacagtcccacagtgaggggccacgtggcactgcgcaccgatcttgagctatagtcacaaagctcctaggcaccacccacgaaaggccgggtgatggcagaacaaaaccatctggaaacctgaagatggctatcttctcttttgcagagaacaaagaagattacgtgttttgttcctaccttgatttcattttcagttcttttggacactgccttagttcagctcaagtgcatttgtgatttcacatgtaaaaaaaattacaaatgagcatcatattattcttgcttagtgttcacaatgctttggcgtccaggctatgttccccttcctttgcattaaaaaatgtgtaattttcatatgttagagctagaagggcaccaaagaagccatgaagatgagctttctgttaatctgttggtggcttgcatcatcattggatgatgcctactgaagcaaacgcaaaattctattataaagctaattcttaaacaatgtgcattacattcagctgctgtggccaccttagctgaggaagacatttctaagggatgtatggtccctgagggctctgtttaggcatcatatcatcaggaagtttatccttattcattcctactccttcctctctcccctcaactctgggatctatgttgttcaatgttgtactatcaaagaccgtattttattggcatttttttttccttttctttctctcctgctgtgagctccttgagggaaatttatgtttcccaggtctttgcatttctaaggctacaatcagaaagtgacacaaagtctacattaaaaaactttaatgaattataattatgaattataaccaaattaacaacactgaacctattattaatgatttaagatatgtagaatgttattgatatctttattcattgtgttccttttattgttgttttagggaatataaatatgtaagcgcttacttgtggtgttttatgactttgagcccccaaattttatattcattatcagatcctgaatgttcaactgccacaacttccatcacaggccaactcaggctgtcctagcaggctgctggatgccagtcacattaggctcaattcaggatgcagtatgtgctggagctggcacacacctgctcaaaggagctgatccttaaattttcaggaattatgtgagaagctgttaaacaatggatagcttgaaattggcaatggcaggagtatctataccaaagcaactggcaaatactacaaatcatatcactgcttctaatgagttacaaaggtgtgtgcttacatgctacccaaaaggaacttgaaggccttcatgtgaaaagatcatatgaataaacacaaagaaattagggaataatggccgggcaccgtggctcacgcctgtaatcccagcactttggaaggctgaggcgggcagatcacctgaggtcgggagttcaaggttagcctggccaacatggtgaaaccccatctctacaaaaaatacaaaaattagccgggtgtggtggcaggtgcctgtaatcccagcctacttgggaggctgagacaggagaatcacttgaacccgggaggtggaggttgcggtaagttgagatcatgccactgcactccagcctgggtaacagagcaagactccatctcaaaaacaaaaaaaaaaaaaaaaagaggaaattagggaataacaaactaaaccataatcaagccctaaatttaatataatcaagaaccaaaagttataacacaggtaagtgatacaggtatcagaaatgggagatgtcacagtcaaccaaaattgtggggggatcttcagtgaggagttggaaaggatgcaggaaagagaggagaggaatatcttcaggatcaggaaccagctgaacacagctgaacacatggagccaagcacctcacatgtgtataggggagagtaaagagggcaacacgaatgccacacagcatgcagccctcagggggagtccactgcacacacgcctggcttctgtggaacttggttactggaagtaccacatctgttgtcttggtccagctgtagcagagccatggatacttaagagtttgagaattaaggtgattgcgtagccggtgcctcctctatttcacctgtcttgcttattgtctatatcctctgtttaatcctcatctcgaccctttccatttatgattagaagttctcttcaaaaatatttctttaaaagctttgagggctatttccattttttgctatcttcatttttgttaacagctttccatggttttcctcataatatatgctttttttaaaaaatataacaaatccccataatccagattaaagctaaacaaacgcaccaggcattaagcaaatcacaaactccaggcttttttctgtaatacatgatacaaaacaatcagtaacactcaattccaggaccaacgagaagggagacattataaaaaatttaaaatgtctcaaaattctgtcactacagattggccttttctgaacatttcatataaatggaaccacacaatatgtgtctggtttcttttacttggcagattttttttttaggttcatctatgttgtagcatgcgtcagtagattgttcccttcctcattcacacccatcttcctcccttccttcctctctccctcccttcttctctctttccttcctttcttcctcccttccttcctctctccctcccttctctttccttcttttcttcctcccactctcctttcctccccatctttccttccttctttccttccttccttccttccttctattcttcctctatttctttcccagatagcattccattgtactaatgtactacattttgtttatccatttaccagttgtgacacaagttagggttgtttccactttagaaataactgtgaatcatgcttcagccaacattaatgtgctattctttggatagaaatatgtttttatttcctttgggtaaatagtggatatttgaaagtggaatcattggatcaaatggtcaacttaggttgacatttttaagaaactgccaaaccattctccaaaatggctgcaccaccttatattcccatcagcaagtgtgagggggtcttattcacatcctggccaacattccttgttgtctgtcttttttattataaccattgttctgagtgtttagtggtatctcactgttttgatttgcatttccctaacaacgactgatgttcatcgtcttttcatgcatttatgccatgctttctaataaagcattcatttcaaaatacattcatttgactattcgcaactgatcttttcttgtcactataaatccccaacttagaaaaaaactcttctgatcttaagagtattgtcttggtgtttataaccatcacctaggtgtcagcctgcatggattcttttagagaatggcacccaataattgtcctgtttctgtgtgctacccctttatgtgaacagccctgcagaggaagagcctgctggatgttcctgatggccctccagacctgctcttctctcttgtctcccctcatctgtgctctggaggctgactttgtaccaggatcccttgtgtctggcttcggatggagacacaggcaggtagagagcaacattgaagagcatttttcctctgctccctcactgtgggctgcagtttggaagtagccactgcctttccctgcctagtttttaattctggccaagcagaccctttccaggggctgaatacacttgaaagctcctaccaggagctccctcctctcataccttcagggttagagatggtaagggctgttttgggtgactggtcccttattcttctccacccactgatgggtcccttaaccttgtcaacccttctggagagagcttctttttaactatttatttatttaaatagaatagagatagcatctcactttgttgcccaggctgatctcgaactcctggactcaagtgatgcttccgccttggcctgctgagtagctaggactacgggcaagtgccaccatgcttggctaatttttaaattttttgtggagacagggtcttcctacttcctatgtgacctaggctggtcttgaactcttgggctcaagcaatcctcctgccttggcctctcaaaatgctgagaatacaggtatgagccactatgcccaatctggacagagcatctttaactctcatttttcaagtgtgtcttctcctttttgctgggactctgatacaggagataagcaaaactcctttgtgaaacctaagaccagcacttttatgcataaaacaaatggttagtgctaatgattaacttaaagtagtttcttcagacatatttgacacaacattacccactagtgcctgttcacctctgatcttgtagcactttgggcttttcacaaggacttgtcaccctctaccttgctttgtactcacttgcagtaggagacaattcccaccaccttcaccccaaacagcataaaaatgtaaaagttttttccagtttccctaaagtcatctgagcagctctccctaacccagaggagtgcaattactctaagaacctgtccatacaggcgttttttagtagatgttctttactcagattggagttatgaattgctaaccgtctaaattctctactgattgggagaatgagatgaggagtgaggggaagaaaggaataaagactcatctgaagcttcctaagagggccagcccaggagaaaacagccatgaggcagttcaaatctgcctagccaagccagggacaaggagctgggaatccccacgtgctgtaactgtcacaaatgccacactcaaatgcagatccctgggccactacagattcactgtattaatccattctcacactgctatgaagaaaccctgagactgggtaacttataaaggaaagaggtttaattgattcatggttctgcattgcttgggaggcctcaggaaacttacagtcatggtggaagacaaaggagaagaaggcatcttcctcatagggtggcaggacggagtgagtgtcaagcaaaggcggaaaagtcccttacagaccatcaaatctcttgagaactcagtatcacaagaacagcatgggggtaaccacccctatgattcaattacctcccatagggtccctcacaccacgtgggaattatgggaactacaattcaagatgagatttgggtggggatacagacaaaccatatcattatgcccctggcccctggaaaatctcatgtacccacatttcaaaaccaatcatgccttcagcattaactcagaagtccacagtccaaagtctcatctgagataaggcaggtctcttccacctatgagcctgtaaaatcaaaagcaggttagttacttcctagacaccgtgatggtacacgcattgagtaaagacagctgttccaagtgggagaaattggccaaaacaaaggggctgcaggccccatgctagtccaaaatccagcagggcagtcaaatcttaaagctccaaaatgatctcctttgactccatgtctcacatctaggtcatgctgatgcaagacgtgggtccccatggtcttgggcagctccacccctgtggctctgcagggtacaacctccctcctggctgctttcgtgggctggcactgagtgcctacaggttttccaggtgcacagtgcaagctgtcagtggatctaccattctgaggtctgaaggatggtggccttctcaaagctccactaggcaaggccccagtagggactctgtgtgggggctctgaacctacgtttcccttttgcgctaccctagcagggcttctccatgaaagccctgcccctgtagcagacttctgcctggacatccaggcatttccatacatcttctgaaatccacgcagagtttcccaaacctcaattcttgacttctgtgcactctcaggctgaacaccatgtggaagctgccaaaggttgaggctttaaccctgtaaagcaatggactgagctctacgttgacccctttcagccatggctggagtggctgggatgaaggacaagtccctaggctgcagacagcatgggaatcctgggcctggccaatgaaaccacttttcctcctaggcctccaggcctgtgatgggaagggctgccgtgaagacctcagacatgccctggaggcattttacccattgtcttggtaattaacattcagctcctccttacatatgcaaatttatgcagccagcttgattttctcctcagaaaacgggattttcttttctatcatgttgtcaagctgcgaattttccaaacttttatgctctacttccatcataaaacccaatgcttttaacagcacctgagtcatctcttgaatggtttgctacttagaaatttcttccgccagataccctaaatcatctctctcaagttcaaagttccacaaatatctcaggcaggagcaaaatgctgccagtctctttgctaaaacataacaagggtcatctttgctccagttcccaacaagttcctcatctccatctgagaccacctcagcctggatcttattgttcctatcactatcagcgtttttgtcagagccattcaacaagtctctagggagttccaaattttctcacattttactgtcttcttctgagccctccaaactattccaacctctgcctgttacccagttccaaagtcatttccacatgtttgggtatcttttcagcaataccccactctactggtcaatttactgtattagtccattttcatgctgccgataatgacatacctgagacttgccaatttacaaaagaaagaggtttaattggacttgcagttccatgtggctagggaagcctcacaatcatggcagaaggcaaggaggagcaagtcatgtcttacatggatggtggcaggcaaaaagagagcttgtggaggggaactcctctttttaaaaccatcagatctcatgagactcatccactatcacaagaacagcatgggaaagacctgcccccatgattcaatcacttcccaccaggtccctctcacaacatgtgggaattcaagatgagatctgggtgaagacacagccaaaccatatctgcaagcaaggagggatgtacctttagtagaattaaaccacttatttatgtgaaatactaccactgctatggtctgaatgtttgtgtcccccctagaaattcatatgttgaaatgaaatcaccactgtatttagaggtgggggcttcaagagttgattagatcatgagggcaaagcctcatgaatgagattagtgcccttataaaggaggcctgagggagattgcttgtcctttctgccatgtgaaaatacagcgagaaggaaccatctgtgaaccagagaatgaaacctcactggtgactaaatctgccagtgccttgatcttagtacttgccagcctccagaactctgagaaatacatttctattgtgtataagccactcagcccatgatattttcttatagccgcctgagtggactaaggcagtaatgtaaagattttactagcttttatagtaaaaatctagcttttctagtttgttcttcatatatatatatatatgagcattttcaaacagagtacttctggaagctgaacaacagtgtctcctgttaaaaaattcaaatcctcatccaaattgacatacatgtgctggcgcatatgttgtttatttctctgctgtttataccaaacttttcctgcaaacgcatccatcacacacacatgtggatacgcacaggcacacacatccaaatacactgcaggtaagacccactactactagtctcacagtttcacagtgatgttgggccaaaaacctgatccattattacttactgcggttcacggaagcagctttgtaaacctacataaagattcccccttccttgggaagccataaatgcaacgtttcactgagcagcatggaggcagggtgttaacctgctgtgtgactgctttcaaagagccagcactcctcagcagaagcctaatcatctctgtggatgtgctgtcctgggcctgcttcgataagtgctgtttatgtggctgtattttcaagatagcatggagggatgctaaacttggtatttgaaatctgtttttcctcacggcagcaacaagcctgcagcacagcgctaccagccagctagccaaccccacagccgcctgttgggcaaaggaaccctggaactcgttgaggttgcaggaacatacagaagatcatttctcctctttcattttcttgctgccttttctttcttaaaatcttaacgtcccaaaggaacaactgatgtgagtcagtatgtgttggcagggcaggatggtgtgtgtgtgtgtgtgtgtgtgtgtgtgtgtgtgtgttcgtgttcattcttcctgttcctgttttcccacctcagccttgggtgtcgatgaaactttttttttttttgagatggagtctcgcactgtcgcccaggctggaatgcagtggcacgatctcggctcacttccacttccgcctcctcagttcaagcgattctcctgcctcagcctcccgagtggctgggattacaggtgcctgccaccatgcccagctaattttttgtatttttagtagagacggggtttcaccatgttggccaggctggtctcgacctcctgcccctgtgattctcccgcttcagccacccaaagtgctgagattacagaaatgttttatatacctatttgctccaggcagagtttgaaggcagagacttatatcaattagagatccataaaagccagtgaggtgacatgaacaaaagcattcccaccaacactggaagtattcaagccagattttaaacatgagatttccactttaggataaaggttggatccgataactttgaagatcctctgccatttaaaaattctatgggccagacgtgatggttcacgtctgtaatcccagcactttgggagacagaggcaggaagatcacctgaggtcaggatttcaaagccagtttggccaaggttgtggcacatgcctgcaatcccagctactttgaggctgaggcacaagaatcacttgaacctgggaggtggaggttgcagtgagccgagatcatgctcctgcattctagcctgggcgacagagtgagactctgtccaaaataaacaaacaaataaataaattaaataataaatacaaaaataaatattctgtgatgccatgatcttactcccagtttaatgaacagttctgatggtgatgtttagagtgaaactcatagtttccttgaatattttcctactttgcatatttcccaagatgctttttccattttgaggaagatacaagataagatacttctcactgaaagttctcctttaaggggagaagcaatggcatctgaatctcaaagtttggaaaaaataaaccgttttttatctcttggctgaaggcaaagtgaagaagtaaccacagctcagctctgtggagagtgggggtggcagatgggaaggtgaaggaaggaaaagcaaacacagtcagccctccctccacactggcatccatgcatccacggattcaactaaccaaggaccaaaatatcccaaaaataagaagaaaaattaaaatgacagtacaatgaaaaaaaaatacaatctaataagacaatagagcacaacaactatttcaataacatttacattgtatgaggtattataagtaatctagagatgatttaaagtatatgggagtatgtgcccatatacacaatggcaaatcctatgccgttttatataagagacttgagcatctccagattttggtatctgaggggaatcctggaaccaattccctgcagatactgagaaacaacgctatgctctgggcagaagtacttccagaagagccacacgattgttcccctatccttgctcaacaaaatgccagcatcagaagaaacaatggaaaaacctgattctttcacaagagctgacctctgactataaaggatttagggacaagattcccaacctactctatatggcaaaggaagaaaataaaatgttatcttctttctccccagaggtcactcattgcttttcctctccaaaatatgcttgtcttagttcattcagcggctataacaaaataccatagactgagtgtcttatacacaacaggaatgtattgctcacagttctggaggctgggaagtccaagatcaaggtgacagtggatttagtgtctgctgaggacccactttctgattcatagatgatgctttcttgctgtgtgggcactaatctcattcataaaggctctaccttcagggcctaatcacctccccaagccccagcctcctaataccatcgtattgggggtgaggatttcaacatgtgaattttggggacgtagaaacactcggcttatagcagtgctctttttattttgccttactgatagctaaggtcactctgtgtgcacatttatttcacacttgaagcatccctggtgtttttaataatcacctccagcctgtcacgtgaaattaataacacacacacacgactccatttttcatcaaggccaccttccagaaagaaattactctttgactactcagagaaaggtgcagagattattataaaaatcaggagaggcaatgaataatatgaagaaattcagtgtcccaagttcttttcctcccacacttatttgtagccagtgtgatcattccttatgcacctaaactgcataatctaaattaattccaatgtgttgtagagtttcaccaccattacagtttgctgtgattagcaaaccttaacctagtgccttcatgtagaagtatgactattttcacagttttgtatgaatgtacttgctatatgaccttgggtaactcactttaccttctttgtcttggtcttttaccatctgtaaaatatagtatagtttttccttctccatattttatgattaagaaaaaatagaagatggttagaaaataataggaacacatgattcatgcaatcatgccaaaagtaccaggaaatcacatttcaacatataatttctatgcaggttatcagtaaagcacatctttaaatcactttcaatcaattcacaaggtaacagaattttgatttttttcccctttttaggtgcggattaaatatcccatctagattaagttttatatatatatatatatatatatatatatatatatatatgtaagaatcaatgcaatatcatataggtctcaaaatacgttattttcttactccttctttacattcttctcattaagtcatttttttcacttaacaaatattaattgagtggctactatattccaagaagtatgttaggcatcacaggctctcattttatctatatgcctggtgacaggatagctttgccttgactatatggtgttttcaaattttctttcttttctttttcttttttttttttttttttgagacggagtctcaccctgttgcccaggctggagtatagtgtgctatcttggctcattgcagtatctgcctcccggatacaagtcattctcctgcctcagcctcccaagtagctgagattacaggtgtgtgctacaatgcccagctaatttttataattttagaaaagacaaaattttgtcatgttggccaggccagtcttgaactactgacctcaagtgatccacccacctcggccttccaaagtgctgggattacaggcatgagccaccatgactggcctcagattttctattgacttcatttctatatagccagacagtaatgaattggttctgctgaaaactgtggtcaggataagttagaaacccttttgtttccttatgtatgtctttctaaatttctgctgagctacatcttaataccttattcccagacctcagctcagtgccccagtgcctgacacaaaataggctcaaataataattagttgaaatataaataatgatcataatgctaaatgacaaacagcccttctactactgggtgacctcgggcaagtcactgcatctgatgctctcttcattcataaaataatagacaaggctggtggttgctaaccagctgggtcaagactggtgttattgtaaagatgtgaaaatgcatatacattctataataagtcctacataaaaacagaatatactatttgtcatatatatatgtatgtgcgtatgcacaccacacataaaacaaataacagttttacatgcatgtagattactgtgtctaagaaaaccagtatcatttaaaagcactgtagagtttataacatcttttggctactatgtatttcgttaatgagcacatacaaaaatgtaaaattacaaccattttgacattctaaaacaccttcacactccaacagggcatcactggattaaatgatcttcaatgtcctatctagcacaaatatctgtggttccaattcaacagaaagcagaaaatatttctcaagtgttagctatatacacagcaaacaaccaagtggaaagcagaaaatacagccaatgaactctacaagtagaaaatgtgagcattttctctttttttttgagatgaagtcttgctcttgttgcccaggctggagtgcagtggcgcaatctcggctcactgcaacctccacctctcaggttcaggtgattctcctgccccagtatcccgaatagttgagattacaggcatgtgccaccacgcccagataatgtttttgcatttttgtattttttgtagagacgggctggtctcaaactcctgagctcaggtgatctacccaccttgacctcccaaagtgctgggattacaggcatgagccactgcacccagcctcattttcttttttactaaagctgctgccatgactggctttatcatgccactccccctcccctgtccccaaggtacactggcatggtcctgctctccagagtaagttctacacataaatgacccttttccctttgtccagtaaatggctgggccatgtcctttaaaccagcagtagctgttaactcttggttaaccacaccccatacccacaatgtcaagcaataaatgtttttgggagataactaaagaggctgctggaaacatttgctgcatgttcaatagtgactgacagtggagaggagggagtggtgggcatttcttttatttttatattttgagatggaatcttgctctgtcgcccaggctggagtgtagtggtgggatctcagctcactgcaacctccacctccagggttcacatgattctcctgcctcagcctcccgagtagctgggattacgggtgtgtgccaccatgcccggctaattttttgtattagtagagacagggtttcaccatgttggctaggctggtcttgaactcctgacctcaagtgaactgcctgcctcggcttcccaagataggcatttcataagaatcatacaacctgtcctccctgtacctggggcatacacagaccaagggtacaatgcgtatgagctaaagagatcctggctgcaacgtatttgagcaaaaaaataataatcatttgtattatacaatgaagagagatgatgaaatggttgtgacttatttgagaatataaactatagtgatcaataaaatcacatttggtgcggtatttaacccatttatagagatgtatattttcactctatgttaatttgcagggacatttgagaggaaatgtctgtataataaaaacattaaaatagaaatatttcaatctcagttttgcctaaggccccaagtccttgtttatcaggatttgaaaacaagataaccagaaaaaaaaactttatgactctgagtccctcagtcatcttgaggatataaatctgatatgtatattaagggttcaaaatggtaggattagaaattaaaataaggcttatttggataaattgttctataaaccccctcccatagggagtgtgggggagtttgcctctcacctcaatccaagagaaaggttttagacatcttgatatgtagcccctggggtttggaaactgtattagtcagtgttctccaaagagactgaatcaatagaatacagatatagatgtagatacagatagatgtgagggaatttattaggggaatggagtcacacaattatggaggctgagacatcccacataggccttctgcaaactggagaaccagagaagccaggagagtggctcagtccaagtccgaaggcctgagaatcaaggaagttaatggtgtagctctgtctgaggccaaaggcacaagaacccagagggccactgttgcaagccctggagtccaaaggcgggaaaacctggaatccggatgtccaaggccaggagaagaagggcatcccagctccaaaagagaaggtgagcaagagtctgccccctccttccaccattctttttctatctgggcccctagctgtttgcacggtgtctgtcaacatcagggtggatcttccccactcagtccactggcgcacatgctagtctcctgcatacacaccctaacagtcgtgcccagaaacaatgtttcaccagccatctaggcatccctcaatctagtcaagttgacacctaaaattagctatcacgcagactgatgtctgatttgtgctataacatctatggaaagagagacggtagcggatacgcagttctgattgtggcctgaagagagggcaacaacctgtccccacagagagtcagagcaaagaaagcccaagttccttagactctgctcaggaagcctgtccagccatgcaagaagactccagcagaaggaaaatgaaggggtgccacctgcatgcagcgggtgaagggctgaagaagggatcctaaacaaccaggagaggagaaacactcaactctgtcaaagacactgcagataggagatgtcaagtgaactgacaggatggattaggaactcttttttttttttttttttttttactttaagttctgggttacatgtgcagaacgtgcagttttgttacataggtatacacatgccatgggtttgctgcacccatcaacccatcacctgcaacaccaggctgccacaacacttgggttacacctaatgaggtgactccatttccattgtattgctattctggttagtgagaagacacactataggataaagtttgcattagaagagccaggaaaatatgaagtagaattcctctttaattaatgttaaagaacttaatcacagagggagaaataaatgttcacattggcacccatcgatatcatgaatggaatacaagctccatggtaccatgtgcttcctctcttgtaggatatggactgagccaccttggcaaactatgcccatggtatattcacttcatcaacaaagctagtccagaacattctatgcatttgcttcttataacctgattcttggccacttaagcagcattctcaatgcttccaatgagtgaaaatgaaaaaaagaggacaaaataagccaataattccagctcattagcagccaaaaaaaaaaaaaaagatctttgggcaagccaaagttctaaggggaaagggggaataacgacctaaagaccagtgccacgtatgtttgatactcttaactgtaactctggaacaacaacaacaaaaaccccatccaggtttaaaaatatgtgtaaaacaccatattataatataatctcatgtttattattttaaagtaggaaaatgcagatagtgtgtcttttgcatcactgttgaaaatacgatcattcattgaagacagagcagtggtatcctagttaaaactctttcaagttattcaacaataattgggagcttcatcaatagcaattgctattttccatcactgaatgcaactcattcctgaagcccattgaacactccagaatattgtgcaggcgtaggtcttgctgactcagttgtagccagcaatatttagtcatgctcctcgtcaggtacttctggctctctatgatgtggagaaatggtaggaggatgtcatttggacccctgtgttcaatggagcaatgtggttggttctggccaatgagctgtgagtggaagagacctgccgcttctgccgagcatttcgtatatgtgtgggtgtgagtatactctccttctcctcccatggtggccagcaacgttccaggggctgagccccctgagaagcaatgcccccatttgccagagtcagccatgtagtatgagtgaggaagaaaactttgtcttaagcccatgagattcaggggttatttgttactacctgttaacctcccctgactgatacaaaggtcttattgtctacctccttactgatattgactgatcaggtcacttactgaatatgcctggactgcaactcagtgcccatttttattttaaagatcgatgagttgttttatgattggaacttggggtaatacaaataatacatttcccatacgagcatcactaagagtaaacattgactgacaatgaatagtcattgttgatttgcacataaacccacaggtagattttgttcattttgtaagatagaaattagatgcatttgtcaggctgatgactgagggtgggagcatcatggagagtcacattagaagtggtgacacctgccatgagggcacagcatttgtgcaggtactgtgagaccaaatgcactgccttcaagctggatgcaatgtaatcaatccactttaacatgagtaatcattgctgagcatttaacatgagaatcatattataacacatattatgaggcgctgaacaatttggtgaagaagagagttatacaagttatatcgatgagttcagatgatttgaaaaaaaaaaagtggttagatttacaaaaggcaaggaaggaaaatgtgtaaagggaaatactctgtgctgctcctccagaaagacattccccaacagaggggggcttgccccagtgcggtaccacctgtgttggggcaggtaagcccacctctttgggtgttcagcattggataacacatttacctgcagatctaaaccacatcccgcagtgtagactttttcagtaataatggtggaaacctgatctccttggccttactactttgttctatgtttcaatttgtccagaatagggacagagaagcaagtgctgttgattggtctcttcaaatacagcaagggaaagtcctaatggagaagccagtcttaggctgagatgggaaggaaggaagaaatggggtttgaacgtgaggaggatgggaagtattccaggatacagtactatggcacaaaatcaaggactaaatgcttatctgtctattttttgagttctgtaaagtgctttcacatacatgataaaaatgtgtaatggcactgatggtcagtgtaaatcctgtgctctcttctgtatccaaacactggcagccctggactcctagtgaaggagacagacatgtgtcctgtttttgtggcgagattctagtggtgaagttagacaggaagcaagtagtacgtatataaagtattttcagatactgattagtgccatgaatgaaaataagggagggtaaggagacaggatagtggaggctcgctcttctgggcagttggttaggtctggtctgtgaagatgggtctttgatcagagtcctaactgcaaggagacaaagagccccaaggagaaacaggaagggaagaatctcaggcagcaagaaaggcaatagtacagaccctgaggggaaacgtgtttggctgtggaggaggccagtgtggccctaggggatcaggaggggtgagtccaggggaagaaagccataacatgcaagtagcagctggaggaggaccccaatgtccaaggtcaggggccctgaaatgaaagaaaaggccagtgaaagccaggactgtgcccagagaaggcgaagtgattagaacactcttgaaaatgaatctgctactgggttagggtgtctccccgaatgtcgggaaaactggccagaggtcattaaaatattgcaggtgcgagataattagaacctagccttgggcagttattacaggtgctaaaatctgaaaactcaaactgaggaaaattggcagagctgggagacttattggatgacaagggcaaagaggagagagaaatggcagacaattcagggtcactggctgactttcactgtcagtgatggcagacgtgggaggggaggccatctaacaaatgctcacgtctagggcttatgtagtcaacggtgagagcaacctgcaaaaaaataaaaaataaaaatactgttccaagagccattttttaaaaaaagaatgtcacgcagactgaaaaagaaaatcaaaataaaatcaagaaaagggattgtattacaaactcactattctcaagataaactgaaaaaggcaaatttcatacttagtaatgagaacaaaataaacactttcaattgattaatattgcaatacaatcattttgattatgtgtctttattttatttgttattttttcagtcagggtctcactgtcttgcctatgctggagtgcagtggcaacctctgcctcccagtccaagcaattctcccacctcagcttcccaagtagctgggattacaggtgcataccccgaggcccagctaatttttgtattttttggtagatatgggtttcaccatgttggccaggctggtgaactcctgacctcaagtgatctcccctcctctgcctcccaaagtgttgggattacaggcgtgagccacctcacctggccagattatgtgtctttaaaaaataaaaatgaagacatgcataaattagtatagtagaaggaaaaaagagatacgacaccttttatcttttttagggatcaatgaaaggccaagagatttgagaactgtaagaaagccctgagaagcacattgttcaaaatttatgctcacttgaaaaaaagaaaaaaaaaaaaaaaaaggaaatgacctaggctgttacaaaagttaaacccaaattgagcaccttttaaataaggttgtcaaaggttaagtatgtttgaggtaaaattatttccccagtctcaaaatgaaatttccagtagactttagaaaaaaaaaatatggaaaacaaacatacatggagaaactgcattttacaactgaacactgggtttcaagtagagtgatttttaaaaatctcatatttagatactgtctggttttaaaaataggccaaatggatcataggctgagaatcagaaatccttcttttgggttgtctcttctccgtaagcctcaagtacttcttagtcctttcttcatgactagataaaattatagtaactaccacagggattatgattcctagtcaaacatcaatcatagtcctacacacaaatgatgtcaagtgctaggcactgtctaggttctataatattagagttcctaaatttacacacgcacgcacacacacacacacacacacacctgagatagaggatagaaagataaatgatgatagatagatagatagatagatagatagatagatagatacatatacatagacagacagacagaaagatagatgctaggctgggagtggtggctcacacttgtaatttcagtcctttaggagcctgaagctggaggattgcttgagcccaggagttcaggagttcaagaccacctgggcaacaaagcaaggctctgtctctatgaaacacaaacaaacaaaaaattagctggacatggtaacgcacacttgtgctcccagatactaggaaggctgaggcaagaggatcacaggagcccaggaggtcaaggctgcagtgagccatgattgtgccactgcactccagcctgggcaacagagagagactctgtctcaaaaaaaagaaaaaaaagaaagatagatgctagatagatgatagatggaaaggggaaggaaagggaaaggggagaggaggggaggggagacgaggggaggggaggggaggggaaatcccttcaccgaagacttgtaggtcaggtctcaaagagcagccagcagacagccttcagctgtcaactacatcagggattgacccagctgcagagaactgcctcacacaaggtcacaccccttcctgggtgactcacaatcaactgacacaatcaataaaacctgtctgtcttgagccaagttggcacaactctgaagatccattctgattgtggagttccctgtgaggtctgtgtggctgggcctgcattgtagctcaatttctccccctcctcactactgtctcctctcttcccttccagatgtcattaccaaggatcctttttaattagcatcctatattccaaactctaaccacagtctgcttcctgtacttgcatatattcattacatacatatgtgtgagtgtacatatatgttttaaaaatccctagcaagagtaagtacgttatttggtcagtcagctgttaaaacttccactttctccagttgtctggtggaattaaaaaaaaaaaaagactttcacttttattagtgcaattcatatcagtgtgccactggtagctcttggaagagaaggaagagagagctaatatggaacctggagacaagttccactctgctcctgctgaatgcccttctcctttgcttctacctacctccagaagtgctggccattgtcagctcctgaaaaggctgatgctctgacctgtttcagtgaacggggagaggacttgaggctgggaaacctttggaataggcaaggggtccccctacataggcttccctccatgactcatagtgtgttccttggttcgctccctgtggtcaaccacctgctgcaaaaagtcgttcactgctggtgtgagaatcattgtcacctacactcaagtaaaaatgtgtatcaaaggaacagatgcttctcttccatgcaacctgaatatagatctatcaggcaaattcagacagctgttctagatgcagagaccatcatatctgctaggggtcagcaaacactgaccatggctcaaatctggcctgccatcagattttgttgggcccgggagtgaagaatgttttcaggcttttcagtggttgaaaaaaataaaataaaaagcataatatttcataatatgtgaaaattatataaaatctaatttgtagtgtccataaataaacttttttcttttcttttcttttctttttttttttttttgatactgagtctcgctctgttgcccaggctggagtgcagtggtgcgatctgggctcactgcaagctccacctcccggtcacgccattctcctgcctcagcctcccgagtaggtgtgactacaggcgcccgccaccacgcctggctaatttttttttttaatttttagtagagacagggtttcaccgtgttagccaggatggtctcatctcctgaccttatgatccgcccgcctcagtctcccaaagtgctggaattacaggtgtgagccaccacgcctgtccccataaataaacttttattaggacacagccatgctaattcatttacatattgtctatagctgcttttgatccacaatagcatagttgggaagttgtgacagatacctgaaagccaaatatgtttactatctggccctttgcagaaaaactttgccaaccacagagctatgcgatttaggattatacaacacaatatcacacatttgcttattggtgaacatccaatgggtggatattcacacagatatagacttgttacctgtacatgtctgtaagtatctggcctctcataaaacactaaacaccttccacagaagtgcacaatgatgtagagaccccacgttatgctcaaacccaagcgctatctttcttcacatctttttagttcaaaatatctgccttaaaacagaactggaaaaacaacatttgtcaagtaagtgcagccgtgttaatgttaaatagatgaatgcatggatggatcttttaacatacaagcaatggagaagatatgccagcaatgataatacttgtgttagtgtgaagggtattttagatctgccccaaactcaggtagaaaaagtttccctgaccttttccctaccagtttagaattttaattcatcccagagagtcagtggctttgacacaatagcacttactcttcagatgcctaaaattttatggtcaaaaatatcaaaagattagaaatgtgattttcaatcccaaaagccacattgaagttcaattaaacaaaaatgcctggggttttcatatgcactgaaaatcataaaaatcaattttattacaaatctacccatgaaaccgtctatctgtctctccatccatcaatttatttctgcaatatgtctcaaaatagcacccaagagtttgtgccaattcttatttttcaagatatatgagctttttcaagttcacaagctccataaacttcacaaactccatatggtgttcacaaaggaataataaatgttttttatcttttacattgtttatgaacacataattcatttttactatatcaattgcttgcctaagaagttacaatgcttccttttctgcttattctggcttacaagcctttcagaattgaatcttacctgatctgttcaatattacattctacattacacacccaatttcactgtatctcacccacctgtcttcctacacactaaagcccttactcctcctaatcgccatgttttcattatctccatgtcccttttatgtgttgttctttctacaaagaaaccccttttctcctctttttgaaaaacacctacttatccttctagaacaacctaaatgtaggaactttccaaattctccagggaaatatagcccttccttccttccatccatccatccacccacccactcacctactcactaatttatcccttactgaacaaacatactgagcatctattagatgctcaaaaatgtataacaaataagctatttctgcttggtttataaggacactgagatatcagcaaagtgttatgggaccgaagaagaagaaaatagaagaaagacatcaaagtcaaactggaagtaggacagtttggaaagcatttcccagaagaggtgatactgagttaagtatacacaggacaagaattatgcagccaggtggatgagggatgggaagaggagaaagggagagggtgttctaagccaaaaacacagcaggtaagaaactgagtcaccactaggaaagttaaatcaatatggcagaaagaaaacctgctccttgggtcatttcatcatgcgtttggtagagcacttacaactttatattaagtaatatgggcttgaggttctgctttagataatatggacttgaggttcttctaccttttattacctgtcagaaatagggttttaatccctgggaggtgaagcttgcagtgagccaagatagcaccacggcactatagcctgggtgacagagcgagactccatctcaaaaaaaaaaaaaaaaaaaagaaaaagaaaaagaaaaagaaatagggttttcatctggaaatatttggggctaagtgttgtcctgaaaggaactttggaaaagaaatattccattacacttgctttgtcatcttgtgatacagactcagcccatggatcaacaaaatgccttcattctcaacagtccaaagagctctgggtaggatctcaccttccttacaaaattcatgtcagatgttgaataatagacattattctgttcctcttccaagtgagagacaatgagtggctcatcccctgaacggtgtgtggaataaggtgaaacatgtagcaatcaagaaactggactcatcccctgaacggtgtgtggaataaggtgaaacacgtagcaatcaagaactggactcatcccctgaacggtgtgtggaataaggtgaaacacgtagcagtctagaactggctgcagaatatatgtttggattttgtaactttcatgctcccaaaactcagagtcatttttctacattggctctttccctgtattatcaattgtacccttcacataacaactgtttcctaatggcaaccaatcaattcagaattcaaatggcgattcgccagtttgatatctacgttgccctggggttatggaagaagctgcaaattttggggtactgttccagcttattaaatctttttattgaaatttgattcatcttttcctgaccttatcaaaccatcccggccttgtcatctacagcaggactttgcaaagtggactcctgtcgcttgctgcattttactggtgtgaaatcagaaggagtatggtggataatgcattttgaatccggttagacattaattattaggttggggcaaaagtgatagttttttttgccattaaaaaaccatgatcacttttgccccaacctaataacacccaaaccacctgtagaaatgatttaagaaatcttcaactcaaatgccttctttcaggaggagttttaaaatagaaattacatcattccaaggttgtgtctgcatatgcagttgtatcaaaaaacttaaatgtaatttttgagggaactaagccaggagaaagggccatagtgatgaatgtatccaaaagtagccatcagagaatccgtgagttcttacactgacacaggaagaccactgtgtttgacagatgcaaaatttccattcagatctggtcagcactcttcacctaactggtgtttttaagagataattaaaactgtttgcacaatggcacagtccatgacacattaataataataactaataacacattaataataataactaataataactaatggcacagtccatgacacattaataataactaatatataataattatattattataactaataactaataataactaatataacgaattatattaatgatagtaactaataatgtgaccatgacacattaataataactaatattaataataataactaatattcaatttaattctcatttctataagtgccaggaaatttgctaacattgtatgtatacatgtaatacatgtacattacatctcatgtaatcataactgttttattgcttttttttttttttttgagacagagtctcactctgttgctcaggctggagtgcaatggcaccacctcggctcactgcaacctccacctcccaggttcaagcgattctcctgcctcagccacccgagtagctgggattacaggcgcctgctaccacgcctggctaatttttgtatttttagtagagatgagtttcatcaccttggtcaggctggtctcgaactcctgacctcaggtgatccacctgcctcggcctcccaaagtgctgggattacaggcttgagccaccgtgcccggccaactgttctattgttaaagcaggtagctaggcagacgtgagcaggtcaggagaggacccccaacccctccccaggaatgtcagctgaccactaggtaatggtcaggaggttgttaaactatttctctaaaataataattgattgcagctggtaccaaagaaagaccgtctcccaatagatataaaacacctgaaactggtgatcagcttccaaataagatctcagaagttgggcgagcacgctaagcatgtgcactaagaggcaaaatggcggcgtttaactggtatatgagcttcctccaggaacgctctgctggtaagggaaaaacgcctcaagtgagcatgcacacaacttcagtaaacacactgcgcacgcagccccttccaagtgctgacaggccactgtacatgcggacagcccgctccgaaggaagaatcaggggagaagaaatgcaagcccaaaaaccctgccaaggtataaaaccccagtcaaggaccggatggggcactggatctctcaagtcacccacttggtcctctggcaagtgtattttgcttccttttgttcctgccctaaagctttttaaacaactctgactcctgctctaaaacttgcctgtatctctcccgctgccttaaacccacttctaccccttggccaaattctttcctttgaagaggcaaggatcgagtttctgcagacccatacaggttctccactggtcacaccatcaagtaagcattatcattattattcccattttacagaagggaaaactgagtcttaaagttataagctttcttccccgagttcacacagctaataaatacaagaggagaatttgaagtaaggcagtctgactctggttctaaaccaagtttatagtctattgatagctgttgccattgttaaagcccatgtcatatttagaatatagttccagagttggcacattggaaatgacaatattactttaaaaaatgtgttgaagatgggagttaaattgttttggaatttgccactacataaactatataataggggcagatatgagcagtgtcagattaagcagagacaggctccgtggccaggaaggcataaccatttgcggcttaacacagccaaaaggtcagaaagggggttcattcgagggagccaggaaacggggcctgaagcaagacttggcagtgacctcctaactttatcagtgaaaagaaggtgatttcactcagcctgctcagtcctagggctcagtagctttttgtggagatgactgcatagcacccctcttttcaaatacagggtggaggaaatcaaaatatctcaaaacatccttctcggacatattttgagatggatgttcagagggccagcagatagaagtagccatgcaaagctgtcttttgtcggggagatacacatctgcagagaaaatctgcattgatgtagccaggctttctccaagggcctcccctgtcctcttccagatctaggaaagattaaccgactgtcgacacctttgaaggtctgaaagaaacatttaccatctattctctctgagggcggctacctgtgagatttcatctacataacaagtgatctttgctagccagggctcctcttctctccctcccataatcacaacctgttttgccacaatccaagcccccattctttctgcaacctcaagatggtacataagcttctgaaccccactggggagttgggataatcactctgcagttttcccccatgcacatgttatctatgaacagaaggacaagttagttaccctctcctcacaacccacacctcaccaacaagcaagccatcaattttgcagcagactgaagctggaagtcctctaattcagttccactctgacactctcttcctggagatagcgtcagatcccacaggttgagggctcagtccccaagaatgccccttgcttctgacgcgaattacaagtcccagtttatttcacctgtgcttctgacagaccagctggaaattagagatcccatgatcccctgcttgagttcaattaatttgctagagtggctttctgaacctagggaacacttatgcttactggtttattataaaggatattacaaaggatacaggtgaagagatgcatagggtgaggtatggaggaagggttgtggagcttccatgaccttcctgaatggctccaccctccaggaactgccacatgttcagctatccagaagctctcagaaccctatcctcttttttttttttttaagcttcattatgtaagcatgattgactaaacctttggccattggtggtcaacttaaccttcagcccctttcccctccttggaagttgaggggtagggctgaaagtcccagccctccaatcatgcattggtcttttcagcgtccggtccccatcctgaagccacctagggactgccagccatcagccaactcattagcatacaaaaagacatcacttcggagattctaaggattttaggagttgtatgttaggaaatgggatcaaagaccaaatatatattctacaatatcacaggagtccttgaccaaactagataggccaggtctggcagactgttgctagctttacctcatctttcaatttttctagagaagtcagatatctgaacattaatgtgaaattttccatgtttaaaaaatactgcgcaggccaacaaaacacatcccctactcagattctgcgcatgggccaccgatttgcaagtggcatgtgctcatatgtacttcagatcaatacattctaataccgaggcaacttttttctcagtaatctaaatttagggaactattctcagaattgcccataggtcttatataatctgaacatcacaagagaactcaaatgactataaccataatcgtagaactgaactgtgtcattcacatgctgtcatatccatcacatttccaactcattccaagcaaatcctcagctgatcctgtgtaagggctcactccttccctatgtgcgttctcatcatttgatgaacttaactttggcaaggagctagaagacttagctcttgacaccacagcatgagatgggaactaaattggtatatgacttgattcttgggcacagcagtttatgtttttaaccaacactcattccagaagtagactacataagataagtagcatacacacatatgcatttcttaaactaccgatttaataattcattccccaaatacttaatgattgcataccatgttacagaatctatgctaggggtcgagcacacaatatttagacacatgcacacgtatgtttattgcagcactattcacaatagcaaagacttggaaccaacccaaatgtccaacaatgatagactggattaagaaaatgtggcacatatacacatggaatactatgcagccataaaaaatgatgagttcatgtcctttgtagggacatggatgaaattggaaatcatcattctcagtaaactatcgcaagaacaaaaaaccaaacaccgcatattctcactcataggtgggaattgaacaatgagaacacatggacacaggaaggggaacatcacactctggcgattgttgtggggtagggggaggggggagggatagcattgggagatatacctaatgctagatgacgagttagtgggtgcagcacatcagcatggcacatgtatacatatgtaactaacctgaacattgtgcacatgtaccctaaaacttaaagtataataataataaaaaaaaaaaaaaaccagccctgaaaaaaaaaaagaaagaaaaagacaacctggtaccaaacctcaaatgcttttacccaacagcagtagttctcaaaatttggcccccagatcagaagcatctgcatcggccactgagaaattgttagcaacacaaattcgtaggccccgcctcagaacctcagatctactgaatctgagagtctgggaaccaggctcagcaatctgcgttgtaataagccctccaggtgattccgatgcaagctcatgtctgagaagctcatgtctggagaacatctgggggtggggaacaggggtagaattcaaataaaaaacacaggagactgatttacacatagtggccagaaaagcatctcttaatagatgacagttgaacctgaaaaatgaaatggagtcagtccttgaaggataggaagaagaaaacaggatgagtggggaaaacattttagggagaagcggcacacagcagtgaccttgtgcagacaaagaagtcagcgtatgcaaagaactgatcaaaagaccctctggctggagcccagcaaatgagaagagaatgtaataagataagattgaatcaatgactccggagtagatctgaggtgcagagatggcaggaagcgaaaggatgaccctgacggacaagagctggggctgagaatggggaaaagtttatgatttcagaagggagggagtcactctgtagctgaccaaggctgagataggcagggccagagattttgggtgtaaaaacttcctagaaagtgcctttagcgataattatttgcagacagaattatcgtgaataagtaatcagaagacttctgagtttttgaaagactgtactatccaataaaccacatttccaagcttcaagcccctgccagtcttcagattgcaagagaaccctgggccccaaagcttatgctgactatgcagtgccaaaagcagcatattctgcaatgtccttttttgggtaaggtcatgaataatgtgctaagaacaatctcttgaagggatgagacagagggcacaaagagagtgaacaatggaattccttccagaaggcagaatcaggccccatggagtaaaccccatattctctactgccagcgatgggaatctgttattcttgaccagtaaaatgtgttaattgctatgaaatactttctggcctgtgtttcccatcctcttcctctccaaatgagagtttttattacagtttcctgtgccactgctccattgaatatggggtaatacagggcatggataacctgtcttttagtttgtcagtcaccaaaataagaaaagcaatacacagacccgggggagaggacgtgaatgacacaggcattctggacttcagttcagatgcagtaactggttagatcttcgggcttgcctccttttgggagcaggtgagtgtgttatgtgtggggtgaagaatacatacaaatacgtgtttggccgggggcagactgaagcagattgttggatttcctccagtattcgttcttctcatctttcaatgtaaataaagtcaccaacttctgactgagcatacgccacctgggataaatgccaaatttcccagcctgccttgagatccggtggggtcatgtgactaagatctggccaatgtggtaaaaacgaatgtgtcatgtggcatcaaccaggagatttccacagggacagctgtactctttggtcctcctctttttttttttttcttgagacgagtctcgccctgtcacccaggctggagggcaatggcgcaatctcggctcactgcaacctccacctccttggttcaagcgattctcatgcctcagcctcatgagtagctgggattacaggtgcacaccaccacgcccggctaattttttgcatttttagtagagacggggtttcatcatgttggccaggcttgtctcaatctcctgacctcatgatcctcccgcctcagcctcccaaagtactgggattacagggatgaaccaccacgcccggcctgatccttcttttatatttccccttcctctttcctgctgtcagttacccaaatattacctcggacaaagagccaggtctgtactcctggggtggtgtggtcatggaagctggaaggggcaactgaaaacatcttggagcaaagccttcagactgcatgtcttcaagactcttgtgaaaaaaatgaaaactgtttatttggaatttctgttatttgcaaatgaacttatcttaaccaatatggactcttggccactaaaagtagcttaaattttactccaaatgcactagcaacccatgagagggtttcaagcattgagcacaataggctctgctgtgttacaatacttttaactctgcaaggaatgatgagaaagaggatgggggtataggccatgtggaaaatggcaccagcaaatatggtggattcaggagggataaaggggggacatttttgataggttttagaggtaacatagtattttttgataaatttgatgagattgaagagaaaaataaaatattatctatatctcatggataatacaagtgatacttatttttatcaagttagttgacaaatagaaatttctctgggaaattggaaatatatgcatggcagatactcactagggtggctcccatgattcccgccccagcatcagtatctttgtgcaatctcctcccctcgagtgtgtgctggacctgtggcctgctttcaacaagagaatatggcaaacttgatggggttatcactcccctgactacgttatgttatatcacaaaggttgggggattttgcagattttgttcgagcccctatagagttaataaaaaggaatatatatactgcatgggtctgacctaatcaggccctttaaaaagcatctttctctctctctctgtctctctctctctctccccccacctccccacctccccaacacacacacatagagagagcgagagagagagaactaggccaagagcccaatgagcagaggtagaagtcagagactgcaggcagcaattactctctctccattgctggtttggaggaagcaggccaccatgacttctacagctgcaaggagatgaactgtgcccataacctgaagaagctaggaagtggatcgttcctctcagagccttcacataagaatgccacctggttgacatcttcatttcagccttgtgagaccctaaacagaggacataaactgtccccagactcctgacctcctgactcacaaaaactgtgaagtaataaatgggtgtttttttaagtcactaaaaagtttgtagtaatttgttctgcagcaataggatactatacatacatacatttatacacacatgtaatatatatgttatatacattaacatgtcaatgtagaaaatgatatacatgtatctatatgtgtatgttccttaagtttatcctccttaagaaaatcaagtccttttttcatccacaaatgcctgtgaatgtgacaatgtatgtctatgtatgtgtgtttctttttttttttttttttttttttttgagacagagtctcactctgtctcccaggctggagtgcagtggcgcgatcttgggtcactgcaaccactccctcctgggtgcaagcaattctctgcctcagcctcccaagtagctgggattacaggcacccaccaccacacccggctaatttttttgtatttttagtagagacggggtttcaccatcttggccaggctggtcttgaactcctgaccttgtgatccacctgcctcggcctcccaaagtgctgggattacaggcgtgaaccacccgcacctggcctgtatatgtgtttctttaggctataattgaaaacagaatattgctactttgactttactgatggctagtataagatgaggtcatttcttagttataaaattaggaatttacctattaaacagaagaaattcaattgtgtttcatatatgtacttgtttctgtgtaagaaatcgattatgtttcttcctatgtatgttcgtatgcgtgtgtgagtgcatttataacaagcatcctcaatgcttaggagggttctcaaccagccaatttctcacattacctcaactgagaacagatagctgcagcaataaaagaatatactcagatctcggtgggtatcttagagacatccctgatgaaatctcacaatgactctgggatagctaccctgggctcccttttcagaagggccaccgtccatcagcatggtgggggatcactatggccattgactaacagagacagcagcaatctcatattctgcttttggaattctcttgacatgctaattccatattatcaaatatatcacgggtatcatttagacttttctgtacaatgtgttccagtcaccactccgacttttgctttcaattatttcccaaagatttgaaataacagataaacttaattttcatttatatgcctttctctactgcctacttccttttatttgtcaaatgtatgataactctttaaaattaaaaaaatacatattttacaagtaaaatctgcatgaatcaaccttgagttttataattaggtgcaatcatgatttaatgtgtttagattctagacaacttctcaatcatcctaaagagatacacattagccttatacggagacagaaacagagaaagaaggcctgcaaatctcttacgcatttatttttataaacatatattataaacttactatgtatctgaggcaccgtggtggggtgtatagtctatgacctcaaggctaccatgttgtcatggaagaggcagactggcagagcaatgatgcaattacaaataagagctgatgtgcaaaaggctgatggagatctggagggagcagtgcggaaagtgacttgctgggcagtaggaaagatttcactctatttttgtagcacaaacacaaaatcaccccaattcctggggtaaaaattatttatgttgcattttaggtaaaccaatagtattcttaacagtctttaatttctgttttcttctttaaactctactgcatccaagcctacagaggactcaatagtagaagcaataatatcatcattttaggatagtgagacgtgattggtgataggagtaatctaattagacaagcaaaacactctggagtcatttaatatttcagtgtaggagctatcagtcctataaactttaatcatcaggaaaaaaattattgctttgctgcacactttgtgataatagccatgagtcattaaagtaaggttcaattatgttcattatgttctatttaaaacggaaagaaacataccatatttagaaatctttctgtccaatgagttatctttaaatactacctaaataggtgaccgtttcaaaatttcattcatcaaatatgtcatttgttcataatgttggaaaaataaaatgccaacatactaaaaaaaaatcacattacatttaaatagttgatagtggtctctaaagttttttcctaatttctcagcataattccataaggcagacattgtttccattgtgccactgaagcaactgacacagtcacttaaccttagtcatgtaagtcacccagttcttttaactcctataaatgctctttcatttatccatctattaattcaatagactcatttattgagcattcatatgacccacgtttcataaaataaaatggcagacagtttaggtaatcctgtaaatctacaattataacatgattcaaaatttttctggaggtggattttctagtaacaagtgattcctagaggactttaactcactttacaatgaaatactacctgccatttaattacaccagggaatacttcgggtattttgagagatagatggattaagtcggtaccctatccgtgagtgacacaggtccacgaatgggaagaactccagctttctctgtatgttcctcacataaccagatactttaaatgactttgtaattttttgttcatctctcagttcagcaggtgaaaaaacaaaacaaaacaaaaaaatcaaatcagtcagagctaacgcatcctgtggagaaacaaaaggactgactctgtttctttcttcaatgggctgtttgatattgtgtagatttagtgtctgtgctcttcttaaaaaattccacttaacgacccaaaaagaagagcattactttcacaatttaataaatggaaaactgtggaatagaaaggttaagtgagctgattatgctcagacaagtccttagcaacatagcatttctctgccagagattacatgagaagctgcctttccatgattcccattgtttatgcagtcattctgtgttgtcaaggcactttttgatttttgtcttctgtttcctaattctgccaagttattctttttttaaaaaaggcacagcacacgtggcaatctaaaatccagagtttttcttggcatcactgattatgcttttggatgaatgaacacaccgacttggatgaggaaaatgcaaaagaaaaatagtaaaatagtaaaataagagaagtattatgttcaatatttgaaataattacagtcactcaggaaaaaaataagagcatcttaaaatccattagctaacaggactaggagggcaaagaacagcatgaaacagctattggaatttataccttttttttaaactcacagactaaaccaagataccattcatagtttaaggctagggggatagcaaattggcctcacattagaaagaattgtccaggctttgaattgatagcccaaagacaaaacaaatctggctgtgtgtctaaagtcagccttgattttgatgtcagttaatttgcttgtgactttgaaaactttaaattgttgccatctttaacccttgagaaatgagtcatctgtttctgtaaagtagaaaaggacaaaatcagcaagaaagaaaattttattttcaaagttcaaagagaatgcaataagtagtggagatgatttaccagtaactgtgctattgtttttctcaagagtttgaaatactctcttaaggaacacaaaaagcaaacaattttaagaataattgtagaagtcaggttttctttctctcaaatttttgcaacaagagaaagccgaggaatttgcttggcataactataaaggaaagcatagagcagctattgcaattttttttaaagacatgattagaccaccttggtatcttcaatacagtttccaaattattttccttgtaataaataattcatgatcagtattattatcctaatttttcaggtgcataaactgaggcccataggtttttatatcgctcaacaaagtgactggtttccaaggtgaaggtctaggatctgagccctactctgtgactctgtgaactccatcctctgacctctactctagctcacttcttccagtgaatcttcatactttgattgcctgcattgtactttcttttcctatacaaataaagatggcttgcctgtcttactcaggtcatggagttgttataaatatcaaatatcacaatgtatgtaaacatggtttaggaatttaatagtgaagagtttttattttaatgcatatagaaagcatgattgattagtctgaaactggttgtttggatttagagcagctattttagtggtaatctgaaaactacctgccaaacacggtggctcatacctgtaatcctacaattttgggagatcaaggcaggaggattacttgagcccaggagttcaagaccagcctgtgcaacacagtgagaccctggtctttacaaaaaacaattagctgggcatggtgctgtgtgtctgtagtcccagctactcaggaagctgaggcaagaggatcacttgagcctaggaatttgaggctgcaatcagccatgatagcaccattgtactctagcctgggcaaggagcaagaccttgtctctaaaataaaaaataaaaagaaaattactaacctttgcttcctgcccctaccaccacttactaccctcccatagtcaagctggagaattccagagatttatagtaaatcttccccatattcccattcttccaggacacactcagctaccacacctacccatactttacctggaagaaggatgagtgtgaaagcaccattcatgcttctgattgcattttaacctaacactcatgatatacagagtttgaccagtcaaagatgcaaatcattcccaaatgtgctgggttcctgtgtttaatgagaattataggacttgctatccaccttgaggtctgctggagataaaccaaagaaaaatatgagcaacagctctttttcatgaataggttgaaaacttgcccaataattcttagcagttctaggacaagacccaattttctacttgcagccttgtttgaggtcccaggttgaaaaaattaaaagtcagatactgaagcaccccaccaccttgattcacaaatgcagtttctatgtgttacaaccagaatcaggatgcaagaaacttcaggacaagaaaacttgactttgtccaaagtgtgattttgtcagagattaatgcttctgttcccaataccaagtaagaaattgattggttcagatccacagaatgagaatgaggaggcactgatgctgctgagaactcagtgcattgcatgtcacacctaaagcacacatttatttttaaagatctcaactcaatcattctgtttgccaggcactgggctgtgagctttctatgaagtattttaattaatccttaacaaacactttttatgtgggggctatcattttacacatgaggaaacagctagtggatccaaagctagaacacaccccaacactgggctatttgcaaaaagttagcaaaaagtacgtatctggggacaactgcttccttctcccctatgcctttgtgatcagaaggagtatttctatgagaggtggtcctgtgagtgtatgatgaacacttaaaaacaaactataaagctccttttagtgtgttcagaagcgaaaatgttttctatgtgttactagactccaattcacagaattttgtttttttttttttttttttttttttgagacggagtcccgaactgtcacctgagctggagtgcagtggcgcaatctcggctcactacaacctccgcctcccaggttcaagtgattctcccgcctcagcctcctaagtagctgggattacaggcgcccactaccatgcttggctaattttttgtattttttgtatagacagggtttcactatgttggccaggctggtctcgaatgcctgacctcgtgatccactggccttggcctctcaaagtgctgggattacaggtatgagccactattcctggctcacagaaaatcttagaagggagatatatgagaaaagagaagggatcattgtctcctattacacattggaagctataacattctctagcatttttataacataactgaaagcaaagcttagaagtcagtggtgggagatgagttcgctgctacagtgtaggtacttcagccatcacagatttggatgggacttgtctggttctctgagtgccagcttccttggtcaaggctccatgaatggtctcccaggactccacacatacagaagaggtcaaccactgcagagggaagaccaggctttattccaaggtttatgagttgttgcaggcctcaagatgcttggagactaggaagggaagtggacatctgtgtcaatgccagaatgctagccagaccatgataaataccataagagggcactaggaaaatacaagcattcacagaaaggagtgtgcagagccatggtggagggaaatccaccacagagcagggagaggggcttcagctgtcactcagagttaaacctggaaaaatcagatgtctacgaagactgaactttatttagcgatgggagcagcaatagttggagaggaggaaaaaccattgcaggaaaaaggaacagctacaatcaaacacatcaagacggaatgtatgggacaagtgcagaggcccatttagctaagaagaatagtgaacgaataagaacagctaaacatttaaagagcagtgattctttttgcaagtaatttacatgtagcatcttatttggtctgctataaagtaggtgctatcagtataaggcaagaactatcactatagccactttacaaataggacctcggacttaccacctttctatgagaggaggtcctgtgagtgtatgatgaacacttaagtcaactggctaatctgcctagacagtaacagagcagatgcagcctgctcccaggtcccctttgttattatgacttccttttaagtacaatatgggagataaggttgtgaaggggagttgtggccagaagtcaagagtcctggaacattatcctaagataggatcgagaagcatagaaagccttgaaaatgttcaacaggagttagatatgatcagagctgagctttggaaagaccgaagctatccaggacattattttaaaaactgagttactagtttgcttgcttgcttaagcccccacttcaaggatgaagggaaaagtgctgatagttatttctgggtcagtgtcttctgagccagaatcctcaagtgcatttccccactccctctacactcattttagttgcctagaagagtcttacaaagttttctaattggctgaggatcctaaacccggaaacaataaatgaaagtctgagatttgggctcaatcaatgtcacaggaaagaaggcactggggcttatatttttacataaagatgctgcatttggggtagtcaaagctcacacattctgcagtcacccccattacaggaaatggtgggccttggatatggctgactgtaatattaactttatgaggaaacagactctgctctgaagacttatgacctgagggaaagatggacaaacagaagaccaaggcctcatggtgggctcctctgatagcctcctgtgctgctttcctcctcagaaatactgaggttggacgtgaggcactcttcagcaaaaggacatttctgcctttccagcactaaaatggccatgagtaaaattgatatgtcaccgtctcaccaaagtgaaaaactgaagcggactcctaaggccacgcatggagcaaaactgtttatgcaagaagcatttactgagcacctgctgtgtgctctgcttgattgacttggatgagaaccatgaacaatatgaacaagtgccctgccctcaagagtcttacattctagggcaggaggaaagacacctgtaacaatcaagagataataaaatgtctgtgaaagtaaaatcagatcaggtcataaagtaacagagcagtaggctactccacagagcttgccaaggaaggcctccctgaagaggtgatgtgtgagcagacactggagtgacgagaagaagccagcgtgcaaagggccaggcaagcacatctgatggagagagttcagcaagtataaaagcctcaaggcagggaatgtgtttcccatgttcaaggaaaataaggaacaggagcctggagcgtagacagggatggcatgtacaacagaaaatggaagtaaagggggccccactggccagatcatctagggccgtatttataaatttgggttttattgtaaatataagaagccccttgagggttataaacagtgatgcgactagtgatattaatagtattaaaataggactgtgcatgttgagtgcagaatgaatagcacagaagcaaatgtggagacagagagaacactcaattgggtactgcagaagtttaggtgaaaaagcctggtggttttgactaaaggtggcaatggggaggtagaggaatgagcagattcaagatacatttttggagacaaagacaacaagacttcctagttgactgaaagggaggtgggaatggagaaagagagagtgattaaagataattactaggtcttagtcttaagcttaaacaactgattggaaagtgtcatttgctgagtcagggaaaagtggggaggaaaaggagggtcgagaagaatccagaggtccaactgagttgccttatgtttgagatgcttactggtaaaaagacagatatgtgaattaggtagttggatacataagtcaggagtctaggacaggaaaggcacagtggctcattcctgtaagcccagcactttggaaggccaaggcaggaggtttgctcgaggccaggagttcaagaaaagcctgggcaatatagtgagaccctgtctctacaaaaaagatagaaaaaaaattagttgggtgcagtgacaggcatctgtagtcccagctatttgagagactgaggtaggaggataacttgagcccaggcatttgagattgcaataagctaggatggtgccactgcactccagcctgggcaacaaagcaagaccctgtctctaaaaaaatgaaaaagtaaaaaagaaaaaagaaaaagaaaagattctaggagacagttgagatcgctgagggttagagacataaatttgggaatcgtaaaaatttggatgcatttgaagccatagaaccagctgtgatcactcagggagagattaaacatagagaaacaaccagggcccaagagtaaacccagggagttcattcagcacctgtaggttcgtagaaggtgaacagtcagcaaggaccaagaaagtagaaggaaaaccaaaagggtacaagaacacagaagccaagaaaagaaagtgttgtttcaggaaggaggacatggtcaacaggatagagagagtgattaaagccaattactaggtgacatgttgcctaagataaaggcagttttgagctccttcaaaggtatctgtttcctttgttttgatattgtttccaaaaactacatatcaggtttgatacgataccagaatgcagttaaaatgtaatcagtttatttactcaagatgtgtgggattatagaaacattttatcaattaccatttccatttataacttgtgcatcagttatagatcctattgtaagattgatatgcagccaaactgtgctatatactttcagtgttcactgtgtaagatactaaagggcttattacactgtagcccagcctaaagacacatgctaattatcttccatcatggtgcctgcactggctgtacttctactgaattgtaagctctatcatggtgggcacgtgcctgatatgttcaatcaaacaatagtttaatgtttagtatgtttgtttgtttgttttgagacagagtctcactctgtggcccagattggagtgcagtggcacaatatcgactacctacaacctccacctcccgggttcaagcaattctcctgcttcagccttccaagtaactgggattacaggcatgcaccaccatgcccagctaatttttttgtgcattttaaatagagacggggtttcaccatgttggccaggctggtctcgaactcctgacctcaagtgatccttccgcctcggcccccaaagtgctgggattccaggtgtgagccaccaggcagattttttaaactttggctgataaagtgatttaatcattaatcagtcagtgttaagagattagccctcccattggacatgctgaaaacaggcagctggcgactaagtgaagtctcacaggcagaacatctccactaaatcacagtctagctccaaggaccccttgttattcataatatttactgcatatttagtccccacaagctcatgattaattactgcacagattcggatggacaacatgtgacctacagtttccctctgcacagtaattgtagagggaaatgtaataatacccagtcagtctaaaaagcctattagtccaattctccacaaaattccatgaaaatataacatcacagcctgttgacttccaagaaatagtttaccaagagttgccataaacattagtacattttagttttagtgatagggtacttggcaaatatacataaaatcatacacacatgaggcactttgataggcactgaaaaataaaagacatacttcctgatcttaaagagtcctaaaatctagttgggtagatgcttttcataacatgaaaagctaactaatagttagacattgaaatgagaaaaacgaaatgttatgaggttctatagaattgacagctattgatgtgggccaggtatgagatggatatgaatcttcagtggaatctctgataaacacagaaagtgggccgggcgcggtggctcacacctgtcatcccagcactttgggaagccgaggcaggcggatcacgaggtcagatcgagaccatcatggttaacacagtgaaaccctgtctctctctactaaaaatacaaaaaattagccgggcctggtggcgggtgcctgtagtctcagctactcgggaggctgaggcaggagaatggcgtgaacccgggaggcggagattgcagtgagctgagatggcgccactgcactccagcctgggcaacagagcgagactccatctcaaaaaaaaccaaaaaaacaaaacaacaacaacaacaaaaaacacagaaagtgaaggataaacagagtaacataaagtatgtgtgtgttttgttcttcctcaaaataaaaaattatcagtcctagactattttatgtgagaaacccaccttgacacctgtttctcattgtatggcaactacaaagaagtataatgctgaacagtgcatctctagagaacagcttccatgtgggacagtgtttccaaacagagaatacattttctatccctgtaattactcttctattataataagatgtcctttgacacacagaatggcgttgtagaggagcactagatcaagagtcaaagggtttcagaactcctgactctgctgtgaatttgatgtgtgtccttgccatggataggacagcagcgcacgggagtcaagagctctccagacatacctgtcattcactatttgtgtgattgtaggcaaggcatttcagctttctcagactttatttcatcatctataaattgggaagaacagtgtctccggaaactccaatgcatgttagtaagtgaaggaagccaatccaaaaaggctacctactgtatgattccaactacataacattctggataaaggcaaaaatatggagacaataaaatgattagtggttgtcaggggttagaggagagggatggatgaatcggcagagcacagaggatttttaaggcaatgaaactacctcgtatgattctataacggtggacacacgtcagtgtaaatttgcccaaactatagaatgtacaacaccaagagggaaccctaatgtaaaccatggaccttgggtgataatgatgcctctatgtaggttcattaattgaaaaaagtgtacctctctggtggagtatgttgctaatgggggagattatgtacatatacggatacggggtataggagaagtctttatagcttctcctgaattttatcgtgatcttaaaattgctctaaaaaataaaatacatttaaaacaatcataaaagaacagtacttcggccatagagtagtaataattaaatgcgataaatatgtaaaggacagcacagagcttcctaaatagtcaatgttcaataaatgccagctattactctgatcctgtttcttagcatacagcagatcaaaagctgctgactggaattaaaggtcagagctgctagaagttatactgatggtggccagatgttacaggaggatacagaagaatgctaggaaggaagcatcagaactcaggaaacatttcttccaaggctatacagggagggagcaaataatggtctctttgttttttgttttagacactgggtctggctctgtcactggggctggagtgcagtggcatgattatgactcactgcaacctccacctcctgggctctaacaatcctcccacctcagcctcccaagtagctgggactacaggtgcaaaccactatgctgagctaatttttaaaatttttctgtagagacagggtcttgctttgttgcccaggctagtctcaaattcctggcatcaaacaatcctcctgccccccaaagtgctggaattacagatgtgagccattcctggcctgctctctatcttaacagatcaggaagcatcagtaccgtgcagagtcacaacctatagcattgtgatgtaagaaaagcaggaacatttgcctaagaagggctgggttggaattcttgctctctgttggtcccgtgctaattctgggtccttgactaagtccattcacgtccctgaactggatccctgccatcaccatgcgcaataggcacagctcagctactgtccgctctacctcagcagacaggactaggacctttctggcccagcccatcttgttgtaaataacaaagcatgccccataggactccaaagaataaaaaatcatactccatttgtcacagctgtgataatcactcacttttgctctaaaaatggagacagtatgcacctcaccaggcaactgagagaattgaatgaagtcatggcttacaaagcatttgggacacacaacccccagctccgtcaatgttagtgtggctatgaatgttttctaaatgataattcacacgctcaggtgccagcatagagctatacttgctactattctgacctgggtattgtgcctccgttttgaaaattgagtattcatcccgttcctgagccttagtttttccaggtcttatgaactggcttcttcctaacccggcatctcacgctttttttttttttttttttgagacagagtctcgctctgtcaccaggctggagtgcagtgatgtgatctcggctcagtgcaacctccgccttgcgggttccagtgattctcctgcctcagcctcccgagtagctgggattacaggcacatgctaccataccgggttaatttttcggtttttgtttgtttgtttgtttgtttgttttagtagagacagggtttcaccatgttggccaggctggtctcaaactcctgacctcaggtgatccacccgcctcagcctcccaaacgtttttctttttttttttttcttaaagaaagaatggaaaaatgcatacataccgtgctctggtccacatttatttgctttcattttggtaatcctctgggtcctgctgtgtgcttgctagtcccttatccagagcctgaagcccagactcagaacacagtctgctggctgggttcttctcctcattagagatcgcccaaataccactctcattgcttggacatacaagtagaccatgtcccacctctcaatccttgaacttcgttcatgtggtaagataccctattacactatttcttctgaaaatttccattactaattgtttccccgcataaatgattgcagtatgatttggttgcgtgcctatctatggcactcaattcccactatcagcacctgcaaaaggctcagctcagtcaccacgtgctccatctgaataggcaggactagaacctttctggcctggcccatactattgcaaataactaaacaggccctgtagatacccaaagtacaataaatcatgctctgtctcgcagctgacatttcccctggaattcaacagtctagatatatcaagtagatgggtgggtcaggtctacaagaagtctatctacatacacatggtattgaaaagtctcctgtgcggaaaagtcactctcagagaaaaaggagtcaaactgggtcaagtacaaaacttatactatagagaagagacatgcttctatgagttcaaatctgttttccagtctaggcctcccacatattcccacctgaattctagtaagagagtaagagaaagaggctctatgtagtaaaacagtggaatgcactgtagggccacatgggaaacatttggaaaagtaaacagtaaggagagaggggtattccctctacttctgtaccgccttggcacacgaaggacatcagagaacctggcatctcttaggcattcaaagcacattggtggcattatcgtcaggaaagagacagcagcagctaaaggaagtgacagcaacaccctgttgggcagatggacagaacaggagtcgatgggagtcagaactaccctctgagagtagctcacctgtggatcctggaagcaaaggcgaggcattttcatgcaactttgcacccatcaacaacagagaaaggaagcttataccaggaaaagtagagaaataatgaatgtcatttattcagtgactggattattattgcactcagtgataataaacatcctgcctaattgatcagcagaaaaaaaaatgtattgagtgaagtagtctagggatcatgactccacaattattcattgagctcaagagccaataaaaacatgattacctagccactctgttgacgacagcagaaaaattatattcatgtattcatctattcatcatttaaaaataacctgtaagtacctaaccacacatcaggttggtatgacaaacaatgtggaaacagatgattaagttattctccaaaggcatctcataggtaatgatatgcaggttgagcatccctaatttgaaattcccaaatcggaaatgctccaaaatccaaaactttttgagtgctgacatgaggacacaagtagaaggttccactttatttcctgtttcacacataagtacttaacacaaactttgtttcataaggatgtaacacaaacttcatttccatttatttaaaatattgtataaaattattttctggctatgtgggtaaggtgtatacaaaacatcaacaaattttgtgtttggatttaggccccatcccccaagaaatctcattatgaacgtgcaaacattccaaaatccaaaaaaaaaccccgaattcaaaacacttttggtctgaagcattttggataacagataggcaacctgtacaatagaatttcaggttccatgacagaaatatatttgaagagctataaaagcttgaattaatctactgaggaaaacagcagttcatagaagtttgactgaggaagtaacctttgaattggacattcttaagcagaatgaaggcaaaagaaaatattatggaagtggacttttgcaggaggtaatattctaaagtatgtccacaacagaaaaatcaggtaaagtttattcttgtacattccttaaatcatccatgaaatatacatgaatttgtgtgtataaccttatagcatttttaacattaaactttgagaaccactagtcaggtctaaggacatcacaagaaactgtccacatggtctacgtataaagatcattctgcttttaagataacttcttaacaagaaataaacagaaatttctattgtttctatttgtctgaagggtttactctattttattttaatatgaaatctctatgaccacctaacaacagaggttcaaaattcatgaagcaaaaactgatagaactgaaaagagaaatagaaaaatccaaagtgatgactggagatttcaatttcaaccacaatttctctgcagttaatagaacaaataaaaaataggtaaggatatagaagacatgaacaacagtaccaatcaagtggatctaatgtctatagaatattctactcaacaagaacagaatatacatttttttcaagtgcttttagaactttcaccaaattagaccgtattctgagctataaaacaaactttaacaaatcatgaaaactaaaaatcatactaattatgtttcctgcctgaaagatcaaaatagagctcaattacagaacaatagctggaaggtcctcaaatgttgtgaaatttaaaaacatgtttctaaataaccataagccaaagaagaagtaatgaaaaaattagaaaatattttgaattaaataaacacaaaaccacaacatattaagtattgtggtatgcattcaagacacagcttaaatgaaaattaataccaccaaatgcctaaatttttaaaagagcatctaagtttccatcttaataaactagagaaagaaaaacaaattaaacccaaaacaaacagaaggaaagaaataacgaagttaactgaagatatcagtaaaattgaaagcaagaaaacaaacaaaaccaacgggaaaatcaaaatctggttctgagaaacaaatgaataaaactgacaaatttctagccagattgaccaagataaacagagagaagttacaaattatcaatatcagggaaaaaatgggaaacatcacaaagacagcatcaatatttaaggaataataaaggaatgtcacaaactagatacttaaccacactctgactcactcaaaaacattttatgctcactcaaaaacctgcttatgaaagtttatagaggatttattcataatttcccaaatctgaaaacaatccaaatatccttcacctggcaaacagataaacaaatactggtacattcataaagtaacatagtttcacattttgattaagtccaatttatcaactgatgcaaaagaccacaagaaacaacatctaagattgttttttttctagcatttttacctgattgctatggctcttcttcaaacttcttttccctcaaattacatttcctaaccatatatatatatattttttttttttttttttgagacggagttttgctcttgttgccaggctggactgcaatggtgtgatctcggctcaccacaacctccgcctcccaggttcaaacaattctcctgcctcagcctcccaagtagctgggattacaggcatgcaccactacacccggctaattttttttttatttttagtagagacggggtttctccatgttggtcaggctggtctcgaactcccaaactcaggtgatccacctacctcggcctcccaaagtgctgagattacaggcgtgagccaccgcgcccggccatctaacataattcttatccagtactagcatatggctatgacaatggattcaatgttggataagacagaaatgtaagcagatgatgggtcttgaggtcttttgcgtcaactgttcatttgccaagtaacatgattcactcatattattctcatagaaacttaagctcccttaataacaaatcctacatacttctccagaatgccaaacgagaatagattttctagtttagaaatgagaaaattgtgacaatttttgaagtactgaaaaggttataatcagaggaaaggacccagtataaacctctgtgatttttttttaaagaaggcaaaaaaggaaaggcagatgttgtgaaggagtgaaaagagaaaaagggagagtgtagtgttacataaaatctcaatttaggctgaacatccaccaagattctactggaaatcaagcattttactctcatttcatttccctaggaatcctgtgaagtaggtaatagctctccatttatagatgaggaaaattcagtttagagtgataaatgacttattcaatgctacattgctagttaagtgaaggaggtaagatttacactaagaattagagattatacactttttttcaagtgccacttttgggagaaaaaatgattaaatatcagtataaaagtattattttgaggaaagaaggctccttaaaaaggtactccagttgtttggaataattgcagtctcgtttcagtctcagctctatatgcagtacagctcaataaagctctaatatgcagtacagctcaataaaggtggaatgccaaagttctcatcttttagcctcatggctgttgtcccacttaagggacacagaatggctttataaagaaattaacattaaccaagtatatactgccacttatctctcttgcctcatttctcaataaagaaacctgaaagttactttctatggctagcttcaccttgaagcatgtttgttttatctaataaaggaactgtttagcttaattccattactgattttggtgtcagatcacacgatataagctaacaaagatctacttcactgattgcattgcaacattatctgaaaataaaagtggggtaggaagggaaggagaagggagagatgaagagaggatggtaaatgggtacaaacataaaactaaatagaaggaataagttgtagtgtcagcagagtagggtaatgatagttaaaaataatttactgtatatttcaaaatatctagaagatatttaatgttcccaacacaaagaaatgataaatgttttgggagatggatatccaaattaccataacttgatcattacacattgtatgcatgccatcaaaataccacaggtaccccataaatatatacaattattatgtgtcaataatgaaaaaaagttagagttttatataacttctattatagtccttttcttttatcctcacacacacacacacacacacacacacaaaaagagacagaccttaaacaattatacagaaagttgtctacaaggatgttaagagtaataaccaatctactttttaaatagttgagtgggttttcagaaaaaaaagtattcaataaacaggaaatatgtgcaagaataaaaagagaaccttaattataattatgtatttcttttcagcagagtgttaaactctggtaatagaaaaaatatatttttttcttttaatccatggacattttatttacaaaatcttatgatcataggtttattaatgatcctcagacgttttactacaaaaaatgcttgagattataaaccacgacagaaacaaataaaaccacctcatgatagtcttggaacactaagaaaaagtcctaagactaatattaattgacttctatggtcaatggttctctgacattattgtgtgaccttaggtagtaaattagccactccacaaatttgtttacttatttaggaagagaagtagtaagaattcctttcctattaccacctcaaataattattgccaaattatatgaggaaatacacaccaaaatactttgaaggcttcgaaattcagcagaacttcaaactatcaaccaaacaatatacgagtgctccagttcctctacattctcaccaacatttggtgttgtcacttttgaatttttttttgagacagggtctcactctgttgctcaggctggtgttcagtggtgcagtcatagctcactgtggtctcaaattcctgggctcaagcgatcctcccacctcagcctcccaagtaactgggactccagacacatgccaccacacctagctaattttatttatttgtttatttttttgtacagacaagagtctcgctacattgcccaggctgaactatttttattttactgttctgataggtaggtatgtagtgatatatcattgtgattttaattgttatttccctaggtgttggacatctttttatgtgcttatttgctatctgtataactttggtaaaatgtttatttatatctttgcccttggtctaattgtttgcattcttactgttgtgttagaagttctatagtctatattctagatactagtcctttgttagatatggggtttaccattattttcttccggtctctagcttggcttttcatccttacttaacaaagtctttcacagggcaaaaggttttaattttgataaagtccaatttattcactttttcttttataaatcatgctttcggtatcaagtcttagagctatttgcctaggactagattctgaatattttttgctttttctttacactttttataaagttttacattttacatttaagtccatgctccattttgagttaatatatttaaagtttgtacaaggtgtgagacttgaggttcatttattttagtctatggacatttaatcgctctagtatcatttgttgaaaggtgatgtttccttcattgaattgcttttgaatctttgtccaaaaaatcaattggtcaggctgggcgcggtggctcacgtctgtaatcccagcactttgggaggccaaggcgggcggatcacaaggtcaggagatcgagcccacggtgaaaccccgtctctactaaaaatacaaaaatttagccgggcgcggtggtgggcacctgtagtcccagctactcgggaggctgaggcaggagaatggcgtgaacctgggaggcggagcttgcagtgagccgagatggcgccactgcactccagcctgggcgacagagcagactccgtctcaaaaaaaaaaatcaactggtcctatctgtatgggtatacttccacaccatctattgtgttccaaactatctattctgattgctagtggatttatgtgtctgttccactgataatcttgatactatagtgacatagtaagtcttgaaatgaggcagatttatttttatcacattatttttcttttcaaaattgttttagctattttagttcctttgaattttcatatgaattttaaaataatctcaatatttataaaaattttgctcatattttgataagaattatgttaaatctgtatgtcagtttgtgaagaactgagactttactatgtcgagttttccaatcagtaaaaattgcatttatgtccattaatttacattttgtgtgcttcctttgattagtactgtagttttcagcacacaagctctgtacattttgtaagatttacacctaaatatttactttaaaatgtttctgattattgtaaatggtgttataatttaaattttgattttcatgtgttcattgctatgataaatacaacagatttttgtatgtttatcttctatcttatgaatttgctgaacttatttatcagttctgtggatgtttttgtagatttttttcattttctatatagacaattattccatctgaaaatggtgactgttttttttccttcctggtttgtatgccttcccccagccccatcttattgcattagcaataccttccagcactatgttgaataaaagtggtggaacctgtttctaattgaagggaaaaagctttcaggttctagccattaagtgtaatgttagctgtagttttcttgcagaggggatagatgttctttatcacgttgtgaaaattctccgctattgccattttttttttttgcgacggagtcttgctctgtcgccaggctggagtgcagtggtgcgatcttggctcactgcaacctccgcctcctgggtttatgccattctcctgcctcagcctcccaagtagctgggactacaggtgcacgccaccacattcagctaatttttgtatttttggtagagatgggatttcaccatgttggccaggatggtctcgatctcttgaccttgtgatccaccctccttagcctcccaaagggagggattacaggagtgagccaccgtgcccggcctccactattgttatttttatgagaatttttttatcataaatgagtatttaatttttttaaatgctttttctgaattagttgatatgatcatgtgagcctttttttctttagcctgttaatacaattaaacacattgactgattttcaaacaatgaatcatccttgcatttctagaagaaatcccactttgattatgatgtataactctttatatgttgctgaattctatgtgctaatattttgttaaagacatttttatttatatttaggagatacatcgctctttagtttccttttttgaactgcctttggttttggttcaaggtaatactacttcataaaatgatttgagaggtatcttctactcttttgtctggaagagattgtgaattggtgttaatttttctttaagcttttggttgaattctctggtgaaatcatctggacctagatatttctttttggggagttttagattataaatttaagttccttaatagtcatagggccattcaaattctcgatttcatgttggtttacttgtaatttgtttggaattggcctgcttcatctaagttgtcaaattcatgtgtatagagttgttcatatgcgggcaggggtgcctcactaccatctaacagagatgtaaattcaggctccttcctgggctgcctctgttatcacccaggtgagggtgtttggtctcaacagagcctcacaaaggtcaaagtctacgttttctactcaggctttgctaacatgagcagaggcggggccaaacttctttctgtggtgtttggctggaatagaaaggttattatctaaaagctccatatcttgccagcctggccctttcctgatcatttggctagagaaaacaggtgtgtgtgtgtgtgtgtgtgtgtgtgtgtgtgtgtgtgtgtgtgtgttttgctttgattttgatttggcttggttttattttctgtctgcacgtgtgtgtgtgtgtgtgtgtgtgtgtgtgtgtgtttggtttgctttgattttgatttggcttggttttattttctgtctgcacctgtccgcatttccaggattctagttctttagcattaagaactcactgccatgtggtttttcaggtcccaaaggccccagctcaaatgtttcttttctccacttttcagagtcctttatgtatattttatgtataatgttcagaatttttacttagtgggatgaaaaggcaaagaatgcctacttcagcttctagaaacagaagtcatccaggatttagttttaaatgaattggtcaagatgaatttctggtacataaaataggcctagtcaaaacatgaataatttatccatgaaacaaattccttttcgtgacatttttccttggtgggccaatctgctattccccatcagaaaagagcccaggtgagagaagaagaaaatagaagaaaacagaaaatcaggaggactttctctttctcactcctcacttcattcctgcctcactcccaaggcaagttcagagccccacagtaccaagagttcaggaaaatccaagggctgaattcaacatccatctagccagtagagatattttaaaaatcacacatattatactgacttgaaaaaatattttcagcacctactttttaagtactcttatgctaaacacaatggagaaaattaaggtacaaaggcatagcctctttcagaaaatccataaaacctgtatccaaagaactataataatgggcaggttctgaagaatgacatagaatgggccacacatctctaggataggatttaaaatgtcatttaaatataacacaaatgtttgtattgggaactctaaattgtccttgtctacagccttcttccttccctttcttacaacctataagatcagacttaagtaaactcctaagctaattttgaatcatttgtcctccctaagcccataatcacatggctaagccaagaattattcaaacctaattctcccgcaagacctcatccattgctcactgctcctgaagatggtcttgagtatccccctggatctgggcctcagactgtctttgccactctcctgtgttaccacatggagttggtccccgccatgtttggtcaggtctcttagaatgataacttctaacatcatggatcctgaaaattagctaatgtgatttccaactactgtgtctcatctagctgatattatcaatcaattcatcctgcctgaatttataacaccacatttggatatagtgtttagttgcttaacatatgttcaataagcataaattaaatacatatagacaaatggtctagagcagtcttcatcatgcttctccggaaggatctagagtacttatacaatttgagaagattgagtttcataccaagtagggacagggtctggaaacaggcagtacacaaacacttgaatgtatgttaagactgagacttctgctacagaaagtcagaggaaagaatgtgactttcaggtgagatcagcaaagaaggattccctctgccacaaaataacaccttctttcccagaaactcagatttcctttgatataattcactattaattttcactctaggagatgaagcatctgaatgaatgttcctggaatatgcttggaacatgggaataaatcatgctagttgatatggaagacaaacacaacactccagcaatactctcttaggaattccctcatcaccatttaaattgttgattttctgctcttctgtagaaatctctagttctggatgaacataagcactgtctatattcgttagacagcacaatacatattagtctttaatttatttcacctacaccaaacctaaattttttcttcttctaactttatgtcctaattttctttacttaattttgtctacatttttgtcatcattttctcttagatttttgttcagctttccttgaaacccaataaaagcaaaaattatattgagaaaagacaaaatttcacatcccatattctacagcttgctacctctgggcaccaatggacattcaactgaaatataattttttaaagaattttatcagtataatagactcttggacttgaattatgaagcctaacaactggtgctaaatcagatgaaattgtgaagaaatgtctgcagtgtagctctaactaaaagctatattctaacaagtcggcgatggagcctccaactttctcatgcctctggatggaatttattccctaaactcagtaaagccactgactttcagaaaatgaataatctaaaaaaactgcaaaggcaaggcttttgttctttaaaaaaagaaatgaagctaacttctgcttatggcaatggagatcagtttattttgcaccaatttcctactgaaaataactataaaggctgaacaaaatgtccaaaacccatctgtttgaagtcatcagagagccatcaaggtaaagaggggcttcagggcaaataatctgacagaggcaagccaagagatgttcaccccccaaagcagttactaaaggcttggaggttgacaggagtatttaaaagtcgcactgagaaggacaacacaaatttgagtttagtgccttccaggaatgaaaaatccttggataaagacttaggatatcactctgcaatctacagggcttcaccctgcaagtgagtgtaaacagaaaatagaacaagccttataaaggtttaagaaaagttttaggtcagctcaagtcctaaaggattaaggtgattggcatctcacttagctgcctggtagaagcaagttgaagtcccacctggagaaaaacattcactgaagcctcaaaatgccttgcaagttttcatctaaaatgtatgacactcaatgaaaaattaatagcatattaaatagatttgaccagcggggcgtggtagctcacgcctgtaatgccagcactttggaaagctcaggtgggcggatcacctgaggtcaggagttcgagaccagcctggccaatgtggtgaaaccccgtctctactaaaaatacaaaaattagctgggcatggtggcgggcacctgtaatcccagctactcaggaagctgaggcagaagaatcactcgaacccgggaggcagagggtgcagtgagccgagatcgcgccattgcactccagcctgggtgaaaagagcaagactccatctaaaataaataaataaataaataaataaagatttgaccagctaacaagagggaaagaaaaccagacagtgcaaaattatccatgagaaatgcagttgttgtatttatctgataggacttaagataacagtgattaaaatgtttaaaagattaaataaggcaatacaattcagtgaagaacaaaaaattataaaaacaaagaaaatataaattctagaactgaaattaagaactttacagatagatgtaacaataagacatacaggactattgaaaaaatagtgaattggaagataggtcagaaataaatattgagaacaaaagagggagaaaaaattacagaaaataaagaaaagagcatgcaaaatttatgggacaggtacaatgaaaagatctaatacacatgtaactgaaatttcagtaagacaatgaaaagaaaaatggggcacaagcaatatttgaaaagatagttgctgaggatttttccaaactgatcaaatactttattcaagaaatgctatgagccttaagaagaaagaatacaaagaaaaccacatagctagatgcatcatagttaaatttctgaaaaccaaagtcaaagagaaatcttaaaaaaagaaagagatagagaaaaaagtgtattaacttcaaaggggggacaataagaatgacagctaatagctgacttcttaattgaaacaatggaagccagaagacagtagaaagatatctttagaaaggggtgggggcagaggtcaacctgtaattatgtatcagtattaagtgcaatacaaaaattcacaaaataaaagcattttcacacaaataagaactgaatgcaccagcagcagatgaacagagaaaatactaaaggatattcaagaagaagtaaatttgtactaaaaaatgtgtaaaaaaaaaccccatctgtttgaagtcatcagagagcatggagaaaaacattcatttaagcctcaaaatagcatattaaaaatatttgaccagctaacaagagggaaagaaaaaccagacagtgcacacaaatatccatgagaaatgcagttattgtatttatctgataggaactttaagataacagtgattaaaatatttaaaagattaaataaggtgatacaatttattgaagaacaaaaatttggcgatgcagaaaggaatgaagagtaactaaaaggagtaaatatgtggataaacacaagtgaatattgactataaaacaataatactaaagtcttatggattcttaagtatttagaaaattgtaacacatgagaacataaattagagtatgggtaaatgaggctaaagtgtattctaacttttgcattgagttggtgttggtaaaaatagtaatttatgttagacttgaatttcagggatgtattatatttcataagctagggtaagcactaatacaatggtaaaagaatgtgtatctgaccagctagtactggggagaaagggaaaaataaataatactgaatccatccaaaagaatgtaaaaaaaaaaaaaaaagaacaaataaggaatatgctgggttaattagaaaataaatgtaaagttctagattttaaacttaatatatcaataacattaaatgtaaatggactaaacactccaattaaataacaaacattttcaggctggatttaaaaaataattatatgacacaagagactcaccttaaatataagaatataaaaaagttgaaactaaaaatagaaaatatatataccataaaaatactaatcaaagtatctttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctaatcaaagtatcttaatctcaaagtagatggtatagcaagaagcaccactagagataaagatcactttccataatgatagaacagtcaatccatgaggaagacacattttaaaacttgtgcacagttaataaatagtgtcagaatatacaaaggtaaattattagaagtaaaaggagatatataaaaattcaaaattgtagtgagagatttccatacatatacttattaactgatggaccaggcagaaaaaaacaatcagtaaagagataaaagaccaaaaaaaaaaaaaaagattgcaaacttgatctagttgaaatattcaaaacattactactgtataataatattcttcccaaatgcataatttaccaaaattaaacattatctatctatctatctatctatctgtctacctacctacctacctacctagtttcaaaggtttggaaatgtgaagtatattttccaacctaaatggagttaacctagaaatgggtaagaaaaataagtagaaaatatcatggacttggaacatagactatttttcaataattcatgagcaagagaagaaattacaagagaaatttaaaaatagtttgaaataataatgataatgtaacatctcaatacttgtaaggttcaggtaaagtcatgcttagaaagaaatttatatttaatatatacatgagacaaaggctgaaaaatcaacgattaagcactaaactcaaaaaatcaacaaagagcaaattaaatgcaaataaagtgaaaactagaaaacaataaaaaataagagtggaaatcaatataactgaagcaaacacataatagaagaataactaagaaaaaaggtggttctttgaaaaggctaatatagttgatgataacttgtcaataccctgatcataaaaaaggcagaaaaaaatccataatgaacaatgagattattacagctcacataggcattaaaaaggtaatagaatattttgaatagctgtatgccaatgcatttgaaaattgacataaaatgaacaaatttctgaaaaaacacaagctaactaaactgacacaagaaaacgtatcatttctaaaaatatgaatatttctatatttgtgaaagaaaatacatttataattttaaaacttttcataggaaaatctataacctcagtgttgttactggtaaattttaccaaacacatttggaaaaacaaaataccaatcttacgttaagttctttcaggaaacagaaaaaacgtggaacattttccagctgtttttttgaggttaccataatcttcatatcaaacctgacaaggactttacaagaaaaatcaaacaccaatcattgtcataaacccgtatgcaaaaatattacaaatttgtgctaaccaaatccattaatatagaaaaaagataatatacaaccaaacagcctagttcggtttattccaagaatggaaaattggcataacatgtaaaatcagttaatgtaattcaccatatgaagagaataaaaggaaacaatcatctcaagaaatgtaaaaaaaagaagtcatctgattatttatctgatttatttataataaaagcccttagcaaacaaagaataaaaaaaaaagactttattggccggtctcacgcctgtaatcccagcacttcgggaggccgaggcgggcggatcatgaagtcaagagatcaagaccatcccagccaacatggtgaaacctcatctgtactaaaaaaaatacaaaaattagctgggtgtggtggcatgcctatagtctcagctgcttgggaggctgaggttgcactgagctgagattgcgccactgcactccagcctggtgacagagtgagactgtctcaaaaaaaaaaggactttatttatttagtaaacagtatctagaaataacttccagcaaacattatacagaatggtaaaatattaaaaatttttcctctaaaatcaagaacaaagtaaaaaatgccagtgttacttacatttgacatgtacaagaggtcctagtcaatgcaataaggcaagaaaaagccaaaacatgtgaggattttaatggaatgaatgacagaagtctagtcctcttccctttcaaaataagctgtggcttccagaaaaaaaaaaaaaagagaaaggatgatgggaatgaaaacaacagcagatatctactatgtttctctagatgaaaataaatatagttactctgtttttagctgacaactagtcagtgtcaggatattgatgaacctcagtccgtcaatcagaaaaactactgctatcatcacacagaaggggttagaattcaagctgtactgcctgctagctgtaggacctttgacaggtcatatagcatgtctagcatttagatccttcatctgcaaaatgtgggtggcagaagtacttgcttcctctgcctgtatgaagattaaataaaattatacaatgtaataaccctaacatataaatacaaaataaacgttagatgaattttactgaaattattagtaacaactccaaagccttggttccttcagttaaggcgaccactgaagttaatctcatgtgaaaataaattataccccaaatttaacacaaacaactataacaggtgatctggaactgaaaataataacaaaaaattaatgaagcttacattaatgagatatttaaatattaccttacttttttcaaaaagtgttccttttctctctctttcccatgatttttttaaaaaaagcttttaattgctgcaaaccggcagaaaaatacttatttatatcttaaaggtactgctcaatgaattttcacaaactaaacacgtccatgtaaccaacacccagatcaaattcttcccatgatttgatcattcagaaaatctttgacaaagaggttgacaaactcaagctggagtcagacaacccagatgctaattctggctctaatagggatgcactggttgacttaaattagctccttccctacatcctttgcatcctaatttttctcatgtggaaactaagagcaacacattcccctgcccctccaacctcttgtttcacagtggagttccaggaccataactgcaggcaaccaaaaccgtcttcctaaagctccctctcctttagcttccatgagtctagaccttcctgaatttcatccactgcccccggattattgcttagtttagtttctgttcatctttgaatgaagacatttcccaagattctgttctgcccccaactctcctcagtttctcattaaatttctcactgcactttctcattcaattcctggttagtttcatctgatcacctccatgtccagacttccaagtgcaaaatccaaccctaatttttctccccaactccagtccaagattttcaactacctgctgatatcttcaagtcctgttgatacatcagtcccaatctatcaaaagagaaatcatctttcctccccataccttctccctatgttatattctttactttgattaccacttctggtcacctctgtaagacacctgggaatcatcagctttctctggttcacttgccaaatcttgttaattctaccaccccaatatcctttgaaatgtccctttgtcactatgcctaccccacttctctaattcagttcatctgcctgagggatttcaagagtttcctgactgatctgctactcatggatctaatttctgcaatgcatctttcattctctaatggacttcttttcctaaaggtgtgtcagatcatgaaaatttcctgcctttagtcatcctacataaaagcagaataaagaacaaactccttggcctgtcaacctaaaaggacggttcctttccagaaccatccaccatgaaatagcatcatacaaattacactggagcctcaccagagtgtgcactgttcctgcatttccataaacccatgattttctaactttttgcctcttctgtactcaccaaagtgatatgtatccttaaatttcttccctggccttcacaatcagaataaattagcccttcatttcagaaccaacaccacttttttttaatacatatataagaacttaaaaataaaactacttttgtctactttgtgtcaagcatttgaataggtactttatatgctataattcatttaatcctcattagttgaatcttcacagcaactttacattttagagatgagaaacttggtctaattaaggctgaatggttcacccgaggtcttactaaagtgaagtaaacgtaggagccaggatcagaatccaagactttgggattccaaagtcaattttctttatacttcgcaaaataatttctacagctaattgtttatatgtgtctccctaaaagactgcaagctctcagctgagaatgtgaataatctatttcagcccactacctcaaccctgcaaacacacagacacacacagacacacacacacacacacacacacacacacacacacagagacaccctaattgggttacttccacaacagtttgactctgtaactgttgaggaggtgaatgaataaattatcaaggttcttacattaatacctactcagatcttatgatagatattaatgacaaaagaggtatttctgtacctgtctctgtggaacttgcaaacacagaaaagaacaataacaaaataacatcagttgtagcatttactagtccagaaatagctcacctatgaaacaaacacaattttaattcattttccccatcccctaataggaaaatagttctttctgtgggggccaagggaaaacttccctgtcacactctgaaggttcactgaaaatcactgacaaaaggcagattaacaagagaaaaggcatacaaattcatttggtcatagttttgcatgacacgggagccttcagaatgaagagccaaagagacaggagaaattgtccatttttatgcttagattcaacaaaggatgaacagctgtgttgaaacacgattgggcaaaaagggaatgatctaatggtaacagactgagtggggaagctcagcaacgcctgtctgtttagatttctgggcctctctgaagctttccttccttctgggtatgaggcaggcccctctctggaatgcaggtgttatgacctacagtcaaacaagtcagataagttctttacggctagtttttatacagaagtggggaggagtgtagggggcagttagagtagtatttttaggttttatggctggctttaggggaaaggggttctggcttctatgacccgccttcaggaaggggaattctagtttctatgcctaaccttgggggagagtaagaggccagagacaggagggaacgaggtcagagaaacatgcttctgagtccctcatattgggatatcattttctgagctttaacatttctgtaagaataatgacaactaatttgaggtgcagcactaaaaatagaaggaatctagcagctcttgaggggtccatcctgagttgctttgttctgatcacttagcatgtgatcttgctacctagaaaattattttacctgtggtttttctcattgaaacccaggccataaattccatcctgcactaccttccttccactcgatcacatttgcattttttggctgccacgagacttaccttgagttctgcttctttttttatttttatttttgagatggagtctcgctctgtcaccaggctggagtgcagcagcgtgatctcggctcactgcaacttccacctcccaggttcaagcgattctcctgtctcagcctcccaagtagctgggactacaggtgcccaccaccatgcctggctaatttttgtatttttagtagagacgggtttcactgtgttggtcaggatggtctcgatctcctgaccttgtgatctgcccacctcgggctcccaaagtgctgggattacaggtgtgagccaccgtgcccggcctgagttctgcttctttccaagatagatcctctggttttctgttgattctgtgagcaccaggtactccaaagaatatcatttcaacaaacagttttctgtttaaaccaatcaaagtaagatcctatggcttgaaattaagaatcttgcctgacataatccctgtctcttgataaacacaaacaggcaatcaccaaaccagtgccataactccacaactcaatttttaaaaattaaaatataataaatcccctctcttttcatttattcgttcgttcatggcaggtacatttctagataatgaagatacagttataaattttgatggattttacaattttcatatctttgttattggcaaccaaagggtataacatgcacagtccagacaaggaagttaatcagaaacagtaaaaacttatcttcccgaaatgataacctgaaggtcaaatacaacaggagctactcttgccctttcaaatggccaacaatctgaagatatcaactaaatgccaaatattaccaaaagtaaatactataggagttgcccagtttgttaggtgagagtttaaaggaaactttagaaagaatgagcctgaaatgatgggaggaacacaggtgtgtatagagaaggagggatggaaccatttatggtgaaattttctcagaaatggcacaaagaaaggagctcaagaatcacagtcaacacccaaggaggagggtaattcattggattgaaaggatcccagaggaataaaaagttgtagaagaaaagaccaaactattgcatttgctcaccaagttctagagaattattttatcctctaggtcacagagatgggctgcagggggtggatagataagatgtggtgtgcaagttcttaaaatatgtactgcatatcatacattttaggtgggtattggacaattttcttagtgaataaagaggaaattcatttagcaaaaatcaaaattaaggtaactctagcattctttttcctttctctctgaaaaggtaataattgtgatatctgccaatttataatagaaatgtttaaaaacaaaagaattaaacttagagagttctccttaaaagtcagacaaatttatcaacaaaagagaagaaaccattgtctcaagtgtctttttgttgtttctttattcttcttattttctgcaaaaaaaaaaaagaatgagcctatgaaaagcaatgttaatgatggcacactctggggttttcactaatgttttaaataggctttacatagagcagcaattatgtgagatgatatagttaaacagtatcgataataaaatattccatttgagcacctcaaaatactttggactaattcatattagaacatcttgctatcagaactgttgagtttaaaataatatacacatatgtatatgtatactcatatattatataaacacagttacacaaaagtaaatttatttattaatagattcatccctttttatctatggtcataaaattcaaggatcagtaatagaatccatagatcccctaaattcatttgtgatttttttttttttttttttgagatggagtctcactctgtcaacaggctagagtgcagtggcaccatcctggctcactgcaacctctgcctcctgggttcaagcgattctcctgcctcagcctccagagtagctggaattacaccactatgcacaccacgcccagctaattttttttttttttttcagtagagacggggtttcaccatgttggccaggatggtctcgatctcttgacctcatgatccacccgcctcggcctcccaaagtgctgggattacaggcatgagccactgtaaccgactgcatttgtcatcattttttaacatctttcttattcataaaccaattagctagtgggaaaaaattaattagcatttgtaggatatactttttttttttttgagacagagtcttgttctgttgtctaggctggagtgcactgacacgaccttggctcacttcagcctccaccccccaggttcaagtgattctcctacctcagcctcctgaactacaggcatgcaaccaccacacccagctaatttttgtatttttgtatttttagtagagacagagtttcaccatcttgcccagtccagtctcgaactctagacctcaggtgatccacccacctcagcctcccaaagtgttgggattacaggcgtgagccactgcacctggccaggatatactatcttgattttttcctaatcttaactttaaagatgctcctatgaataatactaataaggtcccaggtaatgagagagaacaaagggtaaagagtcttggtaattcccaggctagacaaatattaatagacctatggagaggtacaagacagctgacttgttagaactgtgcagtttgttactgaagccaaaaatttggcagtaatttctagacagtaatttcgtaagtgttttttttttttacatttatgcccccatgtttaacccactagcaaattcagttgactcagcccccaaaacacacctgagataatctatttctaggcatccccattataatcaccctggtcccatggaccattatttctggcctgaactaatgcaacagcttcttaattggttttgctgttgccattcttacccagttacgatccatttgccccatgacttaaagaatgaactttttttttttttttttgagacagagtttcgctctgtcaccaggctggggtgcagtggcgctcggctcactgcagcctccccttcctgggttcaagctattctcctccctccgtctcctgagtagctgggattacaggtgcccaccaccacacctggttaatttttgtatttttagtaaagatggggtttcaccatgttggccaggatggtatcaatctcttgacctcgtgatctgcccacctcagcctcccaaagaatgaacttttaaatacttaaccagatggcttcattcttcttttaaaagtttctcattgggttcacattgctatcagtaaattaggaacttcttactttggcatacaacgtgagaagatggaactgccatctatgtgcccaatcttattctttgtcacggtctttttcatgtaccatactcccagctgcccttcctcagttcctcaaacacaccaatcccatttcctccttacggcattgggactagctctcacatgatttgaaactctcttcctgctcacctctccatgttaaccctaacttaaatgtcacccccttaggccatgggaacacccaatttaacctaattcttcagccacattacatggctcacctttaattctctccatagcacttagtgctgtctcaatttaccttctttctttctccctccctccctctctctctccttttcttccttctttctctctctggttttttttttttttttttttttttttgagatggagtctcgctctgttgcccaggctggagtgcagtggtgcgatctgggctccctgcaagctccgcctcccgggttcacgccattctcctgcctcagcctcccgagtagctgggactacaggtgcccaccaccacgcccggctaatttttgtatttttagtagagacggggtttcaccgtgttagccaggttggtctcaatctcccgacctcgtgatctgcccgcctcggcctcccaaagtctctttgtttctttctttctctctctctctttctttcccctttcccttctaaagatcaagaattatgcatgctttgttcatcactgtgccaggtatggagtatgcactttaaaatgcatatatatatatgcgtaaatatacagctatgtacatatagtttacattttgatatcatgcagaccgatagctatgaaatctgattattcattcagtgaaggtttactaaacacctatatattccaggcactggaatatgagacagacaagactactgtcttcatgcagcccacatttagctcagggagacagagaactaacaaacaaatgaacaaacaaaagaaaatttcaggctgtaataactgctaggaataaaattaaaaaggtaatatcaaagaaagttataatggacttgttcaaaaagcttcattaaccaaacgcaccaaaagaatcaattgaaatgttcaagtagaagacattttgcaatttttaaatatcttattctccaaaatcttccacacgtttggaagcagttgtccataaactaccttcgaatgaaacatccactaaattactgccactagaaaaagaaaagactggctcaatgctcaagattaaaatgcaggctgacactttctgctttacttgttttggggttgtgtggagaaatgctgacatctttgccttttttctttgagatggaatctccctctgtcacccaggctggagtgcaatggtacgatctccgctcactgcaacctctgctgcccaggttcaagcgattctccttcctcagcctcctgaatagctgggaatacaggcgcccgccactgtgcctggctaatttttgtagttttagtagagatgggagtttcaccatcctggccaggtggtcttgaactcctgaccttgtgatccacctgcctcatcctcccaaagtgctgggattacaggcgtgagccaccgcgcctggaccatctttgccttttttgaaaatagaaagagtagtaattcttgcattgagaatatgacataatcccaaccccaaaccatgagtctcatggccatgtctaagccacgccctgacgatagggttgggatgactacgccaggcttagtaatgcacagggacaggaggcatttcggaaccacaccacgacactgctggcaagaaagatgggaaaacggcagcaattctgtctgctgtgctttgtgtgtgtgttctacctggctgattgaatttcctcccaacacctacctcagatgtgttgtctaggtgaaaataagcacttcaatgagctggtctaattttaatcctcagcccttcccagtcagccccgcccccatgtagttacctccgtcatgacaaagaggaacatcccaggtgcaaatctagcacagtttccctatttcacctgtgtccccctccccatcttcatgccagcatcagaaacaagagtccaaacatcctcggcaacactacagaagctgttcaaacaatccctgtgttctttccaatttgccgacgtggtctggcaaacaaagagatttctttgtttctctaagaaacaaaggtttcgtaagagaaaccttaagagatgataaatacaattaatagagagatagccaggcaaggtaagagaatgcttgactgttttaactgcttatcctgtgctgtaacagcttacctaagagatgtcagagggacggacagaaacctatcagcgctcaggcagaacaggtgctccagtggaggcaaggactgcgcctgcatctgtccatgcagaaactatgttctcatggatacaggctgatgatagtaaattctggtgggctatttactggtggagtgtctgttcccaaagaaaattaattattaaatcagtgtcaacttagagagatgtctctagtggtctgccgcagggcactgtctggggcactgtctgaggcactgtccactctgccacttttaacagtgctttgatggcctggggcacacagatgacacacttatctatgtgtgataacgctcagcctagaggaacacagaatgtattgaataaagggatctgattcagataagtgggcataatggaaatttagcaaggtgatatttaacaaaccgcgagcttaccttaaaaataaaaatgaaatccccatgagaatggatggggagaatgtaataaacattagtacaaataagacttaggagttttaatttaccattaataatagtaattgtaataatgataatagtaggtagcacttatcaagagtttatcatgtaccaagcactgttctaataatttaaaacttatcattagaggctgggcatggtggctcacatctgtaatcccagcactttgggaggctgaggcaggaggatcacttgaacccaggagtttgagaccagcctgggcaacatagcaaaaccatgtaagtatgaaaaattttaaaaattagctgggcagcctggcatgcacctgtagtcccagctactcaggaggctgaggtgggaggattgcttgagcctgggagactgaggctgcagtgagctgtgttcatgccactgcactgcagcgtgggtgtcagagccagaccctgtctccaaaatataaaataataaaataaagaaaattaaaataaaatatattattaactcatttaatcttgacagaatctttagagtaccttattggtatctccattctataggtgaagaacagatgtaaagtaacttaaaatgaatcaataatgtaatgtcattgtcaaaaagtattaatgtgatcttagagaatagggtccagaacatgagaattgataaagcttctctaactgcacttaaattattgtattctgttttgggcaaaatggagccttgaggaaaaaggttagcatgaccaggaatgcaaccatatatatatatattttttctttttgagatggagtctcgccctgttgcccaggctggagtgcagtggtgctatcttggttcactgcaacctctgcctgccaggttcaagtgattctcctgcctcagtctcctgactagctgggcttacaggcttataccactatgccccggtaatttttgtatttttagtagagatggggtttcaccaagttggccaggctggtctcaaactccggacctcgtgatccacccacctcggcctcccaaagtgctgggattacaggcgtgagccaccacgcccggctccaggaatgcaaccatttttaaagaggaacaatgaatagaaaagtctgatggatttatggctaaataacagaaagaagggtagaacatgagagtttgagtgaggacttcaaacccttcgtaaagttcagtttaaatagcatgaaacatatgccctgctgctttggagtgtggccatgaaaataatagcaaacacattccatggaatatttactatgactttcccagattacaaagtacaaggattagatgtggaaaagaataaatagaagctcaataaaaagcaaagctttctagtgggattgctttgtgagatgggaatcatgcctcactgaggatgtgcaggcagtggctgaaatcagatgacacagggcgaagggacctccccggatctctactctgtgagtctataaagaataaactgcagacactattttggtaatagatcaacataagaaaatttaaggctagaggtcaattgtggtaaccaaactaaatgtcctctgaaaaggcctccacctgtacttctaagtgtttccataaaatttagtaaatattggccaggtgtggggctcatgcctgtaatcccagcactttgggaggacgagaaggatggatcacctgaggtggggagttcaaaaccagcctggccaacatggtaaaaccccatctctactaaaaatacaaaaattagctgggtgtggtggcgcttgcctgtaatcccagctactcgggaggctgagtcaggagaatcacttgaacccgggagggggaggttgcagtgagctgagatggcgccattgcactccagaccctgtgtgtttattcactaggctatcccctgcccacccagactccatcatgaaatgaaaggcaggcatagcacaatattagtcagataagagtctcatattatgtgggaaccatgccattttatttctgaaacagcaacttcattgtgaggcttagaaatccctgagctttgtggcaactgaagacctgtcaccgtcaccgtagctggagtagtgagcaacacgaggtggtgggacaaaagccattcctttaagtgtcctctgtacctgacaaaagaggacatcaccaaagacctagcatacagttggtactcataaaggttggctgaattgaggctaattttctagctgcagcaccagtcctgtttataaaaaccggtcaaatcaatcttctacaaggaattgaacttcgagcactttgaagtttctaaatggaagtctgtatgtttcatcaagcttaaaaaacagtccaaggcattgatgtagcaaggcgttatggtgtcatagaaaggaaactggacaaagagttaaaacaaaaacggatttgaatcatggtctgtctcgatgcctcagtttcctaatgtggaaaacaattttatttttcacaagattctaaaaatccaatataattgcgttaggtgaaaagcattctgtgtacggtgacaagttatacaagtataaataatcaatatcattactaacaattacattattattaattgaatgagtgtattcacccattaatcattaccaatccattattacatgtgtattattaatgattattattcaattattatatgtattcatttattatacatgtaataattgagtaataaattattcaattataattaataaataatagttaattattacatgtgtaataattgaatacatgtactaattgagtaataataacaaatacacatgtaataactggatacactgaaggaagtgtattcacttatggtttataaacattccaacatcagatatgtaatatttgcctctttgtcatttagaataatctgtatcactagtcaagtgtttgtatccaaaacccaggaacagggtcgacttcgtgggtgtgtcacctgagaggtgacacacggttccaagcttaaagggccttgtgcttggtttaatgctctgctgtttccatcctgaaattcttattagcgtatgcatttttattttgtgctggacctcataaattatgtagccagtcctgtggtgtgaataaaagctgaatctgaagctgccagggtaggagagttggaggaaaaggtgggcttacaggaggaagctcctagctgtctgcacaggagggtagtactcagttgcatctgactgcagcactgaataagaatctcagggaccttggatatcattcagacccatctctcatttcaattgaagaaatcaagagtcccagattttcggccatttgcccgaggtgcccacctcaccagcagggtgtcctctacattctgtctaatgaatgaatggcctgccctggaacataagtagggcttccgcgttgttgtaggacagctttgtgttccagatcacagatgtctctttcataagccacacctcctcccactgctgtgtgggccacagctccggttagatgataactctttgactttttctcaaagtccctgaaatcagtcacagagaaaatggactgatcctttacatcaatctgagtgtccttgtgcgtgtgtttcattttgctttctattcatcctcaatgattgccaacctgcttgtgagatgtacctgagaataaccttcagacaaacgcagtgggctctgcattgatggtgctgattcagaacacatttggggtgttgtgtcatctgtctattagaatgcttccaaaggatgacgactcactgatagataatgttttgtttacaagcatgtccttgggtatgagactttgtagtgtcatgactgaccgtaaatctcactggcagtagcacagcatatgaaacaccttctgctctagtcattactttatgttcatcacaaacaaatcagaacaaattctgaatgcgaatctcctttcaagttagctgactcaggctgtcggaactcatgtaaaagcgaaccaaatatgacaggaggtgaaagctggccgtagaactggaaacggcagaacgtcattgaagtctgcctaagaactagtcagcatcccacctgcttgctcacagtcacactcaacatctctgtggaatttttagtgctcttttttgtattagtcttttagtcgttaccctagtgactctgatatgcattcctaacttatcagtttactttgaattaacattagaccacttgatatataatgtaagaacttcttacagtgtaatttcatgtacagacttcacaatccttttgttgtagctaaagtttacttctacctagattataaactccacaatactttgtcattaatgtactttatcaggtatgaagattcagttaattttaaataattttttaaaaagaaaaatactctttttcactctgatgcccaggctggagtgtagcagtgcaatcactgctcactgcagctttgacttcccaagcttaagcgatcctcccacctcagcctcccaattagctgggactacaggtgtgtgccaccatgcctgggtaattttttctacttttagtaaagacagggtctcactatgttgctcaggctggtctcaaactcctggactcaagtaatcctccccccgggcctcccaaagtgctggaattacaggcacgagccaccatgcccagcaagaaaaatagcctttatatttatctatgtattaacaatgtcttttacttgcctctccagtagatctaattttctatctggtatcatttcctttcagcctgaagaccccctccttgagcatttctcatgttatagacctgtcagcaacaaattctctcggtttttatttatcttaattttttttattatgccttcattttaaaaacattattttctttaatatagaattctagactgacaaggtattttcagccctagaaacttatcattccatgttgcctggtctcaattatccaatgacatgtcaattgtataagctagtttaaacaattcttgtcatttttattcaatatataatgttttttttttctttggctgacttttaaatttttctttcaacctttggacttcagcagatctgcttaaggtgtggttttctttattgactgagattcttgaatctgtgggcgactgttttaggccaaatttggaaaattttcagccagaatttcttcaactatttttttcttcttcattttctctcttctcttcatcaaggactacagataaaagtatatcagatcactctatactgtccctcagatcattgagaatgtgttcattcttaaaatctttttttaaatttgtgactcattttaggtaatttctattgattcgtgaccaaataaactgcttcttttgttgtgtctggtctgctgttaatctcatccagtacgttttttaaagcttcatctattatatatttcagttcttagatttacatttgctttatttttaaatttttcttatttttcttgaagttccccaattctttatcctaactatggatactataactttaaccattatatctattttttcctatggattctttatgtgcttatcatagttaatttagagtacttgtctgctaactccaatatcagaaatatttctgtaaaattattttttcttgactatgtctaataatttttagagtgccctggtcaaaataacttttgattgtatagtggcactgtggatgattcattgtaaaattttagaatccattatctctctttgaagagtattgagtcttgtactagcaggcaattaaattactaatgaatcaccctgactatgctgagacttgatgtgtttcatgaggatatgtctattttagttatgccatctctcagtcttgatacatggtatttattactaggagtggcccttataggttttcagtgaaaagttcaacatagttatcaatgccctctaacttcacgggactcatacttcaaacgctggctcttagcaacaggaagtagttgaaatctctgttaggctctttcagccttctgactgttggtttcctctagggctccttgactatttcccgaataaatgagcaggtcaggagtcaaccaaggacttgagaggagtttacgttcatattgtgcaacccctccttctatgtctctctcttttctagtatttcctcccccagtttccagctgctctggctgttctaaacttcctttctgactcctcaggcaaataggacttcaaaaattttttttggcctcagttctagccacccaagagatattattcgggaagtcctcgtaggggaaaaaaacagtgtgtatcttaaccaatgtcattcccttgtttgaagcgttaaatgccctctaattccatctgcatttggttgctttcattaacttgaaaattctctttctatttttccccagagtttataattgctatcagtagaaggcttaatcttatacaagcacttctaccatctccaagaccagagtgctccattggtttaatgtgtaaccatgagtgaacaaaattgttttcaaaaaatagacaaacctcactgaacctcaatgaacactgaaaagtaagaataaaggccgggcgcggtggctcacgcctgtcatcccagcactttgggaggccgaggcaggaagatcacgaggttaggagatcgagaccatcctggccaatatggtgaaaccccatctctattaaaatataaaaaaacgtagccgggcgtggtggcatgtgcctgtcatcccagctacctgggaggctgaggcaggggaacaggctgaacctgggaggtagaggttgtagtgagccgagatggtgccactgcactccagcctgggtgacaaagcgagaccctgtctcagaaaaaaataaataaataaaataaaaataaaaaaaggaagaaaaatgagaataaaaagaggtaaaacatggcgtttcatcttataaatttaaaatatacctgatttggtactgaatgattgtaactaagtttttaaacagtgttcatggcgtgactgtaaacccagctcacttttagaaaaacgtttttaccaacccaaacagtatcctactcaacaccagttatatttgtgggaagagagatagagttttctggggaaaggcccactcttctaagaaaatatatggttttctttgcattacttttccttctttattccctattcacgctattgaacatgtctatcccaacccttttttctggtcacataatccaggtctgaccacttggccttcttcttctcaatgtaattgatttaggaatgagtttgtggcccaaacaaatggaaagagatataatcctgggaatctgaatgaaataattggtaagataaagttttcttttcactgaggtagacagtagaatataaacttggaactggtatggccatcttgtcatctcttgaagacagcctgcctaagaatgaaaatcaatgctgagaaatataggacagagtcctgacaatgtcagttaaacctgaatccagcaactctgatagctatccctgattgcttagttatttgagccatttcattattgttaattgcccttacagcattttcagctgagttggtgttgtagaatgaacatttgtgtcctaccacaaattcatatgttgaagttctaacctccagtgtggctgtatttggacacagggcctttagggaagtaatggaggttaaatgaggtcataggggtggggccctgatccaataggattggtgtccttataggaagagccactgagcttgctttctctctccaggtgcacatattgaggaaaggccatgtgaggatatagtgagcaggccacctgctatgagccaggaagggaccccctcaccagaaacagaattttctggctccttgattatggacttctaggtttcagaactgtgagaaaataaatgtctgttgttgaagctacccaacctgtggtttttgctgtggcagctgagcagactaattcagttggggtcacttaaaactatgagtctccagtcatccaggaagtaggggtgcaaaggcagatttgtactgtgaccctgtcatggcaattcattctactggcaaaaatttccctcaattaaaacccaaatgatttcaaaacaccccataataggatcagcaagagactccaccaagactgaaaatccactgtgccaacaaaagccttctaaatgcacgttttagactttccttttaccttttcaagtggctcactggcaaaaatcaaggttctaattaaatctaaagggctatccaatcacacggttggcaccaattactcatttaactatgtatgtgttaagcataagctaattgcctttctctcaaaccagagccagttcagatcaggccattcaagagcatttaaacttggcacaagagggtagcactgaaaactgacaataaagaattctctcttgcaggagaacctttcaggaggctttcaatcaatttttgcaagttccaaaactcaaagaagcaaagctaactatgtagctggtgtatttctttctagatcttgaagcattaataaaaagatggactcatctgagaatcaaatatctggtgaaactatacataaatagatatatttgtgtgtctgtgttcatgtgtgtgcatgtggatatgtgtgtgtgtgtataattgcatgatgttcttcctcaccttcaaattctgacagattctaaggaggaagggcacagatgtgtttcctgcaaaagagccccgagtatcttttttcacctcccttccttccctttgtccagatgagaatctttgttttaggggaaatggaatttaatatgtaaaatttattctcagtgagtttcaccaaaataggaaccatatctctaaccttatattattattatctgtacaatacctgtcaaacggagcccccagtaaatgctgaaagcacttcacatccattgggaaggtgagtgcatttccctaacgtattttagagtataattaacacacagtgcctaacagagaaaatcatttttgtgtgttcagctaaacactcaactccacataagttgcatttgatatcgggttcactcggagaaatggctctcacacttgagcctgtgtcagaatcacctagaggggctgttgaaacagactgctgctctgggtcctttccccttcccctgggtttctgactccttagacttaagtgggggggtcccagaattacaatttttgtttgtttgttttttgagacggagtctcacactgtcacccaggctggagtgcaatggcgcaatctcggctcaccgcaacctccacctcccaggttcacgtgattctcctgtctcagtctcccgagtagctgggattacaggcacacaccaccacacctggctaattttttttttgtatttttagtagagatggggtttcactatgctggcaagactggtcttgaactcccataattagaatgtttaacaagttttctggggatgctgctgctgctggactggggaaccacactttgagaaccattggctaagaagctataggacaagagaggcagcttgccagcaggaaaggcattaagtgctctgctttctgggggagttttgcagtagttcacccactgtcaggagctacaaggctcacatccagctggtgtgagggcatcatgacttaaaagctacatgcctcacatctcttgtaataacttcatagacatagtgatgcggtttggctgtgtccccacccaaatctcatcttggatttccacatgttgtgggagggactcagtgggaggtaactgaatcatgagggcaagtttttcccatgctgttcctgtggtagtgaataagtctcattagatctgatggttttaaaaagaggagtttccctgcacgagctctctctctttgcctgctgccatccatataagacgtgacgtgatcctccttgccttctgccatgattgtgaggatttcccagtcacatggaactgtaagtccaattaaacctctttcttttgtaaattgcccagcctcaggtgtgtctttatcagcagcatgaaaacagacgaatacacagagcttgcagggaccccactagagatgtgccagttacccgagtcacagtctgagatggtcagagttatggcttcctttcaggtatttacaggtcacccagtacaggaatgacacccattagtaccaatcagggatcactttacaatgttgcctagtgacaaagttgaaacataccacctttgtatgtttgcagagaaacagagctagaaagataagatcaaattttcatgcagaaggggaaagaaagcattcctttgttaagcctttattcacaaggtacatatctttactcacattatgcccctattttaaaagcttaagaaatgtaaacattatgtcaaaaatttttcattcttggtttagctgaatctcaaagccaccagttggaaggatcatgccaatcaaggaagcagatggcttgctttgggcttcttcaacaaaatcacctagatcctaaattgctgtttctgtgacaatccatattgtctgtttctgttgcacatgataccacaggatttgctaatctctaacctaatttgtaaataggaagtaaatttctacttcagagcttctatcatctagtttttcttcacctgactgctatatggtctgcttcattttgttatgttgcttacttgaaaagaccatggagaaaatgtatttgttatttaaataaatacccaaatttgcaactccagatcttaactctgctaataaaagaaacttttaaaagaaacaatcttggcctaagtaaggaattcttacccttgttacataaacctagagatctaaagaagtaattattagccctggttgcattcacttaaagatctttttaaaaatactgacgcctgaaccatactgcaggccaattaaatcacaatgtctagagagatagggtccaggcacagaatgttcttaaagctccccagataattctaatgtagagccagcgttaagaacttttgaaactaaagtctatcactgagagaaaattatttttccttcctgtcacccttcctccccttctccttttttttaagaaagaaaatactgggaaagaaatcctaggctgtaattatgtgggttggttacagctttctttacaaacactcctgggttatcagaagaactgctctaaccttggggcaggtggactcttcctataatgacatgtaattattagtattattaatacttttgcaatcatattaataattaaggttcttttgcaataaaaaagagacatgggccaggcaggttggctcatgcctataatcccagcactttgggaggctgatgcaggaagactggcttgagctaagaagtttgaggccgcagtgagctatgtttgcaccactgcactccagcctgggtgacagacagagagagagagatgaaaggaagaaaggaaaggaagaaaggaagaaaggaaggaaggaagaagcaaggaaggaaggaaggaaggaaggaaggaaggaaggaaggaaggaagagagagagaaaggaaggaaggaaggaaggaaggaaggaaggaaaagaaagaaagaaagaaagagagagagagagaaaggaaggaaggaaggaagaaaggaaggaaggaaggaaggaagggagggaaagaaagaaagaaagaaaagaaaaaagaaaacaaaagaaggaaggaaggggaaaaaagaaagagagaaagaaagagaaagaaagaaaaagagacatgaatctaagctaaaaaattagacaaagattaggttctgcacttcagtttaaaaaagaagaaataagtacgcaaatctatcatttaatgagagcaaatatttatgtctccatgtcttaaaaatgcagatgtggcatagactggcgagatgctcacccacctgtttcctttcttcctgagcatgtgcctgaacatttcccagcttcctttgtccatggatatagtgacgtgactgagaatagtcagtggaatacgggcagatgtaaatatcacatccagagctggtcaatgaagcctacccatacatgactgtgatagttacttttatgtgtcagcttggctgggcgacaacgcccagataagtagttaaacattattctggacgtttctgtgaaggtacttttgaatgagattaacattcacatcagtgggctttgaataaaacagattgcctacaagaatgtgcctcatccaatcagttaaaggcctgtatataacaaaagactgaccacccccaactgaaaaaagaattctgtaggagatggccttcgaacttgaatggaaacatctactcttctctgggtttccaaagttctggcctattctataaattatagacttgctagcctccataaacataagccaattccttaaaataaatctttctttcctttctctctctctctctctttatacacacacacatacattttatactcacacatatacactttatacacacacacatagacatacccgtattctattggttctgtttttctggagaaccctgactaatacaatgaatttctaggaagaactcttaagaatgaagaaagaatttgggtttctttgttggaagtcctcttgccaaccagggacatccacatggacttagcatgaatgggaaataaactttcattgtgttaagctactgaaatttgtggttgtgattgttatagctgccagcattacttgatctaactaatatagcagatggtgaatgagatggttgttaatttccctttatcgctgacattctaaagcagtggttctcaaactcagctgtgcataaaaaaatcttaaagctttgagaaagtactcatacttggtctttaccccgaaattacgatttctttggtttctgaggtatagcccaggcactggaatttctaaattctctccaggtgattctaatatgtcaataatttgaagaactactgttatacaggatgactgagaccagagttaaaagttcatggataagagaaaccaagagggttctgttggtgaaaggcttcatctggatgaatggtatgattttctggcctcaaagcagagctcttgagctatataattatcgttattattaatagtaccaagaggatacatgcattatcttactaccttgctaaattctcacaataaaactcttccataaatattatgattctcacattttaaatgagagaagcaaagctcaaacagagattaaggtaacttgctcaaagtcacacagctaaggagtagagcccatgctcccaactctaacctgtaatacctcccattatcctaaagaaaatgctatcccacccccagccccccaccccctgacaggccctggtgtgtgatgttcccctccctatgtccatgtgttctcattgtttaactcccacttatgggtgagaacatgcagtgtttggttttctgttcttgcaatagtttgctgagaatgacggtttccagcttcattcatgtccctgcaaaggacatgaactcatcctttttgatggctgcatagtattccaaggtgtatatgtggcacattttctttatccagtctattattgatggacatttaaataacatatagtttcccaagccatttagcaggagaacctgctatagatcgagaaccactataattgagaaccactgctttagaatgtcaacgataaagggaaattaacaaccatctcattcaacgtctgctatgttagttacatcaagtaatgctggcagctataacagtcacaaccacaaatttcagtagcttaacacaatggaagtttatttcccattcatgctaaggccatgtggatgtccctggttggcaaatgtcctgatttgccaagatttgtcctgataaagaaaatgtcctgatcaaaataagtaagaatcacactgtgcaacttgctgctcagatacctgaaatattgcattcaattcccagagtcccagtttaaagaagaagatagtaaaattgtgttcagagaggagcaagtaggttgttggaaagcctggcaagcacgaataagtggaagagaaaggaagggttagatcccagaaaggcaatgctaaaaaagaaggaatgattaaagaaagagaacataatagcgcattcaaatattgtaaagtttgtcacgtgaaagaggaattagcctgttctccctttgtccagagggttaaatcaggatcataaattagacattgcaaaaaaaaaaaaagaaagaaaattctgtttggtataaagaagaccttctaataattagagcttttctgaaaactagcagggttgctaggatttaatgagaaaatatgttctgtaaatgcgtataaaacactgagtatttttgttgctattatcatgtaggtgagtgttccattcattgaaatgtgcaggtacatactgaaatggtggttctgcacaagataggaataagttagatggtcattaaggtccattctaatcctaagattttatcctcacatatcttgggtccctccaaaaaaaaaaaaaagtgttttataaaatgtcttgtctaatgactggttgactggtgaccaatatatatatatataccatatatatatttctttaatttattttttaattatactttaagttctggggtacatgtgcagaacatgcagttttgttacatagttatacacgtgccttggtggtttgctacacccatcaactcgtcacctacattaaataattctccaatgctatcccacctcccagccccccacccctcaacaggccctggtgtgtgatgttcccctccctatgtccacgtgttctcattgttcaactcccacttatgggtgagaacatgtagtgtttggttttctgttcttgtgatagtttgctgagaatgatggcttccagatgcatccatgtccctgcaaaggacatgaactcatcctttttgatggctgcatagtattccaaggtgtatatgtggtacattttctttatccagtctattattgatggacatttatataacatatattttcccaagccatttcgcaggatatgcagtctatttcttcccaccataaaagttaaagaaaatctacagcaataatttggtcaattgtggtttactgaaaacttactaggaggctaactttgagatattcactttacttgaatataaatatcacgaagtacatatagtggatagagtacttcctgagacagcacgaaggcccatgtctgtcccctttagctcctcccatagtcaatcattgtgttgagttgttcagtctgcattgtctcatcttctccatggcaagcttttctgaacaggtccactacgctttggtattctctccacagtatagctcagtgattgccacaccacagatgctcaacaaaagtttgatttggagatgacctagaccctacaaaagttgtctgtggtcctgcactcacagcatgataactgagggataatgtacaaggaaaaatgtgttttttttttcttttaaaaaaattttatataaatgtaagggatacaagtgtagttctgttacatggatatattgcctagtgatgaagcctgggctgtcagtatacccatctcccaaatagtggacattgtatccgttaagtaatttctcattcctcatcccccttgtaccctcccacttttccaagtctccaatgactattattccactctctgaatccatatgtacacattatttcactcccacttataagtgagaacatgtggtaagcaaaatacatgttagatatatctctgtaatgaaaggaaaagtaaaagaatcagtcttaaactactgaaataatttatgcatttctcccacatgtggcaaatatatcaactctctttaggtataatatacctgacctcattgctgatagcataagagctttaaacaaatacttattcaatacttagctttttctctcataaaatggaacaagatatactagggtagagaggacgcttctcacgttcactgctgtatcctcagcacttggtacatagtgtttgcatcacaaatactggctggatgaatcagtgaatgaatgaatgaatggggaggctatggatgtgaaatgtttgatatgccttttagagagatattacaggcctttgagtgactatgatatttccaccaagcttctcttttgagcatataacttagtaagtatcttaaagttcatgttgacagagagggtgaaagtatgaatactttcttgagcttggttatttctaacttgttaggtacagttatcaacagtgataacagtccagcctgagctagatataaacaagaactgtatgccagctttcaaattgcagtttccatgataagctggctctgttttgctgccactgaatagagtgccatttagcagtggtgagagtaagaaaaagttgatcctttggtactaaacagttgagacctactcaagggagctgacattttcaacaccacttgaaacttgggcttggagccaggagaaagtttacacacaatcaagagggcactgctgcatctgcaaaagcagtttcctgtagctagatcgtaaaccaagagtgatggagatgagagcacccaagttcataaaaattccctaatatgttcatttgtaaaagaagaaaacaacattggccaaagaaagatgttctcctagaaaaaggaaaagaaaaaaaggaaatccatcttaccctctaggtgaaaaacacaaataaaatgtccgcgggaatattaaatgcttttccaaaatgtgcaaaacaataagcttcctactgtcctggtgtgcaacgtttgagaggaggctggaagaaggagcattcttgtctatgggcacctgcttctgccatgctggagagaaggcaaatctcaaagggtctggtagttaggatgattggatagagtgatatctctatctcagtctaaaggattggaagtactacacattcttccttcatacagtccaccttttctgagcacctgttagcagccaggcagtgtagtaggaatgaggagataatcagttagccagaccacccctgcactcatggatcttatacaaaaacagaggtaaaagacaatcaacaatggactgattccattacaatgatggtgttagaagaagaaatagtactaggaatttacatagtggtgaaatctgacctacttcattccatgagcaggtgacaccgagctgaacattgatgcataagcagaaactgacaaaaggaagccattgccaccattgataggaataagaaataactatttcccaaattctttatgttatcaaattattctccacacaggtgttttggctttgcttttttaaattctgaagtctgaagtttcagaaactacattgtaattgaaaataggtactcccctctttttttctctgatgctttcattaaaaattctcatcatctttttatgttacttattcggaccttaaaatgtataaaaatatgtgtggtttttgctttcagaaggcacacttgggatctgaagcagcaataattatgaactgacaatacgaaggttggctggctctgatgaggaactccaaggaccttaaaattcacttatgtcaagaggggaaaaggaggaatctaccatagcaaaataagacccttgtacaggatacacccacgtgcacacgtgcactgagagaaaatgagagttgtagggggctgtaggatcctgactgtctcatgcctacagtgagaggttcatagagattaaagagattgctcaggttgtccagcttggaagtgacaaaggctgggagtgctgaatactggaatgtaatggaatccatctacaggtaaaaagcctatggcaacaattagagggagaggtaaagtctctgaggcggcaggcaattggtacggagcctgaaagcccaggacaaagttttatttgctttcaagagcgaataggctcacacctataatcctagcgctttgagaggctcagatgggaggatggtttgaattcagaagttcaaagccagcctgggacacacagtgagactctgtctctaccaaaaaaaaaaaaaaaaaaatagaacaattagctgggcatggtggtgtgcacctgtagtcctagaagctgagatgggaggtttgcttgagcccaggaggctgaggctgcagagagtgagccatgattgctccactacattacaccgtactcctaggtaacacagcaagaccttgtgtcacctccagaaaaaaagaaaaagccttaacaaacagaagtgaaggtaccctgagggaatattctatttggctggggactccttatcatgattttacttagtgttgcagcatattgtgttttctgaaggtaggtgttccccctcaatctttctcatcccaccggcccttctccaatgtgaccttgccattcctccatcaagaagggaactctaacttgcctccctcttcagatctaggctaccttatgagttgctggtagccaacaggaggtggtggtgaaagtgacactgagtgacttctcaggctatgccagaaaagccatggggcttgtgcttgattctcttgggacactggctctggggaagccactgaccatggaggtgactgactagcctgacgctgctattttgaaaaggccacatgttgatgctctagtcaatagagtatcaggtgagcccagcgttctgtccaccccggccacaatgccaaaacacgtgaatgaggaaatcattgtagaagtgatctcctcccagccatttacgtttccacctgagcccctagaaatcatggagctgaaataacatgccctgtctaaattgctaacacacagaaacggtacgcacaacaaaatcacataaatatagataaaatccactaggttaaaaggagtttgttacacataaaaaaaatgactgaaataaatgttatattatctatctataaagactactatgggcattgagcccgctgaacagataagaaacccaaggtacagagagataaacccaactagatgatagaatcataagtagaatcttataaatgcagcaataaaatgatcataaaagtacatgtgaggacactgagtttcatagaaaaatgacttggatccagatgcacagttaataaaggcagatccaggaaaagaacttagatttcctgaagagtgctggagtctgaagctctttccaaaatattagatcaagcacggggtagttaaaaaaaaaaatcacatgctttggcatcagatctgggctgattatatccctgaggtaagtttactttatgcctggttgcccctatctttaaatagaaagaaaacagagaaagaaaaatatgaataaaacaatgaaatttggaacaggcttgtagtttaataggatcgtactaacgttaattacctggttttgattattcaactatgattacataaaatgctaatagcagcagcagctgagtgaggggtaaataggaaacctctgcactatttttgcaactttttgtaagtctaaaattagatcaaaataaaaaattaaaaaaaaaaaaaagaaggaaaaaccatacctaacttgtggggttttaaaaaacaaatttggaaaatgcaatgcctggtactttaaaaagatttcagatataattctcctctgcttccctcattccaactttctgataaagccagaacagatggcccacggacttctggttcagaccttgctccccaagaaaaagtcccctcatactgcaggtatatgccagcactttgcagctagaacacctctcagaaaatgaatcgaggaagcagacgatgggaaacttcccacggtagtgaaatctctaaacctcttctctgacctttgaattcttggcagccacaagctacgttcttgccaagagtcctcacgcgtgtagcttccacatctcctcgccctcatttagagggtagacttcctccacactccagtcatccggtgccatctgtctgtggccatgaattagctgaaagctctccgaaaccgccttctcaagctaattgagctgctctaaatatttgaagagacagaaatggggttataccagagatggtttaataaaatattgaaagagcttttttctaacggtgtagtagtccacttccttctttcctcccccagggaaatatgcatcttatcagtttatcatccgaaatgaacttgactggtctgggaaatcggccacaccgtcaggggagagtgaaggagaaacttccgggaaatgatcagaactattttaaaatcattttgctagtgcaaatcttgaacattcataaaacttatctatgaagataaagactgaacataaagaatagcaatgggcttggcctcctaccttaaaaccatagagattgactgtgttaaaatatattgttgaggatctgtaacaggaaacagataacctcggaagttcagcgtgaagggctactgcaccacagtcagcttctggctacaagaggaggagtccatcagttcacaaaaccaatgacttccatcaatttatatttaagtttttttttttcactgaataattctgtccttctaatataaatctgacttttctaaccttgccttatacttcttggaaattcctacttaatatgagtccatataatcagaaaacatgatgaatttggggcacaaaaactaatttttatttatttatttatttatttgagacagagtcttactccatagcccaggctgaagtgcagtggtgtgatctcggctcactgaaaactccgcctcccaggttcaagtgattcttgtgcctcagcctcctgagtagctgggactacaggtgtgtgccaccacgcctgactaatttttgtatttttagtagagagagggtttcgccatgttagtcagtctggtcctgaactcctgacctcaactgatctgcccaccttagcctcccaaagttctgggattactatcatgagccaccgcacccggccagggcacaaaaactaatttttctactaacagttgctgggtatgccatggggcccatcaacaatggagcccactttgactcacagttctgtgctctgagtgagcaaaaacattaacctcaaggcctgtacaatgcctgagcattttctgaatcattaagtacaatgacgcagggaaagagaggacaggaagaaggctgggaccaggcccccttcaccctagtgttctgtcctaggaccgtgagtacagctgcagtcttaggtgtgcttgtagatcgggaggaggcaggaagcttgggaaggaaacagacactttggttgtccccatattgcttctggacccctcatggtgctctaagaaggagagagcaaatttgtctactgagagggacattgtagtggacatcaagatgcaagttagtgctttataaatttatatttcctcatcttttcaagttttacctctgatcatgataactcttttggttgttggtcgtactccctcctgtttcccttgactagtctagaaatccctcctccctaagttctccacccttttctccttttcttcaggccaaaatgttctcaagttgcctttgatgaaactagatctgaaatgacttctagttgattaatttgttcatacaatatactgtgaaactgggcaagagatgatataaacactccttgaagctagctggggaggactctgccactgttttttcattttacaaatgaaagagcctctatttatggcttttgatgacatagaatagtctatttgataaaaattaatagtaccccctctagttctaataaaaaatttatttattataacaatatctttataaatgtggagtgtcttcctcttaatgattttctggaactctagtggtaagatcacattttgattaaccatgcctggctaatttttgtatttttaggagacagggttttgccatgttgggcaggctggtctcaaactctataggcacgcaccaccacgcctggctaatttttgtatttttagtagagacagggttttgccatgttgggcaggctggtctcgaactcctgacctcaagcgatccacccaccttggtctctcaaagtgctgggattacaggcgtgagccaccatgcctggcctcttttcccattttctaattaatcatttgtcttattgagttgtaagatccctctgtgcattctgaatacatgtctttatcagataaatgatttgcaaatatttcctctcaagatatggcttggctgttttcttaacagtatcttttgaaaagcaaaaggttttaattttgacaaagttcagtttatcaatgtttcttttatagattgtggttttggtgttacatctaaaaactcattgcctaactcaagatcagaaaaattttctaccatgttttcttttagacgttttataacttttgctcctctgtttagttctattattcattttgaggtaattttatgtatagtgtaaggtaaggatttaaattcgctgctttttgtatggatatataattgtcccagcactatttgtttagaaaacaatgcttaccccctttgaattgcctttacacctatgttgaaaaccaactgaccatacatataaaggcttattttgggatctcttaattctgttccattgttgtatatgtctattctctctctctctctctctttctctctctcttttgagatgccagagtgcagtggtgagacaatagctcactgcacccttggactcctgggcttaagtgatcctcccacttcagcctcctgagtagctgggaccacaggcttgagacactgtactcagctaattcagctaatttttaaatacatatatttttttttggagagaagggatctcattttattgcccaggctggtctcaaactcctggcttcaagcaatcctcctgtctcagcctcacaaagtgttgggattactggtgtgagccactgcactgggcttatatgtctattaagccaaaaccacattgcctgataaatgtaggctggtcataaattttgaaatgagtggtgtaaatccgctaactttcttctttttcaaagttgcttggctgttctaggtcatttccatttccatatatattttaggagcagtttgtcaatttctggaaaaaaaaaaaaaggcctggggggagcttagatagggattgggttgaatctgcagatccactgcagaacgacagtcttaactacatagaatcttcctatctgtgaacacgtaatgtctctccatttctgtagatctttaatttttcacatccatgtttgtagttttcagtgtgtacttcttgcacttcttttcttacatttattcctaagtgctttgtactttttgatgctatttttattgttatattgtccattgctagcatacaggattaaattattgtagttttgtaggtcattggcttatataaaaaaaatcttataatctttttacaggaatcatatggtgacatgaaaagggttccataatatagtccccacctgctactccagcatcactccccagcacccgtaagtcagaatgtatgtttccctagcactgaacttctaaaaattgatacatgttagatgtccatgtgataatttcatacatttacataatcaaatcaaggtaacttggatatccgtcaccttaattatttatcatttctttatgctagggacattcaaattattatcttctagttattttgaaatgtccaatcagctaatattaactctagtaaatttactgatctacggaacaccaggtgttatgtcttctttcaagctgtgtatctgtacccattaatcaacttctcttccctcctccacactgccattcgcagcctctggtagccaccacactactctctatcttcatgagatccactcgctagctctcacagtctcacatatgactgaaatcatgggatatttgtctttctgtgcctgactcacttcccttaacataatgacctctagttctatccaagttgctgcaaaggacaggatttcatgctttttttatggttgggtaatattccattgtgtacatctaccacatttttcttatcctttcacccattgatgaacacttagattgactccacattttggctattgtgagcactgctgcaaagtacatgtgagtgaggatatcgcttcaatatactgatgtcatttcttttggatatatacttagtagtgggattgctggatcatacggtagttctattttttagtttagtttttttttttttttttaaggaaactccatactgttttccacagtggctgtactaatttacattcctactagcaacgtatgagggttcccctttctccacatcctcaccaccatctgtcattccctatctttttattttaactgggataagattatatctcactttggctttgatttgcatttctttaatcgtgagcactgaactttcgacagtaccctgcaaccttatgatgtttttacttaaatttaatttcaacctcaagtctcagtttatgcattacctcatcctagaagcctttcccgttttctctctacttgcgctacgctgcatacactggggaacgcatgtgtgcatggacactgtcatttctataccaaattttaaactatactaaattttaactaactacttacatgttcatcttgagaaacctgtgtcaccatgtatagcaaaacctgccagttgtttatcgatatccatcttctctttccaaaacaatagaacccctaattttttgctaggcataaagcaaaagaaataaagaccatatttctggccccgcttgccattaaatgcagtggtacgattatcttgcatccagtgagagaagctcatcgggcagctcccagaaaccttccctcaaaaacagccaatgcatatcttgtttttctttttctttttttctttttttttttctccttcttgccagttaaaccagatctgctaaatgaggctagaccagccaccctgagtggatgaagtgaagtgactgtgggaacagagacccacatggggcaaagcaacaataggaggggagcctgggtctccatatcccaccctggtctgcctacttctgggctttccatgagaaagacacacaattctccctgctttaggctgttatttccttgggtctctcttaactgttgccagacttagtcgaaagaggtttataccacatcctattgcatcttcagtacctggtgctgtgccaaacacatagtagttacttaattaatgtttgctaatttactgcaaaaggatagcaaaagttaaaaaaaaaaaggaaaaaaagctttatggaatattaccttcaaatccatcctgctccacatggttaccaaatctctttccaggataataaaatcttaacattttaggcatacaatttggccttcaaaggcctctcagctttttaaatctaatttctattctaatttattcatcatgatgttaataagatgtttggtttttcatgtagaaggaaaagcaaatttatacaatgattccatggatagtcaagagacagaaggcctgtaattgactataataatagatctcacaaaatcataaaactgatagtaacaatggggttcaagcaattaaacaattttgattccacagatgaaaaagctgatgttcagagaggtgacacaactaattccaggccacacaaacattgaatggcagatctgatgtcagaacccagataatctaacttccaacttggtactctcagaatcagttagagtgcctttggttgtcaagagcagactaactaacataagcaaaaatccttttaaaatcttagaatttacaggatccaaagcctggaacaggcaggaaccaggcagctctgttcctgcctggtttccatggcaacatcagctacagagctcatactgatttagctgacggaatgaatgaataaactccaacaacggttattgttctgtttttcattctgattgtagaatgcttctttttcttttcttttctttctctttctttcttcctttatttttctttcttcctttcccttttctctcttttttcttttttctcattctctctttctttctctttctctctctctttctttctctctctctttctctctttccttctctctctcccttcctttcctttccttctctttctctctctctctctctcttcactcctttccaccattatttttgcttactgaatctgcttcccagaacagtggctgatgagaagcctaggcaccaattttctcattcccatttccctcaacctaatatagggagtgagatacaagggtgaacccctaggagatgcactttgagagagagagagagagagagagaaagacagacagagacagaggagaggagagagtaagagttagctctctggctttcctggcttcctctcattttctgtttttatatgcattttatttgttcacatgtttttaaagtctgcagtttgagaccatgagatgacaaggagagaactgaaagccaaacttttgagaatacttaagagaaagttaccaagtgcctgagtcttctatgatatcactgagcaaatgacgacctccgccccccatattttagaaacaaataactgaatgcatgaataccgtaaaggaagatgagtacatacatgtaagcacttagagaaatgagaaaccaccttgtatttttatctggaaactaataaaaagcaaaatgcatccaggaatattatacgacatgcaatttcgcaattcaaggtttttctctttcagtgtgtagagttagccataaagcaaattgacagatactgaatgacctagttaaatcttccacggatgctaatatctcctgttaacaccctgcagcttgaccctaaggacttccgcgcacccatcacatgtatagtatggtgtttatttcttgattttatatttttaatatataaacacattggttatggacaggaaagaccttctgtcttattaaatgactcacatgatttgcctcgaaaccacaagctaagtcaaacttgtgctaagcatggtttaatctgacagaatataaagattctaggacaaatcaaacccaagtgaaagtttccagttttattgccacacccaagttcgataaagaagcaatatgagcttgaattaaacttgcagccgagaaaggttacaacttgaatatagtattgagcagaaagaaaactttccatggatcaaggactcaacataattctaggatctataaaaaaaatatccatctgatcttcaatgtgtgtacattctaggagtaaaacctatgctttgttaatattacaaagtaaagcaatcttctttcttcccaacagcattgctttgcccattttagtctgttatgtagcattatccatgaagagcacgacaagggaaatgtacagcgagcccttgttaatggtcttcggagaaaatggtttaattgcacagacaaatgctgagtcaaaggtgattgtgcaagccagagaaggaagaaaagaaaatattttttaaaattagccaataatccatttataaggacaacaaacaatagaagcttaatgactttttgccatattactaaaacatgtaagaattacacgtgacttctggaacacaaaattcttaatcccaggtcagaatagttaattcaaaactaatttgttttcagggaacatatctgagaaataataaaatgtagggtctcagctcacatccacccttgctcagatgaatgatcataaaaatggtcctaggcaaggccacagggtctggctggctgaggactttgtgcactggaccatataccatgagcagtgagttatttcaaactccagctatggggccagaaactccttaggagtccgcaccagaatgtctagaggagcacgtatattaacaagcatattttacacttaaaaaaaaaattaaccacagaaactgagattccaccagacttccttgataggaagataaattgtaaaagttttactgaaggacttaatttttaaaattaagccatttaatttaaaaaaataagacttttaaaacaatgttgagaaacacacccttcaccagaagaagaaaggggcgtggccagggaagcagagcagttccgcctgtacctggtttatgcagtgcacttctgaatattgccttcgaggaaaggttaggacaggataaagcctccagacaccaccgttcgagtataatttgagccaggaaagctgtcagtgcagctttttactgtgttgtagaatcctttgggaaagaaatcttttcttgggttcctctgagaattccgactgaggcaaaaccagatttatcagggattttgcagatatcctgaaacaaaccgtctctcagcgtgagtctaaaactccatccgccaagaccgtcgctgggactaagccctgaagctgagtgatcacttgcttcctctgctcctctctcgtaagaattccttccctcaaaggcctcacaggctagatagggaggcagacacaccagagaaacaacagtgaagcatgcaaagtgctgtgaggaagtgttgtgcaggtattgtagaagctcagattgggagtgcctagggctgaccgacccagacagtcttttatactgggcatgtgtgtgtgtacatgcatatagaaatttggggaggagaagaaaaagaaataaaaggaagtaatagtggctgcaacttctgcctacagatactatgaccttgtatagataatgcttttgtgactatgacttggccttgcttgcaacccaccatctgagtcctgctaaccgaggaccaactatttaggaacaagctacactgtgccaccaaaacagacatcaacaacacctttattacatacacaattgccccaagaatttttatatatactattttcctttgcagcaactttactcaccctctctctcttttttcttttaaaatttttagaggagtttcactctgtcacccagggctggagtgcagtggtacaattatagctcaccgtagcctcgaactcctggggtcaagtgatcctcctgcctcggcctcctgagtggctaggattacacatgtgtgtcaccaggcccggctactaagctactaaccctctcttaaatacaagctactaaatctattgaatgatccgggaagaaacaatatgaaaaataaaaagataattaagaatttcacaaagcaaatatatgtataatgtctagaagaatcaaagatggaaagataatatggtaatatgacactaaagagcctgatgaactttttgatttgttataaaacatttaaaaattttccttcaatatttaattggccaatgagtctccaaatagctattgcctctctctcttttttttttttttttttttgagatacagtctcgctctgttgcccaggctggagtgccctggtgcgatctcggctcactgcaacctccgcctcccgggttcaagctattctcctgcctcagccttctgagcagctgggactacaggtgtgtgccaccacgcccggctaattttgtgtatttttagtagagacgggtttcatcatgttagccaggatgttctcgatctccggacctcgtgacctgcctcccacggcctcacaaagtgctgggattacaggtgtgagccaccgcgcccggccatccctctctctaactcttaatccacattgccatgcattggttccctgctattaacctctttggttctaatctagatgatggcatctgctggtcagtgtcctggtccaatgtggatcccatccagcatgctctccaccttacatgcagagcagtctttgtaaatcacaaatctcatcatgtccccccttcactcaaatgcttagatacagcctttcaggataaagtccaaactttttagccgtctataatctgactcttttcttgttacttgctcaatttgggacatgtactctggacaaatgaactgtgtcataccccaagcacgccatggtcttgtgtgccttcatcttttttactctccactccttaccagggatgaactgcctcccattctcagtctagatccgtggttctcaaggttctcaagggaacagtggcgacagcagcaaacgggacatgtcagaaatgcaaatgatcaggcttcatctcagatctcctgagtcagaaattctggagaatggaccagcaatctgcaaataaggactatagaagatcttataccacagaaaagctaggcagcgtgcagagaactagagggccatcgatgacttctttgcctgcagttcagcaaatacacagcagaagtgaagaccactaggtcacttggtcaagctattcataaaacagaagtggctcaaggagaataaatggattatacgcagggacccctgtagcttgaggagtcagatagacattatagaaacagagactgtcagtgtcccaggggtccaggaggtcaaatagtccagtctcatcatgtcacagaggataaacaggagtcctggaaaggtgaaatgacttactcagtgtgagacagatggccaagagaacactgaaaccaaagtgttttagaaggaaaaagctgcatggtaaaaacagctgagtcatctgatggacactgacacaggcaagtccctcggtgggcacccaggcagaatgagaagcatgacatgtttgttcttaataactcagtgggctgatcctgcagtctaggcaccctgctgacgggaagaagcaacgactcagttagactcacgtggatctgtccagcactggacgtcagcagtagataggtttgatggagctggaaagtttatcctttaaaaatggccacaaatattacacttataaatatgtatgtgtgtgggtgtagaaacattacttgtaaaaaatgaaacctgttagattagatcaaactaggttgccgcttctaaggtagtgaacgtgtaaaagagtaaacctcatagaaacatgaggctgcccaatgcatgtgtacatgttggtgttgtgtgcatatacttcatcatatacatatagttagaaattgtatgtataattaaaaatataatcattcaatcataacattaaacagtgaaattattacatcataatgttaatcataacatggagcaattaaactacagtgttttatgacatatagttttaaattataacattaaaaatataggtaaacggctaggatcggggagcaaatattaaagtaaataaatccctgccctactccctgagccctttctgctcatattttgcactcttctgaggactgatgttggcctcccaggcttcaggacaacctgacatcaagatgcctttaggttctttctgacagctgctgctgcttcttcatcacagagagttcatttgctctcctcggcaggccagagctaattaagaagagaacagcccaggttcaccctcccaaccctcctcatcggctagaactgcctgtttgctgccctccaggtcttctgcagtgagaccccctgcttttctccagagagtgaggaaaccaccactagaggggtggggtctcaacacagacatatttacccaacaggagcagaatgtttccatttgacaattccactacaagaagcaggccttcttggacctcttgcccaacttctggccttctgattctaagtagaagttgtcatttttctatgactactattaggttggtgcaaatgtaattgtggtttttgcaatgaaaagtaatgacaaaaaccacaattacttttgcaccaactagtgctagcaatgccttaaaaaataaattgggctcaagatttcttggggcataaattgttttgtgctgttttccgtttcatctccatgttccacgggcttaaacaccacagagcaaaggcagcacgtgtctgtggagctgccccctttccaaggaagctgctttgaccttcaccttctgcctcctggtagtgtgtgatgatcacatggaatagtaaccagagctgtgtcacacttcacaaaacaccttggggattttgtgacctcaaagtattctcttcacctggcaggtggcatgagccatgggagatcccgacactcccaactttgctaccaatgactcagatagagggacacatgtatacatgtgtctgtgcacattaatggaccagcactggccatgtttctatgaggccttttcttttacatgattaccatttaagaagcagcaggtgaatctaacctattttgttttcttacaagtaatactgtgttcgctttttgaaatttcttttctgaactttagtaaaaccatttgctactctttcactctctttttgtgtttttttttttaatttttaattttgattttcataggttttgggaaacaggtggtatttggttacatgagtaagttctttagtggtgattcatgacattttggtgcacccatcacccaagcagtatacactgaacccaatttgtagtcttttatcccctactgccccccaccctttcccctgagtccccaaagtccactgtatcattcttaggcctttgcgtccttatagcttagctcccacttataagtaagaacacacaatgttcggctttccatccctcagttactttatttagaatatggtctccaataccatccaggttgctgctgctgcaaatgccattattccgttcctttctatggatgagtagatagatagatagatagatagatagatagatagatagatagatacaatttctttatccacttgttgattgataggcatttgggttggttccacattttttgcagttgtgaactgtgctgctataaacatgtgtgtacaagtatctttctcgtataatgacttcttttcctctgggtagataagcagtagtaggattgctggattcaatggtagttctacttttagttctttaaggaatctccacactgttttccatagtggttgtactggtttacattcccaccagtagtgtagaaggtttccctttttaccacatccctgccaacatctattattttttgattttctgattatggccattcttgcagaaggagtaaggtggtatcacacggtggctctgatttgtatttccctgatcattagtgatgttgaggatttttttcatatgtttcttggccattttcacatcttcttttgagaattgtctattcatgtccttagttcactttttgatgagattgtttgttttttcttcctgatttttggagttccttgtacattctggatattagtcctttgtcagatgtatagattatgaagattttctcccactctgtgggttgtctgtttatactgctgattatttcttctgctgggcagatttttttagtttaattaagtcccatctatttatctctgtttttattgcatttgcttttgtttttgtgtgtgtcttttgtttttctcctctcccactcttatccccaacccaactttgatttctctctttattctctagaacgtgaattaaccagcagcctgcatttcacatttaactgaagaagcagaattgatgagtgtcacctgaactatcttgaacatttcatgtcacattgcatgtcagatatttaatcttgacacctcctctccgtccagagccaaaaagtcaccaggaatgaagaattctttcttcatcatatagaattttgtaggccatggaaagcaatctagacattattctaagtgctatagaaaactgtgtttgagttttgagcaggaaagtgatatgatttgaattctacttaaaaactcaggctgggaaatagaagaatgaaagcaaagagaccagtaagaggatttattgcaagaatgaaaggatcacatgactatgggggagagaaatggatgaatttgggatatattttgtgtgcagccaacaagacaaaaattaatgcttgcaaggaggggaaaagaggcatgaagggaaagagatggatcaaagaagattcataggcttttacttgagcaactaaatccttgcagctgccctttaacaaaatagggtacagagggataaaggaaatttggagagagaaggaataaaaagttctattttggccacattatgtttcagatacctactaaacacacaaatagaaacgaaggaaagtggtcaccttattttaatgggaaggcagcaacctgaaaacctagtcatcctggagcatccagcagagaaaatttctattgcaagaagtaaacacttgattttgccttccagacagatcatttcattattcaaagaacattttttttcagaaggaccatgagatatgcaaatatatagcagagatttttcagggtacacaggtgttagaagctaaaagtagtggagcaaggtgacaaaaaagagatcctttctagcgggcagtgaaatgcctatatattattttctttagagcaagattccctttccaagtatgaacttaaactgacctatccaggtacatattattattttcttagaaaatgtgtgtgtgtgtgtacacagcaaaagaaactaccatcagagtgaacaggcaacctacagaatgggagaaaatttttgcaatctactcatctgacaaagggctaatatccagaatctacaatgaactcaaacaaatttacaagaaaaaaacaaacaaccccaccaaaaagtgggcaaaggatatgaacaggcacttctcaaaagaagacatttatgcagccaaaagacacatgaaaaaatgctcatcaccactggccatcagagaaatgcaaatcaaaaccacagtgagatatcatctcaccagttagaatggcgatcattaaaaagtcaggaaacaacaggtgctggagaggatgtggagaaataggaacacttttacactattggtgggactgtaaactagttcaaccattgtggaagtcagtgtggcgattcctcaaggatctagaactagaaataccatttgacccagaaatcccattactgggtatatacgcaaaggattataaatcatgctgctctaaagacacacgcacacatatgtttattgtggcactattcacaatagcaaagacttggaaccaagccaaatgtccaacaatgatagactggattaagaaaatgtggcacatatacaccatggaatactatgcagccataaaaaatgatgagttcatgtcctttgtagggacatggatgaagctggaaaccattattctcagcaaactatcgcaaggacaaaaaaaccaagcaccgcatgttctcactcataggtgggaattgaacaatgagaacatatggacacaggaaggggaacatcacacaccagggcctgttgtaggttggggggaggggggagggatagcattaggagatatacctaatgttaaatgacgagttaatgggtgcagcacaccagcatggcacatgtatacatatgtaactaacctgcacgttgtgcacatgtaccctaaaacttaaataataataaaaaagaaagaaagttggacttaagaactgtaaaaatgcaaggtgatataatttggatttgtgtccccacccaaatctcacatcaaattataatccccagtattggaggaggggcctggtgggaggtgattggatcatgaggatgctttcttatggtttcgcactatccccctagtgctgtcttatgacagagttctcaagagatctgcttgtttaaaagtgtatagcacctccccacacccccctcctcttgctcctgccgtgtaagtgtgctcacttccccttcgccttccaccatgattgtaagttttggtgatgcctccccagaagcagaagcttgcacagcctgcagaaccatatgccaattaaacctcttttccttataaaaaaaaaaaaaaagaaaacgtgtgtgtgttcaggcctggcacagtggctcacgcctataatcccagcactttgggaggtcgaggtgggcagatcatgaggtcaggagttcaagaccagcctgaccaacatggtgaaaccccatctcgactaaaaatacaaaaattagccaggcgtagtggcaagtgcctgtaatcctagctactcgggaggctgaggcaggagaattacttgaatctgggaggcagaggttgcggtaagctgagatggtgccactgcactccagcctgggcaacacagcgagactccacctcaaaaaacaaacaaacaggcaggacgcggtggctcatgcctgtaatcccagcactttgggaggccgaggtgggtggatcatgaggtcaggagatcaagaccatcctggctaacatggtgaaaccccgtctctactaaaaacacaaaaaattagccaggcgtggtggcgggcgcctgtagtcccagctactcggaaggctgaggcaggagaatggcgtgaacctgggaggtggagcttgcaatgagctgagaccacgccactgccctccagcctgggggacagagcgagactctgtctcaaaaataaataaataaaaaaccgaaacgtgtgtgtgtctgtgatgatggggtgtggatgaagactgggcaagctatctcaaaggcaatcagaaattgacattccccccaaaatccaaaaatagcaggaaaggtatgtaggccacagagtctgcttgagggtgagatataattatagaagggaaggaaacctggactgataaatctatctgtctttttccacttgtcatatatataccaatgcttcactactaaggtagtgaaccgtgatagagcatggttgtgaaattgaaatcctgggaccagaccatgtccctgcgggtagaaggtaaaattccttccaaaggaagtagatatttttactgtctgtgttccaatggagagatccattccagtactaatacgaagtttaagaaggcatgtgttaaactagaaaaaactgaagatgaaaagaacacagcttcctcctaagagacttagaggaagcatggctctggatttcgattgagtactatctacctgtgagtagtccttcgggggtaggcaaagtggattctgcaataaggcattaggccagaagctaagggtctgggtatgttggctttaatagttaccatatctagttgctattataaattgtcctctttgttgtttttttttctattattgaacacactgtaaatcttgtagaattagaggcccatgcttggatgaaacatcatgggggagagcagtagcagtccaaagggagccatttcaggaagtaggggatacatgaacgtcagctgtggcccttgcgcagaactgagagtgctggctagctgaggaacacagcagcaagggaaggaattagtttaacagttaccatctcctagaaactcccagaaatacacagaaagaaaattttgcaaaagactaaaattactgcattcaagcaggagggaggctgggaccattgtacatatgttctttaaaagggaatatgttctcattttatctaaaaatgagacacacctggcacatttgtctgtctccttctgtaggctataagctctttcaaaacaaggacctatcatgtcagaaagacttaataattatttacaaacgaaagaataagggtatccttgaatcaagcctttaatttgaataactcgattggttttacagtagcaccaagttctacttcctcatttacacattgtgaattacaatgctattattatttggaagtaatggcttttaaatgagcctggagttgaaatcgtaggaagaaagtagttctgtgtatgtaaattatttggttgatgaagggggcctgccgctccacacctgtgggtatttcttgcaaggtggagacgagagactgaggggagtctgatctctctttcccccacaggttgaaagagatggttgcatgctgttgttctttaccaataatgccagggataactagccacggagggtcaaagggtagtaaggctttgtaacaactttcttaatgcaatgcaatcatacaggtggtatgcatggccaccaaggagatgcagattggatttaactagaataacctggggactaaccaaggttccttttctcaactaaaaaaaaaaataggtatagtgatgctaaatctctaaatactcttagaaagattaagaaaataattataagatatatgtcctcatgatggaattaaaaatgaatgtattaatgtcttgtattggtagatttgttttatgacccagcatgtaggctttcctgataaatgcttcacgtacacataaaatgagtatgtaatctgcagtaattggatgatgtaaataactctctatatggtcaagctgatggatagtgtttcttgagttttctgtatcttcactaatggtccatcacttgttctgtaaattactgagagaagaatgttaaaatgtccaaatatctttgtgaaggtatatctttctccctttctgtcactttttgcttcatggatactgaaggtatgttattaggtgcataaacatttaggattgcgaatcattatgattttaccctttttatgtctaataagacttcttgtcttgaagcctattttgatatttatacaaccatgtgcaccttcttgtggttagtgtttgcaatgatgtgtatttttccatgaatttactttcaattttttaattgctgtgcatctttatatttaaattatatatgtgcagaatcctatggctgggtcctgttgtagatatatatacatatatatatatacgtatatatatgtatatatacatacatacatatgtatatatatatacatatatatataatcaaataatctctgccttttggaaaaatatattttggtcgtttacatttaatgtaagtattgatatgactgtggttcagtctcccatcttgctggcttttttaatatttggcatctctgatcttcgttactttgtcccttatctcttcctcatttcctgtgttcttttgtgtgaagcagtattttttttaaaatttcttctatctcctccactgcattttaagctacatctctttgtatttttaaattcattcctagagtgaacatatgcatccttaaagtgtcacaatctactttgagcaccaatactaaatgttagggattcaaacacgagcaaggcatatccctccttttcggatgagtggagaaggcagacatgtaagtaataaatacagcaaaacctctcactattcagaggacctttaacatggccacaaggctcaagcttatcattcgacgaacttgctaccagtatttcttggttgtacagattattttttcctcttcgctcactggatttcatatttgtctgaaaacatttcgccctgtttttaactaaattgtgttgtcatttgtatagtctatatacaagtgctttgttggatatgtattttgaaaagattttctcccaatctatatcttgtcttttcatcctcttcacagggtcttccacagagcaaaagtttctaattttcgtgaggtataacttattgattttttttggtttatagattgtgcttttcatgttgcatgcaggaaaactttgtgaaacctaaggactctaagattttcttctatagttttatagtttcaggtttcgattttcactatatgattcactttgagtcaatttttgtatgtggtttatggtaaaggtcaagatttttttttttttggcatttgactatacctaatttatcctttccccattgaattgtcctagcattttgtcaaaagtcattgctcatatatgtcatctatttctagactactgttcccttgaaatattggtctatttttatgccaatactacactgttttgcttactttacaataagtcctgaaatcagtagtataaattccttaactttgacgtctgttttcaaaattattttggcaattccagacctttttcatttccatataaattttataatcaatttgtcaggttctacgaaaaagcctgctgagatttcaattgagattgcaatgaatctatagatcttttgggggagcactgacatactaatcatatcacctcttctgaacatatgcattcattatgatctagcaatctctttctaagtatgtcttagaaactcttggacaagtgaacaaggaaatatacacaaggatgcttctagtactgctgcttgtaacagaaagacaccagaacattttccttatcacttgagaagatagaaaaatggtggcatatttatacagaaaaaaattttggaatttcatgtggcagttaacaatgaattgactcataaacataacagttacattttaaaaaaggaatatatatagtattatcctatcaatattacattaagaaatatgtaaaaccaatcacatgttgtttgagaaagcaaatatatgtgttaagactatacagaagaattaggaaattataaatacaaagttcataataaaattcataatgagctttttacaggatggggaaagcaataaccttgggagggccacaaagttgtatttcttaatcttgatggtgagtacacagaatgttatcaaagtgttattctatacagcatatatgtattttagtatatccttttctatttaatatttaatatctaaatcatttttaaaaggaaagacagagaattttatcgagggggaggaatcagagtaaacttaaatcttacactagtgaaacagggcacaagcatttatggttcaattgtgtaatcgattcttcatttatactattccatttgcagcttatgaactgcaaaacagcatcctgaataaatactaggagtcgccaatgtaaacctgttaatattgtgggatttttttttttttggacactcaccttctgcaaagtaacaaaagcactttaaaatgtgagaataaatgttgttgattgcagaagaataccagggaaaatagcacaggccatgcctttctctcttactcctcctattgggtctgcaggcctttcgcttgcatgagtcatccatactcaggtaagcactgtgcctttattctttattgcactaggcctcttgacaaatgactgtttaaggagtgtttgcacacctgtcaatggttcctgtcatttgtcaagtaacaaatataaaatctgataactaaacaggagaaaacctgtataaaccaagaaatattggtaccataagaagttcaacagatgataaggctaagccctgtggctctctggaagcccctccgaatagtgagtggttctgctgtatttgttatttatgtgtttgtctcctctgctcatttaaaaagtagggactatgccttgctcatctttaaatccctaacacttagcattggtgctcagtaagtgtccttaattgatggaaactgatatctgttgatcccaaataaaaacaggtcaaagccatctttcacggcatattttcaaaccttctgttttcgcattaaatcgtgaaccttttgaaagtatctacacacttttaaaatattttggaggcattattcaaataactattttgatactgagaaaatactaccagtggcatagatacaaattaactcctggatgcttttaactaatttttgtgtttggtgctaatgaaaaagtacctgaagcctttaactttgaagcccgggcttcaaagacatgattgctcagatgtcttgctttattgttgcagtttagcaagacaagaaactctcccaaaatgtcttactattatgtactcactgtagagaaaatatgattgtgaggaagaaaagtaaagaaggaaagcagtgtgagagttaagcacttgaagtttgcctggagtgaagaaggtcctaccagttaagtgctttggattttttcttttttcttttctttctttcttttcttttttttttccagatggagtcctgctcgattgcccaggctggagtgcaatggcgcgagcttggctcactgcaacctccttctcccaggttcaagcaattctcctgcctcaacctcccgagcagctgggattacaagcgcttgccaccacgcccagctaatttttgtacttttagtagagacggggtttcatcaccttcaccaggctggtcttgaactcctgacctcaggtgatctgcccacctcagcctcccaaattgctgagattacaggtgtgagccaccacgcctggctgggattttttcaagaatgtgtactcaaggtccaaacttttagatcatttgaaggaaatccttttgccactctcaggtaaatcactttggagctctgtaaagagtaaaacagccctccgcagccacacacagatttgcatggtggggctgcggagcctcggagtccaagcgtgacttatagtccctcataagcagaggccaagaagaggccagcttttggctttttctttctttctttttcttttttttttttgagacagagtctcactctgtcacccaggctggagtgcaatggtgtgacctcggctcactgcaacctccacctcccaggttcaagcaattctcctgcctcagcctcccaagtagctgggattacaggcgcccaccaccactcctggctaatgtttgtatttttagtagagatggggtttcgccatgttgaccaggctggtcttgaactcttgacctcaggtgatctacctgccttggcctcccaaagtgttgggattacaggcgtgagccacagcgccggaccttgactttctttcttgataactgtaaaagcaactgaaacagatgatgaaagaagaactcactaccatgagccagagcccatagttctcaataactcaccttgcccctgagctgacaccctcccacaccctgcaacaaatacatgtggttttctttctttgagaaacatcactatatttgggcaacatgtcacacacagcccagtgtattctcggtttcccaagtaacctgtagagaaattctatgatgtgatgccctttttcctggaggaccatagaattcagagggagaggaggccttgagaccatcctcaggtctcctgcctgaatgttgctaagcctcaggactccctccacccacatgcaaccacacatagcttttacaaataaattaagagtaagtcttttgcgggtaggtattatggcattttcacctcctctaggcagaagtagtgtggtgcatttttaaggaaggggaggttgctttgcacaggcctggaggcagaagatctagtcatccatatctccccaaagcacactgccccccttatcctcggacttgcttctaagatttgctgtcttgctgagaagttagcagtactcatcctctgaagatgctagactttccagatatttggggaaagccaatgtaatacatagcaccctaggtcagaagtgtgccttgagacagagttctacagtgattacatattttcttcctagtctgagcagccacatatcaactatcaagaaggtttctaccctattcttgatgctatgcctatgcagtttaactccagaatttatgaagacacataatactgttgacagattggatgagaaccattatcatttccccagattatcgacatgtagcatgctattagtaggagacaagcagtagattatgatgtcagtctgtttatgtgtcttctcactaagagaggtgagaaataaaagccagtggggatagaagactggttttggtctggcttaaacctccatactgtggggttttattctacgtagtttgctgtaaacgtgtgcccacttcttccttcttgagggctcccaggtggccatagatctctgtgacatgaagcttctttggagtattctgatgataaaagggagaatttcaattccatttgacaggaagagtcactccctccttgaagtggaaatgaaaatggatccctaactgtgcaagaggcaacgatgaaatagctctccctctgaccctccattaaatgacagcaggcagtagaattattatttggtactttatgcccaccgttgtgtcagctgtacacatgggccaaccacacatttctctccttccataattctgactcatgctgcatgggcttgagaacaatgttgaaaagttcccccagggtttctgatttacagtcccctcccttttccctggtattcaactaatgatttagaagctggaagtagaggaggctcttcttatttctgtcaaagagacagaaaaagagcagtcagagacagactaagaaatcatgattctaggaatggaatgtcccattctagaaggacagtgttcaatgtggtgaagaaattgaggaggagagcagtaggcagaggttattggttttgatggtgatagattctgttaagaaattagtggtaaaatcctggctaacacgatgaaacaccatctccactaaaaatacaaaaaattagttggatgtagtggtgggcgcctgtagtcccagctactgggaagactgaggcaggagaatggcacaaacccgggaggtggggcttgcagtgagccaagatggcgccactgcacccagcctgggcaacagagcaagactccatctcaaaaaaaaaaaaaaaaaagaaagaaagaaattagtggtgaagccatgctgtaaaggggttagaagaatatgggagtagtttgaagatgtggcaaggtcatgtttgtgaacaatggaattcacagagaagaaattttcttgagctgtgatttagtcagattgggatgctagaataccacagactgggtggcttaaacaacaaaatttatttttcacggttctggaggctggaaagtccaaggtcaaggtgccatcatggctcttcctggtttgcaaatggcgtcttcttgtggtgccctcacatgctggacagacaaagagctctggttccttcatcttctaaggatactaatcccatgacctcatccaaactcaattaccttccaaaggtcttacctccaaataacatcacctcggggataacggtttcaacatataaattttggaggagacacaaacattcagtccatagaaagattttttttgaggtttcaattgtataattcttatgaataagttacaagatgtcaactatttattctcagaataatgtttaactgagtaaattgcaaatctataatgatatagtaaaaaccacattgtctgggattttaccacctggaaagtgctagatatcaacacttctgacatttcccaagaaatatttaatttattcctgaggctgatgccaaaagtcaccaactctatgctgaaacacccactacatagcatcacagaatttcagaactgggcaagtatcccatccaaccaactatccttctacagatggagaaacataggcctcatggagaatagaagatgactgttgaagtcctttctaaccctgaagatatataatctcagaaactagcttgctaaagttcatactattcttttaaataagtgaacaccattctctgatcctgattatgtcattactagtgggcaactattgttttttaattcatctgagtgataaatgtgaaatagtacaagcagactatcgccagttctgaatcagctgagtcctaatttatgaggtataaataaatgtattttgagcttctcctgggaatgagagcctatctataatgtttcaatcctgaaaccaggttttatagaagagagactggcattaatcatcacctaaaatccttccaactcatcattgacaggtgtagttagtgatacccatggcttttacacaatgttgtttaaccaggaccaaatagaattctaggaactgattgtccatgacaggaaatcctacctaaacaaaaggcattctaagctcacacagaaaaatgagcaggcctgaacttgagggaacacaagaatgacaacaattgctacatttaaaccaagtgaggggggtaaagagaaactgctgtcagcatttagggagcccaccatcctggttgaagcagacagggcttgattcctgagagatctgcaatgtgcttccttctttagataaatgtggagagaattctgcattcatatgcaactggaattctgaattctgcattcgtattcaactggaattcagagaattctgaattcatattcgactggaaatatggtggttcctaccgcgatgtgcttttctaaaactcccaaatgggtgttcactaagtaaacatgcatttcaaagagaacttaggtaattcccttagcaagagaaaccagaaattctgactggggctccacaatatgtttatgaaaataatctatgtttccggaaattttgggacaccagcggtaaagaaagaaataagactgagaagtccttgaaaatgacaaactaaaaagaagagagatctggaacaataataaaactgcacatagatgagggaaagtttcaagatcttttaagataccagttaactaattgggaatccctgttctgtaattctctagccacacctcccccaataaaacaaattcatttcagcaagactgaaccatcaatttcttatttatgtaagaggatatagaaaattagggtgtcaatattttaaaatttatgcataatttaaaattatacattttttaaaaggctctgggtggttgtaaaaatttaaattccctctcaaaagatctttttggaaattattaaaaagactatgctctgaaaaaaatgtttgtcaacacctggcatgatttcaaagagtgatcctgcacagaaaagtaccaaccagctgatatccacagaaacacttcactgtcaatcattgaggatgaggatccaccataactgtgaggtattcctgttggtcacttatttacaatttcttcaagcaactgtcatactcaggtcaggttgccataacaagaataccatagactgggtggctgacacaacagaaatttatgtctcacagttttgaaggctggaaatccaagatcaaggtgttgccatatctggtgtgtggtgaggggccccttcctagctggccaatgactgcattctcgctgtgtcttcacgtggtggagagcacagggagtgagaacaaggtcttgtgtctcttcttataggggcactaatcccaaccaggagggcttcacactcatgatcaatttacctcccaaagaccctacttcttaatatcatctcattttaacacatgagttttggggaggcacaaatgttcagtccatagcaaggatatttgtcaacttctcccgtaggccaagaccccagttattcttaaactaccactagaaatacacacacacacacacacacacacacacacacacacgtgtgtgtatctatatatacatattgtatatatatgtgtatatatgtgtgtgtgtgtatacactatatatattgtgtatatatacagtgtacatatatacacacacacattgcttttctaagactactgtcttagtccatttgggctgctataacaaagtatctgaaaccggataatttataagcaacaggaacttatttctcatagtcctggatggtgggaagtccgagatcaaggtgccagcagattcagtgtctgttgagggtatgatctctacttcatagatgtcacctctttctgtattctctgacagagtcccccaaacccttttataagaaaattaatgccattcataagggtagggccttcatgatctactcaccacctaaaggccctacttcttaatattatcatattggggatcaagtttcaacataaattttggagggacataaacatttaaaccatagaaatcactgtctcctaacagacacttaggaatactttccaaaaaacttaaaccaacctagattgtgccaaaattaaccagtcaatgaaataaaaatttgaaaaaatttgcaacactgtgcccaaaatgtttttatctaatttaaggggaaacaatacatttccctttggggaattaaattctgtccaaagtgtgagtaaaacatcaagttttaattcagaaggccaatggtaaggagattctttctccaccttctcttttctcacctctcattctcctaccctccttgcaagcacacacaaaggaaaaaaaatgtggtctacattgcctcatagataaggaaccagaggcacagagaactgaaatgcttcactgtatttcatgcagaaagtgtttgctagaattagaattcacttttcactctacaagaccaaacacgacatagactatatagttcctttattgtcattgaagatttaaaatctataacacaatgcaggtagaatgatgtaaattatgtaaagatactcatatagtataaaggtattataatatagtatgtagacactatgaattccaacctcctaaaaacttagctctcctgaaaacctcagagtaaagaaaagtctattgactatgtaatgagactatctctgataattcttatatatagtattctggattggcaagaagtttatttctttttttatttcatcacattcatttagatttatggaagctggaaagatttcccttctcttatggaaatggaattaattgcagcacttcaataatctcagtgaaacccatttcccctggggaaatgaggaaagagacctagacttaatgtagataaaacaaattgacatgggacgtgaatgggagagaaatgagaaaaccattctagactaaaggtcttacacatttcaggaacgagaagtaatagagggatttttattggcagaacttattgaatctcataatttataatgtttaaagctactggtgaccttttcaaaagcaattaattcggttacatatttattgggagctacatcaagctttcaggagtcatgcacgcataccaaggtctttaaaggaacagaattaagtagataaaaggaggaaatcataaaatgtaacatcctttcccaggtggccacagcttgttcttattctatgcttctattagtaaagaccaaggtcacacaagtcagaccacttagagtcctaacaaggaacagacacccttgcaggttctaattgaactgatttgggctagaaactctgtgaacatcactgaagcctgaattttaacaagcaaaaattcaggagggaaaaactattcagatggtcttctacgggaggcaaaatacaaggaaacttttctacgccaacgaactttgcctagcaacgtgataattcacagagtattatcctgcaggcttcaaagacaacagacaatcagcctaaaagttacacctttgcttttaaatttcttcatataactaggaatactggtgtaacaatgtcaattacagcagggggccatacttcacaagcaggaaaattgtagagagatacaggtatgcgccccagttcctgcccctccctttcccacaatggaaagaccacctttcacttcttcgctcactccccatacttccagttaatagcatcaatttcaaatactactacaactttctcatgttccaaaaaattgacaagcacatgaacatccgttcaattttctctggcaaatatttatcaagcagcaaataatgtggcactatactagccgtggtattgattaggcattatcctatcttcaagaagttcactagttaatggacctttgggtgtggcatataaaggtatgataagtataagggccaaaaagacaccacaaagaacaaaattaggaacaaattatgtattactggccaggcgcagtggctcacacctgtaatcccagcactttgggaggctgaggcgggtggatcacctgagatcggtagttcgagaccagcctgaccaacatggagaaaccctctactaaaaatacaaaattagtcaagcgtggtggtgcatgcctgtaatctcagctactcgggaggctaaggcaggagaatcactagaacctgggagatggagattgcggtgagctgagattgcgccatcgcactccagcctggacaacaagagcgaaactccgtctcaaaaaaaaaaaaaaaaaatatatatatatatatataattaaaataccaatctaacagcaacaacaatatgttttgatgctcaagaacatgtccaggacaaagcctgcaggacacaaggtccctgtgccacctgcatctgtcactgcatcattggttctcatgacatgttccagcctcaactgatgccactatacttaattggcacagtttaaaattataaaatattagtagtaaaagggaccttagtgaccatctaggcttatttcttcatttcagaatctagcctagagattaaaatgttggtttttatccccataattaatttgttgaatcgtcaagaccagaatgaatgaaagtcatttaccttccagtcctatattctttagctacaccacactgtctgccatccatatggaatttgtcctatacccacccaaattcttactgcttcgtctcagaaagtcttgccttcaccatggaactcttctaaccactgtctctattgatctcactcttctttgagctcctacaacactcacaggctaagccacaattgtcctatcaattactttattgcttctcgtagggaactctcccaagtacacagtaggtcacttgaagatagagactgatcctcaatagtattcttgtgatcctagcttctgtcgggcacagtcaaggcagccctaaatacctgctcagtggctgaatcatcatttaatgtaacctcacctccatttactatattgggtatatcaaatacttgctattacatgaaaaagccatacctgtcttcaaactggcacacctgctttacacagggcagccaatttgtgctttaaaattctaaataaatttagctcaggtgaagataaggaaaaagagtaaggtgtgattcagttgctttttttcacatatttgtttctcagtttttgtgtgtagaccttggataaggcatttaccttcactgaatcttgaactcacctttactataagggtaatattatctactttacaagtacacatgcttattgtgaagattaaagaaaattgtgaatggcaagagcatatcacactaatgcccatgttttccatcctactgctctagcctctaaaacccaaatccatcctttgtctcattctgctaaatcctgggaaggtgctagcagatatctaaggagttggttaaaacagacttaaggtgagactcctccctaagacagttttttcatggacacaggaagaggaacatcacactctggggactgttgtggggtggggggagggggaagggatagcattgggagatatacctaatgctagatgacgagttagtgggtgcagcacaccagcatggcacatgtatacgtatgtaactaacctgcacaatgtgcacatgtaccctaaaacttaaagtataataattaaaaaaaaattaaaacaaaacaaaacaaacaaaaaaaaacaaacaaaaggcagtgtttttaacaaaaggcttcttcgaacctcaaaggattgctgttctcacagattaggacaggcactggggaagagggccctgctggtgcctcaagtcatccccagaagcagtagcctcggagtgtcttggtaagtggatgcggctgggaacagaagtgcatgcagctgggactagaagccctgtgctctagtttcagctcttgctacattttaagttgctcttcttaaaaatgagggcaatgacactttgggaggccgaggcaggtagatcacaaggtcaggagactgagaccatcctggccaacatgggagaaacccagtctctactaaaaaataaaaaaaaaagaaaattagcccggtgtggtggcacgtgcctgtagtctcagctactcgggaggctgaggcaggggaatcacttgaactcgggaggtggaggttgcagtgagccgagatcgtgccattgcactccagcctgggcgacagggtgagactctgtctcaaaaaaaaaaaaaaaaaaaaatgagggcaatgatttagatagtcaccccaatcattccagccctactatcatattctaccccttcataccaagaagacagatgctaaataaggatcaggagccataatgttaattttaaccaaaaaacccatatatattcatctggtgatactagagctgaagaaaaccatgatgattagtaaagcaagaaataaaaaatgtatttccccggattttttatggttggttgtagatagaaaaatgggggaaatttgctgattgagattaaaataataataaatatgtattacatatatactttgtgagtggcccaggaaaaacagattttttgtttgttcattttttaagaacaggtagaaaaaaggatttttttaagtgaaatgaaatttttatcaacaggaagacacaactcatatgtatgtcctcaaagtctcaatttcagaccctcacatgaaaggctgggactgttccaccctaccccattccccattcccccttgcaaggtcttggcgattcacagtgtgccaggcaaggaagagaagaaggcctctctgtatgggtcccaaatactgcagaggctacagaagagatccatgtctctacagctaatacgccattgttgcagttcttaaaataggtagggtcccatttcagctggtggggaccaaggcattctgtgacatttggatgagaattgcaaagtatctcactgtcaatcaagtaaaggaatatttcatcttcatagcatcatatccaaggcagcaacagctttcaagaaaaaagatgccagaagttcatgggcactatcaacaatctcaataagcctcatgagaaagttgtttcacctgtccttaatgcacagttatgtgggaagagagatttgtttgtgagctttgaagcaaaatggaaaattagcttaacctctgcatcaatagttcagaattgtggccacatctcacattgttactattgttcgtagcaacataattataaaatcgcagagtttaaaattttgtgaagactccctaagtgtttatttcccaatttctaaacagagatactgcacttcttcaaaagagtcatggttacgggtagtctctgcttttggtgtttctacctgcatttcactaagaaaatatcacaatacctcatctatttaaaatattatcagccaggcgtggtgattcatgcctgtaattccagcactttgggaggccgaggcgggtggatcacgaggtcaggagttcgagagcagcctggccaacatggtgaaacgccgtctctactaaaaatacaaaaattagccaggcatggtggcggacacctgtaatcccagctactctggaggctagggcaagagaatcccttcaaaccagaaggctgaggttgcagtgagccgagatcacaccactgcactccagcctgggcgaaagagcaaaactctgtctcaaaacaaaacaaacaaacaaaaacaaaaattagccgggcatggtggcatgtacctgtaatcccagctactcaggaggctgaggcaggagaattgcttgaaaccggaaggtagaggttgcagtgacccgagatctcgccactgcaccccagcctgggtgacagagccagactccatctcaaaagaaaaatatatatatatataaaataaaatattatcaatagcttataatgggcacacttcctacaactccatcaatctgctttcagccaacagccctgtctctggggaacatgtagtgcccggttaggaacttatattttgaactgcagtcgctccaaagggtacaactatagcatggtggataaaaccaacagggctcgtctctggagcttctctggcttattttggcaacaggtggacctgtgtggaaaccagtacttattgcattcattattcagcaggcatttatttacagggtgcctggcatatgcaaagtactaaggttatagcagataataaatgataaatgtatgaggtgacagacatgctaagtaccctgacttgatcattatacacaatttatatgcatgaaaacatcaaattggatcccataaatatgtacaattacaatgtgtcaactttaaaaataatcaaatttttaaaaaagagtccaaaatgccggcctcatgaaccttacatttaccaaattgttgcatatcctgacattgcaaactctggggaccagaaagagggaaccaggcctgggtgctcttatatccctggaaacacagcaggaactactcagaagtcacagaacttcatgccagtgattattcaaataaatggcgcctctgtggttttaaatagaaggtagggaaatcactgtcatttccaaattataagaaataattgataatccagaagttgttcatgttgcttaatagtaaccaccgtgcaccaccctgacttactagagctcttaaaacctcatccagtatatagcactattcactgagcaattaatattctaacttatgtttgagtattttttaaatttccaaataatttgaacaaatttctcacaagaacatatctccttttaaaaatatgacattaggccaggcgcagtgactcatgcctgtaattccagcactttgggaggccaaggtgggcagataatttgaggtcaggagttcaagaccagcctggccaacatggtgaaagcccatctctactaaagatacaaaaattagctggctgtggtggcgtgcacctgcaatcccagctacttggaggctgaaacaggaggatcacttgaacctgggaggcggaggttgcagtgagctgagacagtgcctctgcactccagcctgggcaacagagtgagaccctgtctcaaagaaaaaaaaaagacattaattctatgtattgataaaaaaccctgaacgtcatgttttcaagaacactctttctgctcataactagctatgtgactgggctcagggcattcaataacctcagcttcctcagctatgaaatgaatgtattcaggtgaataattatgaagtctccagtaagctacatgatcttttaatgctaaatagatcagtgcagttggtgtggattgactctgccccatgatgcagtaagagatagaaggctaaatgcagtggttggagcagaaaaggaagagacagacataaacacaccaacaggtcaggagatagagggaggacctgtggtatgaaggcctaaaatgaagcctcaatatgatatgtgccttgacatcttggaaaaaacaggagatcctccagcggcctaactgcaagtttccccctccatggggctcccatagatcctggagccaaacaaccctccttattaagaagtgcaggcccagtttctgcttttctctgagtggcggccttcagttcccttccagcccatggagttattcaaataagccagtcacattctcccatggaaccagggttcaacctcttgttactacaaagcctacctcccacatcccctgattgttcaccgtgttcccaagtgcagcctttgtgtggctgttcctgcagtggcctcctcctgtaggctgtgaatgtatgtgattaataaactgctgtcaatgttatctgtccagcggcaggtgccatttactcggccatctccataatccctccctccttcaaccaatgggatgcagagaaggcaatcaaaacaaacttgttcatgggtcaacttgacacacgcagttgattctgagtatatagaaaataataaggtaaatggcctccaagtgagtgcaaggcaacagagagaccaagaagatacagaggaaggtttttctgtaggcaggtggaggacagccacaggaggtgtaggtagccagaggcagtcttatgagatccacatctaaccacaggatgcagcctccaggcaagacggctggggctggggacagggctccaaagtttacataggtcagacaagcaaactaaaggaaggagttggaccaattatccagacaaagactgagccacagagggcagatacaaatgagtcaatagatgctcaatctaaggaaaaaaacagaactttgattactcagattgaatcatgggataaaatattagcagccaagtcaccctgatctcaagttactgcccttttcctcgtccttttttttttttttttttttttttttagacagagttttgctcttgttgcccaggctggaatgcaacggcgcaatctcggctcaacgcaacctccgcctcccgggttcaagcaattctcctgcctcagcctcccgagtagctgggattacaggcatataccaccatgcccagctaattttgtatttttagtagagatggggtttctccatgttggtcaggctggtctcgaactcccgacctcaggtgatccacctacctcggcctcccaaagtgctgggattacaggcataagccaccgcgcctggcctccctgctttttagcattcaagacagacttgtttccagaggctgaatagagctgatctgtccaggaagttttagaagagctcaaggggaattgtgagtcacaaaaaaatcagaacgagggccacttgccattttcatctcattttaatcatgttatttttccaaggattaacaccaaattttcaagactgttattcacctatttttaaaactattttgcagcttctatgtgtagctctggcatcatgccaggtttttgtgattttcaaaataattgggtgcctcattaaatctgttagctaacccccctaagatcatggagttcggtattgccaagatcacacacttattccattctttaatttttgaaagtggcttttatcaggattatcttggttccataattggctaaatctctccattctatttcctttaatttaaaatctctatccagttcttagtctctatagaacacattcactgcttgagcttttccatttggggccaggcctattccacttgtattacctttcctcaatgtattttataaagatttctgggaggtcttccgtagtcttccacactttgtaggactaagatccatatttgaaatattcattcattcaactaacatttacttgtggcacacctaaaacttgctaagcattggatagaaacttcaggaacctagtgaagaatgcagttttattttacagagtgtaaattttccttttggatacaaaaatgtgacaaaaaaatcaaggcaaattctttttcttcctttccctaaaacctcctcggattctggatctaggattgtacttacaagaccaatcctataattcagacatttggcctctgtatgtaccgtgattaagcaagtaaagtctgggtctgcccgagttaaaaccagtgctttactagtcctacaaatccggaaatcattcagattcatttttctttcctggagacctctgccttctaaccacaggtggtctgtacctgtcctcagatgtgccgtgagattgggtgtcttacttcaggatcctagctccgtctctctcagtttctcccacttcccagcgtcttcctcaaaaaaggatgcatacaaggtagatttaggtgctcctggctgcctgagatgtctttgttccttcctcaccttgcatggaggggtctgagtaagtgtagaatcctactttagatgactgcacctgattactcctttgctcttcaggactccgaagggactactccgttgccttctagggtaccaggatgctgcagagaagctggagcccattcctatttccagtgctttgtttggacttattttttctcttcgatgttctaaaaattcacaataatttgcctttttttctctctctttcaatttttggggctggctacttggcagacctttccctctggaagtgcatattctttggtttgaggaattattcttgcattgtttccactgatttctcccccttattatctctctctatacgtagaacttccagtgatcacatgctagagccccccattttcacatcttttctctactctcatcaatttctttgccttttattttactctccaggcaatttcaactttattgttaaattcttctatgtatttttttagcacacatatttttaatttcacatagcactatcctgtcctctgatttctctctttagcatagaatcaatggaatcttccgttatctctccaaggatattaactacgaggtttttgaagcattctttttttctatactttttaatttccctgtttacacttctgaaaatttaacttcagttggtttattttagaatatgcctttccttttagaggttgttctaaaatgtctgattctagaatgtttctaaaacatttgtatttcttgtcattcgtgtttaaaacaaagccattaaaaagctgaccggaccgttgagcacactaggggtcttgctagctggtggaccttaaggttggatgactgggcagtgagagcttttttattgggacacacccaaagtcactgtctagaggacttttctgctttctggtggaaaagaactgcccaagcccacctgccattcagcattctgggagcagagccaggaagagagctgaggcttccataattcagtgcgtagacttcagcttcctctcctgcattcagccctgtctgtctcttcaccctagaacagggtttctcaacctcggcactattggcatcctgggctctagccctgtgggagactgttcggtgcatcgtaggacgtttagcagatctctggcctctacccactacacgccaggagcaccccccaagttgtgccaatgaaaaatgtctctagatatgggccaatgttccctggggtgggctactgccctgcagggtgcttgggctccctgaggtctgagttcttccaactgtttctccagttacaaagttctaaactcttctagaagcaaagggtaggtgtggtttcctgaagctaggagatacgagagggaaagtggggatgtaaatgccacatgtgaagattttcttgcaattttgcctcgtgttatccttgctctctgtggtatctagagcccccagtcatgtgtcattatgggactctaacagttgctgctcaatgatacctgcagacactgagttcagctttgtccctccgctggatcagtctccactcctccaacccctacatattccaaaaatgtgtggacacctctagcccactcctgactcctcacctcttcactattgaccttgtcttttctgtcttttactggcatttacatggacttgtggaagggggcagagagaagccacatgcccaatgccccatgtttaactagaaacctgtactgttactttacaaatgtgattcctcatttattggtttagtacgtgcataatgaatttcttcagtagttattctagagattctgattaattatacagagtgatattgatcacttatatcattttttcttttcccaactcagatcaactatctcatgctcccagattagttttaacagtttaagaagtatggaagagttgacagactcgtgggtctctttttaaaaaaatctcttttgtaaccagcctagacgccttggctgaacacgataggagggctgtggaggtggcataagctctagtccaaggctcccttttgtggaaacgtgggtagacgcctcctggcggatgcctacagcaatacctggagcatgccagcaagtaaaaataaacctggaagagcactgggttcaagcccacgttccgtccatcccagagggccctcgagcaaggcctcctgcccaatcacatgtttttatcataatagattcttccaggtggtaagagcagtaatacaatcatcacacagtttgccaaagcattttccaagaataactgccagaagtgtgcattcagcttgtgtgtccatatgctcctggtaagatttagaaagcagggaaaagggatgagaaaagattaagtcaggaaaattgaaaaagaaggagacaaattgaaaagggaagaaatcgaaaaagaaagaaaggtgattccactgatgagtgggcgatctgctactctttgaaccataaatacatttcctctaactaaatgcatcataggtattctcaattcgatgtattggttttccacaacctaatctatgaattttcaagtgtaattgtacactgctgtctgaacaacacaagagcaagtccttcagcattgtacatagtgtagccatttaggactgtgcactcaaaattggttggcaaacatagggcattatgaggctgaaataactgtagctcactcttcctgaacctcattacttttggcagtgcctctactggtaagtgaaatgagttggatagcacaggagcagatatatgtttttaagaataaactcagggaccttgagtatcacaaaatcttagttaatccacctcttttcctttagaactctgcttcagcctcacccctctgaaagacctggtgccagctctgcccgcctccactggctccatttatcaatgctggcccctgcatccctgatcctctcactaatcctaagcttagagtggcttttcctctcccatggggccaattcctattgaacttcagttagtccaggtggagtggggctctcggtctaggatacaagcaagctcatgcccttggtctgactaacactatattttaaaattggacccaagaaccaatagaaatacattccttccatttaccttgggatgcagaaatactctcttttaatgatcttgaggtcattttgttccttgcattgcaaatcctacaaggataaaacttttatcttaaatctacttacttaaacttctttttttaacaagacaaaatttaagccatattcccatggctgacacaaaaactgaagcggttttctccatcctgatgtccttggaaattgtacttgtaattcagagatcaagtatctgtcttcgtttaaagaaaataagcaccaactggagctctagtaagttttcttttctctctccaggggaggttgttgccctatgtcatgagaaacacagaggacctgacatgtagaatgactatgaagcagtgttcatagaaataaacccccccccctttttttttttcttgagacggagtctcgctctgtcgcccaggctggagtccagttggcgccatcttggttcactgcaagttccgcctcccgggttcacaccattctcctgcctcagcctccccagtagctggggctacaggagcccaccaccacgcccgctaattttttgtatttttagtagagatggggtttcaccgtgttagccaggatggtctcaatctcctgacctcgtgatccgcccgtctcagcctcccaaagtgctgggattccaggtcccatcccttttaatttctgcacgggccctactttaagtatcgctgcagtggcgaaagcattcatcattgccgacctgtgtggaatgtgaacctgagtattttctattggcgggaacttacgtggctaaaacgtctcctttataatgtggagctaaacagttcaaaatcttgaacagatcttatcacccttaaagtattatgtaatatgatcctcacccaagaatgacctccaagtttcctgacatacttgacgggggagactggtgtcacatgaggaccagtaaaaaatctgtactgaactgaaatttttatgcctcaacatttttttacaaaaggaaatcaaatgtgaaaatttatctggatgctccatacttcaaacaattcccattaaatgcattaaggctttccagtggcctcccatagcaggattcctccaacacttctgtgacggttcattttacatgtcaacttgactgtttcacaggagtgcccaggtatctggttaaacattatttttgggtgtgtctgtgagaggctttctggaagaaattagcatttgaatggtggactgagtaaagcagactgcccatcccactgtgggtgtggcttatccaacctgttgagggcctgaacagaacagaaaggtggaagaagtaaggattctctctctgctggagtgcttgagctaggacattggccttggagtgggatttacaccagcatcatttctggttctcaggactctggaatcagactaattacaccaccaacttccctggcctccagcttgcagatagcagattatgggacttaacctccacaatcacacaagccaaatctttataacgtgtgtgtgtgtgtgtgtgtgtgtgtgtgtgtgtgtgtgtgtgtgtgtagacacactattggttctgtttctctggagaaccctgactactagaatttctttttttttttttttatttttattttttgagatggagtctcactctgtcgcacaggctggagtgcagtggcgcaatctcagctcactgcaacctccgcctcccgggttcacgccattctcctgcctcagccttccaagtagctgggactacaggcacccgccaccacgcctggctaattttttgtatttttagtagagatggggtttcaccgtgttagccagggtggtcttgatctcctgacctcgtgatccacccacctcggcctcccaaagtgctgggattacaggcgtgagccactgtgcccggcctgactactagaatttcttataatggcctacccaaggtcacatatgatctcactcctgcagacctccccaaattatttcctacagcttccccctccccagcttcctgctgtcctcaaacatgccaggattactaccaatttagggcttttacacttgtttcttaagcctagagtgccttcaactatattttgtcatggcttttgatttctgctcaaattatggcatctcatatgtgctttccttgaacagccaatctgaaaagaagttcctagccccatctgtatccaggctccctctagctgtttttccagtggttgaggtctttaagtttaatatctctccaaatatttctttcttctcaactcccattttcctctcttctagactccagttacctgtgattagataatttgatattatccacaggtctcaagtagcctttttcattttttcactcttttcctctctattttgcaaattggataatttctattcacttgttcaaatttactaatcccttcctctgctatgccatgtttgctattaaacccatcaaaaaaattctccatttctgatattgtacttttttttccagcacagctgtttgattctctatcatttctatctctctaagatttcctttactttttcactttttcattgtccatttttctgctgatctttaacatatatacatatgtatgtgtgtgtgtctgtgtgtgtgtaatctgtccaataattccatctggtccattccttggtctgcttctgttgactattttctctcttgactttatgtttcttcacataattcatcaatttttattgtggttcagatattataggtaaagtattattacagactaaagtaaataataatgaacccccccccccaaaggatacactccttcttctctcaaggctgagttagctaatctgcagctgagatgtgtctgaacttagtctagctttagttagattcagttgaccactaactataagtttgaagacatgataggactttctctttagcaagattgggtatctgcacattgtcaagactctgaaaatattgttctccttaacagcccagccaccaaacttctaagctctggaaatctctatctacttgtcagtccatctgttagcttttttttttgagggagatggagttctcagggaattgttttttgttcatttgtttgttttgtttgtttgcttggttttggtctagtaccacttctagctttgtgtgcctccaagtagtgctctctcttagcattactgtctgactgccagcctttagggtctctatggtgtgttctgtgaagaccaatattactttggtggaattattctcagctttcctgcccaactctagccctcataggacttctgcagtgtacttggtgaggcctaaagtgcctcaaagggatttctttcctctctcctgctctacccctagacttcagcagccctctgccttgtccttaaaaaaagtccctcatatctcagggtaaattagttcagcaaagctgctctgattccatcatttggcactgtaccctgtgcatttagtgaaggtccctggaaaagagtgggcagacagatgcagacttttgtgtctggagctccttgagattctaatccttcctgccagctcatatgcagccaccaaaagttgggctggtttctcttctcctattagtccaccaagaataaaagcaactgtggatctcttctctcatggaaatgtcttgccactttctggaaattagttaattgtctctttttgcatactcagctctgatgggtttgagatgttacaatgctgtagagtgtctggcttgatattaaggttagagtggaagtgatagtctcttgtacttcctacatctatccagatagaaaagttcccaccacatctttgtcatctttatattttcagcatttgtactggtactagtacttggtagtcactcaataaattttttgttggatatgtaaaaagagaacagtgatattaactagacacctaattggtagtattaaccagacacctaactggtaaaagattagttaaacctaaatatgcccagaattttttgaagaggcaaagattatacaaataaaagaatttttaaagtaatttatagtaatgctgccactctaacacaactatgtacatggaactaatattatttattacgatcttataacactgatgcctatctgaattgtgcagatgaagaaaaataatataatctatgcagatataattatgacattagctgaggcaggaaaagtaaactctaatgtatttaagtggaaaacacacaaattaagttaaaacaaatttttaatggaagagtagaactggttcactattcacgacttttccaggtttaaaatgaatacaattatattactagtaaaacctcattacggcccatggaaatgccctgtggttacactcagtgtttcctcccaatctcatgattgactatggaaaactgcaaatctaggttttccctggttcatatcagcctgagaaattagactgaattatctgtaacatctcccttttaaacatgtgctttcagataacatcacgaccagagtactgacgagatatttccttatccaggacggactgattattcaaattaactttggtagagtaaacatgattctatattatctgaatagctacttggtttaactgacagaaatgaggaacagggtcagaacagtcagtgtactataagtgcacttatggcatcaaataccacaagcaagccaaggctggttcagcaaagcaattttggagacatccctccccataaagcctgaatatagctggcccctgttcagctctggttgggggaaaagtggattattaagaaaacacttcagatgtggccacagccacatattaatagccacagtccagcaataatgctttgacctgaggctgataaaacatggtggagtacctactaatttagattatgagctaagaaagttgtctattttttcactccgaggaaaggtaatatttagtaggaacagtttgtgcaatgagtcattttcatccataaaaatatacactatagcacacccctaacaggatacttgtttagacgttcttagacttggtcgccttggcttccttttggcatcctatggtaggatcctatgacttgattctttagaatcctctatggtaggaaacgttggtgacccttgaggccgtccttctctctctcatagcaattaagatcaactggtagatctttactagtggactcagatgggaaaacaggagttaagggcaggcaggatatttattcatataagcatgtcaaggaacttctttttctaatgattccacagagccctattttgaacaacagctgggagagaatcaagcaagctcttttaacaaggcaggctgcaagcattgccattccaggagacagtttagatgcaactattcactcatctctaaccatcacttgcgtgaacattactcaaagagatacagcaaccaaagaaatcaaaccagtaaaagaaaggtttatttgtttaatagaggtctggcagctgaggcaaaacctaacaataattctgatgaagactcagtcatttatttggagcttctaatgaatctaactaggtaccttatacaggcttgcgtgggttaaatcacagctgtaaagtgccatgctaacagatgagagagtatgtgattgtatcagagatactagggcatccaattatatttatcacctgcctcctattaaagcttttttctgttcttaacgtttgtgttggtagtggcaacatagaggttacagtgagctttgtcctaaagaacctggaaataactgaagtatgagtcagactttaggagatcagctcagaatggatcagagctcagaggaaccttgggacctcattcgtccaatgtcctaatacagatcaacgatcaaaacagtctatcaagggttcagcctaaacacaattaacatggagcaactcttgccattagtatatttagctctcgataaagcctgagaggttaatatgattctagacaaccattcataggcagagatatatcttcctagccaaaaagaaaaaatatagttcttaaagaagagtaggaaatggcttagaagtgatagttttatttccaattctcaattccctgtctcattttgctaaatgggtttaaggagcaacgatgacaatctgctacgatttgcatactcaagcaacactatgaatcactgcaagcatcctcttttgttgcttcattttagcttagtcaacgtccagacaatcagggtgtattgagcatcttctctgataaaagtattttgaagaaaaacaaaagaatggaatgttccttctctcccaagggacttaaaatgtactacctggcatacaagtatttacatcttaaaatgaaaagcagtgaataaaatcatagaccaaaactaatggtgaatttccagcctccagtaaagaatttttcttgaataaacaagtctattttatttcttttcgttctttttaattttaatagtacaggcgacagttaaaaataaaagagagagagaaaggaagagagaaaaaaatggattgattgattcaggtatccttcgtacctctgcccagagacaatgtccatcgtcagcttttaaaatgcatcctaagatgtgcatacaaaatagcatcctactgttttttacttaaaatatatctttacttaaaatacattccagatcactcctgttagcgttgctacatttttaaaatagctatgtactctcctattgtatgcattgctccaatttcttctatttctgctctacataattctcttgaaagaccaaaggctgggctcatctttttcgtcttgttatgcccaatgaattattttttcaatttttgaagtcaaataagtttaccgcaatatatatctgtattttgatctttatgtaaacattagtttggcactcacaatcaagcatgcaggccaggcgtggtggctcacgcctgtaatcccagcactttgggaggccgaggcgggcggatcacgtggtcaggagatcgagaccatcctggctaacatggtgaaaccctgtctctactaaaaatacaaaaaattagccgggcgtagtgatgggcgcctgtagtcccagctactcaggaggctgtggcaggagaatggtgtgaacccaggaggtggagcttgcagtcagccgagatcacgccactgcactccagcctgggcgataaaacgagactccatctcaaaaaaaaaaaaaaatcaagcatgcactttgaacaagccagggtgtaagcattgccatcccaggggatattttagctgtgacttttcactcgtctctaaccatcacttgtgcgtacattactcaaagagatacagcaacagaagaaatcaaaccagtagaagaaagatgcatttgtttagtagaggtctagtagctgaggcaaaacctaccaataattctgaaagagacttagtcatttatttgaaaccttttatgaatcttctggttctgtaaagttttactgagttgcatctttagtttttctccattttgttatttgattctcttcttcaggaatagcaaatatctgtttgtcgattcactttgtcttccatatttaccattgaaaaactcattttaactctttgctcatgttgtctttgttttgcccgctgttctcagtgccgtcacagcgatgcttcctgccatattttcaataatctttaatttcccttgggttatttccaaacaggactttatatttgatgttcgtatttttttcttctacttattgcctgagcttgatcagctcatgtttaatcttcttccattgcttcaccacatttttcatgacctcttatattcatggcttaagtttttgttttctggaaattattgctttctttaaaaaatgaacataagccagtattttaaacacagatattttgcattgggaagattttttagatgcacgttttctatctgccatttatttttgttttttctaatctattctacattacttccctgcaggacctgttctttgttctcctcaccctaccccaccactcaatttatcacttgtctttgcacgaagtgagttgtttcaggcgcagccattgttgttgttagtgaggttctttgcggtgcagagttgggtgaaggcagctacaggaggctcaagggcagatcctccttcaccacagagctcacaactatggcaatggctgtgtcctttctcattcacccaaacccactgagtatcccttttccaccagcccacacacctcaccactgctcccaacaatgggtggttgttttgcccctcctgttgcgccgctagcattgaagatctacgttctgttggctttgtctacgaactgccacgtggcgcatcctgactcggcatctctgcacacctccttttgacttctttcactgcacttgtccactcctgttcagacactgacatttaggatggcacacaccttctagttccactgaaaataaatcttatgtttcctgtttctaatctccttattttctggagaaaagaatggaagcaggatccctttactccaccataaaaggaacacatacccacaactattcatttggggacttccaaccatatacacaccttccccatagttaagtgccactttaagtggttccttcgccattgaagacaatgtgaaaggcagtgtgaaaggcagcaagatctcataaattcttcataacatatataatatatataatataacatataactttataatgtaacataatataattacatagtaatacactggagaacacggaaaagaattaggaaaaaagattttactcctttcagtatccaagagagctcacagagcatcattcaggactcagaaagaggggcagagctcagttacagtgaagaatgggttccccttgattttcctactgtttctatgttctttgagggaaagtaaagaacaaacgtattttgtgtaaacatgctcagtgttgaaattgtatgacaaaaatagtcttctaacaaagataataataacatctgctgagcacttagctatgtatcatgtacctatgtcctatatattttttgtattaaaactttattgtgacataaccatagattggcatgcagctataagatatgatacagagggagcatttgtactctagccaacctcttccaatgctaacatcttgcaaaagtatagtaaaatatcacaaccaggatgctgaaattggcatagtgaagagaatttttccattactacaaagatcccatttattgccttttttatcaccttactcaccttcctctacttcatcccctacatcagtcctaaaaaccactaatctgctttctgtttctataattttgaaatttcaggaattttacacaaatatagaattatatgatatgtaaacttctgagattagttttttcactcagcccaactttctagagattcacccaggctgctgtgtgtatcaacagtttatccctttttatagctagtggtattctatgggaaggaggtaccacagtgtatttaaccaatcccctgtggaagaacatcttaattctttccagtttggggttttttgtgggttgagttgtgcaccaagaatttacacggtgaagttctgattcccagtttctctgagagatcacctcagaacaagatcttacttggaaatagagttgttgcttgtatcattagttgagataatgtcatactgtagttgggtgggcctctaatccaatgtgactggtgtccatataaaaaggggaaatttggacacaggtgggcacacagggaaaatgtcatatgaaaatgaaggcagagatcatggtgatgcacctacaagccaaggaatgcccgtgattgccggatccctccagaggccagaagaggggaatggaacacattcttcctcatggcctgctgatacctcaatctcaggtttctagtctccaaaactatgaggcaatacatttctgttaattaagccacccagtctgctgtactttgtttaagtagttctagcaaatgaacacagaactactgccagtaaagctgccacacatttgtgtacaagtttttggtctttgttttttgagacagggtcttgctctgtcacgtagactgcagtgcagtggtgcaatcacagctcactgcagcctggacctcccatgctaaagcaatcctcctgcctcagcctcctgagtagctgggactacaggtgtacatcaccatgctcggctatttttgtttgtttgtttgatagagacaggatttcactgtgttgcccaggctggtctggaactcctgggctcaaggaatcttcctgcctcagcttcccaaagtgctgggagggattacaagcataagccactgcacctggcatgtgtgcaagactttttgtggatatatgtcttcagttctctgggctaaatgcctaaaggacaaaatgatagttgcaagtttacttttgtaagaaactgccaaactacagctgactcttgaaacacaaggtttttaactattcaggtccatttatatgcagattttttcaataaatatactacaaagtttgttagagatctgtgacaatttcaaagctcacagatgaaccacatagtctagaaatataaaaaaaaataagaaaaagttaggtatgccataaatgcataaaatatatgtagatactagtctactttaacacttactaccataaaatatacacaagtctattaaaaagttgaaatttatcaaaatttgcccacacaaacacttacagatggtacgtggcaccattttcagtcaaaagaaatgtaaacaaacttaaagatgcagtattaaattataattgcataaaatcaactgtactccatactgtactgctgtgataattttgtagccaccttctgttgctattgtggtgagctcaagtgttgtgagtatccacttaaaacgctctttgtccccacacagccagttcgtctctccagtaaattgcctatcacagcaaaaagtgatagtttctggttcttgggtatttttcatcatgtttagtgcaaaccgtaaacgctgaataacaccatgggacccacatgaaatatcactagtgatgccagaagtgctcccaagaagcagagaaaagtcatgtgagttgcttgatatgtaccatagattgaggcctgcagctgcagttgccaaccatttcaaacagacaattcatcttgtaaacagacaacataaacttaaggcattgatatatacagcatggcactgtaaatgtactttttcttaagattttcttagtaacatttccttttctctagcttactttatcataagaatataatatgtattatatatacaaaatatgctttaatcaactatttatgttatgaattgcattcaacttacatgtcagcttggcaagaattgacatcgttactatgttctcaaccaatccacgaacatggcatgtctctccatatatttagttaaacgttcaactacttatgttatcagtaaaacttctggtctattagtagttaagttttgtgagagtcaatagctgtactcatattttcttttgttttccctcaaggagtacatgtgcaagtctgttacatcgataaattatgtgtgctgaggtttggtgtacaaatgatcctgtcacccgagtagtgagcacagtaccctgtaagtaggttttcagtccttgtctctctcccatcctcctcccctaggagtccccagtgcccagtgtctatcattcccatctttatgcccatgcatacaccatgtttagctcccacttataaaggagaatatgcagtattttcttttctgttcctgtattaatttgcttaggataatggcctccagctgcatccatgttgctaaaaaagacaattgtaagtggtatgtatctttaattttggtgtcctcacattcattactataatatagaaataaaattgatttttggatgtgtatcttgggtttcttctttgggttccgtgaccttgctggactcattcgttagttctaagagtttttatgtatatttcttggaattttctacatagacaatcacgtcatctgcaaataaggatctcttcctttctgatcgaaatgtcctttctttttcttatcttattgcactggctaaaacctcaagcactctgttgaataaaagtggtaaggatagacatagttgccttgttcccaacattaggggaaaagcattcagtctttcaccattaataataatgctagctgtagggtttctgtaaatgtcctttattaagttgaagaagttcacttctattcctagtttcttgagagttttttatcataaatgggtgttaaattttgtcacatgcttcttttgtatagattgatagaatcacgagctttttcctctttagctttctaaacaactcctttgtttcctttaactaatatgtgtataaaatttcattttccatccttcacctcctatctgcttatcattatatttgaagtcggttctttatagaagtaatactgttgctttagtttttacattatatgtacataatttatgacaatctactagtgtcatcattttaccagtttgagtgaagtacagaaatcttacctcccttcatgtccttttatcctgtcctttttataaaaagctgtcttaaatatgtcctttatatatatttagagccacatcagacagtgctgtagtttttgcttcaactgtcaaacatatgtagaaaactcaagaggagaaggaaaggttattgtatttaacaatactttcacttactatagtctttgctcctttttcatgttccaaggttctgtcttctatcacttcctttctgtttagagaatttcattcagccattctcttacagcaggtctgctggcagtatattctattagttttcctccatttgagaatgtcttgattcctccttcattcctgaataatatttttgctggatatagtgttctgagttgtcaattcttttcttttagcacttaaaaaatgtgtcatttccttctggcttccaatgtttctgatgaaaaatctaatttttcccccagtaggtaagatgtcactttttaatgaaaatttttaagattttttctttaatattcataagtttaattatggtttgtttgacatcaatttctttgggtttcttctgtgtgaagttcactcagcttcttgaatctgtaggtttaagtcttttgccaaattcgtgaatttttcagtcattatttctttgagtgtttttctatccaacctctttattttcctccttacaggactctaatgacataaatgttagatctttaattgtagtcccacagatctctaagtcttcctatttaatttcagtctatttcctatttttcagattgggtaacttctattgttctatcttccagttcaccaattctttcctgtgccttcttcattccactgatgagccaatccactgagcttttctttggttattgtattttttagtccttagacttacatttggttcttttttgtaccttatatttctttgataagactttgtatttatttactgaggctttctattttctcatttgtttcaagtgtgtttgcattgcttattgaatcatttttttcatggctcctttaaaatctttgtcagataattttagcatctttgttaccttggtgttggcatctattgatggtcttttctcattctttttgagatctttcttgtcctccatataagtgattttcagttgaaacccagaatttttctggtcatatgttatgaaactttgaaacttatttgaaccttatgtattagttggcttttctaatacttctttggcagggaagagaagaggaaccaccccatgactaccagttggaggtagaagtctagttttgcaacatggcctccaatgccacctaggggtggggggagtgtttggcagggggggttgttctggttccctacctggtgttcaatgataccagagtggtgatgtcctccttaacctggcaataaagtcctgactctccactaagtaacaccccaggaacaatggtgaaagtcctgacttttctctgacaaggagagagaatggggcaccttgctactgtcaggtggagattcaagtccagctatccacatggtctctactgacattgtggtggaaagtgaaggaagtctcaatgccagtgacaggaacaaaagtcccagctccctacttggcctctctgacatcaccctagtgagagtgctggggaaccccattatagcttgtgaaggtagaagtctagcctccccactcagcctttgctgatatgggtgggagtgatgctacagttttttctgtagtgtttggctggagtaaagtggttattatccaaaagtttctgtctttctttgtttttttttgtttgtttgtttttgtttttgagatggagtctccctctgtcgcccaggctggagtgcagtggcacgatctcagctcagtgcaagctccgcctcccgggttcacatcattctcctgcctcagcctcccaagtagctgagactacaggcacccaccacaatgcccagctaattttttatatttttagtagagacggggtttcaccatatttgccaggatggtctcgatctcctgacttcgtgatccacccgcctcagcctcccaaagtgctgggattacaggtgtgagccaccgcgcccggccaagtatctgtctttctatgctgccctttttccagggctttgactagagagaccaggcttttgttggggacttgtcttgtctgtgcccattggcattgctgggttgtgggtttcttctactccaaatatgggatatgagtggaaaaaaacacagggaactcattagcatgttattcctcatgtcctgagtccccagctaatctgccttgttctcttcttctttcatggcctccctacatttgttttatgcaatatatacagttttttattgtaattagaggatctaatagaggacgctattcctactccatcttcttggaaacaagagtctgtcttagatattttacacttactcatttaattctcacaataaccttttaaagtagtattattaaggtctcaattttacatttgaggaaactgagttacagagaagttaagtagcttgtctatggtgacatgctaacagcagcaaagccaggtttcaaacccaagaagtcagcctccagagtcagtgctttcaaacagtatactagaactgttttcaagtaataaatgttcacaacgaagctcctcatttgtcttggttggtctctccctgcagggctggactcccgattattgtacaatagttgagagtgccctctgtggaacatagtcctcaggttacacgccccatcttttccccacttcttacccacaagtatatacctagttttaaaggtgcagggttataagcataaaaatgatcagtcatgatcaatcacatcccttatttttgaaaatccatcatgagtgcgcataataacctcaaaatgagagccatgaatgtaatcatcgtccctgtgtttattaatcacatccttttgaattcaacactttttattttctgccaacttcttgctgcattatctacaaggtaatcattctttcaagggatcttctttaagtctcttccattctctcagcctttagcccaagtcacctccatcactttcaataagacttcaccaattctgtaatgttctactacatcaaaagccacagaagcattgagatggaaagagcctttagggaccattttgctggtgataagagaactaagtgacttggacaatgttacactgcttcttcgtgacaaacctgagactagaaaactactacatatgacatcctacacactgactcccttcttcagctctgtctgataaagggatgagagatcgtttcttattattacacatacacgccacttccgttccttccatctaaacctagttcagaaacaccgctaagaattcccacccccaaaaaaatggggatgggggaagagaaggaagtgaacagtggtgtcatcccaccaacaagcctgactgcacaaactatctgcctgttccataacaaagagattatatcaaacctacctccccaggaatcagtctgattcaacctcggaactcctccttctcctttccatttggcccaaactagggtttttctctcaggtcttttgggctttctgaacaagtgccagcaccctgtggcttgctgctgccagcccaactatagtaattttccagaagtctctggttatgccacactgctcaaggaagaggaatatcattaaagtgacttcacagccccataaacatgccacttgcagccctcttattctgtctggtggcctacaccacacactacaatcaacaagggacatctagatttcagggccaaatccctgcaaagactctgtctgaacatacttttgtgaaagcctgcagaatatagatttctgtgtgtcataaggaaataatcggtccttaaatctcaaagtacaactagctgcagtatttaaaaagcccatggacaatgacaaatatagacatcacaaaattattctaaactgatcaatgctgagaaaagtcatgatgtgtcaggagtctcagctccaaaggcagtctgccctttaacataatgaacttcagtaaaagtagaaaccatttctgagggtgtaattgacaagtggcaatgaggtcatcagtagagtttatgacatttaaatccctgtgatatggtttggctgtgtccccacccaaatctcatcttgaattgtagctcccataattcccatgtgttgtgggagggacccagtgggaggtgattgaatcatggaggcgggtctttcctgtgctgttcttgtgatagtgaataagtctcacgagatctgatggttttataaagcggagttcccctacacaagctctctcttgcctgctgtcacttaagacgtgactttgctcctcctttgtcttctgccatgattatgaggcttccccagccatgtggaactgtgagtcaattaaacctctttcctttataaattacccagcctcaggtatgtctttattagcagtgtgaaaacagactaacacgccctggatctacttttcccggttttatttttttgtaacccacaagctgtcctgcctcgtgtaatggtcttaggcaaaggaagacctctctggttatccttaattctatagatacctacttcacacacacacattcaaacacacacatacacacacacacacacgacagagggacttctaagtaaatatcatatacattatgaggaatcaagatcttgcccttttctaaagcaaataactgtcaggcttgggcaaatgcaggggccatattttctaatgaaaaaataaaaatatatgacactggacaaattattgaaaatggaggtatacattataacttcccttactttagcttgctgacaggtaaccttgggctctgccacaaagtaattttcccatctggactaactggggatcagacagaagattctttttctttcaaggtgtcctagaaaattggggacaccttgtagcaaatcaattaacattttatttgatgtagaaccttacgacaaatagtgagaatttccacaacacaaaaattgtgaagtttttggcaatgcataagaaatgaacattggcagatatgtttcacgtggccaagaacttgatgtttcatcagccatgaggctggtagtgtctctattttacacacgtgaaacatgggctaagtgaggtaaagcaagttgcctgagatcacgtggcttgtgatgagaagattcaggattcgactccagctctgtgctactccagagcttccgttctttctcacatatctagttcaggctccttcatctccgagtgggtatggagaccaagtatgcctgttattgttcctcagagaaggatttctggaggacatgagtagtctgaagagttcagcaagtcctccaagttccacccaaatctgataaatgtgctgaagtacggggcgctgttactatacaacatggtgagtaaagggaaccttctctctgatccccagacaccccagatggaaaaaggtgctttgctgcagagcccacggttatctgtctggaagcaaaagtaagggaggccacaaggtctacttccattttcaaactgagggcgcctaacaattgcaatcctgtaaagaaataaattcatttctggaaagttggaaattgtcttcatcgtgccctgcccaaagcctctggtcaagaaattgaggacttgcagaataggactcctcctcaaactcaagcttttgtgttccatgttcaatgagagattctggccacagaaatgttccctacctgctccagcaggaactaagccttcctggaacatgattatcacaaggatccctcccagtgaccacattttctgacatcagcctaaaccaaaacgactcgcctgctcagtgattatataaatccattcagtctctgcaaatgcccaggcttttgttaccactactgctgttttggctgtacaaggcttaaaatgcaaagtaagtcacgatactaacctttgcctccagtaaggaatgctcttcttggagcagcccccatacctgggacaatgcaagtcagcctttcaatgagatgcttagcacacaagccttctgtgatccagctcctgcctctccatcatgcctcagtgtccaacactctctcttcttcagtcaattcaaactatttgtaggtccctaagcacagtttcccctctttctgccctgcagacctgctttatctagcaaatgcccactcattattcaaatttagtgcaattatccagtcatctgggaaactccccttgatccacaaccttgatttagtggtctcccctttgtgctccctgaatagcatgtccatgcttctccgatagtgctcaccacattttatagtaacagctgatgtatctacttgtgtgccccaaccaaaaatcaggttctacatatcttgaggaagttttctcattcaattttgtatgagaatttacggaacttccaattctataacatagttgttaaataaatgcttaacgaaaaggtacacttggttcactcaccaaacaaatatttacaaaggaactacaaggtatatttagaaagcacatgagttcctgagcactgatcctaagttgaagaaaccctcctcacctcaatctcttgggcacatgagaggtctcctcacagactctcaaacaattggtgcttgaagagaggtgggaagtggtacgagggaagatggagggagagcatgactgcctgctgctacctgagtgagaagaggaaagatggagatgagggcaagcagaagcatgtggtccacagcatcacctagtgcctagtgcggaagaggaaagtcttggttccatcactcattctagcttagagtgaatcttctgttgcaaactttcttattgctctaagacagagatcatcagaattgaggcaaaggctaaagcagtactacactttctatgtcagtatttttatatactggttagtggtatacatgcatgcaaatctccctttaaattcaaatgtcatgttagaaagtagggtttatatgtacaggtgtttgtaaatgagaagtttgtaatttagggagtacatatttaatagtgcctcacccagaactgctataggcaagatgatcaggaggaaaaacagcagcagctgatgccaaaatgtgtgattcagatgatttggaaattaagagacattccaaagaacgtgtgcatatttccttcagacatagtctactagctaacagattgaatttttaaaatatatgaataacttttctgacaaaagcttaccaaaatacagcaatgacttagaaatttagcatggttatatgtgatccgtttatctctcccatcatcccactatctcagagtacaaaataaaaatcattcgtttcatttttctttatgctaagtagaaaggaaattgtgtcctgttctcatttcaagttaggttgcttcttgattaaataagagaatgaactcgcctagaataataaatgatcctctcaactgcacgttaactgaacactctagcataaattaacaaagcagagagatcaggtggaagtatagctaaaagactaaaattagtttggcatgggtttggatattagttttgtcactctgtagctatgtaagtttggacaaattaccataaactctccaaatctcaattttctcaactgtcaacagagttgacagcaaatatctcatgaaatggcgagacagatttcaaacttgtcatttacaaacacctgtaaatacgaactctactttttaatatggcattacaacttacaagatttgtatgtatgtatgcaattaaccatgatacaatggcagcataaaatggcaccggtaaagtgtcaggcacacagcctattgcagagtgaacactcacattttgtttccacgtgccccacctcttttcttgatttaaaggatttctactgggcaaatgataagagaaacaagacacttttctgtccttaaggaacttagactggtaaagaggataaaataaacacagacaaagccaggcaggatatacattttgagagcagaatgaatccaggtgatataagaacacaaaggaggaagaccatgtgccaagttccctgaggacatcaggatcaacttcatgaagagaccattttaaatgggtctcagagaattggtagggaccttgtcaatgtgtggtttttatttcctaagtaagactcacagttacaatacacatgtaaacacaggagaagacagaagttaaggcagatgatactctggtttaaaaatccttagaggaattttcactggtcaccaacttttagagctacattgaggatgacaactagggtggaaaacagtatattgtccagatatactattaatataaaatggggcaatgttgcctactgaagggaaggtaggggcaagccttatctttccctttctggctcagagaattcccagctttttttttttttttttgcttttttgagatggagttttgctcttgttgcccaggctggagtgcagtggcatgatctcggctcactgaaacctctgtgtcccaggttcaagtgattctcctgcctcagcctcccgagtagctgagactacaggtgcctgccaccacgcccggctttttgtattttttgtagagacagggttttgccatgttgggcaggctggtctcgaactcctgacctcaggtgatccacccgcctcagcctcaaagtgctgggattacaggcgtgagccaccatgcccagccagaattcccaacattttaaccaaagcactaggagctttccatctgtagtacaatcaccgaacaagccagaaactgtgtcatggcctctttaatccatactattccttctacagagactaattcccttaaaaactaagagacagatgcagccttagcctcggcctacacagggtccagatcatccatatcactgtttccacctccatgtcttgtcctactggaaggtcttcagaggcggtaatatgcatggagctgtcgtctcctgtgacaacaataccttcttctggaatacctcctgaaggaccttcctgacgctgttttataactaacttattacatacttctacttacataagtaaaaatacactctaaataatgataaaaactatagtatagtaaatacataaaccagtaacatagtcattatcattattaagtattatgtactgtatgtaattgtatgtgctacacttttattcaactagcagcttagtgcaaaataaaaagagaggactcaaaggggatcatttaggaaataaactactcccgggaaagggacacaatctcaacaagcaatagggcggcttgtgtagtgtagtgggctttggagaagatccctggtagcagtggagattgggagttgtggttttcacgtacttagtcatttagtcaaccagagagacaaatagttgggataaaagaggatctcataaatccaacagaagagtacagaacacagagcttaggctgttcacagcaccacctcctaggaaaacactgtgagcactcaggttaacagtaggtagatctgtgcacaagccatttactctactatggccaagcagcctaatctgtcgtgaacattcctcttccccccaaaaataaagaggaaataaagagaagggagaaagggagggaagaaggaaaccatgagtcttaaaaagatagcacagaaacaattattctgaaaatgtagaggaaaagtatagctctttaaaattatttacgacacaaatcagaagagttcaaataaattacaatgcattcatatattttgcagatgttcactcatgttctcaaataccattaaacgcatcagaaaatttgtagaatgtaatatgaagtgaaaagagctgggtgcaaaagctgtatatatcaactttacaaaactttgcacatgcggtacatataaagtcatcaattgcttaacaacatttcagtcaacggtggactgcagatatgacaatggtttcatgagattataatggagctgaaaatttcctatcgcctagcaacactgtagcagtcataaagttgtagcacaatgcattactcattgttgtaaacaaacacactaagctgctagttgaaaaagtgtagcacatacaattacatacagtacataatacttactaatgataatgactatgttactggtttatgtatttactatactatactttttatcattatttagagtgtatttttacttacgtaagtagaagtatataataagttaattataaaacagcttcgggaagttccttcaggaggtattccagaaggcattgttgtcataggagatgacagctccatgcctattactgcctctgaagacctttgtggaggtggaaacagtgatatggatgatcctgaccctgtgtacgctgaggctaaggctgcatttgtgtcttagtttttaataaaaaaagtttttaaagtaaaaaaaattaaagcacaaaaaggcttatagaataagaatataaaaaagaaaatatttttgtaaagaagagtcaaaaagttaagaaatttaaaaatgctcatcatcactggtcattagagaaatgcacatcaaaaccacaatgagacaccgtctcacaccagttagaatggccatcattaaaaagtctggtaacaacagatgctggcaaggctgtggagaaataggaacacgtttacagtgttggtgggagtgtaaattagttcaaccattgtggaagacagtgtggcgattcctcaaggatctagaaccagaaataccatttgacccagcaatcccattgctggatatatacctaaaggatataaatcattctactataaagacacatgcacttgtatgtttattgcagcactatttaccatagcaaacacttggaagcaacccaaatccccatcggtgatagactggataaagaaaatgtggcacatacacaccatggaatactatgcagacataaaaaagaatgagttcatgtcctttgctgggacacggatgaagctggaagccatcattctcagcaaactaccacaggaacagaaaaccaaacaccacatgttctcactcataagtaggagttgaacaatgagaacacatggacacagggaggggaacatcacacactgggacctgtcgggggtggggggcaagaacaaatacctaatgcatgggggcttaaaacctagacgatgggttgacaggtgcagcaaaccaccatggcacatgtatacttatgtaacaaacctgcacattctgcacatgtatcccagaacttaaagtaaaataaaacatacaataaaataattttaaaaaatgtaaaagtcaaaagctacagtaagctaaggttaatttattattgaagaaaaggaaattttaaaaataaatttagtatcgcctaagtgcagggtttataaagtctaccctagggtacagtaatgtcctagaccttcacattcactcactactcactcactgactcacccagagcaactcccaggcctgcaagctccattcatggcaagtgccctatatgggtgtaccatttttttcctcttctataccatatttttactgtaccttttctatgtttggatacacaaatacttaccatggtgttacaactgcctatagtattcaagagagcaatacgcttccaggtttgtagcctaggagcaggctataccataaagtccaggtgtgtaggaggctacaccatctaggtttgtgtaagtacacgctatggtgttagtcaactaaagaaacaaatagtggtgagagaagagaaatcacctataggtgcacttctcagaacatactctggttttcagcaatgtatgactataaatcagcaaaaataaacggaggtgaaataatagttcctctaactgagtgatgtgattatgtaagaattttagttccttcctactatttttctattttcttccaacctttctgtgaagttactttcataatttaaaacttgtaatgttttattaaaaatagatatgtttgcggccgggtgcggtggctcacgcctgtaatcccagcactttgggaggccaaggcgggcggatcacaaggtcaggagttcaagaccagcctgacgaacatgatgaaaccccgtctctactaaaaaaaaaaatacaaaaattagccaggcatggtggtgcatgcctgaaatcccagctacttgggaggatgaggcaggagaatcatttgaacctgagaggtggaggttgcagtgagccgagatcgggcctctgcactccagcctgggtgacagagcaagactctgtctcaaaaaaagaagaaaaaaaaaagatatgtttacaaatatacagacattaataatggagtctgaggataagagccttcaaagcaaaggtgaaatgtcccaaaagacaagtcggtaagaaaacacaggccacgtcctaaaggcgttggagaactgggatgtgtgagagcaaagaaagggccttgaatgccatgtttaggggcagagattttcttctgtctgtagcacatattttgaattagaaagggctgttgttggagctgtctttctagagattccggagtcggcaaatggcatctaaaattaaatggattagaggtgagtggctattgtgatagtccaagtgtcaagcagtgtcagcctgactatgtggtctcagtgacaaaagagaggacatggtagatgtgagtgttgagtacaagactcagccaatggttgggtataaaccgcctgggagaagacaggactgaagaaggctttgaaggctagattctgggtgatgaatcagagatcaatattagtcacaaaagttggaggaagaatatgtgcagcttatttcgaacatgttgagcttaaagtgtccatggagtatcttgagaagattctgagaagttgcaacttaagagagaagcctgggctggtggtgtggatttgggaattatctgtatagacaggagaggtggtcagataataaaggaggagaccaggaaaggaagagcaggagagggaggaggaggaagaaggggaagaagggatgcacataagacagaaagagaagataggagaagataccagaggaccacactacagaaaagaagtagccgctgacacagccagaagcagcaaacagaaagaggagtgcatatttcaacactgcagagtaggaaacaaacaccaacaagagagtcacccttgatgtgaaatgttatgcaaagttcaaagaggctgcacactgacaagtcgctactggaaatagtgattaggcgctcaagtgacataaaaaaattttaagtaaaaaataagaaataaaatcaacatgtccaatgtcattgcaatagacactttcctgtgggaactaccattttaaaaacacatctggagtccaatatcctaagtgtcaagtcattcctcctttgtccacatggacggaagacgttcatctcttgagtgctaatggtttgaggccaccaccacagcaaccaacagagcaactgttgtactttaactctgcccagcactaactacattctagtctgtggcctgcatggaaatgaagttgttctttcagacactgctgtgtgggactcagtctggctgcaggtgcctgcaagcactgtctgatttgagatattttctataattactggaatgatgaaatctgtcatgcagtaaggtagcaggcaggagacacaaattcattcctagcttcctgaattaaaaataaatggttatcaagtccaattgaatttgttttaattagctgggttttttttttttaagtcacaattttcgcagctcctttatcaaactgactcttccttaatactaaagaggaaacttttcacacctaaaatattcctgtaaagacaaacttgctgggtcttgttcatgtccctgttggcccctaagtatattttacttatttgtctcatccattgcctcatgtctttccaatgtgaactccataaagaaagtgatttttgtgcatgtaatgaactgctgtatccccagaacttaaatcagggtctggcccatagaatgagctcaatggatgctggtggaatgaatttatggaagaatggatggaaagaaaacatacattataagaataaatcctcagaaggatagcagcaccattacagaatcaggtgaaggtgagtagactgaatatgaagaagatatgatgagtgtcccacctatgtggggagaagatgtgaattgctgtaatgagatataggaatataattaattggctttctttatatccagattggatgcagctttgattcttcagcattactgtaaggggatggggcggggaaaatccataataagctctgtgatcctacaaatttcatttcagaaagttagaaatttattaagcaaataagacaggccatgtcaccagcggatcggcatcaggcaaaaacccaacagtgtaattggccaatgctcggaagaatgacataacgaagcttggggttgccatgagatctacatgaaaacaatttctgtgctgaaccataggtagctcttgagtttataaaccctcaagtctcccattaatccagtcttcaataactggatgatttaagtagttacagtattttttaaaatcttaatcctgagagctaagtattcaatcgttttctaaagaaacgcagcaaagaaagtaaaatcaaacaacctgcctcaaaatggcagcatgtccacacactggcttcggtctgaaggcaccaaatgacctgggcatcctctagtatgttgcaaagtttaatcaccactagatcgaaactaaataccagaacacaggtgtgcatcattcaaattggcaaatcaatatattaatactttttttaaaagtcagtgagaaaaccaccaaaatcatttattaaagggaactcaagtggcacaggaagatcttcaagccaagtcccattcatttcccattaaatctgctacaagaaccttaaactgctcccctcaaagaaaaagttagttggacagtgaccagtgagatacaaaagaagaatcacaacgcccaactactaaaacccaggatggttttttaaaaaatgaatcccttgattgagggtcaccagagaagacagatattaactaatcacagaaagaattaattagaagctaggaggagaccagtattccaagccaaagtagtaatctgtgtgaagactttgctggaacttgtattatgtctgaaagattgaaataaagtgccttaatccaaactgggattttcctgactgacatctactagttcttcaggtccccagcctacacataaccacttcaggaagcccttctctactttatcttttcaactaaatcacgccttctgacactacattccctgacgacaccttctaccattgcttcattgaactaaaagaattatctgtaccctcgggtatgattatagagatgcttagtctaaatgcaaaccaagatacaactttagagaaaattctggagcctacagagtagaccagagaagcatctcacaatgaatcctccccaaataagtcttattctttctatatatgtcaagcattaagtaaacacttgagcagcacaagtcacaggcgatccatgctggccattaatcggcagtggcaatatcagtaaagtcaacgctcttccagcatctcctggactaagatcagtgtccagtgtttttattttatttttttccacagtattttgactatctcaagataagcttctagagaaaaaaaatacaaaaacaaatgtaacaaggtcaattgagctgcgcgtgctatgtctggaaacacatgtgccgtcacataatttagcacctaaagaacaagaggctgcaaaactgcatccccagggaagcccagagctggcaaagtaatctctgcagacatgaggaactctgctcacccactttaattttaacgctactatgtacaagcttaaatatagaatcaatcacaaagaaataatacatatttaagcagacacagggctaacgaatctgagccagtacaattctgaaaactttcaagtttccctttctcactctgacatttctaggcttgctaatagtcctcacaatgtccaggaagatccgtgtttccattattccctcctgttatcatacactgaccatatcttgtgtgcctcctagatgattcatacattttcttagctctaaaaatactacagttttagtgctagaataaatgtagagaacttagaagtaaaaaaatgttttgaaggtgagataggaaaaagccaactatcttgaacaattcaaaagactttcttagcaaatctcatttctgagagctttgtatagaaatttcatcatcagctttggctgctatggcaactagatatttcagaaatgatttgaaatgagtatcactacatatccagcatcttttgcaagaaacagaaaagactatgaaatctaatccactgtaaatttcaaaatatagtgttaattttcatttttgaaatctatttatgcttctatttgcaaatcaatagataacaacctggtacgattacatatgagcacgatggagaagtctttcattttagtccttaactgtcacattaaagcatcatttaggtactctcgtcccagttttattaggcctttaaaaaaaaaaaaaggctgggcacagttgctcatgtctgtaatcctttgggaggtcatggtgggaagactgcttgagtccaggagcctaggtaacacacagatacctcgtttctccaaaaaaaaaaaaaaaaaaaaaaagtaaaaattagccaggagtgatggtacacacttgtaataccagccactcgggaggctggggtgggaagatcgcctgaacccaggttttcaaagttgcagtgagccgtgatcacgccactgcactccaacctgggtgatagagcaagaccatgtctcaaaaaaaaaaagacaattttttgggcagttttaggttcacagcaaaattaagtggaaagtacagtttccatataatccttgtcccctccccaacctaccccactatcaacaccctgcatctaagtggtacatttattacaatcaacaaacctacatcgctacatcataatcacccgaagttcatagtttacgctagggttcactcttggtgttatatattctatgggtttggacaaatttataatgacatatatccaccattagggtatcaaatatcaaaaatcaaatcctgtgttccatctatttatccctcccactcttcttaagccttagcaaccactaatcttttcaccatctccatagttttgccttttccagaatgtcaaatagttggaatcacatagtatgtagacttttcagatagacttctttcacttagcatgcatttaaggttcttccacgtctttccatagcttgacagctcatttcattttagcattgaataatattccattgtctggaggtaccacagtttatctattcacccactaaaagacattttggttacttccaagttttagcaattatgaacaaagctgctataaacacttgtgcacaggtttttgtgtggacatgtttccagctcatgtgggttataccaaggattgtaatgtcttgactgtacagtaagagtatgtttacttttgtaagaaactgccaagttttcttccaaagtggctgtaccattttgcatttccaccaacaatgaatgagagttactgttactctacattcttgccaacattcagcgttgtcagtgttttggagtttggccattctaataggtgttaatggtatttcattgttagtttaatttgtaattccctagtgagatatatgtcaagcaccttttcatattcttatttgccaggcctttccttttagccatatctatgccaaagcccaagtcccactgaatcttgcacaacagaataaaaacaaggtcttcaatgatgagttagttgtgatttgatttaatcaatgaaccagccatggttttcacattctaccctgcagagctactattcctgggtcactgaaatagctcatagcaaatacatgctagagcaaagaaagctgtgtggaaatgtaaagtaatgcaatgactggataatttaatcagcatttacacccatgcaccttaactacatatatgtaaaagcatcaaacgagttctcaaattccctgcttaggtcatgacactgaggggttcaaatagaatcatcagtgtttgcttgaaagtccacaaagtaaggagatttattcttgattgaagttttcacagcatgttaccctgaatatttagggatgatggttaagggttatggaggtcaagatgaactggtagagagagcagcatgttaagttgtgtaagtgtttgctgaaggacaatggggaaatggagtgagagacattctgcaagtgtgccacaattcaaaagaaccagcatcctcattaaaaattgtgaatttattaaaataatggcaaagttattttggaagtaaactgatctaactataattctttttcctcttgaaacttatcaattttaagatacttacaatagtgtaatctcttaaaagttttctacctctgcacttaagtgtagaaacaagcttatgctgaccttttgaatagaatctaaagcaatgtgcattacctttatcaattctaaaaggcatttccaacagctcagtcttccaaaaatatactttaaatgtagtagttagtgcaaatgatatatcagaagtatcgagtaaagaagaaaaatactatgacattcatagatgtcaaatatgttagaaaatcatcagcactgtggatcaggagttctgggccagagctgtgggcagaatgggacattaaatggggcccttattaggaagttgacatctgagcaaagacttgaagaaagtgaggaagtaatattcatggtttatctgggggaaagtattctgagcagagacagcagccagcgtagaggccctgaggtgagagcaggcctagcacattgcaggaacagcaggagggtgagtggaacaaagtgaagggggaggatcagctgcaggcatcttaaaactttggcttcggccggccgggcgcggtggcttacgcctgtaatcccagcactttgggaggccgaggtgggtggatcatgaggtcaggagatcgagaccatcctgggtaacacagtgaaaccccgtttctactaaaaatacaaaaaattagccaggcatggttgcaggcgcctgtagtcccagctacttgggaggctgaggcaggagaatggcctgaacccgggaggcggagcttgcagtgagccaagatcacgccactgcactccagcctgggcaacagagcgagactctgtctcaaaacaaacaaacaaacaaacaaaaaactttggcttctactcagatagggagcaccttgggaattttcagtaaaacaaattactttgaaaaatttttcttatcatacaaaattttaaacatgagcaaagtagagaaaaatgatagtatactctagtgtacgtatgattcagtctcaaaattactgattcatggtcattactgtttcatttacactctctaccctaccctcaccccaaatcattttgaagaaatcttctgacgtcatgtcttttcaaccataagtatttcagtagggatctctaaaagacaggcattcttttctttctttctttctttcttttttaacaccactgtaatactattatcacgtccggtagcggttaaatcagctcatacctgctcagccaaagagaaactgtgtatgccactcttcccactcacggacccatgacttcatgaacgtggcttgaaattaaccatgaagggagtgtatacaccatgaaaatccacaaatactaacagcagggcttttatttctagtaataaaattgttaattctttactatctgatatggtttggatttgcgtccctgcccaaagttcatgtcaaattgtaatccccagtgttgtaaaaggagcctggtgggaggtgattggtccatgggggtggatttcccccttgctgttcttgtgataatgagtgagtccccatgaaatctggtagtttaaaaatgtgcagcacctcccactgctctctcttcctccttctccagccatgtaagatgtgcctgctcctccttccccttcggccatgattgtaagtttcctgaggcctccctagccatacttcctgtatagtctgcagaactgtgagtcaattaaacctctttttctaggtgaattacccagtctcaagtagttctttacagcactgcaagaatggactaatgcaccatcacacctctgactcacacgtagaagattaacaatgcttacttaataccattagatgtctactctacacaatggtcatatttctttggtaaacctttttttcagtttgtatgtctgaatagtgatcaaaataaaatctatactctgtgactgtttgatatcccttaaatctctttgaatccataggatccccaacatctctcttttttctggcatttgtttttattgttgttaagggaactgggttgtttgccctgtggagttcttcacagtctgcaattgctaattgtatgcctatggtttcatttaacatgttcctctgtttcctataaattggtcattagatttagtggcttgctaagatgcaggatttattttggggggcaagacttcttcataggtgcaggtggtgcacgtccatcagaaggaactgtcatgctggttgtgtttcatttttgtagtaataatagcctactgatgattctttcaaaatgataatattttgcattctatcacttattcttcatttactattttaaatacatctataagagaaatttatattaatcaatcatttggctaatttacactttattttattaattttttgagagatgagattttgctacgttgcccagcccgggctcaaacttctgagcttaagtcattctctattctccctggctcagactcccgagtaactaggactacaagcctgtgcctaatttatattttaacaggatcactctgattgctgtggtagaaaagactctagaggcaagttcgcaagtgtgaaaatagagaaataatctaggagggtgttatggctacctgggagagccatggtcacggctaaaaccagagtataactctggaagtagagagaagcaagtagggaagtccaaggactgagttgacgcacagccaacagcagttgtgagtgtactggagttatagatttttccacttgcaagtggctcagtaggttcctgatggttaataggttttatcatagctgagatgggaatttgggctctgggtgctacagctgggtataaaagcaaatcactcagcaggagggtgaggtaggggccgggagcgggtgttgtgaagagaactgatcatacaggtttcttgtcttaacaaagctctgagttatatacttaatgctaaataggcagttagtttaaaattccagttatgtacttttgaaagacagcagtggacattaatgatagttactgcgctggcttaaaaataaagaaaaagtaaagaagtctaagaaaaaatatatttgcacatatgtgatgtttgaggaagtcatgagattatcatgttaaagacctacttaacacattttcatcagcactctattattgcctatatttaggttgttcatgattaaatcacaattactaattgtagtaattataatctgttgtaaccctctcttgagctgtcaaaaaaagctgttgtattatttaacaacctaatttgacaagaaacttcagctactatattatttcaaggttttaaaattttcagaccatctgtttttaaatggtacatgcttcatttctttgaagacatctcatattttctcaggtagattcttttacgagtttttaactgctttcactggctaatttccgttcccaagtttttatgaaataatttacaaatgtattttcttttccagtgcttctaacgccactgattagttttctctaacttttgaatagaaaacaagtcgatggagaaacacattcagaaaaacacaaattctgaactccacatcatattgaatctccagtttctagatggagtttaatgtcgtcggtcacccatgccctcgtgggttcaggcatcagcgacgccactgttgctaataagcatgtcagcttcttagggaagggatgcagagaatcggaggacacgtttcccctgagacacttataaaaagaagagcataatcttacagctgggtgggccatgaaggttttccaacaaactactcttcccatcttttttttttttttttctgcaaaggttttcttatgcaagggggaaggggctcagtccctggcagctgctttcctcagggcggggccgggacattgcacaggctctctcactttctcttgggggggaagtgtgccccccacccttttcctgatgaacttgagggcctgtttgtcctgggagagcttgagcaactccacagcacaccgctctatgggacaaagccacacacctctcggggcatgtcttgcgcgattttggtgtttgctgaggcgcccgcttggctgtgccttggtttcctcacgttcttggtcaccttgtggcctttgttgaggcccacggccatggggtagtgcaggaccatggctgttgctctccgagggccgccgcagaggacccaccttctcttttgtagaaggaaaaaggtgtagaaaggggaagtgactttctctaaagtagagagtagccagtagacatgaatttggaaaggtttatgggggctgaagcatggaattcacatcagaataacgagaagagaggttaatggttaatatattttccaagaaaccatgagtagctatattctttctctcatctctttttcacacacacacacacacacactcacacacgtccacacacattcacacaccctcccatgcacaaatacacacacaggtccacacaacacaagcacacactactacacaccctcacacacataagcacacatgtccacacacatacacacacacccttacacacataccctcacatgtacatatatacccatgtccacacccttacacacatcctcacatgtacatatacacacatgtccacacacacgcacacacccttacacccttacacacaccctcacatgcacacacgtccatacaccctttacacacacccccacacaggcacatatgcacacgtccactcacacacacacgcacacattgttacacaaacaccctcacatggccatgtacacacgtccacacacatgcacacacccttacacacatacacatatgtccacacacgtacaaacccttacacacacaccttcacaggcatatatacgcacatgtccacacacatgcacgtaccctttcacacacaaatacatgtccacccaacacatgcacacactcttacacacacatacacccttatacacataccctcacacacttatgcacacgtccccacactcgcacacatacgcacacacctttacacacacatcctcacacatgaacacaccctcctgtgtgcacacacatacacacatctatccactcacatacacacaacaccctagatgcctagtttggaacagaagcggttaactggcaaaacatgttatgtgaatggcgtcccagtattttctttcaaatcacactaacaaccaggtaatgagatagtttgcaagggagaaagagtgtaaaaatgaaagaaaagtacttgcaggcaaatcagtatttgttcacctgttgaatgtgttttgtttgaatagatttttattgaaagattctattgtatttcccatggtttagatatttttccagcttttgtataaatatgaccatacaaaatgctcttgttcccgcccaatctctatttgcaatttactgaatgagtcatttacagagaggatcctgagaccatctaaaatactatgagtgggccctgaaaatgctctctttctactccctcctaatgaatttaagtgtttgaagaaaaacttactaaattcatgcgcctattaatagttccacaatgaagaagaatctaacaggagttcaatgtaaccactgtcatggcagagaaataacaaatgcatattatattttttaaaatcaggcttttttgagtgcatcaattatcctggtacttcccacttagtaaaagcagtgagtaggccctttaaatctatttattaattcactgagcgatctcaacaaactgttaaaaaagctttaggtattcattcaaaccaactaaaatacacaggtatcctttagaaaattaaaatctaggtaaagagaagataaaaagaggatactgattattgatcacccattctacgacgggccttttaataggccctatttataaatcaggtcaacacacgaacgtctccaccattaaatagaaatttgacaggagtaagagcattgtttctctgatgtatcgcccagcacctgcagtatctgacacacaacagatgctaagtcaatacttttgaatgaatgactgaatgaatgaatgaatgaatgagatgtcttcccagagaagtggttagtcccaagctccataacattgggtgggtgtcctcagccaaagtcacatcgcctcagggtacagaaatagaagacaataaggaaatgtgtttaatgaggatttcggtcatgtgttgatactcagctcttcacctcactccatcgactgacttcattcttatgattttatacttaaaatgtttgtgcatttggatgcaaacagccttaccaaggggaaattaggtataactctggagacaatgatctttattcttttttaagggcccgtttcaggcaatgatgccaggctttgctgttgctagggagatagagagaatgtggggggaatgagggggacattgagtgttttctttagcctgcaggccagggcacagtgaccagaatggagaaatagggccagcctgttctctcaatcaaatcccgtacagtccattgagaatagaagtagtcatgattacgttttggtatttagcctagaaccaccaaaaatatcagcctaaaacaattctattccaaatactgccatgttatttaagttgtcaattgttaggaagcatgggggcaattttgtgttttgacacggatatggattaagcacctgggagaagcatctgctctgcaaggtgacagcaacaagcctgacagagaaccagagcaaacagtcttttatcagctggtctattacctgagagacccagagaagactgtgcccagctgtgtgaatacttcagcaggcttgggctagacagctgctgagtgttcttcgcagtttctgtcatggcctggatacaagtgctcttaatctagtagattttaccatgagtctggctgctttttccagcacgctctccaggcctgttcattgattcatgctgcaagtacttacagtgagtctactgtgcggggggccctcttagcttaatatacacagaaaagacacttggttcagcaaagaaaagaaaggaggattcattaatagaaagccagctaatgcacagtttttccccccaaaatgtttgaattttttaaaaaattgcaggaactcacttcttagcacatcaggtctcccttgtctttttgccctctgtcatcttctctaaaccgaggacagcgatcagctacgtgagagtggtattcatgagtgaacacatggccaaaagaggaacacacaaactggtcatggtattttctttgcatctctcacaataacctctcctttaattttcaaggaatgcaagtcatctttagaaaatgacaagaataagtccaggcgcggtggctcacacctgtaatcccagcactttgggaggccgaggtgggtggatcacctgaggtcaggagttcgagaccaatctggtcaatgtggtgaaaccctgtctctactaaaaatacaaaattagccgggcgtggtggcaggcgcttgtaatcccagctacccgggaggctgaggcatgagaattgcttgaacccgggaggcagaggtagcagtgagcagagatcacaccattgcactccagcctgggcaacaagagcgaaactccaactcaaaaaaaaaaaaaaaaaaggaaaaagaaaaagaaaatgacaagaataaacaacataaggtgtctatgagaaacagaaatcacccaattgccctggccatattgtaggctgctgtaaagaaagttcactaccaaaagaaattcttcaagtgccgtggcatctggtgttaagattccaggcatctgacatttgccactcgacaggaaagatatagacaataaagtcatcctttaaggtgttactagaatgctctgtgtaaacttggtagaatgtaaaggtctgaggaacattgtgttataatgttatactttgcagtaccttttcctgtaaaggagtcctggtttactgaaaatttaggaaaggaatgcagattgtgacatttgcttctctggcataggaggcaaggcaaaatgcaaatgttagaattaatctcactttacagcattgcacttaacacacgcgttgaagtagcacagattcaagaatcaccatgattgccttcgttcaacagcttatgacacagtgcccagattccttttaatttcatgtaaaagaatcaatgtgtcaaactggcagagtatcctgaataaccctagtgagtggcattggaacactatggtcggtgctattcacaagacagcattccagagcaggataagaaatgtgtcagctcaaaaacgacattaatcctgtttcgtaagcaatattccattacaataaggtatactgcccaggaagacaacatgtttgctacttctagatgtctaaaaggtcattttctccagtcaaactttcattacaagaagacaataaaccaatatttgtggtcatctttctctttatgaaaaaaagtcaagaacttgagaaattgactgaagtagcaccctgtcttctaatgtagtcaagtctaccatgttctgttacgtacatttatctcaggaaacagtgtatatgaagacctagagacgaaggtgtgagagtgtgtgtgtgtgtatgagtgtgcgtgtgagtgtgtttgtgtgtctgtgtgtgtgagagtgtatgtgtgtctgtgtgtgtgagtgtgtgtgtgtgagagtgtgtgtgtctgtgtgtctgtgtgtgagtgagcgtgtgtggtgagacagaggaagaaaatatatgcaacacaagaagacaggactatgtctttttttttttttttaaacaatgtactgcccacgacagtcacggaagtgatgaaaatccagaacaatatgatgggtatcataaaattaccagggagtcaatgactgcccatgtaaaggagcttatagcagtgactgatgagtgaatcattctcagccttaaatgcttctcttacccaattcagaactgtcctacttcctgttaaatgtgttgttaaccagcaatttttaaattcttaatttaagatccttgccttgctttttaaaattcactattcaatcaaaggggttcacttggctatcaggaatatttttccccaaagaaggctacacaatgcacatttgcaagacagtggtcaaagaaattagccaggatcctttcatctcgatccctggagttggtggaatgcaatggaagacagaggactggatctgactatggttctgacacggactaatttttgaccaacaaggttttcatcttttgtcatcttttgattcctcgcttataaaatatcttcctcaaagcagttataaaaatttaaaatgagataaaactgaaactataggttgaaaagcataagacaattaaaagtattgctactgttagatattttgttagcaccttttgaaaacacaatttgtttttctataacaacttaggcattcctgaaaatcacacaccacagaaaattgagcaataaaaaccacagagcttaagagaaaagaaacagggtgcaacgctctaaaaattttatctgtgccacataaaaaacaaagataggaacctaataaaaacggcagcacagtgtttcactagttaattggctaagaaatacatacatactacaatagttttgtattttcaagacaatacattgtttctatcctgacaaagacctgaaagttggctcatggaagtgagcaccggaagagctaaagcttgtgagttattggaaagtggtagaaagaggattgtctgaagctggagagctgtcatgccagtaggaggtgttatgctcatatccaaggcctgaactgtgaggtagctggtagatgtttgagaaatgggcgttttatatatttctatagggctcaattcagctgggtgcagtttttttcattcactcacaaatgaaactatgcataaacaatcacgaaattcacattgcatgagaattgctccctaagatatcaattgtgttggaacaaatttgtgttttcaaatgagcattatagcagaactgactgtatcatgatatgtgtccccaaattggaaaacaaaaccccaaaataattacatgaaaatcaactggttctctttgttcctgctacttaaaaggagtatatacacggaagaaacacctcagcgcagctctgagcttctctccttttatcagcaaatagatgaacatttgatggtttgaaaaatcaatgacttcagacatgaatttcatcacacctctgtcttcctcagcatattatttgaacctcacaaaggacatttgattaggaaattaagatcaataaccagtagattaccaaatacagggagattttactttcattctccaatcattcatcagattttcatttccaatcttgattcactcagtaaatatttattgcacatttgtaatgtgtcaggccccattctaggcactggagatgcactggtgaacaaaacacaaaaaggtcactgtcttcacgcaacttacattctagtgagagaaacagactacaaacaatggcacattgatacatatacaggccttgtgcttgctttaatgcactttgtagatattgcattttttataaactgaaagtttgtgacaactccgcactgagcaaggccatcagtgccattttcccaacaacaggtgctcactctgtgtctctgtgtcaaattttggtaattcttcccacagtgtttcaaacttgtttgcattattatgatatctgtgatggtgatctgtgatcagtgatctttgatgttactattgtaattgttttagggtaccaaaacccacacccctttaaaatggtgaacttcatccatgaatgttgtatgtgttctgactgctccaccaaccagccgttgccctgtgtctctcccactcctcgggcccctctattccctgagacacaacaacattaaatttaggccaattaataatgctaccatggcctctaagtgttaagtaaaaggaagagtcacacatttctcacttggaatcaaaagccagaagcatgaagcttcatgagagaggcatgtagaaagctaagataagccaaacagtcagccaagttgcaaacgcaaaggaaaagttattgaagaaaattaaaagtgctactccagtgaacacacgaatgataagagagtgaaacggccttattgctgatatggagaaagtttttgtggtctggatagatgatcaaacccgccacaacattctcataagccaaaccctaatccagaacaaggccctaactctcttcaatcctatgaaggctgagaggtgaggaagtcacaggagaaaatttgatagctagcagaggttggttcatgaggtttaaggaaagaagccatctccgtaacataaaagtacaaagtgaagcagcaaatgctgatgaagaagctgcagtaagttttccaaaagatctagccaagagaattgatgaaggtagttacactaaataatagattttccttgtagatgaaacagccttctgttggaaaaagatgccatttaggactttcatagctagagaggagatgtcattgcctggcttcaaagcttcaaaggacaggctgactctcttggtagaggctaatgccgctggtgactttaagtttatgccaatgctcattgaccattccaaaaatcctaggactcttaagaattatgctaaatccactctgcctgtgctctatcaatggagcaacaaggcccaggcaatgctcacagtcacccaagagctctgatgaagatctatgaaaagattaacgttgttttcatgctaacacaacatctattctgcagcccatggatcgaggagtagtttctactttaagtcttacaagttaaaaacaaaatacattttgtaagtctatacctagacagatgtataataacatctatccatgtagatagtgatttctctgatggatctagcaaaaaaaattgaaaaccttctggaaaggattcaccattctagatgtcattaagaactttcataattcataggaagaggtcaaaataacaatattaacagaagtttgcatgaagttgattccaaccctcatgggtgacttaaaggagttcaagccttcagcggtggaagtcactgcagatgtggtagaaatagcaagagaacttggattttaagtggaggctgaagatgtgactaaattgttgtaatctcatgaaaaaacttgaacagatgaggacttgcttcttatgaatgtgcaaaaaaaagtggttttttgagatggaatctactcctagtgaagacgctatgaacatttttgaaatgacaagaaaggatttaaaatattacataagcatagttaataaagcgtagtagggcctgacagaattgacttcaatcttcgaagtccttctgtggataaaatgctctcaaacagcataacatgcaatggagaaatctttcgtgaaagaaagagtcaatcaatgcggctcacttcactgtcgtttatttgaagaaattgccacagccactccaaccttcagcaactaccaccctcatcagtcaacagccatcaacattgaggcaagatcctccccaaggaaaaagatttgctgaaggcacagacaattgtgaacaatttttagcaataaagaatttctaagttaaggtatgtaccttgtttttttagccataatgttctttgacacttattagactacagtgtggtataaacttaacttttatatgcactcagaaaccaaagaatttgtgtggctcgctttattgtcatattcatttatcaaggtgatctggaaccaaacctgcaatatatccaagctatgcctataatacataaattatatataatgttagaaagtaataaatgttatgaacaaaagtagagcgcagtgggaatcagaaatatataaattccctttcttgcaggggatttggtaaaagaagtagagctgtggtcgggcccagacaccatcggaatttgtaggccaaaggaaggggaattcactgataattttgtgtaggctgtagcatgagctaactcaaatgtttaaaagattattttcactgtactgtagggaatagatagaaggtaggaactatgagagccacttgggagccctttgcaatagtctgtgcaaaaactgatagtagtagcagtagaaatggtttaaagtgagtagagtcaagatatattttaaagttagagcccggggaacttattgatgttgaagacagagtaagaaaaaggatggcatcaagaatagcttcaaggtgttttattcaaacaatgaaacagtagaagctttttttttttcttcttcttctttttttttttttttttttttttttttgagatgcagaaaatggcaagaactgacttggggctgagggagagaggagtgccagaaatcaagacagtcttaataacagccaaagatcaacctaagaatgaaaagggaagcttcagcttgaattatttgaagttgaatagtggtcagtttttgttttttgtaattaaagtggacctcctacaccttgcatcttccccagccgtgctctcctgtcaacaactgtctgatatctgataatagctaatccctatagccttgcaatttcagaatagggggaaaatacatttaaaaaatttgatgattaaaaaaagatagtgataaccaagccactttcttgtggtactaaacatttgaatgtagtctctaatgttattactttttactaattttagctaaatacattccataaaaccaacaactcccacttactgattttcctgctccaagttctaacaatttttgtgaagtctctgggatcttctacatataaggtcatgtcatctgtgaaaagagagaattttactccttgttttctgatttggatgcatcgtatttccttttctagcctaactgccctggctaggacttctagtgctatgctgaatagaagtgtcaacagtaggcatcctcgtctttttttctgatcttagagaaaaagctttcagttttttaccattgagtgtgatgtcagctgtgcccttttcatatacagccttcattatgttgaagtaaattctttctacacatatattattaggcatttttatcaataaaggttgttacattttgtaaaatgctttctctgtatcttttgagatgactgtgtgatttttttccttcatttgttgatatactgaatcacattaattgatctgcacgtggtacagaagtagaaaaacaaacttagtttctcctactctactttcataacatgcttctgacactcattgcggggggttcttccccacacatcaagcaagcaatcaattcttgagcagacactagctgtcctccagtacagtcctgccactatctacctagagatagtgtttccatgccctctgcaggcatgccaccctccaggaacctccaagtgttcacctctctctgaacccaggttttgggggtttggggagagtgctgttacacagtcatgattgactaaatcaccggccactgaagaccagctcaacctttagcccttctcctctccctggaggtgggggagcaaggatggggctgaaagtccctaccttctaatcatgccttggtctttccagtgaccagtccccacatcctgaagctacatagggtagccagtaatcagtcaactcattagcataaagagatacttaatactttggagattcccggatttgaggagctgtattcaggagactgatggaagaccaaatgtaagtatttcacaataccaaacatgtggtgaggcattcttgcatcccaacgacaaatcccacttggtcctggtgtatgatccttttaatgacctggtgaagacggtttactagtattgttttgagaatttttgcatccatatttatcatagatattggcctgtagttttctttttttgttatatctttatctagtttttgtattgggttaatgctggcctcataaactgagtttagaagtgtccccttttcttcaatttttcagaagatgaatgtcaaaattccatttgtttatcaatgatgtgagccacttttttgttgctgaatcagatcatttaatagttttcagatacagaataatatatgtgtttactattatgtaaagtaatatgtaatagtgaaaggcattaatgcacttttaagtttatatttgcaatgttaacattttctccatcactttctgaagtcttgacagctaataaaataatcaatcaagcactgatttgtagtgtttgctgatttccctggggtaaatacaaacaaaagtatttgcacgtttggaagctgatttcaagcttccaatgtttgatatggagcccagagatgggaagaaatgagcagtttatttacaagatgtaaacaacctcaaaagcacagataattgtaaatggagtaaaaaactagaaagttacaagttttgagtattgcttccatttaatataatttaatgaactataagtttatataattgaatagttaatatatactgtttaacagccaacatgtgaattcctgagaatttagcaattggctcctgtgaaatactacaagccagctccagcacaccattgtagcttggtctccagaaaacaacttgttagaattatttggagccaaatatggggaaaggaccttacccttactttctgcattcctcttttcttacgtctccctatgtgcacaaaggaagctactgtcaactcttcagctgaatcaaaccccaaatcctgaggcaggcttctcaaggtctcactgagaacccatggcaatcaggactccactcccagccacccgggattccagtaatgaatttggggaggaaagatcatcagtggttatctgcacatcaaaagtatgcaccctttgaaaatatcatggaataaacatctctgttgctgacatcattagatgtatctttttggattatcaaggtttcagacttcagcttcttggccactcatcagttgctgctgttggatatatttttaggttctaaatatatcttacagggacaataatatcatcatctcctttgccaaagcagaagataacatttggcagtaaacactgaatcatacgccttcccagttcttccgagatttcctttcaaggccttggcttttccacataaacaatatcctgtcttgggttttccacaggaaaaccatctcctgccatcttggtgcccctcactcacttcaccttctcaactgagaggctgagcataatacttactccttgaataatacatttgtctacgtgttacagacatatcccctgtcactcaggaggtcctaaccagagagtaatcattctgatagaaatgggcaagtaaagacatatatagacaaaagattaaaattgtttggtcaatactggaatccagcaatcacacactaatggaagtatctcagtttttaagataatggtaaaattatagacatctataatatttcacattaaatataaaatgagacttggttggaatctatcacgtagatgacatcaaagagctctccactgtaaaaagtcatttcttatatttgacatcattttaaagtattctatgtgcatatatgcccttgccagcatctaaaaggcttctatcctgagaaatttctttcttttttctttttttttttcccagacagagtttcactcttgttgcccaggctggagtgcaatggtgcaatcttggctcaccacaacctctgcctcctgggttcaagcgattctcccgcctcagcctcccgagtagctgggattacaggcatgtgccaccatacctggctaatttcttatttttgttgttgttgttgtatttttagtagagacagggcttctccatgttggtcaggctggtctcgaactcccgacctcaggtgatccacctgcctcggcttcccaaagtactgggattacaggcataatccaccatgcccagactatcctgagaattttcaatgtagagctattgttttataagcaaaaatgatcaacatttatattttaatcattataaagcaatacatattcgatttgcttcatttacaaaaggcttcctggacttagccctttaaaaatgcacgacacttaatttttttttaacaaaaaagcagaaaaagatgatcaaacgaaggatactgatccatcaattactcctcaggaagacaggtggatcatgtgtgatttttcaaatgtttcaccagattgttaaaatgattaaatgaacaacctaagctcaacttgaaatccatacagatgtgatagcaccataaccatttcttaccctctggacactgtagtatggttgcctctggcatctttaacttggttggctgataatatttaatataaaaatcttcatggggtgtcaataaatgttagctttctactccctttctacaataaaagccattaaatcatgatttattacaaaaatgtgacttgactgattttcccatgttatacatccatgaaatgtaaacatgaaatgctaatataaaagaaaaatacaagaatatagattttactgttaatggtgcctattaaatgttggtataaaaataccctaagaaaatgcaacaaaatattaatggtggtagtgcctttaactggagggattaaaggtgatgtttccaagtttacataatgattgtgaaatactcctgggatagagaaataaaattttattaaaaatattattatgtttagagtcagggtcttactttgtcacccaggctggagttcagtggcaccatcatagttcaccgtaacgtcaaattcctggccttaagtgatcctcctgcctcagcgtcccaaaatgctgggattacaggcatgaaccaccatgcctgacccaaaagtttatttttaaaaacataaattttaaaaagataacataatcatatctcacttcactcattaaacatattctagaaaatgttttataatttaatttttgtttttaaaaagttcgaaggccgggcgcagtggctctcgcctgtaatcccagcactttgggaggctgaggcgggcagatcacgaggtcaggagttcgagaccagcctgaccaacatgatgaaaccccgtctctactaaaaatgcaaaaattagctgggcctggtggtgtgcgcctttaatcccagctactcaggaggctgaggcaggagaatcacttgaacccgggaggcggaggttgcagtgagctgagattgtgccactgcactccagcctgggcaacagagcgagactccacgtaaagaaaagaaaaaaagtttgaaaatgtcccaaagaagctaactactctccctgtgttttcccagccatgctgaattacttgtagttccctgaagcatcatgctaattccaactctgtgccctaataggtgctgttgctgatatattaggccccttgctctatgttcctcatgtaactatgagttttccttcaaaaccttccccaggaacactttctgagttctccactacaatataaatgctcatccttcggagagatccctcaatgaatttatcaacagtaagcactatcacactataataactgtggaaagtgatttaacaaagcacagtgccttctgaataaagaaatgaatgaatggataagcaactttgacactcccataacttaaacaaatggttgacctttttgttttctctcacttaagtgactggctgtttgactcgagtagtaaaaacaaactaggtgtcttgacaccctaaaaagggtgaatgttatctacataaattcaatctatacatttaattaaatagtatcattcaataagcattaactgatggcattgtaagtgccaggtttggtgttaggcactagaacatggaaaggaggaacagtgcttctttcctcaacaaactgagactaacaggaatagtcaggcaaatccacagttgcagtagtgttattaagtgcagtgttgaagcatgcactttctgtagcaggaacaaaaaggggtgctgtggggtgtggggacaagccttcttggttccaacactgtgttaaactaaaatgtagttgtatttacaatacaaagcttaataaaggctgcactggacaattgcctaatatcatcaatgtaaatacccaatgttatgtgattagaatgggcataaaaaataacaaaatctgctgttattaacaatgattcccactggaatattggaagacacactgactatcactcactacagaaagtatagaattggaaaagataattttatgaagatttataaacttttaaaactggtgtgaaagtattatttcccaaattcagtttgtagctggggtggggcgagtaggtagtataaatttcttcttaaattgtatcatgacagagaagtgttctttaggattccattgttgtggactaacaaagtcacttttagatatctcaaatttgaactttattgctcttcctatcttccaaagaaatgcactgaaaaataaaatggtctctctacagaagaaccaaaaagcacaagcagttttttttatcctcacagctttctgttttcaagcaatttggagtccccaggcggattcaaactcgatcccccttccacctcactcgggctctatgcactcccacagataacgagattgggtgagcacatcagattcactttccaaaggcacactgaaaaatcttcatgcagattaaaagatttttttaactatttcagcttccacatcttccaaacttctctttctcaaaccatagaacactatcatttgtgcagaacaacatgaagatgggaggttatggttccttcaattatgtctgagaattaagacatatgttatatatttactatgaaccttaaagaataaactgcacctagatctaataaccataattctaaataaccttctataatctattatatacatagtagccagatagacttctaaaaacatagctcaatcagcgctcaaaaatgtggcactgattgacagtgtataattctcactcattagttgtggaataaagtccaaaccgccgttctagaattcaagctcctcacaaactggctccaatctgccttcattgttgattaaccacatgtcccttgcaaaatctacgctccatccccaagagactctgtgttgttctctgagcattcagagaactcttccacctccatgtctgccctctcacggtttttcccacttgactaaccttcctcccatttcacctattcaaacctaactcatcagaagccctcctctctgaagcctgtctagattatcccacctgagagcaatgtctctgtcctctacgttctcactctgctggcatacatgtctcttgccacctctaccacatcttgctcacctttgtaagtaaacctcaccttgctcacctttataagtaactgttgttagcacatactaggtgtacaacaccacacctataagtgagtggctgaatctttttacaaaatgattcagaaggcatctcaggattatttcatttctccacataatcacacatatcgactaccattatttgatagattcagaggttgcaagatattggttgactatatattcactctttaactgatactaaaagttgttttagccagttaatctctaatagcagcttatctgccacttatttgattctcatataaagaaagagtattaaaaatctgatgtttgaatatcctacttacataaattcaagaaaagcaggggtttagcatatctgccaccctgaattcaattatctactgcatgtgttgtctctcatgtgtaacctgggccttgatgctaagccacccctcagagattctttaagttccaatgtcagaaaatttgagggtcctatggcatagaatgataagtaccaacatggttactactgaagatgttagtttggaaatacttttagatcatggagtgcttaagtgctatacagtcatatcaccaatagccttaccttttccacaagattttttttaacaaaatgtaaaatacaggtactgtaattcatgaattctcacataaaggacaaataaaaataggatcatgaatattgctcagactttgaatttttatactgtaatctaagaatactctgaaggacacaaatcaaattggtagggccaggaaataaaataatttctaaattctactaacagtaaaaaacacaaatataaatcttattaaggcagaaaataaaaaacaagagattttcaccatttagtttcatcgtttaaatatcatatttattatcatacactgcaaactccccaaactgctttgatattttcccttaaaaataagagagaaaacatgaaggcatctgattttgtgataatagaaaatttcttgataatatgtttttgtggctataagtgccaatgaatatatcaagttctaaataatatgcaatgttttaaataccaatgaatgttgtgacaatttttttcatttaaattgtgatgtatgtttgcaagatacagtctacttcctttaagctagagaggcgcctgtcagcgcctgtggaggcctaagaggaggaggcttacaactgcagtcttctccttcctccctgaccccgttgtaggaataagaagtaaatcttcagtcagaatcagcccatgcacacacaagccagtggcaaacctctgcccaagtattaaaggataaactgggcaatcagatttgaatctcaaaactctggactaggaaatcagaagaatgaactactgtaagtcaatgatatgaacgagtccaagagacaaagtagagggggaaagctaatcagtagaaaacaggcagatgaagatgcctggagagaagcagagctgccaacggagaacagacgcgagagctgtccgaggtcctgataccctgaggttctgattccagtcaacctgcagactcacatctatcctgaaatgcaacccaactccaattccacagagtcacaatgtacctaaattatttggacagacacagaagtcataataatataatttaacctactgataggccctgtgacaaaaaggcctaggcaaatggtaatttttaaaagcccagtctgcctgagactgaagcccagctctgtcatttattacctctgtggccctaagcaagttatttagtctctcttagtctccaatttatcatgtttaaaatggatataatagcaatgcctcaaagggttgttatgagaaatgcgtgagatgatgaatgtgtagtggttagcacagacggctccaatgttagacgatgatcaggagcatgatggtgacaacaatgatgataatttccttttccacacgggcatagtagctcaatagagaaataaattagctttaaatttaaactaactctatttacttattaccagcttgttcacttaagaaataggtagactattatagttaagattttaaaccttagatgttttgccttggagacagtttgggatgaaagaaaaatatataaaagcaaaaaaaacaaaaaaaaaagcaactttttacttaaaacctagattctttatttttcttcctaccaccacaattgattctaaatctcatgtataatccattttctctgcaaaaagtataactcatgcactcattcccttcatggagactttatgagggcctcatcattgaactttctgtcttctaatacgtgtaccctttttgcattgcatcagaagaaaaacttctaattcacagtcacctctaattaaatactcttctggaacacaccactgtctgctgaataaagaccagatttccttagaatgaccatggcaactttttacagtctgatctcagttcctcaattcatcccctactcatccctaccagcttttcatggtccttcctcatatctattcattttctctggcttttttccttgcccaggatctttttctgacttacaggtctggataaagacacaagtttttggcctaagtcttaaggttcagttcaaaagctctttcttaataaaatgcctcttatctttatactctgacctaatgattttcttttccttggtcatagagtattctgtatttctattaaaagacatcacattctactataaagctatggacacatctttccaaaaaagcagtagctatattttaaataaacagtgataaaaaataattgtgaagttcataaacaaggtaaccctgatatgggaaaattgttggtaaacacatttgaaactattccataggatgtattttaattcctccatgttcccatccacgacctgactctaaggagataaaatagaatcctgttgctacgggggaaacccaattatttaaacaacaaagattttctctagttcaaggtgaaaaactttcctaataagttggtgctcttgagcacaaaaagatgaaattagatataagggggaggcactgaaacccttttcaatgaattcttattgagcgatcacagtgatccaaactagcagaggatccttgtgcctattagttacacagaactcataggccaggtactattttgctattgaatctgcagtttggctctccacagttactcacgctaagctataaacataaaaatgaaaaatgaccataggacggtaaaaagggtactcatattgatgatatgagaggcatctttcatgtatgcctaacacactgccagtcacaggtgcacacacttaaacctgctttcaaataaatctctactgactttcactaggaaaggagaaacgtgtctgttggcaagaggttctcactccatttgggttattggcaacttttatacagagaccatttggcagactccatgacatcatgcagggattttagatctgatacttgttgtgcatgcatctctcatgttttaggacaacattctgatcacaaactattctcctttttttcagttatcatcaaatattgagacacatacagaggggaagggaggaggaagaggaggaggaaatagaataaaatatctgtaagtctcttacaggaaaatgtaatttttctcacttctccaggcaaacaggatgacttggaacaaccgttacattttttcttttttttcactatgctcctctgctctctactcaagaggctaccctgttaaataaactaaaatacagagtgatcggatctactgataaaacaaagtaagctctttgttgcttcacccagcaaaggtcactttcccagtggctttcagcttccccaggaaagtcataatactttccaaagcactcacattcccccgcctaggatgtgtactcaaacagaggtgtctctaggaacttcatctccggtttcactactaattggaaaatactgagggacagaagaaatccctcagcagtttcctcctgggaccctggttgcgtacgtacaccagctccttagtgagatgcaaaggatgaccactgttaacctggcttcctctcaagatcctccagaaagaattggataaaccataggctaccttcttgctctaaataacctcctcttcaattttcacatcagcttattaaaggtagagaatcctccagctataccacctgctttctttgtttctccgtgtatcagtaggcctgtctacaacagcattaccaaattgtgtgtctatttattgtctgtacttcaccttgttctttaaaaactgtgtttaatatttacctacattattatttgccctatgttttatcttttaaaaacatggaacaccaattagaaagacacattaaatgtcaacaattagtaaatttcagagaatcaaaaataacagtagaaaaagtaggattaagccaggtgtgatggatcacacctgtagtcctagcactttgggaggcaaaggtgggcaggtcgcttgagctctggagctcaaggccagcctgggcaacatgttgaaacccatctggcacacacctgtagtcccaactactcaggagcctgacgtgagaggatcacttgagcccaggaggttgaggctgcggtgagctgagatcatggaacagctccccagcctgggtgacagagtgagacactgtcaaaaaaagagaaaaaaaattaagaaagagagagagaaataagcaggaaggaaggaagagagagagagagagagaagaaaggcaggaagaaggaaggaaggaaggaaggaaggaaggaaggaaggaaggaagggagggaggggaaaggaaggaagaaggaaggaaggaaggaagagaaagaaagaaagaaagaaagaaagaaagaaagaaagaaagaaagaaagaaagaaagaaagaaaggaaagaaagaaagaaagaaacacacagactaagatcaagccataggtacaggtaggtaattagaaattagaatacctgccatgtaggcccttatactctgttagaggcaggccatagatatcaacttctgaacctcctggtgtttaaggacacatgcctataggaaatatagcacctgaaataaacttcataaaactgtttattatgaatgttttcatattgcaatgatgaaggcaatgaactaaatagcctaaagagtaaaaacatgttattatgggattccttattaaataatacataacaggcaagaagaaaagccaacagcataagttttcataattcaaccaagtatagggacatcagttgttacttgagctccatcatgtgtcattattataatgacagaagtagcagcatcaagaactagatccccacaatacatctgtctgagagcctgtatcattcattgccaaatgtgataagaatgtgaaagaatgctacactgataatagttttcatggtggaaagaaaagaaaagccattaatccagagcaaaagttagaaataatcaagaataaacgtatgtaggtatgttaaggttttatgactatacatttacagatgttttttaaactcttattattgaaattcctacaggaaaaatagctataattacagatctaaattatcctttttcccaatacaataattatgcttaaaactcaatttttgatagaaaaaggcttcttagagtacagctaccacattctagtacagactgtaaaataaagtaaccatattttcaaagcagaaataacatatggcttgaaaaataatatatgaatttggaagtttgtttttataaaagagtacaatttatgtacatattaaattacatttgattttagatttaatggctttttggaaaatttttatgaagtcaggattgttacaggaaaatttggaatgtagattttgctagaggtggatgctcttaaggactgtttaaaaaaaaggtctcacccaagtttttcataggaatctattcctgttcacatttttttgatatgtggtaagggattgtatttggagtcagggctttgccactggctagtaaccttgttccaatcatttagcttctagaaagttttatctccacatatgtaaaataaaggaagacctggtccactgcatgccttacacttttgtgatgctgtggacttttgagaagaacactgctcacttgtccactttcagccacagtacagctgcttagctacaagaaactacaggcccagctccactcctaacatgggattcatatctgtcctagtggactggaaatcaagtctttgtgccaatgcaaactcacataaccatactctgatggccagcactttgaccaggttaatttaacctgtctaaattttcaccttctgcctgctcactcctctaattttcaccttcccatgaccagctggtatcatggctgtctgttttggtgactgacagctagggactccagcatggttttttatctcctaggcatggctactatctgggatgcttgctctaataccttacactgtcttcttgtaacacagtttcttaaggcttgtgtctctatagaaacatgtcagaaaatgctatcttattatccctacccccaaataaatctacagtggggtcatttcatttatgaaaatactctggaaacaaagttgatgctcaggcaactggtctaccagggatagcatgattttttttttcttctctgcaatacctatgcacaaacttgtatctagaaatcaacaataaatgtgaaatggaagtcattaccactcaccgtcacaaataatgttttctttcattttccatatgggcaacataaaggagtgaaaataaccattgctgttatgcacttggtaggtttccatctaataaaaagcttcatatctgtaaaatgccaataacattcagtctatccttcctcatttccaacttcgagatctcatttatcccctactgttttcaggggttgactgaacttgtatccacaccaaaaccttccatgcccaagatactagtgagttacaaccaataagtattaagagaattacagaaattttgcatatttactttgacaggatacaaagatactatcattagaaaagtgagaaaagtctgtttgagtgggaagaaaagcattctgtcaataagatcagaacatgtacaatagtcagttggttgcttacggagtttaaaatttccaaatgctttagagcccagttatactgcctgggagtcttcagagatgggatacccatcactaatattaatattgatggtaataaaacctgtctccttccagcattaccctacacaaaagagttcttcttgtgataatgcaatgaagcgctaatcctctacaaagggctcggtgatatcagaataccatacgttccctttaatgttattccataatgaccataaagtgcctaattgtcaataaccacttaagaaacaggttctcttgggtccttaagtgctggataatgtggtgctgtcctcagtaccaggtaaaaggaagattttttttagctctaggaacttaggtgaaatcctggaaacatttgacaatgtttcttgtgtgctgctggtggatggatcatagatataaaacatacatgatggtttataactaggctttcccattgtatagcagcaagtgctaatcaataagtcaataaaaacttgatggcaatttttctttgttttttttttgtttgtttgttttttgttttttgtttttgagatggagtctcgctctatcgcccaggctggagtgggtggcgcaatcttggctcactgcaagctctgcctcctaggttcaagccattctcctgcctcagcctctcgagtagctgggactacaggtgcccggcaccacactcggataattttttgtatttttagcagagacggggtttcactgtgttagccaggatggtctcgatctcctgacctcgtgatccacccgcctcagcctcccaaagtgctgggattacaggcgtgagccaccccgcccggcccttgatggcaattgctaactcaagtgagggcccataactctctcatctgatatgacctgctattagtggtagatgtcacacatctgagggtgaaagggaatataccacatgatctatcagattcaaaaaacaacatgatgaaaagccaaattgaatttaataacatgtaattaagtagatttatgtataaagccagtgtgtgggtttaaataacccatcacttgaagacataccagttatacagaagcttatctgaaacaaacctgaagtctccctttgactgcaagctcagtgtgacctgaaagtgtaacggggacaataaaacaatgaagctcttgaaaacactcatgcattaacagaattagagtatccagaaagtgggttgtaaaagttccactgtacactctattagtcaagctacccctatagctatatttgtttatggaaactctcttccaccctagaatctaaaggcatatattcttccacaccacacagcaaaataaaacgctgtttctcaacagactctggggactccaacagcagggagggaggtgtcaggggcaagggttgaaaaactacctattgggtactatgttcactatttgagtgatgctttcaataaaagtccaaaccacagcattatgcaatatactcatgtaacaaacctgcacacataccccctaaatctatttttaaaaaccctgtttgtatttacatgtaacattgattttcattggtccattagtacatctctatttagcttgacttttccatgattcctatattaaatgtgttcttcagtagaattttccttctatttatttaaactctttgttccagcaaatgtcaaaagccaactaaagaggcactttaaagatgctgccaacttcagatcctctctatcaaaaatggaagaaagtctaatttaagaaagagggtatttccactcacccattgtgctgctgattattgaactggaagtaaccacaaggtctgcaaaacctctgaacttcattttgaggaagaagaaatgctagtcaaaatttacttagaatctattaaatttaaagtattataatataatgattgaaagaatggacttaaaaaaaatctaggtttgaatcctggctctgctacatgcaacttagctttggcatgttccttaacttctccaaatctgtgagtagtttaaggattaagttattaatatatagtatatgtaaagtgcttagcatagtgactcacatatgataaaggtacaatatagtttcactattatgttgctgccattgatattatattattattattacttattcacttgcatactgtgagacaaagtttagacttgagatttagcaattgtgtttgttactctagttctgtatttacttactagttacacctaatgcagtatttctaacaggaggaatgtaaataagccactcttcaggggtagagctcttgacaattttactgtcagctggaaatttgaccaggaatgtttcagagagaagcaaaatgagcaatacagcttctattcagatatccagagttagggaggcgtaaggtgattattcattcattcacagcagaaagatgtatggtaatgcagagacgaaaaatatcagtgtcactagagaagcatcaataacatgctgagggatttcagcagatacaggaggaaacctgctggcctgggaatgtttaatttgtaatggactaagagaacaatcgagtttccaaaattgtactttggctacttccattgctgaatttcctttccagccactgccccctcgacctctgttacagtctttacatttttatgaggttgactttcaaacatttattccaaagagcaccgtgtagtttttaaaagtaatcatgcaaggaacagtaatggaaatcgtaagcacaggactggagttaagtgaagcatcagccagttaggggctgtctagaggaggcccacaggaaggataatggatctgcaaaccacatcatgtgacatatgattaaatgaaacagaaacattaatcctggaaaagagaaggcttagggaggccatgattgatgttttggtgtaggtgacgtgatcttgtgtgaaaggagattagatatcctatgtaaatccagaaatgtacattagaaccatgggaaagaatgccagaaaaatagattttatattaatgtaaggaactaatttataatcgtttgaggtgtccaaccaagacttcctcctgaagatgtggactccttcccactaaaagaagtcatagagagggagaaaattctggcatgcgggagagggaggactgaatgagacaacttccgcggccccttcaccatctaagagtccatgaagtatctaacacaacgaaacatttcctttttagagaaaacctaattaattgtggaaagctgttaggaaaacttgattgtgttttatatctcccatctgcatatctgtaagcaaaccaaaagcagaaacttactggcagcttcaccttctttggcgagtttagtattgtcaatacagtaaagcctctcaattctgcatgcaatttgacatgaacagaaggaagaaaaaaaattagaattccaccttcagaaccacctaggagggtgtctgacattgaacaggtaatgaacaatgaacaggaccatttccccagcagcctttgttttccctgccacctgcaagggatggacagttttatttcacaatgatgaacagtgatgtcgggctgagccctccactctgtctcaattcactccccacctggagggaaagggataacaaatacaaggtcttattttgtttttgaagggtctttcagggacaggaaaagcagctgttgtagtttagaacagacttcaaaagcagatcaatagagagccagacccaggtgctccttaaaggcatcgactgctacaatattgtcatttgcctcccttagctttctctaccactttcctctcaagccctgctagactactggttttgatagagtaacactctgttgtgagatgggattgtttaaatgagagaaagttcacatgtggaaatctgccatggggaatctagcagtaactagatatgtcccatttgggtcattccaatttttatttcaagtctgttagaacagatgtattcaaaatgacatctagataaggccaggcggataagaagagacttcagctgggacaagaactactttgtgagttagaaaattgggttcatgtttccatgtttataatcttggctaagtctgtaactgatattcctcatctaccatatacaatgaggactgctgtgaggactaaaaggaaataatatctctggaaacactatgtaaaatccaaaacactgtgtaagtcttagatacggcactcttttactacacataatggtcatggtttgactgaaatctcaacaattttacagcgaattaagggaattcactgtattttcttattttcattaaggatattaaaactatttatatagataatatactctattagcaagattattaaaaagcaatttttagctttagatatcttctccagtacaaagcttttctctttatttttgcatcttagttgtctcttcttaacagaaaaatgatcctttgtatttccgtatgttaataagtttctgtgaaagttagatgacttccttacaaatagtaattaatattattgtaatagcaattataatattatagttttataaacattggtgctgtgatgtcaaaccagattaatatattgatctgtatatacatatatatagtatatacatacatatatgtatatgtatatgtatatatgtatactcttgaaagtattttagtactccgtcgcttccccaaaaaggtaaactagatattaaaactctacctaggataaacagataatggacaagaagagtaaaagctttttcacaattcttagcttctgcactgaagttatgaagatcgtggttaactaaaaagttaaaaatctttttcccataaagagtaatcaagatttccactaatcacaaggccggtggttgaaatagcaagattcatcctcaggcttgcactttcttgttgctggagagcaatggggatggggaaactctcggtaccacggtcctgggattggctgggtcataaagatcattccacaacatgggattctttgatcatctcagtgatactccccccagcctcaaatgctcagggcctctgagccagtccacctctcagaagaggaaacctaatatcccgcaggggcccattccacagtgaaaggctgttagttggaaagttctttttaccttgcagggcaatacagtgggaagggactatccagtaaaactcctccaaaacagtagtaaccactcaattcatgaagttctctttctatactgcagttttctaaagtaacataaaaatatccatggatttttcactttcctttgaatgcggtgaccattccttacctttaccaaagaaattgcaagaaaaaaaatagaaaaaaaagagcatctcttggcaaaaggtcccatcagtaattctagttatagaatcccttcaagaatcattaattgtgttacactacagaataaaccaaatatttatttctgcaagcatcattaaattatgacatattagaagtcattaacaatcagcaggcaagggcactgggttctgccagtttaatgttctgaacaatcaaaaataatatccatggggcaattaatttcctgcacattgattattccaatctccacactaataagtggggctaaaccaagtaaaatcaaaacagcacagcaaaaaactgcagactgatcccacttgtaaaggggagtctgtaaccttgacagatgaattgtatttcctaagttatagggggagaggaggaagttattccagcaccctaaatggtatcttgaggagctagcatgatccttacatccactatacccctttcacacacagagatacatgcacatttcacaaatgtaagaattaagattcaacagattgtccaaatcaagcccctagtaataatgtcgggaccaggatctttggattagttctatgtactttccactctgtgggcaattcaatggatgtttaatgattctggaattggagaaaaaacaatttctattaattcaacaagttccacagcaaactgcaaaactgccacttttctctgggtttgaggaactacttattcataaaatattagtcaaccaatgtatcaaatctgttgttaaaatgttatccagaattctaaccctttcttccttcatacattctttaatctgtcaggcatttaataaatatccactaaatttatcaagtgatgtgttaggtcctattggaacacacaaaaatcacaaaaagatcctgttcttaaagagctcaaaagattttaaaacacacacacacacacacacgcagagtgatgtgctggtagatgctcttcatcaaccagttttccaggggctgcaggagaagccttgatttacagcatttgccacttcccatgatacaaatactccaaccatggctaatttcaatttttcaacatcaatatggggttgtggattcagggagatattaaaaactgtctaaactggctctagtgcaccactactgatacactgctgatatgagtgtgtgtttcactatataaaagaactaatcaaatattttagagttgttatgttagagtagtgtgattatgattgcttcttcttcttctttttccttttttttatagcatccaacattttttatgaagaagactttttttaaagataagtactagtagcaagattcttatcccagaccactttttctacatagccttggtataaccaaaattatctgaggagtagagaggctaaaatattttgatggcacatcagattcgctttagagccacatgtcccagtagaactaagaaaggaaatgctgcagagagtgtccaacttctaagaggcatcatcagacttcatttagcactaagtcttcctgagccccacctatgtgaccatatgaccacctagatcttacaaaatatatttgcagagcatgccacctccacacattcttaagattttgaaatattcaatcataggatgtatgtgaaagaaggggaggaagtagaaactaagagaaggataatccctaaaacataggaatccagacagaaatattattgcttctgcagaaaccctaggacaggattgaatgactcaccacctgtttggttttatggttacatttcaacagtgtctgcagctgtaactcatgcttcctccttcggctttcttaacacacagatgcactctgttttggaaccaaacatctttgtcccattccagaaactcttttctttcttaggactatatgaatgattaaccctgtaatcttcaaggttatttattatcatttttaatgtgaagaagtggaagttttgtggagggaaaataaaacgccttattgcttgcataacattttaacatttatgaaacaattgcatgtaacttatcacagttatcacaataatcctctggaataggatattcctggcaccttcatatgtgaagataaagaggctcagagagtttaaaagactcactcaagttcacaaagccacagagtggtctctcactgccttaaacacatgggcttcagaatccatattccaacccagtagggaagtagcttggtatagtttagagaaaaacaagatgtggagttaggcaggctagatttcaaatcttgacaccaccattttccatctgtgtgatcttgggtaaaatccttacactttctaggcctcattttcctcatttgtagcatggagagatgacactcaccttactggactgttaggaaaatcaaacaaaataaaatttggcataagatgggttctcaaaacatttcttttctcttttccaccattctgtactccattgttcatgcctcttgtccttgtatcatccttagttcaaacatactcattttgtttcttgccctgactcaaacggcctctccagttgaacaaccagaagttgaacaatcatttaatggacagtgtgttctaccagagtatattgctgtagcaagaattagaccccacacaattgggaaatcagggaatcactgcagtctaacatggaagccccactggttcctgcacaatttttcttagcatactgtatgttgtgccaccaagacacagcagctcaacacaaagtacacacagctaggaggatggacaagtcatgcagagatacagtactgaatgtgcggcccattataccacgctcttcctcttggctccatctcactaaatgcacggtttccaaagtatttattgcacacttcaatgcacaaaacacacaagcaaacactcaagaaggagccagaaccgttttatactaagcctgtcactgctcctccacctgcaaattctggtgccaatgctcctctgacttcattttcataactcaggcaactcagtacttccgtacatactcttccaccaacctaccttccccttcaatttgaaaggtaaactcttttatttactggattatttatttgcagggacattaacatgttcttataattgtgctagtattttccataagctcactattgttttggttagtgtttaattataacattaaatgttttgagtgtttaaaatgttttgagtaatctgttccaattctattttcctcaaaacgtcagttatttttagtgagtgatttttcagaatgtgagatttttaaaaggaatacatgcattatgtgatggcaagaatgctcatattttgctttgttgtgtagctattttttatatattgaggtgccacaaattgatgtgcttatttgactctgttaaaatccaactcaggaggaactcatctccatggttaagaatgtacaatttccaccaaagatagtaccgaggggggaaattcatactacttttcataaatatgctaaaccaaatgattctaaacataaaatagtgtatccaatatagcattgaaataaatctatccagtactggcctatctctacaactttaagcagcttttgctttattatgtaaaagcattccatttttaaatcagctaaacttccaagcaagcaaagacattacaagaaaagattcttcagctacagaacctgtcacatgaggaaccaatttccagggtaagaaaataagctcaaatattttaaaaaaatgtttcttcttacccctagcatactgagctggcagtataatgaatcagaacattttcatttgcatttattctttgacatgggcaaatgacaacctttccaggctttcactgtaggaaaatggcaattttaaaaacttgaataactatcctattaattttatgaagttgttataagagataatatatagtatattatatacaaatatatgtttatatcttatatattaaatatatatatgtatactggaaattacttgtaaatctgtttacccttcaatcttgagactgtacagtactctgataaagaacatattatcatcatcactgattccttatccccagccacttttagcaaattgccttgcacatattaattttttttaagttctgtgatacacatgcaggatgtgcagatttgttacataggtgaacgtgtgtcatggtggtttgccgcacctatcaactcatcacctaggtattaagcccaacatgcattagctatttatcctgatgctctctgccccccaaccccaacaggccccagtgcgtgtcgttcccctccctgtgtccatctgttctcattgttcagtcccacttataagtgagaacatgcagtgtttagttttctgttcctatgttagtctgctgagattgatggcttccagctctatccatgcccctgcaaacgacatgatctctttcctttttaaggctgcgtagtattccatggtgtatacacaccacactttctttatccagtctatcactgatgggcatttgggttgattccatgtctttgctactgtgaataggccttgcatataataattattcaataaatgtttgctacattaaattgaaccatatgcataatcaaagtcagagtctcgctgttaagttgtttaaaggactagatttattcctagagagcaaatagattgttcttaaaaggcactggctatggctgttgaattggttaaaattcagtttggatgcaagtgacagaaaacacagattgtaatatcttaaagaaagtataagctaatttttctgtagcaaagaagtttatgtaggcaggtcaggtatggtgaccctgtaatcatcagggaccattgttgttctaccgtcataaactctcagcttgtatctcctggccaagatgattgcattctggcctgcaagaaaaacaaaagaaaaacaagaaaggtgcatgccctttttttaagagcgctttctgaatattacatcccagctgtttgcatcccattggctggaatatattatcttgccatgcctagcagtgtaggagcctgggagctataatctttattctgatggccatgttcctagataaatggttagtgccattactacagaaaaagagggaaaaaataccaaggacagaaaggtttatcacagtttcataaattgacagtgagctttgagtcaaatcaatacagagcaagtaaattaatttgtttctgataaactttcagggcaagaccatcacatgtgttttaaggatgtagataattctagttaatgaggagagttagaacctatttccaacagataaacttcttttgttggaatccattcaaattcccatccctaatgatctatactaaaacttaatactaagccacaccacatcgattaaaagaaatattatgaaaagaatgcataattgcctgagactaagatatcaggtgaaaggagagagctggttgtaataatcttttcacacaaaaccaagtgaatggtaacttttttggttataatcaaatacatctctcttcttaccctcagaatagagggaatgctgtatagtcactaatgctgtccaaacttaagtgcattgggaataaaaggatggggagactaaacaaagccaaagaaataaaataataataataaaataattctgagagcatctgggatattccttaaagaatttataagattcttcaggagatatgggtagcttgccccatccgaaaactccaaaaacagttatttcataggtctaaaacaactaaaactgaatttattttcactgtactattatcttagtatttttcttaattacgcttcatcactatcatcacccaaaagggtcaattattgaggtttcattcaaactaaaaccctgaaaactaaggatggaaagataagaataagcaaaagataagagaaacattcaaatggaaagaagataaaagaaaaataaattagaagaaaaagaaaatactagatagtgactcagagaagtagaggctgaatttggaggaaaataggagaagtaagaaagtaaaggagagagagatgaaggcaagagcaaaaacactagtgacagaaggagttacacacaaagaaaacaaaaggcaaagaggatattttagcagggagatagaaatcctcttacaggatgggactgccagggaaatctctgaaacgggaggcaccatctaggcagcattattcagtaggagaaactgttcaaatttaaccatcgtttggaggacatcaagccctatttttgtgtgatcctgattttccacattaaaacacagaagctcatggagatattccaccccatttacacaatcacgaaatcgtagaaatggtttggtttcttctgtcattgaatttgatccttacaacaccatcgtgaagcagaaattattatccctacttcccatggaggctcagagagagaaactgacttgtccaagattatcttgaacaatgtgagtcccaggtctgcaacttactcggtgtgttgtggaaaagtcacttagcctccataaaaatcatctgtaaagtgaaaataattaataacaagtccacaggttttcacatataaatgggaatatatatacgtacatgtaaaaatacttggtaaaatgaaaaacataatttgtcatatttactaaaactaaaatgttcagtgtaaaaggctacagggagttacatgctgctagtcctttaaactattaggattgaaaatgatggaaaaggagaaggagaagaaggaaaaggaaggaagaaaggaagtaaaaaggaaggaaggagagagggaaagagagaaagagaggaagacaaggaaacagaccaacccagtaacaacggctaacactgtgcattattgtgtgccaggccctgtactaagtctttgctcatttaatcaccatagcaactctaagacgcaggtactattattaccccagtttgcagacagggaacgtgagccttgaagaggtttagtaacttgaccaatttatacagctggttagcgagagagcctggattcaaatccacacaggtacaagtagacactcttcaactcttttttttttttttttttttttttgagacagggtctcactgtcacccaggctggagtgcagtggtgcaatctcagctcactgcaacctctgccaccctggttcaagcagttcttctgcttcaccctccggagtggctgaaattacaggcccgtaccaccacacctgtctaattttgtatttttagtaaagatggggtttcaccatgttggccaggctggtctcaaactcctgacctcaagaaatctgtccacctcagccttccaaagtgctgggattacaggcatgaaccaccacacctggtctctggtactcttcaagtcttatactgcctggatattagtcagctagaaataacagtcctatgagaaagagcgaatatcataaaaatctcactataaaggcaggaataggaaaatattaggcccatcagcacaccagcagctaaaaatattacccccaggcagagatttagcacgtgctattttaacgtccagtggaatgaaggagatctcagtaaatgaaagtaacatcagtcactctaataaggtcaaatggtgctacaagaagagaaaaaacctccatgagattatttcaattgctaatgaaattacaaattagcctttggagctcagttcatctttcctcagcggatagtgagctaataagtaaatgtaaaaagcaattacaaaatttacacagactttaaaaacctccccatgatcaaaaagctagctcagaagtttcaacaaaaacaacagagttttggttagacagaaatcttagtggttgtatagtccataggccaaagcccttcctaaagtgcggacaatccgacctgccttttaaagctgatagattgtccgaagaatatatataaatgccagtgagcacttgaaaagatgctccatcattagggaaatgtgaatcaaaatcacaatgagataccacttcacacccattaggatgactattaccaaagaaatggaaaataacaagtgttggtgagcatgtggagaaattggaacctctgtgtcctgctggtggagatgtcaaatggtgcagccactagagaacacggtatggcagttcctcaaaaaattaaaagtataggccaggtgcggtggctcacacctggaatctcagcactttcggaggcagaggcaggaggatgacgaggtcaggagatcgagaccatcctggctaacacggtgaaaccccgtctctactaaaaatacaaaaaattagtcaggcatggtggtgcgcacctgtagccccagctactcgggaggctgaggcaggagaatggcgtgaacccgggaggtggagcttgcagtgagctgagattgcaccactgcactccagcctgggcgacagagcgagactgtgtctcaaaaaaaaaaaaaaaattaaaagtacaattaccaggtgatccagcaatcccacttttgggtgtataccaaaagaactgacagcagagactccacacagatatttgtatatccatgttcactgcactattatatacaatagtcaaaggtagcagtaacccaactgcccattgttaaatgaatgaataaacaaaatgcagtaaatacattcaaaggaatattattcagcctttaaaaaggagaaaattctggcacatgttacaacatggatgaaccttgaggacgttatgctatggaaataagccagtcacatataatacaagtgaaataagccagtcaaaaaagaataaatactacatgtttctgcttatatgaggtacctagagcagtttatttcatagggacagaaagtcaaatggtgattgcaatgggactggtaggggaatgggaaattattgtccaacaggtgcggagtttcagattgggaagattaagttctagagatggatggtgataatggtcgcacaacaatgtgaagtgtacttactgtcattaaactgtgcacttaaatatagctaaaatggtacattttatgatatatatttttaccacaatagaaaaacaaaaaaaagaaaaagtaaagaagacttctttgtgtaaatatgaaaagaaattaaagcacgttgagtaagaggtgtcccttacctaaggatccaagacaaataacagagtaattttatttacctttttatatacctttatcttctttaaaagtgccttatgtacaaactaaaaaaatttatatcctaaatgatatacgggatttgcttcaaaataatcaactggggcatagaggaagtggggaagtagaaatgaaacaagatttacctgtggtgaatcattgttgacactatgtgatgtgtgcatgaaggttctttatattatttcctccactcttgtattcgtttgaactatgccacaatgaaaaattgtaaatgttgctttatatttaccatatacaacagttttaaacaaaatatcaagccactgaagagcagtgaattctaaaataaggtaaagaaaatttttaaaagaaaatattccttagatgtcatcacttccattggtaggaaaatccatgtcccttttctggacaattacaatgaacagttcacatacactgaagaactgttatttatacaagctttacatgcactgttcacataatactaacaatataccactttacagatgtggaaattcagactcacagaggtaaagtaactggattcacgttaagtgcattttaacccagacagtctggctacaagcccttcagcttaacaagtacatttcttgaattacgagggtatttttttcttctttcctgctagccaatttagacagcctcaacaatcctgagttgccagaattagaaaagcctgattgagaacctatgaaaagaggtattttgttttttaagggatatgatcaatacctttgcctcatctgtcacagtaaatccctgaggagtttcaacattagcttaggtcaatttagttcatttactgagcacctactaagtgtcagaggctgttaaaccttgggcactgtgctaggcactcagattcgcagaggaatataaattattcgattatgaagacagatgcatgcgaatgctcattgcagcactgttcacaataacaaagacatggaattaacataaatgcccattaataacagactggataaagaaaaatgtggtacatacacatcatggaatgctatgcagccacaacaaagaacaagatcatgtcttttgtgggaacatggaagtagctggaggccatgatcctcagcacactaatgcagcaacagaaaaccaaacactgcatgttcttacttataagtaggagctaaatgatgagaacacatggacacatagaagggaacaacacacattgaggcctatcggagggtggaggatgggagagaggagaggatcaggaaaaataactattgggttataactatgcttaatacccgagtgaagaaataatctgtacaacaaacccccatgatatgggtttacctatatatcaaacctgcacatgtaccccagaacctaaaataaaagtttaaaaaggtagtcagtgaactacgacatgatactgtattgaaaactaaaatgtaatcatgaaggtggaatactagaattccctgagaagagtttttataaaggtaaaaaccaacatattaacatgattgtatatttatctggaaataactacatttctcaacgcctatttttctattataaaagtgagtaaaatgaatattgctcctacttaaaagatacattgaattagagactattgcaatataaactgcaaggcctggtatggcatcttggagaagaaaaaatcacaaattccaatttccaaatcaaagaagcaacaaatcacaataaaaaatttaatacttaaggccaggcgcacctgtaatcccagcactttgggaggccgaggtgggtggatcacaaggccaggagattgagaccatcctggccaacacggtgaaaccccacctctactaaaatacaaaaaataagccaggcatggtggtgcgcgcctgtaaccccagctactcgggaggctgaggcaggagaatcacttgacccaggaggcagagattgcagtgagccgagatcacgccactgcactccagtctggtgatggagcgagagtccgtctcaaaaataaaataaaataaatacttaaatgtttctatttttcaacttgcagagtttcaatacaaatgtaaaacatacttaaaataggtgtttctattacattatttgctatcagagagcaataaaaataaaatttgataaaaaaaactgtcaacagaaaatagaggttaacatagtatttattttagaaaccagaaaaccaaaaataaataatttatatcagtcagttcttcctctttcatggtattaatcatcctatgatgaggtgcttggcatctgtgtttgccatggtaaataagctccgcgatggttcagacctatctgcactgtccaaaactctatcttcagcacttaccatacacatagctgccccatacacagccaaggccaatgcatatgtaatgaatggacttgaattcgaatgtcctgtccattcactcatttatctagagagcaacacagtaaagaggcaagagtagggactttggaccaggcattcattcactattttattcattcattcatgcatctatgcaaccaatattcgaggacacctattttgtgccattgttctaggtcctgagacactgcagtgaaaaacaggtgtttccagcctcacagagctcgacagttctgccactagtcttgggaggtcactcagtctgcgtaagttgcctttcagctttttatttttagaaaaatagaatactaataaccaatatggaagattattttaaagaaaacaagtcatatacataatggacctggcacacagtaagtaaacactcaataattaacaatcaaccaaaagcctaaaaacaaaataccaaatataaaatttagaaccagtgacaaatgacattgatttccagagcgaatgcacctagaaaagttcaaagagaaaaaacattgtaataatattaattatgtgttaatagccatattagtatgaatctattctctctacatggtaccaaattttcttcaaaatcccttggcatacaccatcttaagcattaacaatgaaaaaatgtccacagatttctgtactagaggaaaaaatttctatgaaaccagtttggctgacatggagagctttgtgtggacaatgaaggtcatgtagatttgtattgttcttgacatcttctaccaatgagtaaatggaggaaatcatgtcaactgggcttctaaatgatctacagccttggggacacacagcaagcagaggaagacttggtcaggaagtgttttgcaaagatggcttttgcaaggacactaagggaagttgagacacttgcccaagcttgcatagctactcaggggtggggtgagaattcacatccagctcttctgactcgcggtcctttgacccttcatgactactactctgcatgggctatcaccctcctttaaaagttcagagacttagacaagagaagagagattataaaaaatagattccttttataccttttatacctcaatttaaaattctcagaaagggttctaaacactttaaatcccttttacccagaagcttctggtttttgctcagtcttgttaggaattggagtggctgtgatacatctctgagatgctatgaaatagagatgaattgaaatactttcaacatcagcaaatcatctgaggccccataaacaccctgcacagtacattcatggtacatgcaggcctttgtcttactgaaagacaacctatgtcatctgatgttaggagagtcactcacttcagaccactgaaagtttcaaaaaaagagaaaaaaagtcataaaccaagtaaataatcagtgtcatttaccattatatctaccattcccttacgaggccatggtctatggtcttcctttaaaagttctgttgtattctcttgaaaaaaaaataatttgttgaactctactttgttttaagcactgtatgcaactgtttaagtatagcatattgttttatctcttgtcttggacttgatgctatttgttcaaagtcctttacttcctgccactgtgctgtccaatccaatggacactagccaccaagaccatttaaagttaaatttgaattaattaaaattaattacaatttaaaatccaggtcctcaataacactcaccacatttcaggtgttcagttacctcacgtggctagtggctactatatcaggcagtgagcatatagaacatttcggtcatgatagaaagttctattggacagcatcgccatagagcatcaaatccaggacttccagctaagatcagatatgaacagaacgaccaccagaataggtcagactaagttcccaatcttatcgttcctggggttccaagagctaaactacaggtcagagaaaaaaaagcatctaatctatttagaggggttgactagatatcctggtataatccacgatgcccatgaagcaaccaggatgctgattattcactgacactaaattacaaacacaaagtcttagtggatttattgacagagaaagaaagagaggccatagaaagacaaataaataaagacctgaattcaagctgcgtgacttcaggcaaattgtgttacttctctgatcctaaatttcataatctgcaaaatgaaaaagtagattaactctgagtttcctttcacctctgaaattcctggattctaaggctttatatagtttgcataatacccaaggaactgtgcagactgccaagatatataagacaagatgccaaagactttcccattaatgagtagaggaagctgtctagatagggctaaacaatgtaagacgggacattttaagtatcataaaaatggtattaccaatgcatcctacagaagcctcctctttatcttaccagaaaaatatgactggaggtagtggaaacattcacttttctttcattatcaaaaaatatggtaacatagggtaccccacctggcatatatcgggtgtttaataatttttgttgaagaatagtaataagataaaatgataataatattaattatactagcaggcatgtattggaaacctaatatatactaggttctatgcaagacattttccccaggctatcccattctagcatcaaacagctctatgaagaaaacattaaaacattttttatttttttatcactttatagattaaaaaactgcagtgaaagaagttaggtcaccaaaccacagccacacaactaaacagtggcagagctgagatttaaaaccaagacttcccaattctagtgcacatgcttcctccatttccacccattgtctccttaagaaaacttttacttgtcaatcaccagaaaggaccaaagaagactctcaaactttttaggaacccagctaatttcacaaaactgccatttcctatatatttttccagacgacaaaacaacaatgtatctttccagataggccactcagccaaaatattttctagtctagaccaggtggcaatttcagtggagctggaattgagttcatgattgcctgttagtgttccaatgtcctgagacttttgttaattagacacaagacaaagggcattaaaaagaagccaagttaaatttgcatggctgtgggcaaatggcagaaagaagtgggcctttgtttcctacggaactgggcacccactctatcatctacaattattttataattgggttgatattttgtaggatagaagcctgagtaaccctgacatccatatgcctccttatcactgtcatgaagtggaaagcaagggccaattatttgtgttgctcgttttccacaatcttgttttcaaagagacttaacattaaagtcactaaactgtccaaattcaaagtatttccacattctctgcagtgatcacattctgtcacccacacttcctaaaaataccctgctttccatcactcactagaaccacagaggctattagaaggtaataaaatccctcgagggcttctcttttgcacatttgcactttcctctgatcaattagattcagggagattggaagtgggaaataaaagaaataaaattcaggccacaaatccttctcataatcccacaagtagcactgacaaacaacaactggcaaggaaagagctcaaccctggaagactctcctgctctaaactcaattattatccaaaattcatcattaaatgattactcataaaatccttctatctacttctcatcaagaaatatcatcatggaaatatcaatgatggtcctatcttatctcagggtacatgtcagtattagtatcactgagataaaaacagatctgaatatgtttagggtagacaacatcctttggtccagaaagtttctttcaaataatctgatttacaaaagacactccatttaaaaatttttcagaaatggcaagatccttctctcagtgcctgcctcccatctgagcccttaatttagaaatctgagggcttaaaaggaccatgcctttcataatgatcttttacaaacattccttccttttctagtgcgtctttgtcttgttgtcccttgtatatattcctcactctgctaacatgtagtaaacccagacggattaagaaaactaaggttcaaaaatgttaaagatcaactgggcacggtggtgcatacctatactcccagctactcagaaggctaaagcaggaggttcacttgagcccaagagttcaagaccagtctggccaatacaatgagaccccatctcaaaaaaaaaaaaaaaaaaaaaaaaaagccaaagattatttttcacgacggggatttcggcgagaaacatcgacaccctcagcgttgaccagatgggcagtcctgcactgacaaacccactgagttaatgtagaatatgtcagctagctcaatgctaagagaccagtaatatctgtggcccagtctcttccagagaagaaatcaagccactcctctctctggcaagtatgtctcctctcataaaacaggctgacttcagaagtagctttcaaagacaatgcttagatcaagccaatcagcgtaagtactcttcctggttgggtgatagctctcactgtgacttcatataagaaaagccagtggtcttgtcttgctcttcaagaatggagcagtcacggctgggcactgtggctcacccctgtaatctcagcagtatgggaggctgaggcggaaggatggcttgagcctaggaattcaagaccaccctgggcaacatagtgagaccccatctctagaaaaaacaaaaaaattatacaggcatcatggcacccacctgtagtcccagctacttgggaggctgaggtgggaggatagcttgagcctaggagttcaaggttaaagtgagctatgattgcaccactgcactccagcctggtcaacagagcaataccctgactttatttaaaaaaaaaaaaaatagaatggagcaatcttaaccctaaaataacaaccttttgccagtaccaccatatgataccatatgtgaaagatttattcaggtacctgagcttcacaagtaacaaggctggcatctattctcttctccaaaaggcattgtttcctcctttacaactaaataaacagtgcaaattatgtcctcaactttaagtcaggtttgaaaagaaaaaataaaaacaaacgaatgcaaagcaagagactatataaggatgaagggacagcacaggagaatggaggagagaatgggcataggagaaaggtgaggggaagggggagaggggtgaggaacagtgaacttggtaagtctgctatttccaaaaccatgtttactgcagtaagataatgaatgaggaaaacattttcattttcttttctgacagcttgagcataaatgatagctgcaataatatcagaaattattgggcattttgaggagtcttgctagtgagaagccagcattccagccaatttgaagctctggccccaaggtgacctagaaattttgtttttcaaatgcaggaatgtcagctgctggactgaaagtgatgtatactgtctagtggacagcatgctggccagacaccaaatttggagtgtctctccctgtactcagttgttctttacggccagtgctgcccccacaaaggagagttttgtctaaagccgaccaaaaacgggggtagtgtttaagatccatcaacaccaaataacactgagttttgacttgtcacctctacagattcttcaagaagctgatctgaatccaacacctcttggagttagttgggtctcttcttcctaaggcagttgattactactagttctaatctagttaggggcctgactgaaggaggcctaaaaagtgccaggaataaaagcagtcaagcctcataattttatgtgtttttaaacaagacaccctcaagtacataaaacaccacagccattgtaatttaatcatctgcttatgaaaaagacagcactctaaacagaagaactgataaggcaaataatttgcctataaggatttttaaaatgtgtctctgacatcaaatgaactctactgagattccctgtattatgccaaaaacctactggccaacatccaagactgacttgcaagtaccaaccctaatccggatcatgaagcaacattaccatcacctgtacccttcaatagggtgatatccactctaccttaacaatcagagttttatccgctgtacattttttccataagattcctatggacttctccatggaaaacagatccctggaatctttctgtgatttggaggaactcctgtaatttgtatgaggatagtgataacgagagaaacatcaaacacacacaagaaatttacacatcccagcttttctgtgtattccactttggaaaccaatagcctatgaagataaaatggaaacagcacatacatatcttgagtgtgtgtaaatcatcagagtcatatgcaataagtaaacaggaggtgtcatgaggagggaaaacaccacgaatattcccagttcagaacacactttcaagaacgatgcttcaatagtgaagtagaaggggaaatgggcatgagtcaatagaacagcaatttctctatcctttctctccactgttactaagcaatgtcctattggaactgaactttttttctaagtcttcgattgacttcctaattaataagcattgtaatctagtgtttattcctttatgaaggcagagcagttgaaatatcctaacacacatattcaaccaacacccctctccaattattgtgttgttcttcacattgaaatttggcctctactgagaagatattgaatggaaagcccatataagatagaaaaaatagaagcataatggacacacgaaatatgtgatgtcacgatctatgtctacacacagataaagaccatttgacctgataactagcaaatgataagcaaggacgctgtgtctctttatacattatctgatattatttatatattgttatttctatcacaaagaaaaacaaaaaacatatgctcagagaatacaagaatagacagacaatccataggtaagcattaagagtaaaatgtactgaaaggagttactttttccaataatgccttatcaagaaaatctttctttgacaagtaagttatatgtggtcactaataataagcaaaaagctaataaaagaagggaaaaatgagtagcacaagcagttcccagcttaatcaacaaaataatcatgctttaaaaaatgaggtagtacattctcttcctgaaatcattacagtctgttaacttaaaagtaaaattaatggcgattcgatgctatacaacactgtgtagagtaaacccaaaattaccaatatgaggctcaggtacactaaacagtcaaataactatttctgaaagccctgtcttcttattttttctttttttgttctcataataactgactgaatgacacacactagttgctgcatatttagtttatttctaatgaagataactattaggtgtccaatctactcagtccttaatcttttaaagggaaacagagagggaatacaattgtttagcctaacggaaatagcttactactataattttccaaccaaaagtctaactcttcacattgtatacacccataagatagaattcaaaattctcacagcttgcatattacaatactcagagtcttaccaaacacaaaatattatgacttatttgaaaccaccgaactccccccaaaatatttcttctcaaaaccaactctaaatagaatagacaggtatccagttatttcaattaacttaaaaatacaatactaataatttaaactcaagtagattattttcctgatttatgcagttggaatgctttaagactaacatagaaagctaagttctgatttatctttcccatcatactgttttatctcagacacatataaatgcattcataggtacacagtatagtactgttcgcccaggctagagaataaaacagctagcattgtaccaggacgcctgtgcatctttccattaaagccatagcaatattccctcaaacacatattcatcactaccttttaatgattctgggctacacggatgaaaagttttgatttagtgcaggttaaagtagcacatagtctttcatctttattcataatcagctctgatccccttgctgaaaaagaaagaaatgcaaacatcttgaactcttcaatgggcttttctctaattaaagcctttaacaattttggggtgtttcaaagcatgacttcctttttaccattgttagtgttaactaaagaaatattgcccaataagcactccagataatatactcaaaaaatcatctataaaatgcaataaaaatgattggggcagaagaacactgcatccttaattttagtaagattgttgatgataaccagagtgaagctgcctaagcaatcactcaaaagcacatgtaatagttaaacgcatctttattatggttgctcagtgtctaaaagtttgttgccagtagcattgctattaaatgtataaggctgtcaaatctatttgtggccaaaaaaaagcaactctgcaagataaatattatttaatgatttaataggcatacggcactagaatataaatacccataaataccccaagtcataaaagtaacagaaagtaaaaaataatttaggctaagacaaaaaaagactagaattgtttagtcaagaacgaaattagtaaaccacatacatttacacagacacagtctctcttgccacaaaattgcaaagtggtctacttttatttctaaaatgtgatatgcttatatcattattataacctaaatgtttaaagggggtataagaaaaagcttctaaaattattacggatgctactaaatcatgtgtataacaaccaaaatatctggaatgcccaaacgtgctgtcattgctcaggacagaataatctattcaaaaccagcagggaacacgtgaggaggcctcatttacttcagtgtgtttccccacatatgcatcatttgagaatgtcagatcactttcacgtatatagtacataatcactgatgatctgggaaatccacaaggccacaaagttgatacatactctgatctagagggggaaaaaaatcgagaaagccggaagtttcccgttttccaagaaactgaagacattcttacctttctgtacaccagcatgttgggtgattcatcggccaccccgttgctggtctgcccataattattcccctgggccatgtcacccaaaacttggtccactctcaagatacaagaattatcagtgtgccctgcaaagggtcagagagacttcagtgagatcccagtgggactcccctgattcatcatcatcattcacagcacccaccccacatggcgcgttcttacaaactggggctggctggagaaagtgacacaggacatggattttttaaaaagtgagttgacacctacaataacctcaaggaattgtaagaaattacaatcttccaggtagaaatagccatttggttattgttttagctgacttcattttctggatactcattttgagaagtgtttgatgctcaccctaaaaactcgtgggtagcattttcctagtacagagttctcttctctcccaatacttgcatctgaacttggtgatgttttccccaaagggtggaaaggcaacacctgggggatgcggtgggggagtggggggcgggttagcacactttctcctaggtatctgtctagtgtccccacctgcagcccatcagagaggcccattcccggtgtcattctccagcgcacgggcttcctctctattcccccgggtctcccacacagagccggagtatatgcttcgcctactttcacctgcctgcgctgccagccaccggctgctctcctttctccccacttcgcttcggaagtccggaggtaatcctgcctaatttttgcaagaagacaccagaatatgtcccggcaacaagaactagtgggaggtcaagccttcaggccattttacccgggtcaccgtgggtaaaagcctaactgcagaagcctccagagcaaccagccaaagaggagaaaacaggcaagcccctgctccccttgctcgctctcacggcagcagcaaatggcaggcgagcctgtgccccgcgccgcggcggccgccggagccgggcagcagtttcagcaccgtggaccgcggggtgcgcgcggcgcccgtagcccagccccggcgcggggctcccgggggcggccgccctgcgcccgcggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggactgggaccagccgagcgcgcgcgggagtcgagacgcccggcccgtgcgcgcgactgggaggagggaggaggggacagtcacgtgggacaggggcgtccgaaggtgccggctcggatgggctcggctcggccgccgccacaccgcccgggcctcccgggcctccccggcctcccgccctcgcgcccctcgggaggctgtagtcctgcccccggcgcggccagcccgcgctcccgcacaccccgcccgctcgcccgcgcgtgtgtacgtgcgccggaggcctggagagaccggagtttaacgcccagtgtaagccggaaagggaggaaggctgtgcgatgggtgggtgggtggtaggtgggtgggtggtctagtgaatggatggacagatggacggacggatgcacggatgaatggatggatggagccccgtgcaaaccaaggtttcatcacgtgcctaacgactccgctgaaagtcccagggaagcagatgatttattattattattattattattattattattattattattattattattatgcttaaataacagagtagagagatattgagacaccctaggaatgaaggaaatggccaggaccaaatgaatcattcatccccgtttgcctgcggttttcacagcttcttcctaagttggagaaatgggaaacgatttgaaagctgccaaccggaggtgaaaatcttgccacttgtgaaactgaaggaacatccccaaggcctggcttctccttttaacagaaggtgctcagaggaactttcctcttgcccactgccctcatcctctagcaattttcaaagagcttctgaggtgctgatcctcctagctatagtcttcgtactgctgccacaaattcttctgtaaggattagaatgacataaaggagacagatcacttttgtctcggtggtagtaaagcaacctgtgcctctggctttcagggggaagggctgggccgctgtaaatctagttttccttcctctcctgggccagctgtggaggagagggagggagagaaggagaagataatcaagatcagctgtaaatctagttttccttcctctactgggccaggtgtggaggagagggagggacagaaggagaagataatcaaggtcagcctttcctgaccccttggtctaagcagactagaccttattggagataacacttctactcaaacaggggtccatgtggaccaatgtattaccccagccccatgcaggtcttgtcaggtttctctcaaggaacaaatatttatctaacctagcccctgttccaagtactacaggagaaatatcattgtcccaaactacacacactctagtctgacctgtctcccactccaactccccacatctttccactgtagcctctggaacttagaatcttcttcagcaaaattctcttcgttttcgacttctcgaaatatttctttaacgtttttgctctcgctgaaatctacttatccctcctttaacccctctctcttccctcttgttcagtctgctcctgagaagttgatgtgacttgcatgacttggattaataaatttgcaaatacaactgggtatgctcactcagtttgaccattttcctcttaagagagaaccgcctgaaggaagcagtcttcctcctcctttgcatctctgggtaaagtttccatcctcataggaagctgtacccaagctctatatatagagagcctatatatatatatagctctatttatcatatatataattggctctatttaatttatatatataaattatacacacacataaacatacatatatataatatctcttgacaccctttccacttattgccaccctattttccttcttccctttatgccaaaatctttccattccatgttgaacctgttccactttggcaaatgacctccatggtgctaagctgatggtcaattctcaattgtcatatgaattgacttttcagcataaattaacccggacaccactctctattatttctctttctgcattactggctgctttttctcactctcattgcttgttcctctttgtctttttgacccccaaattctgaagcatcttggatcttagtcattaagcctcttctcctctcaatttacatgcactgtacctaaagtgacccaattcaggctcatacattttagtatttcattattaaacactaataacttccaagtgtatatttttaaccaggatctatcccctgaaatccagtctgtcaaatgctcactttacatctccacttgaatatctaattatgcctgattcagcttgaagatagcaaggatattgtcactgcctcagatcctaggcatagtatagttgctggtgcatagtagatgcacaataaacatacattaatgaaatgaatggatgtatctagtaacagtaatctgataggttcttttgtattttgcaattgtatttttttttgagatgaagtcttgctctgtcacccaggctggagggcagtggtgcagtctctgctcactgcaacctctgcctcccaggttcaagtgattctcctgcctcagcctcctgaatagctgggattacaggcacgtgccaccatgcctggccaatttttgtatttttagtagagatgttggccaggctggtctcgaactcgtgatcccaggtcattcgcccaccttggcctcccaaaatgctgggattacaggcatgagccactgcatccagctatgtattttgtaatggatttttttgcattatcttatttaattcttactaatgaccctatagttataatagttatctcatttacatcaatacaacaatgaggaaggagaggatcagaaaggttgggtcaacttcccaatacaaccaacatagccaagaagtggcagtggtggtttgtactctatcgactgcattagctggaacaatgtttctcaggatcctcttgcccgtatgcatgtaagtgtatgcatgtaagtacggttggcccaaagacgaattcttgcaagatttgggaaacagagtgaaacagtatctattcctctctcaaggtctttgtagtttgctgtgacaacacatgcagacacctggagggttctagcatgtcctggccctcccccacttcacacccagatcttccaaatttccagcacagctgatcaacagtagccacacacccatcacaagggccttaacatggatccaaagaggcagtagccaggcaaagacaaaagcttttcaccgagtattcttccagctttctttcagggtccccctcctggatgtggcaggcctcccagattcccctggaagttctgacttgcccatacacacaaggacctcaggaaacccaatagtgactttcctcagatctgtgaattccttcttctggaaaataaccttctcaacaattgtgtaagttctcataatacatccctgattccattatattcataatggttccactttcatgaaagagtggctggcagagctcaaatccaagacttctgggttcttttcactattctacaagaaatccaacttaggtagataagatcttgagacaaatagctgcatgtaagtgaaaaactgaatgacagtgtatgaactactgaaggagagattgacattcaaaccgggctcttcaaggactagcaggatatctactatatgaagggtgaaggagtttctattcagacacaaagggaagaaatgctgaaacccattaggaaaattactagtaataaaaacatcatgtattgaattcctgctgtctctaaccatattaaaaatagtcttaccatagctgacaaaacttccctataaggtatgtaagacaccaatgtcctagttaggaaacttggccatgatcgcacaccttctaaatatcagagtcttgactcaaatatgcctgtgtctgactgtaaagccctgtgaaaaattatgcacaaatgcctcctagcaacagtatgagtttaaaaaagctagagttctcccatcaaggtgcctctcattctattttctccctcatctgccatccttccacacacctacctctcaccgtgctctctgggcagttatgactcaagattgttcgtgtctaattactgttgccaagcaaacatgaagaaggaaggttcaagaaatagcatatttcacaatttttctactgttatttgttagtcctcattagactactcagaatttgtgttactgtatattggaaacaaaattatgtctatcaccttaacgtttctacgacttgtatttttcaaatataaacttagtgaattagactaggtcgtctccaaaaacccatcataagattcaacatgttctcttttgtgctttctttctagataatggagtcctttatgttgtaaacaagaataaaaaagaaagtatagatattgtggagtagtttttttgtggggggggggtcctttctttaaaaaccgtgtgaatatgtggttctcaatcattatatccaaaacattttactatttttcttgtaagccttgtattttattaatatttttgtcaaacaaattaaatggtaataatacatccattttacatgccaggcagaacttctaaatagcagataaaagacctgttacctcatcaaggtaatgaattccagcccaaacaaagacatttcaagattttttttagcttcagtagcgttaccttgggaaaaatagtcagtttttaagattttgtggaaatacaggaaatagtgtctatttttgcaaatcattatggatataggaaccccaaatctattgatatagacctgctttttccctccttttttcatttaacaaaaacttagtcatggatttattgtgcatgaagccttcttaggtttctacaaagatcataaagaaatataacaggtgatttttgtcctcaaggagcaaccagtctcattcagaagatgagagtccttcctttctctcacagctcacatggagttccatcagtgagtcccaccgggtctacctagaagctgtatccagaatctggtcactgcacaacatctcctctgcttcctccctgctttgaggcaccattgaatctctcttggttgaaggcagtaaccttctaactggtctccgcttgcatcccttcccacctatgtctgttctcaacatagctgccagcgtgatcacggcccttctctacttaaaatcctccaaaacactccatgttgcataaagggcaagatgtctttaaaatgcgaaagaggcacttctggagcactctctgccacatctgacctcaatttgtgcccctttccgtcttatttactctgttccagccacactgccctcctggattctgtaaacattccaagcatgctgccacctccaggcatttgcactggctgatccctctgctttgaatgctcttgctttactccaatggcatcctctcagtgagggctactctatccactttatagaaaaccatgtaccttccctgtactctgcttcctccttacactgatttacttgcctttcagagcatgtgtctccttctaacatactgtacaatttatctatgtttgatgtctgtctcctagaaaaatttgagttccataaggtcatagatttttcttcttctgttcacactgctatatcctcaacgtctagaacaaactctgatatatagtatatatcagaatatatataaattctgatatataggtatccagtaattatgtgctgagttactgggtgattgagtccattagcatgattctgtttgaaaactgggtatactggaagaacccagtcaacaacctcgaactgaactgaattagcgtcaggtttccctgtggatggaaatgatctgctcttccaagctgtttcctatgtgtcataatgagaaagactaattcctcttcctaacacacacccacttcacagaggaatgctttgagacgtaattaaatggtaacgtggagaaagcattttgattttctaagagaagcactttattaatttgaggttttattgtgcgaaagaattataagtgacacaggggcaagtacagagatgagaacaatgttaaagggattatagtgttcacaatactacattggaattgtatgagataattgagttaagattgatataagcagcatggaataaagcaaaatagtttgggaaatcttaccccaaatgacaagttttaaagaaatagcttcttttttgtaatcaactctcaattatttacagcacaatatcctcattaatgaattattcttcgcttttactatccttttgtccagttcgtggccatttttcttctaattagaaattccatactaatgtcagagagttgataaagaaaaaagaagtaaaaattaagatttgtcttcttcatgagtttattcctcgctcattccagttgacatgtttaaattctgatctggagtatttccaaaattacccaattttaaaatgtcatattctttttaattaactggcaaattaattgagcacattttctttctttctttctttctttctttctttctttctttctttctttctttctttctttctttctttcttattttttttttttgagacagagtttcactcttgttgcccaggctggagtgcaatggcatgatcttggctcaacgcaacctctgcctcccaggttcaagcaattctcctgcttcagcctcctgagtagctgggattacaggcatgcgccaccacgctggctacttccgtatttttagtagagatgggggtttctccatgttggtcaggctggcctcgaactcccaacctcaggtgatccgcccaccttggcctcccaaagtgctgggattacaggtgtgagccaccgtgcccggcctaattgagcacatattatgaatgagttgtggtataatgtttgtgaaggaataccgaaaatgttgaaactttgttcctgcccttttgacatgatggaacaccactagagaaggtgtcaaaatgtctgagctttaacctgtctccactgcttaaaatcgaggtagcattgggcgagtaatttgaccacttgaagcctgtttccttagccataaaacaaaatttgtattatctgccttgtcttgctctgctgtgaaaatctttttattccaaggcaaattaaatatttggaaagacggtctggcagtagtcatgttgcccatatcgagagatgcagtggcctagaaattaaccaccaattctgtggagcagatattgggagcagctgtagctacaatgatggaaaacagtccatccagcaagtcgtgtttggtgtccagagtgtagaaacaggccagatgactggatccgaatgacaccatgagagatgagagaagcagtgtccccataggagggcaaggcatagcagaacaggccatacctggggctcttaccaggcagcttatgggagcagagctccagcagctggacgacaggagtcatttcccctgacgtgaaaaaccgcagaggaactaatctcctatttggtttccaaattcctagccaaggaggacagtctaaattgaagatgatagaagacataattagaataataaaatataaaaatgaaggggattaccctcaaattacaatgaagaaattgggctttagtgaagtgaatttacttcctccaggttacacactgagacagaattagagccaggacctaaaaccctagtctttatattgagatatggtgctcttcacattatgtgagaagaggcaactctctcagaggcaactgagaccccaaataagggaagaaattgtaaaagggtgctcgatggtgttcatcaccagaatcagagcagtcccagccattggcactgagagaatttggaaatgaaatcctaagcaatttttaaagcatggtggagaaaaaagatagcaaaatagagtcaatttgcctgaaatgagggagaacatgaatgcacaaactggattggtgcccagaacctatccatgggaaaattctataataaaattcaacaaatgtttactgagctcccgcaccacaccaagcatcatggtagtctttgatgatgaatgaatggacctttcccatggcagaggcaggtaggagagacagatctataaatcactgtagtgcaatgtgttaagttcaggtgcatacaaagtgttaggaaagcacattttccatgaaaaggggacattttggcagggtctttaaaaattgatcagggatcttccagatggactacaaggaggaagagcacagcagcatttcaggtaggtggaataacatgtgccaaatcacagaagcatgaataaaggcaaaggcttgatggactgcaaaattttggcatggctgatttcaaagagaagaagtgacatatggggattggaggatggaaatgaaggtggtctatagcttgtggacagattatgcagaacctacagcctatgctgggaagtttgagcctctttttttttttttttttttgaggctgactctcattctgtcacccaagctggagtgcagtggcgcaatcctggctcactgcaacctccacctcgcaggttctagcaattctcctgcctcagcctccctagtagctgggattacaggcacatgctgccatgcccagctaattttttgtattttagtagagacagagttttgccgtgttgccctggctggtctcaaactcctgagctcaggcgatccacctgctttggcctcccaaagtgataggattacaggcatgagccactgtgcccagccaggaagtatgagctttaaccaatcagtaattggatgagttttaaacccttaaacagaaaagtggtgaacaatgagccactctgaatgttcaccagtcacacctcatctcagactagcctcgtttcctctttaaatatggtctctaaactgtcaaatgagggttatattaaggcaatacatattattcagcaaggcacttgacaggacattttgctttagctttgaaaatatactggtaaaacagggttgagtaacagttcattggactcataacaggctgagtgagactggcaaaaagagcactgatgaactgagcaggacacactagaaaggcaggtccatgaggaggactcgaagcactgccctcagaatgcccctgtcctatctgggcctgggcacagtgaactcacgtggtcaatcagatgtataagtggcacaaagctatgaggaagagctaatggcatggggacccaggaagatctgcgcaggctgaaaagatgagctgaaacaagtaagatgaaatttagcaagaataaatattaagacttatacttcggtgggtgcaatggtctgaatgttgtatccttacagaaagtatatgttgaaatcttaattcccaaagtgatggtattaggagatggggcctttgggaggtaagtaggtcatgagggtggtaacttcatgaatgagattagtgctcttataaaacagaccccagagagctcccttgcaacctttctaccacatgacaacatagcaaaaagatggtcatctatgaaccaggcattgggccctcaccagtcactggatatgctatcagcctgatcttggacttcccagccccgagaattgtgataaataaatatttgttgtctataaaccacccactctatggtattttgttatagcagctggaactaagacaaacagagagggctgggttagcactaaacagcatggagaaaatataactgaacatcagtttgaatgacaaaagatactgggtttttgtttgtggttgagagcaaactctatattgttcaaaaagagcacacatctaccaaaaaaagataatataagcacaaattgcatttctagaaatatagtgatggagaagtaccgacgaaatgaatggaggtgttagaaaatgggcccatcaatgctttgtgcagacatgtctagaacatcctggatggca

SEQ ID NO: 551 - DNA, 61318 bp, Homo sapiens
cccaaggtttgaatcccaatgcttcctgcttcttctaagtctccattaatcattctctctcagatgttttatccccacattttctattggaaaggacttcatggcatttctatagagtcttcccttaaatatttaagtctctgtattcctttttataaaattctcaaatgtccttaagctcctcagtacccacccccacccccgaaactaccctgtctctcctcccatctggaaccaagtttcagggaagagttatctataagacccttgtgcttcagtttcctcgccttccattcactcctcaacaccctgccatctggtcttgtcccactattccataacaaagggaccatattttgacccttatattaatagcatttgaccctttgcctccaggataacacattctctagatttcttctcccctccctgaacaggctttctcaagctccttggtaaacttttctttcttggctcatcccttggactttgctgctactttgagctctgtctgcagccttctcttctcatcacatcctccctgggtgagttcacaccctctaaattcttcatttgccatctttgttctgatgtctcccaaatgttgacagctagctcagatctctcttttgagggccaaacttctacacccgtctgctcacttaacatctctaggtagatattctatacacacctcagactccaaatctatacttatcaccttctctcacaaactatctccttttcttacattttctttctcactgaatggcaccctatccattctgctgttcaaaccagacaccttgaagtccataacaattcccttttcttcctcattatctgcatctaatgagtcaccaagtttaatcaactttagctcctaaatatctttggactccatctcagcttctctgctatctggattgatacaacagtcccatgactactttctctggctctggactggtctttctccaatctattctctataattggacaacataatctttctaaaggacaaatatttctcctgctgaaatccttttagggactccctattcctctcaatataaagcctagcatggatccctgatccccatctagttgcatctcttgttaattccttccctgaagtttgtggtccaactgtgctgatccagttatggttccacaaatataccatactctcacctccaaacttttaaacattctgtgccttggtttaaaatgcatctatcacccaaccccttgcctccccacttggctttccaagatcctactcttttttcagctatcaatctagaaatagaaatactttcctgaccaccagactggagataggtctcctatgtcctactacagaatcctcatcatagttcttccttattactctactgtcattgcttgtctatccataggttatccccaatagctgattggctcctggaaatcaaggtccatgtcttattcactttatcccagagcctagaatgtagtaggttctcaatatacttttttgttgttgttgttgttgtttttttttttttgagatagagtttcgctctgtcacccaggttggagtgaagtgatgcgatgtcagctcactgcagcctccacctcctgggttcaagtgattctcatgtctcagcctcctgagtagctgggactacaggcatgtaccatcatgcacaactaatttttgtattttcagtagaggcggggtttcaccatgtgggccaggctggtctggaactcctgacctcaagtgatccatctgccttggcctcccaaagtgcatgagccaccacgcctggcctcaatacacaattatttaaaaataaaagaatatttaaatgcagatctgtttaaaattaaataaatatataaatgaacacatgtgaagactatataaatgagtggagaaatatagatatatagatatccataatactatgatatatatgatctaagttatgattagtaatagcagcaacaataacaataatgtagctaacttctactgagtgcctattatgtgtcagcatcattataaatactttgtacttattaactcaattgatcctcttaatatctttagaaggtagggattaattcaaggtactggggatgtatagaagagggaagatttaattctgctggtattgagggggtgtcaatgtagcttcagagggaaagtggcttctgggtaggtagtagtgaaagccttggttttgggtgagattcgaaccctggggaagaatatctggtggggatactgagcaggagtggtaagagaagtctgagaaaaccaaggggaagtggcactagaaaaaacaggtaaagcgagagcttcagaaaggaagagtgttaaatgtcctagtaatgtctagtagtaaaagaacataggctctggcacctcaagtcctaggtgcccttttgtgagagtaattttagtagacttattcatactaaagcagattagggaaggaatataggcgaagaaatgtagagaatgatacagagttctcatacagaaaactggtagtgaaggaaaggagagaaaaggaaaaggcaggcagggtcaaggggagatttttttttttctttttctagataggagttaactggacatggtttgatttggttttggtttagtcgttgatttttaactgaaaggaagactcccattgactaaatattgaagattaaaggagatcagaagaggcaggacagactaggatgattctgggaaagacagcaggtcttcatctgattggggaaagggacaggtgaattactgacaaggggattcaactggaggaagttctcccttgatggtctctatcatccctgcggaatatggtatcatagttaagatattagaaccctattcaacccagtcttcttgataaaggaagagatgaggaaaaaataagagattttctttaaaaattatggctattgtatatatcacactaaataaacagaagaatagacgggaaagagatgcaaaagagtcagccatacatagttcctttgaatgaatctagggagccaaatggaagcaaaatatcattttgcgaaggcacatctatgctcattaaactagaccataatctccatgaacccaggatatgagactgtcttgtccactattgcatccacaatgcctatttcaatgcccagcccataccaggtactcaataacagttttttagatgaatgaataaaaattcaaacacttataagttttatttagttattttaatcaaggttaaaaacagagccagcttcatgggtatgtgacctgggcagtttcacagggccccatgccccaaagggcccctggcttggtttaatgctttgcagtcactgtgaaattttcaataatatgaacaaggggactcacattttcattttgcactgggccccacatattatgtagccagtacttcttaaaaaaaaaaccacacgtttctataaattttcagtaaatggatattttagatgcatgtgaatgccaaattacccatagaaatttatctttaaaattaaaaaagtatatttcaggcttacctgaaatggtagattgtggtttttctttcttaaaatatggttcatactctctgtagacaattttcttaaaggaagttacagaaagattcaaactggaaataaaatacaaaaactaatttgaaaggcatattcaatatctatttctcacattacaaaaaaagtagatctctcatatcttcagacttctagtagaataccagtatctttattgtatttcagaagtccacagttttataaatatgatcaataagtaaagttaatgaaataattattggtctcttcaaaaatatcctgttgtgataactatttgttcacaagttaatctaccctaatatcattcctcagaatcaattttctaaaaagaacccaatatcacagtagaaacccaaactgtaggtttagattttatatgattaaaatatgaccaaatcctttatgaataaatatatgagctgtttttcaactgatcaatcaaatatagttttaatctactggggaacattgtgaaaaagtattgatttggtggaatttatttctagttgagaggtgagagatggctaatggggtaaaagccctgggattcatattggaaacaaacaaatgaaaaaactgttttggaaagagtcagtaacttgtccaagagatacagttgataagtggcagaaccaagattaaaaaatgtgaaaccactgcattcatgattttaaataaaattagagagaggacagacaacagggagagttgtgagtggtgggttactttcctgtttttgctgttgttgttattgttctgtacctctaaaggcaaatcagtcttatccttgtcttaaactcaaagatgagggtaaaaggaaagagaatttggagaaaataccttgcaaatgtctaaatcagttgatcagagtggctttgttttgcttcctaatgtggggacagtggcccagccataatcaagacataacagcacccacatatgccatgacttctatacagcgcggtggctagggtgcaggctgtgaattcagtatctctggacttgaagcctatatctacctcttattgttttactttgaaaagtttacttcatccatttgtgcctcagtttctacaactatgaaatgagattaatactgaaatctccttcacagaattgttgtataattttaaataagttgatatgtgcaaaaggcatagagctggcacactagaaatactcaatccatgttagctagtaatattattttgtaaatgtaataagagttagtctttacccttcaggttttctcagaaagcaaaaacaaatctgtagttacagtaatgctcacaaattgtaatatgtggaatacagaaactgtgttaatatgtgggggcagaattaaaggaggcacgtaagtacttttagaatagctagatagagaaggtagtggattctccatcactggaagcattcaagtagaaattagacaactacttggtaaggtcattggtgctgagggaaaggggaaaagtagaaggttaaagcgtggaagttgaatatgaattaaatgaactcttagcattcttctaacttaagaattccaggattctatatactaatgtccctaatgtggaagtccatttttatttatttatttttagtacaattgaaaagttattgtcctcccctgccccagatctttaatacagaaatgtagatgatggtgtaaaatctttactaaaaaatatcagtctcttacgtggagtaatttcaacagagagatgtttcctaacatgtttttactatgtatgctgtgtattcatactgaggtatgtctattttgatctgaacaatttctattggaaaataatctatctgattaaaaagttacagatcatatgaattcaaacaatgtgtacgacgagtttttcatttataaggattgtttaaagatgatttgttcataatcacaaaatcatataaagctagaaccctagaaggaaaatgtatgtatatcttttcttcaatatctctttgtatacatgtgagtgactaaacaagttttctaaggaaatttttgaaagtgttcaccttagacttggagcaagaataatagatacattttacctttaaaaggcattgtcctgctaatattatatgaaataagtagatagatgtctgctttgtgctaaaatacactttgccaaaagatggagttggctatgttgatattcacctagtgagtatcatagctctaggggcaggacaagttagaacaagttcttagtttaagcagccagatatatggattagatttttcataagaaaatgctagagagaaatgatatgatttagggttaaacaatatgacagtttgtctgggttgtgtttctatggttttgactcaacaattcctaccagaggaacgaatctccagaactttggaaacttacccacaggatgaggggacagaatgaccagtcatggttccctgtgtactcaccatgtgaatcagacctttgccctatctggttctgcctccggtattttgcttgttattttcaacgctaactacagacaagagaaaaaactcccaagcatgaacccagcatgctacaagaaagccaacaaccaagtctgcattctactcatgagcaggcaagattagtgttagaaggactgttattttccttggggttttagcttacggcagttcccaaagggtgtgggtgtgacctagattatcactttgaagtacgatatttaaaatgattatttttgagaaggagggatctcttcttattataagaccaagatggtatgtaataccctccaaaataacccagttacaatgagagttttaaaaaggttaatattatacactaaaagatctcaaaatattacattattttttggcagattactttggttttgtaattgtaaaagaggaacacatctttcataatgaagtgtgatgtaaggaaaaaaagtgagtcacactagcaggtttaccatttaaaaaataactaactggaaatattgaatagactgtatgatttagttaatttctgagaagtcttatttttaacatttcaattagaaaaaatagtttgcaactcaaggatagtattttatctgaattaaacctcctctcagttacatatgcctttaagtagccaaggtaaaccatatcccaggacatgatgaacagagagaaaaaaaaatgaagagtcacattcaataggataaataagtcaaatatgaagcagaaaaaaggtgaaagtacaaaaacatacaagaactgatgatattttgaaagtcatttataaggcagcaataaaattatatgacaaaaagcacaaggtgttcatttttagttttagaagatgaagctatgtagacaatggaataaataatatgtaactaggagtctcataaaaatactatacaactaaaaatctggaacaggagtttgcaggaagggctaatgagggagcaagtgcctggtgcctttgaattaaccaatatataagccaacacaaacatactaacaaaactgtattgaaaataaacttgaaaagaaggtagcatctaaccaatcaaatagggtgctttctaaaccctcagaatgataaactacattgttggatgcaaaattagcatttgcccagtttatttaattcagtatactctcctattagttatatttacttacctgaagttaaaaaaaaaaaaagccatgacattgcaaagggaatgttctctaaaagaaatagattttcctctctagagaagcccacccggactccacacctgagttaccttgagtttgtgggctcaggtcggtagctccaactgatgccctgagcagccacgtagaactgccttagctgtgccgcttctgtcccttggctcccccagcctacccagctggtgcccaagaccaccaggacccagaggcgtgggcagcctgggaacatgcttcctttcctgctcccgctggctgccaccaccccaggacctgggcagcgcttgccgagctgctaaccacactccgggctgtcccagctgcaatgagctctagaggctgtgggtggcagcgtcctcctcccctgcagttcttgcaaacggcagcagcagcctctggctctcactccctccgctttttctggggcttttcctggcaggggtttggtgagatcacagctcccagtgaccagaggtattagggagagcaaccaaactagtgactgttttactgcaggtgaagaaggggcagagatcagaggctctagcaggcgggacaatgcccagggattcatgagccggacaaagctgtatccctccatttccacctgccaacaccacggaagcagtcgtccgttaccactgacctgaggcctgcctgggtccaagctcacacttggagaaccttctgtgcagtgcagtggcacccaaccaccttaagcagatggctccccttttaatctgaggaaaagagtattgtgccctgttactgggcactgaaacactattttcaagtggtgaagaagcagggaacaaacacatggacaaggcctactgctctgaatcgccttcctggcctctatcaaggcacagttctgccttgataagggcctgtcgccagctaagctgcagcatagcagcgggcttgaagagcttggctgaaaaaaatcagttgtccagatttcagtttcacttactagctgtgttgtcttgggcaagttactgtacctctctgttcagttttgacatctgtgaaataaggatgacaataataatttttcctgatagggtatgttgggaggataaaatgctactgtaaactatagttccagcacttaacacacagaggctaggcgcagtggctcacgcctgtaatcccagtactttgggaggccaaggcgggtgaatcacctgaggtcaggagttcaagaccagcctggccaacatggtgaaacccttctctactaaaaatataaaaaattagccgggcgttgtggtggacacctgtaatcccacctactcgagagattgaggcaagagaattgcttgaacctggaaggtggagtttgcagtgagctgatatcatgccattttactccagcctgggcaacgagagcaaaactccatcaaaaaaaaaaaagaaagaaagaaaaagaaagaaagagaaaaagagagaaagaaggaatcacaaatttattattatgatcatattttcctgtctccaggaccccttgtattcttgtttttcttgaaggatctgactgtttcacagcaccttaaatcttactttgctattgatagagaatctgcgaattatattgtctgaggcatcataatgacttgtcctgggttccctgtatctgcatggctccaggtttctgtcttatgctttatgcattcagtacattcaataaattgtaatctggcacctcacatgaggtctctgttaatgatatcaggctcatcaacagcctcttcctccctccccactccccccaatattctgtcttttctcctgtgctgatattattgcaccaacttagaatgcccattttcttcctctttgctgggccattctttacagtccagagttctgcctatctcccagattctgggctcaaattggcttttccattttatgaactattacaacactattcaaattatataatcatgttaattaccttttgttattccatgcaggtatctattgtctccctaactgaacagttgcttacacttctttatctacaatattatcagtgtctcccaaagttggcagaccatcagaattcccaggggaacttttacaaaatgtagattctgactcaggaaacagggttgagaccaaagtcctagaacacctagcctactgattgacatttaaataagcagtcagagatgctactggcagtgtatcagagaaacgttttgaaagcactgtgtccctaaatcccaaggttactaccagaattgttgcaacattattgtaacctttgagtaggctgcttttttatttgcatgtttgcttatgtatatacagtgtacatgacatatttatttaattacattttacagagacaagatgactactataatttttggctctctattttttttaacatcagttccagataaatactatataactttcaatgacctatttattaaacatgggatttaaagaacatgtaaaacacatttgttcttccctgtaaaatattaaggtgatgaagaatttttccatttctctgattttctcttgcagtgtagggtgtgcgatacatatttgctgactgaatgaatggttgaggtgtaaataggacaaccataattgtgtgttattacactgatggtaaacaatgtgatgtatacagaccttactgaacaaaccataaaatagaggaacacggcatttggggaaaattcttttaattacgcatttgaatattggtctttgggtcatttgagggacagtgactggtggcaggaaggtccacggtgacatgtggccttctagcttgattcttggccttctgcagcctctggtgccatccagaggactctctggaagcctcagagcagaggtccaagaggcctcatcaacagcaaccactggagactccagaagatgctacaggaatttcttccaattagagatgccacctgctttccaacaaagtggagaaaaccttccttcaatcaaaaaataaagaggtatttttatttctccacagtctggtcttcttgtgagtcagatgctccagtctctttggttcactggtatttcaagtaacaggtgagtcaaagcacagagactactgcagaaacatttgctcctggcttctgtggcttgtgttacaggaagagaagaggtgggacaggaaggggtggtaggttgagaatttgagattgtaccacaatcccaaactcaggaaacagggttggtccagagcgggtccaacaggctggtccagagctaatctaaggtaattccatgtctttgattcatgggtgtttatggaaacctgcagcaaatgcattatagttaagtccagtgtagcaggaaacttgatgttcacaacaggatcatatggaggctgaatgaggagaccaggaaaaggacaggtctctggaaatgagaccaaagaaatttaaataattatcatttccttaaaaaaataaaagaaagaaaaaaattgctcatcatatctacaccctgaggcgcagcataatcttttctttctagatttcgaatattctgccattcaggctttttgtaggacactcaactacccactttttgggagagggatagcatcagattatttttgtttttccagcaggtagcatagggaattgactccataacagttcgtaaacatttttcagcagtcctgacttctgctttgcaggcaaggccacatcatcaccacctagcagttaataatggaaatgttacacatcctgaaataagttatgtcttgttaggacatttctgtcctggaggaaatgaaaatccttttgtgaactcttttgtaactccattgtcatacctgtgtcctactgccaacacaatttccttcatgcctgaaaatttaatacatacttaaaatttaatatatgattatgtaaagaaaagttaagctttatagtcttccatttttccctagtgttctatttccttcaaaaatatctttatagggatcttaccttaaggactcgggtcaaatgcagcgtttgtaaaaactccatatgttcctaggtggctaaagaacagaaacacaaggatggcaacaatatactgcttagttctcgacaacacagtccaacacatagtatttccagaaaccacaaattaccatccacccttggaattctgctttagaaaggaaagaaaaataaatgccaaagaaatattcgatatcccacttaccagctctgggtaatttgcattgcattttgcacccacactaagttattgttcatgctttatgtactgaatacctgttataccctctaagttgctgcaacctcttctaggtgacaagaggtagttacaaaattcttggcattaacacttgataatctaacgatagttttcaaagggtgcaatatgacccctaggggtgttttttgatttttataaccaagagttcttccgatattgagtgggtatggggcaagggtgctggatgtctacgacaatagagttcatataaggatttccatgtcctccaggacggaaatgtctttaaaagatatccagcacccctgcctcctgcccactcaatgtcagtagaactcttgttcattacaaaaataaaaaaatacccttgggggcatactgtccctttttgaaaactattgctagattataaatagcaaggggtacaggacacaaaagaattgtccaacatcccacataactttggaatatctgctcgatattcatacaggttaaaaatctctgagcctggaactcaagcactttacatgtaaatattaagcatttttttgcatctttaaaatgcaattgccatatgaatcaaaggacaattatcacaggttttcagactctttaccggagttgttcaccatgttgaaaaattaggctggtgttggccacagttctaatgctctttgagtcactaatacaacattcccccatcagtccacctgcgtgggcgttgctttcctagtgattctgtggaaggtgcacgcttctgatgacctcattgcatctactggcacagcgcctaagtttttgcatcttgtttttattataaattacttttcattttattcctactttatattttaattagaatatttgttatctgtgtattttacttcagagtagaaaagaagacattgcaaaagacattgtaaaaaggaggcaggcattgcatgtaatcattctgacatattacagtgaattataaagttaaggtagcaaaatttactcaatcataaaacatttctaccttacctgtgaggattcaaggggcatttcccatcatctaaaatcagcaagaagacaagaatgaatgattaaaaaaaaaaaacaagatgaaagagagggtcattaaggatagaaattactggggaaaaccagtagactgattttcaggagggctcattataaggggaatattgggaacagtttctccctgaaaggtagaaagtgttttaggctaaattaaacattcgacaatatttaactccagagtcctgtcactttcttcctccttcctttcagtaaatacataaatcaatttcttttgagggcatcttgtgtcacttgccctcagcccttagctgagcaagctaatcacatacatgaatccaaaccaacagaacagtggatgtttttcctccctggtagcatatttttatccaaataacagactctcatagttgaattttcagctatggctgcagcattttcctcttatttggccatagaaaacttcaaagcctaaaatcaaattgggagaagctgaggaaaaaagctcccatccccaacaaatgaatgtatttattattaaaaatattggggcatgagtggccatttgtccttctccactgttagagggtcctctggaaatgtctcaaagtcaaagaaaggacttgggggaaacatcaagattagagtgattcctacatgatcatagagattaaggtctaggagctcttgcctctgccttctgggtttggttgagcaagcacacattttgcatggagggattcactgtagctctcagtacatctctttggtattgaagcagagtattgacctttgtctattgtcttagccactcacaggagagtatatgaaggaaatttggaaaaacagcctcaatgttttggtagcattgtaaatggagaaagaataagagtaaggaacacgtggttttgcctctgagcagttaagaataggtgttgagacctatgtcaacaatagagaaattcaatgagatctctttcagatattttaacatagccactttccattaccttgatttgagcaattaatggtctctctgatgcccccagttactttctatgaggagtgatgaagaagagccccattaggttataaacaaaactttatgaacttataggcaggctaagtgtctggagaagattgagaaaggatgttttaaaccttaagagatgggatgttcccatctttaattcctagactaaagttctttttctgatgaacagtctgatgaacacagtttcccttacagagagttttcatctatttggtcttctctgtttaaatcctgcatcaactttacaaattttcaggagaaaaagcaaatctcttagcttatcacaccaggtcaccaatacaggggcagcttcttctgcccctaacttcatctcctgcctcctccataatccccttttgattcagatgcactgaactgcgaaacataccatcttctcattgattttacactttcatgtctttctacatgccattttctctgatggaactctatttccattttccccttggctaaatgcctctcattcttcaaagctaagcttgaaaaaggctttctgacctgccagtctggtttaggcatccctagtctatgttctaataatacctaggttgtatttgtgtcctaacacacttactacacttcactaccggcactgatttcacctgtctcccctactggatttttccttccttaatatcagaaaccatcattatgagtctcacactctaacagagttgatgaataaatgactgctacatgaagaaatgagtgaagtcaggaagcataacacctttctaattagctttagtgatagcctagggtacttagaccagaggccccaaatgcaaaactgcaaagtagcctcatttgaattttgggagagagcttttgaaaaattcagatttccacacccactaccaagtctccccatagaaggatctatatttttaggaagttccctaggtgattctaatggacaatcagttctcaagatcacttatcttggctttattttcttttaatgcaaatgttttccaacatgaactactgaagttgtggtttttgcctccccaccctaaattacataaatcaatttcttttgatttatgtaaccaagatgcaaagagaagactctttcctatttacctttttgtctgaaacgctttcttagcaaagccaggagcgtcccacccattatcagacctatcgtagaagccaccgctccaccaaagtaagtcagggcttcctggatagtcaatggtcctgctacaaaacaaacacacacacatgcaagacataagaagtgtattatgcaaaagactagtctttctctcccagaaagttttcaagaactctaagatgtgcgatcaagtaggatcaccaaaggtcctgggaatgctgacaagctaacatgaaagaagatctggaattcataaatccactgcaacagaatgggaagtggggccttattttattcctaaggcttaaatatagactgtaatttccaaaggaatcagggtgaggacccaataaaagaaattaaattgtagacacaagaagcctatacatgtaagtatgggcaaataaaataaaagtggggccttaatttattcctaagacttaaatataaactgtaatttccaaaagaattagggtaaggtcccaataaaagaaattaaattgtagacataagaagcctatacatgtaagtttaggcaaataaaataaactgtgcataattttttggcaaagattcagttatgtaacaaaaggcagtcaggacaagctatgaggggaaaaaatagggggctgaaatataccttgcaaacagatggaatttaattaaggaagatctgctaggaggtttttagagttaggtggtaagcaaaggtcttctgagataataaattagaaatctgcatgaaataactcccagtttaaaacattttgaaacttcaaggtctgttaaacagagattataacgaagcaaaaggtttcatttcacaaactgaacactgaagaggaggggtgattacctacacagtcactgggtttaatttccactactttataaggcaaggagattctgcctgattcattgtgaaacacttattaagcagggggaaacccggggatggaaagcaagaccactatgagaaagacacagggaagaaacactgattttgttattttccacatcaaagtgacttcttaacccacatgaaaattgtaccttggcaggttggcacggtagttgaccagtggccattctcttggcatgctgtttgtgcagagccattaagtaactggccctctagacaatggaaagagcagattgatccataactgaagtttccccagaggttggagcagttcatcgctattggcttattaacatgtagttctgagcatttcacagctgcagaaaagaaataatgcaagagaaacaacatgtggattggaggtgaaagagattatagtttcttttgtaacctaacattgccaataaatgaggcagaatgtaaaaggtcagaaaggatatgagccacttccaatattcacagtagctcttctaacagcacatatatgaaaatattctctcgaagggtgatatccaaagaaccaagatgcaaagatggacacatagtagcatccgacaaatacctgctaatgcattgataaatcttgcctccaaatatactatttacaaaattttggttcttaaaatactgttagtctaaatgttattactacatttgtgatcaactggcatgtcagtatgtgtttattgaaatacttaataagtgttcagcatatctggacactggaagtttgaaagaagtagactgtcatcctccttaaactacattttcagggaacttcagggttattctttctaatttatggataggaaattaaaggtcaagaaattagatttaattcaaataaatgttatttatcagtagtgacatttgcaaagcactgtgctatgttttgtgggggatacaaaaatgaaagaaacataggtctcaatgctttatgtgtagggcgatagctcttcaggaaatatcatgtatggcttaactttttatttaggttcaaattattatgaaaatatggaatgtttatactgtcacataatatgcaacttctagtttaccaatttctatagcaggttttacatttaatatgtctatttttctaacacatcttggacatctgcaaatgtttcttcctttaagtctctgagtacttgtgtattagctttagcttgtgacatgaggaaggacagaagtgaaatgcctgtgacacattacttctaatgggattggtgtggatttcataagggagatgacacttggagtagtggttgtggttgggtgagacttcaacatacaggcacaatggctagcttgagtacttgcaggaaggcaggttcagaactgcctgctccttttcaccttacctctgcatgctggagttactgctgtccattgtcctgaaggtctgcagctgagagtgctgtctcctatgagtgtgaatccagcgttgcagccaaagtaacaagtggtattaaaaccaaaggttcccggatgatgcctacagtacatggttccctgcccaggagtggtgagggctggacattgcacccctggagtaggaagtgatgctatgcctgttgtgagaaaatgtttccattcagagacctcccaattaaaagaagcgttaacagagttaaggctaatctggaataactgcttttcactcccttcataacaagggaggctcctgcaagagctatttaaggaagttaagaaaaactatcagtgtcagagatagaaaaccagatgaggaaaattattaaaaatcatccttgaggagatgattctcctggccaagagaagaaatcagaggagtcattgttgttgctattttaaaaagaagcaagaaatggtacagaaatataagaaattcagcagaaagccaaatatacatgggccaactgcctgcccaaccctgccttattgggaaatggtactgttctctgactaaaggtcaatgtgaaagttgaaatttactgcaatgattgctttctgtctcaaactatttcttccatttgaatgatcccaccagctttgtcattaacttgccatgtggcaggaagatgatgattgacctctctgcacctcaattcctagatttgaaaaactggaccagtgactctaccccagtattgtctgtttctctcagcaataaattaatggagaccattccgttcactcaacaaagctctttcaaaaaaagaagccatgaaacaaaattcctgcttaagaatcaatataccttttattcacaaacataaaaatatcctgtcactccttagacattttaaaatccttcagctgtttgctaaacccaaataatggtaatatatacaattatctagttcacatataagaactagataattgtttgttgttgtagaataaatttccaaaagtagaactgtcttagcaagtacatattattacctttgcaggttggtggagtagctgaccatcttccagaagttgtgcattccacattattgggcccctccagcttaaagccgttgtcacaagagaaatggcaggtggagccaacattgaattctccacgagtgtcagaacaatccaggctgccctgctctggggcaaagagttctgggcacttgatggctagagtatcaaattaagagtgtcacaatctccaagtttattcagaagttctgtgttacacaaagttcattcacttatatattcaaaaaatatttattaagcacctatattccaggtattttgctaggcagcagcattccacaacatatcatgtaggtcatttgctgcaaagggcagtgggaggatggtaagcttacagagaagagtataggtacaagtcacgaagacaaagaagtcaaagatttaggcagccatactcaagaacttacaatgtcaccctattttctctacaccctctgcttcagagacctcgtagcctgccgcagctccctctatcttacttgaatgggtgcaatccaggatttcatttccgcccttcctcttgcctgagactacttgctcccatatatcatgccatcttctcaaattcaacacacctaaaactgcaatgattgctttctgcctcaaactatttcttccatttgaatctcctcactaattgttttgtttattttgctgttgtattttaataccacccatccagataacacaggaaaactcaaaacctcctggtcaagatagattagtttcttggaattccctgaagtgactttgtgtgttattgcttctggttcttggctcacattcccctgagaatttttccacttttatggcgtaaaatcccactaatcctccaggatttaactcgtaaagtctctgaagactctgctgatcaccacagcctgaactcttctcctctgaattcttcaactttttgtctgaactgatgtgctgtcatgtcccatgtcataccctcactcttctactggatgggaaagtgtctaaaacccaagaatgattcatccttgagtcttccataactcccatcccaggatctcaagaggcagtgctcagtaaccacttgccaagtgaatgaataaatgaatttaaattttaattcacaatttccccccaaaagtatttttacaaattattgcagttacatattttcttagcattattcttttctccccattaattctctaatataagactattatttatcaataaatgttgggttatagacaaatgaagtgactattctttctttaaatctaaggctattctgacaacaataccttggtcagataagtctcatttacttagatagtttgatttttacaaacctcttcaagacctatatgctccctcatggaaaaccaatgtacagtatttggcttttacatactggcccatgtatttttcagtaacaagctattcattgaaggattatggattcttattgcatgaatccattcaaatagccaaaataacacagtgaatttcagttcagtactctcaaattgttgagtaattaacaacttcatatctgacacatcaaatcaatttactaaacctttttgaaacatgtctactggtgtaactcctagacatgaagtcatctgtgaacattttcacaaaaataactttttcataatctcccagaattacaactttaaactgaagaatatgtataatgtcagctgcaggaaagcagggaccttgtcagttctttgaacactgtatcccagagaacagggcctgacacataggaggggttctacaaatacttatgaattgaatgaatacagtaatgaatacaatttaatttaaatgcattctaaaaggtatgcctacctggtttgaaaagaaacaagaggaattactgtttttaaaaattaaccgaagggggccctagtataaaatgagaactactacagcattaaattcatttgggggatagtgctttggtttcagtcttatcagtcatgctcagccaaggttacatatccagactttcatatttataaaagtctctgaactctctcaggtaaaaattaaccttgacccttacatactaagaatttggctctggatcatgtaaagaagtgggtttacctgtttgaggggcagcctagatgagttacatggaagcctaacccagatccggcatatggtgggcactcagcaaacatgggatgaatgacatttgtggagttatcaaggatgctgctggaatggagattagtgcagatgcaggaaaagagttatacccaggaatgacttttgtgcataactttgagaagtggtcatattcttgagcctactctaaaactttggcaaaaaaaaaaaaactcctgaataattacaaaaatagaaaacagataaggtttgcatttattgcacgcttagtgttctattttcactgactaccaaggcagttctatcacatatgggtattcattggtgttcttctatagtccatcaagaaagtatacatgattgcatctgaattcttaaacatattgatttatattatttcaaatagatttagtaaattatctgtttcctttcattatatcattttacttgagtttgatagagttttctcaataattttctggaaagaagatatagtatgaataataaatgtatctgagttgaatattgtaaactcaaactttaggaataaaactaggaagccccacagattcagagaaatgttgggggaatgaagaaaaaaatggagatgtcagctgggccagagttttagggggcaccagttcaccatattttaggacgtgagtaagcaggcacatggcagaagagcagagttgaggttgggacttggaaccaggacccctccccacgcagtgaaaatagacattaggagttgggttcagcagccaaacatggtcaccagaggatcaatgacagacagtgttaagggattaggaattcagcagtctgtatcatgaaagtggtccaacaggcagggacaggagggatacggaaactgtgtacaagcactccatcatgcaggtggcatcatcaaagttggcacaagaacctcaagcactgcttaggctcatgaaaaggacttcaggtcctgaagggcaaaggcagagacaaggctgaaaaataaccgactctctgtatccaagggttctgcatctacggattcaactcgttgtggatcaaaaacattcagaaaaaaaataaattatataaagttccaaaaagcaaaacttgaatttgccatgtgctgagtatgttgaatccatgcagatgaagtgatgtgtaggctttgcattaggtattatacgtaatctaaagacggtttaaaagtctaaaggagaatgtatgtaggttatatgcaaatattatgccattttatataagtgacttgggcatctggggattctggtatctgcagggagtcctggaaccaattccccctgcagatactgaggaacaactaggcagaggccacatcccagagggcccagggaaccggcattctaactaaagtggaactatcggtagagccatcccccaaaatgaaatctcacattgcactctgaagagacagcttgagaactccacctgccacactgcctctgcttacttggaggcccctgagtccatctgatgtatcctagaactctgcaaaacaccatgtgaaaattggggttctagggggcagtgctgagggttaaaaattaatgggttcaggcatatgggaaaataagaggaaccatttgcctaaatttagagcataaatttggagaacgaagaagaaacacaaatgcaaaaaccagggctcaagatcaggatcagtcaaggttgataattccaagggccatagtgggttaaagctgctgttcatggtcagggttgggtcttgacagtgagtggggatggggcctgcaaagtgggaggcaaatgcctcctcctgcagagaaaggggggctggaaagtagtgaagggaagcaagggctttagagattacagatttagcagccatgttggttgcctacatgatttaaaatgtgaatgagatttttaaaggtttttttaaatattctttagccttaaaatgtgggaaaatagaacttatgagaaatgtcaatggaataaatgaataagagagtgaggaataaatgaatgagtgaaaaaccacaagcccaaatgctttcctccatacatgttctagaattctcagggaacttgtagtatatctttttgacagcagatggtagcattttatgtctttcaccctacagaattcttgaccagggaagcgacctcaaagatggtctggtccactcttctccttttggaattgagaaaacgggagcctaagggtgtgacaagactttcctaatggcacatgacttggagagagagcaatacaagtctttggatattaatctagtgctcattccacaggaaggaataaataatattttagctgtttttgtgtaacacgaatagatttctaccaacatattctctcatctgatcaccaggcactgccatttctaaagttcatttagcagttatagctgcaatctgtggagtggaaaagagtaaattcacaagtgacttacctgagattcagaagctctgccactgggtgatagtgtagttcagtggtcaaaacactagccctataatcagactaggcctgggtttgcatcctgtctccatacttcaagctatatgaactttgctagctacttaacctctcaaagcctcagtttcttcacctttaaaatgggcatagtaataaccaacttaagggtcatttgtgtggattgaatgtgatgatgcttatgaaataggtagtcctacattaagcaataattattaccattatcactggtctcattattactaactctacactgaacaatacattagaacaatagcaccttttgcaactaaacaggagctatgaattaattaattcagtgcacttctattttagaacataaaatatactagatactttgccagccagatgtctcaggggaattaaagacagataagatctggcccctgcctttgagaattccactaaattaccaaagcttgtgtttgagtaaattttactggtaaatgatcaccttcaattcaacagatatttgtcacacacacccatttttattctgtctagctgctgcagggggtataaagatgaagaaggcacagctcctgccttcaagaagcttatattcaatatagaagtggagagaggagggaagtgcacacatagttatgctagggttaaatctcacccatccctaaataaggtctgtggctgggatttagtaatgctcagttgaaggtgaatgtaggaatgaagaaatgaagaatgtagctgaagaagactctgtaaggaagtaaaactttcagtgacatagagctgagccttttcacttactaacagtgtgaccctggacgagttatttaacctctttaagcttgtgtctcttccttatctataaaatgagatgatactgcctttccttattattttagaattgtggtaaacaggaatgctataatgacatgaaagcacttcctgaaactgtgcaatttttttttgagacagagtctcactctgtcaccaggctggagtgcaatggcacaatctcagctcactgcaacctccacctcctgggttcaagcgattctcctgcctcagcctcccgagtagctgggactacaggcatgcaccaccatgcccagctattttttgtatttttagtagaaacggggtttcaccatgttggccaggatgttcttgaaactgtggaatatttaactaaagctattaaaatattatttaaagagagggagaacttttttatctagattaccattgttgtggagagtgttgtttgcttcagctcaagaacacttttatataaatccctgatgattctccattctctgatgtcatctttaaagccataagaaaggacagacccacagcctaccttcacacattggtggggagtctgtccagcgtcccgatcgagtacaatccaatctttctggtccagacaaagaatatccctcgtcacagatgaattgacatgtggatttataactggaacttccaagaggttgaacacaggtcattgttccattctgagggcttagcaaaggtgtgcagggaatggctatcatgggcatggcagaggagaaaagaagagatcattttataattcagcaacctgaactctgtaactctctctctctttctccctctctctctctgtgtgtgtgtgtgtgtgtgtgtgtgtgtgtgtgtgtgtgtgattaatatacaacgatggtatttggctaaaagtgattgtttgaatttcatgatgcttcatcaccagttagagattgtagaggtgtaaaatagcagcagcttacagttgattgacatcctgaagtgctcaatcacaaacagctttagaggtgatttttaaaggaagctggtgctctgtttgggaggatagtggtgcaactcatttttgttgcttctagacaggggtggaactggtttctcccttgataccttcttcagaaacaccccaatgaccttaccagaaaacaatgacaaatgattggaaacacagaaatggaggaaaatactttcttccccctttcccaaccaagtggtggaatctgcgcccaaattttggctctgttacttgctagcaatctatcactagacaataacctttctgagcctcagttgctttatcttcgaaatgggaaaaaggaaaatccttgcatatgtgccacattttcttaatccagtccatcattgttggacatttgggttggttccaagtctttgctattttgaatagtgccgcaataaacatacctgtgcatgtgtcttggtagcaacatgatttataatcctttgggtatatacccagtcatgggatggctaggtcaaatggcatttctagttccagatccctgaggaattgccacactgacttccaccatggttgaactagtttacagtcccaccaacagtgtaaaagtgttcctatttctccacatcctctccagcacctgttgtttcctgactttttaatgatcgccattctaactggtgtgagatggtatctcattgtggttttgatttgcatttctctgatggccagtgatgatgagcattttttcatgtgtcttttggctgcataaatgtcttcttttgagaagtgtctgttcatatcctttgcccactttttgatggggttgtttgtttttttcttgtaaatttgtttgagttcattgtagattctggatattagccctttgtcagatgagtagattgcaaaaatgttctcccattctgtaggttgcctgttcactctgatggtagtttcttttgctgtgcagaagctctttagtttaattagatcccatttgtcaattttggcttttattgccattgcttttggtgttttagacatgaagtccttgctcctagggtcatttttcagccactgacttaaacagcatgaggtttcaagaacactttctacgcctttctcttcccttcattccttcccctctctagctacattcctttcaatctgatcaacttgtccaaagatctggttcttttcttctagttgaaaagtatttctgtagtaagtgtgtatgtggggctggagaggacacaactcaagaagcctataaactgcaaggacttatgggggaaagggtgtgggtgaggatgttggtaccacagaacccatttccagctcttctgtggctttgccttctgacagcaggggtagatgtggaggggtgggaggacattaaaaagggaaattgtctgataacactctctcagaagtattacaacagcgagtggattgcacactgcatggtaccttcctgcccagcccacatttgggtatttcacttgatgtgcacccagcaacaagaggagaaagttcagagtaaataaagaactaaaagcagaagggaactggaaggtcacaggaagccgtggtgagtggcaacctccttgctgtgaaacacccagaggcaggacagtatggagcaatgaactgtaatctgtgccctgcaccacccaggcttgcctgtaagagtttcaatcactgtgatcactgtcctcagggattcccagttcttcccacaacttccccaaagttgtgtggactttgtgatatgtccagacttcaacgtagccaggatgagcacttaaggggcaaggtcacagccccgccctgttctctccagacccagctctgaaggtgcacccaaccctaagtccaggggcttgccatcctctctggtgcctggcgatgaaggacattcaattctgctgtttgcttgtccatttgttcattcattcattcattcattcattcattcatttactgttgacctagcttaacaatggggtgtgtgtgtggggggtgtgtgtgtgtgtatgtgattatgcttttgtgtgacctgaatagtgagtggtttccttttagtaaaaaatatgtatctgcccactttcactcaaatgttgaaagtctatacaaagtgaaaggtatggcaaataatgtagaactgtctagtcttttacccattcaactttattgttaaaattgtatatacatcataaaaatattaattgcataggaggaaaagcggagaaaatattggaagaattcataccagaagcctaacagtgtctattttaggataggagtatttaagaggatatttcttcatttctttattatatttctgcagatttttataaatgaaaatcttgcgtttaaaaagcagcattgtctataaaagttaactaaggaattggatacattgagggggaaaaagcttggggaatataaaaaatatacgtctatccttcaattcacaaacatggatgactagaacccgttcaagttcatacaagatgttgcaatactgacagagcacactggcttgttaaatatcaagtacaaggccgggagcagtggctcacacctgtaataccagcactgtgggaggccgagtcaggcagatcacctgaggtcaggagtttgagaccagcctagctaagatggtgaaacctcatctctaccaaaaatacaaaaattagctgggtgcagtggtgggcacctgtagtcccagctactcgggaagctgagacaggagaattgcttgaacccgggaggcggaggttgcagtgggccgagattgtgccattacactccagcctgggcgacagagtgagactccgtctcaaaaaatgtatgtatatcaagtacaatgcagatagaatgtttatactgaatccacacatttctttcttctgagaatcccgtaacctccagtatacagattagtttttctcttttttctatcactcttcaccttattctaagtctatttctccaattttatacagatcttggagtgtttgcaactgggtacttgtaaattctgcccctcccattttaccattataccctgtggttcctagaagtgccagaccagccttgggacaaccactctgaagcaatttttttcccacctggtcttctttccagatgccatgtttggccaggtgagaagagtttacctggtttgtggcaggagccttcaggtctgggtaaagaccctgataaggagttagcaagggccatgccctactgtctatggccagacatcctgacacttgtgtaatctgcctatcccccggaggcatttgcatttgggatccttgggttataggacaagaggatgagtgagagtatttatgaattttccagtccatttcaaggtggatcttacatagttgtcacctctaaaatccagcctttaaaaatactgcctacaatttatttccatgatgttagaaagaatacactcttaccttggcattctggaggaacagaattccagtttccagtagccaagcactgtagcacacttgctcccaccaggagcaagccttcattgcaggtgaagctgcagactgactggtacctaaaggcaccgaaggggtgggagcagttcacccgggcctcatttggaactgggagatcctggcactgcaaagctaagggatgaggaagtaaggaataaagaaacagtaatacacatgtactcattgatttttgaccattaactctttctagtgtcaagaacagggattcctgaattgggcttgtttaacatagaagataagaaaaagtgtcatttaattataacggcacatgaaggattttattaggaaatgctaaacctttgttgagcatcttggcaacatgtgtcaataatttttaagttatcatgcttttggacccaagaatttatgctaagtatgtaatcaagatgcataccaaaaaatctatttagagatttttgtgaagacattatttgtaagagcggaatattgaaaacaaacacaaatgccattaattgagggtggaaattaatgatggtggatccatgaaaagaatgttaaaggtcactaaaaataatatattttaacttgtaaagataggagagaggtctcaatgtatgatgttaaataaaaaatcagagtaaaaattataatatacaccatgatctcaaagatgtaaaataaataaccatatacgaagagagcacacatattccatgtgttgtctcttctcatctttaaaatggtagtaataattgtaactacctcatagagttagactgagatcatagaaagtgctcaatgaacattagctgctatattagtagcagtggtagtaatagatagtaataatatcattaaggctttgcgtcacatgcagacactgagttcaggagtgggaaacattcagaaggcctatgaagggggttagtgagaccacatctctggatacttaagagaatatccaactatcttttcttgattagacatttaccttcctggagacaacaatggcttgaataatcccttatgatccgttttaagtgtgtcaaagagctcattgtgtctttttctcccagataacatatacaatacattccataactcagactaagtgtcagcatcatggtgtatagccatctattctattgccttcttgttttttctttttttttttttttgctgttcaattttttattatagtgagatatacgtagcatgaaatttaatttaccatttaccatgtcaccaatatcaagtgtacagttcagtggtattaagcacattcatattattgtgccaccatcaccattattcatctccaaaactcttttcatcatctcaaactgaaactccgtatccattaaaccataactccctatttccctcttccgccgagcccttggcaacctccgttctactttctgtctctatgactttgactactctaagttcctcatatgagtggaatcatacagtatttgtcctttcatagtggcttatttcacttagcataatgtcttcaaggttcattcatgtttgtagcagaggtcagaatttacttcctctttaaggttgaataatattccactgtaagtatgtggaatactttttacttatcctttcatccattgatgggtgtttgggttgcttccacattttaactgttgtgattaatagtgctatgaacatgggtgcacaaatatctcttcaagacctgctttcaaaccactgcctcattttaaaatcaaggtatacttaggaacccagaggagtcacatagattgctcagaggtctccgtaaatgaaaacacaaaatgtcaatattacacttctggaacatgactttagtgtgaggtactcctcgtaaaaaaaataataatccttgtgaaccaccacacccgccccccatgagtgccttagtataagagcaaaagattagaaacctaacatattgaaagaggatcattttgtcaaatcagaccacagacatgtgatttataaggtaacatgtcatcatcatcattttccctataaatcctataagagttttaaagttgcgtttacacacattaattcacaactactagtgaggcaggtaggtaaggctgataatagtagccccattttacagaagatactgagcctcagagagtctaaaccactagcttaaggacaggaagtgacaggactgagctaaacaccttgtccattacccttccccatcccatgctattcctcatgcatgatttattcccccaagccccatcttcttcattccaatgcaccctatatgtgtcaatcagtgcaaacctcaccttgactatactatagtggacatgtgcctaagactggcttcacgcaccgtttcatctcatccctggtcccaagcacaaaggacatggcccatagtaggttctcagtgaatatctgataaagaaaggcatgccaatgctcagtgcagatgctgatgcctctaacgagctgagacacacagaaaaacattaccactgttacagtaccttgacagactggggctggtgctgtccactgtcccaagttatcacaccgaactatatcggctcctctcagcatgaaaccttcagcacagcggaagctacagttggtgtcatactgaaacgctctcaaggatggagagcaatccatgcttccgtggacaggactctccagcggctcacacgaaatagctaagtggaaaaggtatcttctaaagccaggtaatggaagggccgggttcttcctcagaaaaaattcctagatgctatatctttcctgtccacattttcagtgtgttcagaaccctaaaacctccattttccaaaagagagactgcctggaacaccttcccatgcccctcttggcctgactcactctcacctgcccttcaggtctcagcttagacttccctttccttaggaagccctcccttcccaccttaactaagggtagaagcccctgcaatgtgctcccacagcctctgttcttgcgctgttcatacatgattgtcattcttccccattataccgtggtctcctcgaagttgggctcagtcattcatagttttattctggagctgagcagagtgttttgtacattgaaagtgctcattaaatattgacattatctgtgaaattgaacctgaaaagagtatatacaggaaaatgctggacttatagggaaaaaaaaaaaagctggactagcatagcttattgttgacactgttacctagtcctgtaaaatgatcctgaccgggctttgtctctagaacacaggatgtcatcctaatcagacttcagttgccaagtgagtgcagccaaagtgaattcctgagcacaattaagccctgagtgacctcagttctgataaagattggtttcctcatgctcttccttgataaagcatttcatttccaggctatttctgaaacttttcaaagtgtaaagactacctctttgctctgggctttgacctctggtttttacagactcagagcatttaagaaccaaaaatccggctgagcacaatggctcacacctataatcccagcactttgagaggctgatgtgagtgaatcacttgaggtcgggagtttgagaccagcctggccaaagtggtgaaaccctagtctctattaaaaatacaaaaagttgcctgtaatcctagctattcgggaggctgaggcaggagaatcgtttgaacctgggaggcagaggttgcagtgagctgagatcgtgccactgcacttcagcctgggcgacagagtgagactctgtctcaaaacaaacaaacaaacaaacaaacaaacaaacaaacaaaaacaccaaaatcctctagtgtttctctcttctctcttatgttttaggcaagaaaagtgaggttcagaagtgttaagtgacttctctaaagtctcatagctagatagtagcagggttgggcttgtcatccaggtctgggaattcactaatctatcgtaaatttcctattctcccattaccactgtccgccttataaactgagggtgtgaggcaattgcagagaattcattttggcggaattatgtaattgcctgggattgcatcacacactttttcgatgcagtgttccttcctttgcttctttgtcaaaggctaccctcaaagactacatggtgaaccactctctttagccaccttagccgctgctcccaactccctctcaagtataggacatggtcctatacctcggatatgtcagtagagcagaagctctatgctaggtactttatacatgctatttaattgtatactttttatgtacttaatcctcacaagcaccttgcaattcttagctccatttcacagatgagaaaaccatggttcctggaggttgaagagcttgctctagtgcaagaacttagaagagatcaccccgacactgagagcccttggcctctctaccatgccatgattccttcttggacagaatggaggttgctaatgaaaaatcctaccctcacaggttggcaagggtgcagaccagtgtccagagtcaatgcagcggagcatgtccaagcccctcactctgtagccgggctggcactcaaatttacagctggagccataggcaaaagcagtgagcggatgaacacagtccatggttccttcactgggggcttccaggtgctgacactgcacagctggagagaataaccaaggataaagagaaagatactgagaaaggagaaaagccacacagagagcaatggtggaaccacctctgaaatgcaggtggagctagcaagatgtaaaggtcaagagaccctaatgatgtttgtccagacttggattaccagttcccagggtgatctgagtctgttaaaaacaaagattcctccaagctgtattcttaatgtcctctattccctatacttctataaacctgtctcagtaggtcttctagtgtccacttatagatgtagaggccaccctttctaatcttatggggaaattatgaatgaggccattctgaaactgcctgcatttgtgtttggggaaagaaaggaatttttttcctttctcatctcagatgaacccaatctagctgaatggcaggtaggaagagaattaaattttggcaattcaggccagcttctccataagctggtcaatttcatctatgcactaagtaaggactgggtgcaatggacattatacatcccaactacctgaaactcacctttacacactggggctggggctgtccatacccccgaggctgtgcattgcaccacttccggtccaactaatgcaaatccctcttcacaactgaagctgcagctagactgatgctggaatgcttttgcagaatgaaggcaggtcatgtttcctcgttcaggaatcttcaggggtgggcactgggcagctaaaaccaaccacagaataatagtgtgagtccttggacaaattttgtccatcaccttggaagccttcaaattctgcagcagtcacaccttcccaaagtggcaggcaggttgatgcactagaatggttaaatggtgttttcaatagctgcttggaaagatcaaacacccttgtttttcatgtagagaagttaggtaaaattatcaaattaataattcttaacccctaagtcctcatcattgtactctgtttactttacaattaacaaagggaaagaggggtccctttgtaatgtttttgcctgcgaatcaacaattaaactgactaagtcactctacccataaaaaaataccatgaaaattgaaattaatgttactctggttgacagttaacagtgataaccagagttttccatctaacctagatggtcattatttctcacattttttaatggagaaagctcattgtgtcctcttctcccccaaaattctatgtcagtgaggatgaaaagaataaggtctacatacctaaacactgtggaggcttatttgtccagattccagaagccaagcattccagcttgctgggcccatttacttggtacccgtcagtgcagtggaagctgcactgcgagttaaaagagaagtttcccagagggtggctgcagttcatgagcacgtgttgagggagctcaagttctccacactctctcactgcaggagacaaaatagtgatttttattttccatgtagaattaacagcaatgtcatgtttgctgaaagctgtaactatttgtgtaaccctcttaactctaattttctaaacttttaacccaagctatccatctctacttggtctctttgtattggctgcatcttgggaaatagtcattctttcacaagtttttacttcaaacaagtaaaattagcctgaaagttctgttggttttgcttcctttccctttcccttttcttttttgaaatttatgagtcaatgttttctcccaagaataaaatgtttttacctagagtgtgtgtctagggacactgagtggaggagacagatgatagaggggggctggtaccatcctattctcactggagagacttcaacatgatttatttacttcttggcatcatctctagcataaaaccaaaataatatcaacaaaaaggaagcctcaccgtattcacattctggcccatagaatccagggtaacaggagcaggtgtagttcccgatggtctcgaggcactctccttgtttgctgcaggacatgtcctggcaggaggctgcatagatatggaaaggtcagagtcatggacattcacagatgtgaggaaaggctgaattctcgttttgaccacagactcatcccctctcagataggactgagctagccagacaagagggaagcacagtatcttctagagagccaacctgtcccttgtgaaaagcattgtaggggcctgctggagtattgcgtggctcccatttcatactgcatttagtatttcctaaggagggtattgttgtgtgtggacacagagggacaaatggagccaatgacagatgtgtggacagagaaaccctatgtggtacaaaatgggctgtggttttcaaaccaagcattgttttattatggaagcccaatgtcacgtattactgcattgaggttaggcaccagatgtggggcgtggggtcacacaggtgtgatatgaatcctggctctgctgcctacttgctatgtgaccttaggcaagttacttctctgagctcagcttgcacagtgttagagcccaaaccctttcacctttcatttgcttcaaatctatgtccagaatcctacagtggagaaacagaggagccaaatgagatgtttaagacgtactcatggtaaaggacaaacaatcttatgaggtgatgtttcatgagtctgaatacagcaggcgaagagagtactgactatggctgaactgccatgtcctcttcaccaagatagtgccactcaggtgacagaatagagaagggccatggtttctttcctgcaagaaagtattttagggtatatgcacttgatgagaattagtattagaattgatactttcaaagcactgagatgtttttattaatgaggtcatagttgggggtaagttctatggctgaactgttttctggtggttacttcctctgtcttaagccctgtccacatgctggttcacttggaagtatattacaaaagaatatccatatgtcatatgtggatatgctgtgctacatgatctctatgtttcctctcaattctgagatactaaaattctataaaccatgcaaggttctataggaagaagttcctgtggcagccagtgaatttggtgaagctgcactgagacactgggaagggttcaaataaagagaagatgtaggaggcaatagcagctaaatggatacaggtttggtccacatcctattcacttcgctccctgaccttaaccccaccaatgtcttaataccttacagtagcaacccctgcctgccctatgttcttggagcatacaaatgtttccccaattatagcttccttgggatctcagaactctaggggaaaaaaagagacaatgttctgtattctatcccatttcagggtttcctgaatagataggttagcaatttgtctattcctttggatctccagggagaagatgatttattcatgatgattcaatgaataaatcttttttcgatagcctgctctgaggtctaataattcctgacatgtggagaattattccaacaatcaaacttaatttcatattacagtaaatatatctatttctcatctcccatggataattgatgcttctctacatcctttacatcttagatggcaaaacgacaatcaatggtagtggctgcttagagtactgtgttggtggagataaaacccatctgtgttcaggtaaagttgtattaattagtgatgtctctaccactgttgtgggttagaggagtgtcatcatttatgccagtaattttttatcttttttctatcttgcaatttttttggcaagctttattgaggaagactgtcttgcagaaatggattttgaaggttgggtgtgaaggggaagtagtggcatattgaaacagctagtggcagtcaaggttatctgataagagataattctagggaggcatagcccagaaaggggtagagagctgactgggagagcagtaggatgagctaatatcctggtaatgtccatcctgatccatgaatatatgctcaattaatcaatttatttatatataaatgcattatttataaagtagatctgattatatgataatgcattcatggatatgttttgcctcagctaggaggcttggggagaagagggacaatgtagaaggcttgctttattctgtgtattctgttccatacctgtactgttgagggcttctgagggagaggtgtttaaaatctaaagaattcagaatatgtatggcagatgatttatcaaagaagcttcagagtacttagaaacttcctgctcggggcagtccataccatccttaggcacagtgttcgtgtgctacaaaggacagaaccggcccctctggacagggaagcaacatcagaaagaaggaatcagctctgacactaggctcgtgactagaggaagaccaagctttcaggaatgtctgcttactctggcactggtaaagttgagaattaaaatacactcgaagtatttcaccttcaattacttctttcctttcctgcccactccccaccactaccctcccaccaaagttcaatggatctaaagatatgttgttgttgaagagaaactataaagcatttacaatccttggttatattctcaaattgtctcataaaaatgtagagcaaagaatgtggtagtttacatggctaaaaaacaccaactttggaatcaacatgagtgtgaaactggctccaccatcaactagcttagaaccctgggcagattacttaatagctctgagcctttccctcatcagcaaagtaagagtaatagaaaaacctgactgatggagttgtcatgaggactaaatttgactaatattaaatgagcaaatgacacatgaactaaataaactaataacacaatgcctagagcatactgacattcagtagctattagttacagctgtgtcacctaggggcagggctaaatttccttccaatttacactctctgttatacaagacacaggggtgaaaaaaaagctctacacctaaaatttgggagactggtttctggtcctcactttgcttctgtcctgctccacggccttgagaaactaaaacctcgtgagtgtccttttcatcagttataagatgagacaggtgagctggatgatattaaaatttccctctagttttaagcagctagttttctctaattctgatcttatattcttcaaggtgctcaataatactgattgactaacaatttaccccttgatttcatgtcctgcctttgtatctttgtgttgactcggtggttatgttggccaaccagagaaggcagggttttttttttttaacaggaaagtttcaaagtagagaaggccctacctgtgtaacacaatgcgtgctttttcttcaagcagtgctcatcattccacttgccaggggctgacggactcttgatgtatatctccacgcagtcctcgttgttccttttgttgttaggttcattatcagcccagttctcagcctcgttggtgagagcctttttggttcccacccatgtccatgtcttattgttctttcggatcccaatccagtagtaggagctgtagtagggtaggaccttattgaggtaatcaatttcatttttattctggatggccactaagtctgtgtagcgattctggcagtatttacgggaaatattccatgagtatgcttttgtgctgtaatgataagtccatgctgccacttctttctggtttgttagttctagagtaaaggagagtgagtgccaggttagtacccctcaccaaaaaagaggccgtgatcccaagtatgcttctgcatactcagatgaatttccgaccagaacattaatacacaaaacaacgactagtttatgtctaatgtagttgtttgaaggaaaaagagtggtttccacctttcacttaaaagtgtgaatgatgtcagaataggaaaatgtcatcttctgaggatccttgatgttaaaggtttggaatcataagatatcaaagttaggagggaccctggaagtcatctaatttactcctgtccttttataaaagaaggagacataagtaatttgcccaagctcagattaaatgacatataaaatgtcttaagggcaagctctacctcttcacatggaaaataacatgctttatgacctggagcctaccagttggtccagcctcattgcccactgtatgtactttctcagcaaaacagaattcctacttccttgaatttgcacatgctctccccacaatcctggctgtcctctcttcttatgtctgataaactttactccacctattctccatggctttcccaggtggactctgtgttccttcctccaggctcccacagcacctcatccctgcctccattgtgctcattgccatgtacggtaatgtctgtttctatgatacagtctacatctgccaggttgtaaatctccgacggtgttttctttttagctttggatccttagcactgagcctagagtttagcacttaataggccttcaataaatacttgttgaatgagtgaaacacagtaggtttgtggcagaacccgggtgggaaatcagatatcctgatctgcaatcttatagtctttccattcttcttggctgtttgtctttcattaactactctacttcttccatgtctgaatactcccttattaagatagggctcagaacagccctttttcacaagtgtttttgataccaaatgaactaaagaatgtgcgtttcaaaagtataaaggtactacagcactcttatcatagtctgtgggagtccacccggggcaggagaggccatttcccacatgaagaggtgtacaaagcaagcaatcaggcctggaaatgggtttctttcctgtttatttaaaggcttgtttctatccaaccctctcctctgctgcctgcatgagggttagtcatgcttgtacctcccttgctgacatttccagggcattgttttgccttaaagacttcattctgatatagccagggctgcattatgactttcatagacttcaggcaactttgcctatgtaggcttcttcctccatgctaacatattaaaaattctattttgcaactgcactggtacaaagatgaatatatcactatatattaaaacattttctttgacttcaaagaaaataattataaaagaaattcagacgtgtgtgggtctttgaaaattttgtgcgtctgtgtctactgtgcctaatggatacattcgtcctggatatatcattttaagttctttcctatgccctttctaccaatatgatggcgttgggtacatttgtcttccagcaatctggacttggacagttttcccatgcctcaaaccaactggctacaatccttaaatttctcacacatagatctgggctctaccctaattacttaggcctaagtgaaaagttagcataaagtttaccagagatcagggcactgaagcaaaggagttgggaaattccaaagaccactctctggaatctctggtacaagatggctatttggcagttggcctgaaacaagaagagaaaactttcttttagtatccatacaccaccaacatggccaaaaataattctagttaacaatcattatgttgaagtataattgtgccaatttccactggaagagtggttcaagccctctgcttccttcttgcttctcattgccctgcttctaagttctaccctggatggacactgtagcaaggctggggacagagttcatttcttcattcattcaacaaatgtttattgagtagtttgtgccaccaatgtttttattttaagatacatttttaatgtgtatggaagaaagctaaacacattaatatggctgtcattattattataaaacaatctttttaagaagtggtatgtcatacccaagaataacagaaagtcacatgagaacttcctgacccacacaaataatgtctaacctatactttgaggtgcagagcatcaacaaattgtgttatgctatgccatctattttgtactatggatctttgttttatcttcttgctttttcatttctgtacacatctacaatactattcaatgtttaatatacatatgtatgtatatatttaatatttcttaatatatgcagtaaacttgttccccttggatctatagcaactattatttctcatgaactctcttctgttgggatttcatcaaatctatgaatatttttaaaatgtttttggggccaggcacagtggctcatgcctgtaatcccagcactttgggaggctgaggtgggcggatcatgaggtcaggaattcaagaccagcctggccaacatagtgaaaccctgtctctactaaaagtacattaaaaaaaaattagacaggtgtggtggcgggtgcttgtaatcccagctccttgggaggtcgaggcaggagaatcgcttgaacccgggaggcggaggttgcagtgagcggagatcacaccactgcactctatccggggcgacagtgcaagactccgtctcaaaaaaacaacaaaaaatgtttttgggcatctaagttctagtgatgctcatcttgtccgacttcctcatgttgcacatgaaaatactgaagcttggggcatctaaataacacgttcagaatgacagtagcagagcttgactttgaaacaagaaagagctctttccactgtacttttttttttttttttttttaaccttcattaacctccaggcttctaaatcccatgctgcattgctgttttggatgataaagcatgcgacatgaccaagcctagctgctacatcagttcccctctaaagccactcaacattactatcaacataaaaacagtgcatttgctatgcatttgcagttttgtcactatcccagccagactgctacctaaaacctttcctgtaaagaaatctcaaattgcctcagaccacaatttggtctgtgacaatttgctgcgaggttatgtgtgtgttcgtgtgtcatgccccagtgatggatgatgtagcgtgcatgggacggtgtgcggttgtgtgtatgttcgtgtgtcatgccccagtgatggatgatgtagggtgcatgggacggtgtggggttgtgtgtgtgtgtgtgtgtgtgtgtgtgtgtgtatgtgtcatgccacagtgatggatgatgtaggctgcatgggactgtgtggagttgtgtatgtatgcgtgtgtcatgccccagtgatggatgatgtagggtgcatgggacagtgtggggttctgtgtgtgtgtgtgtgtgtgtgtgtgtgtgtcatgccacagtgatggataatgtagggtggatgggacagtgtggggttctgtgtgtatgtgtgtgtcatgccacagtgacggatgatgtagggtgcatgggatggtgtggagttgtgtgtgtgtgtgtgtgtgtgtgtgtcacaccccagtgatgagatgtagggtgcatgggactgtgtggggttgtgtgtgtgttcgtgtgtcatgccccagtgatggatgatgtagggtgcatgggatggtgtggagttgtgtgtgtgtgtgtttgtgtcacaccccagtgatggatgatgtagggtgcatgggactgtgtggtgttgtgtgtgtgttcatgtatcatgtcctggtgatggatgatgtagggtgcatgggacagtgtgggattgtgtgtatgtgtgtgtcacacccagtgatggatgatgtagggtgcatgggacagtgtgaggttgtgtgtgtgtgtgtgtgtgtgtgtgtgtgtgtgtcacgcccagtgatggattatgtagggtgcatgggacagtgtggggttgtgtatgtgtcacgcccagtagggtgcatgggacagtgtggggtcatgtgtgtgcatgtgttcatgcacttttgactacagcctgaccagataccagggagaactcaactcaaaccagttaatgtgtcccagagagtagagttatctcataagcctagaacttttcatctgggagcttctgaatcttgactttggtaagtaggcatattttgtgttcttataagctgctgatctctgcaggacctatgattaaacactgagagtatcataacgttatgatttacagctgtttatttgcacaaaatgcagagtgatcgataaccctttggtgcgaacctaaccccactgctttctctgaattgtgttgtgtcacaagctgttcttcctatcacatttcaaaatgcaccattccaaatgctgaagtggaattcttcaaaccaggataaggctgacttcccaaggggttcacaagcaaagagagtgttaattaaatctgtattcagattctcaactttcacatatatactttcttaaaaacaatctgcctaaaatacacctttctcccactttataagagaaaaattataccttttactaatttcttatttattccagagctttgcctttggatataaatacattcgtatgccagagatgattcgaaatattggtataggtattaagaatttgaatattgtaaatgatattgcagcaaatccgttttcaagtctagtgatttccatttatttcctttcatcagctttgagggagcacccgattaagttgtcaagtctgactaaattttgatagtaaatcactatataatttggggcatataacttggaaggacttcaaggaattgagacattgctataataaaacttctaattccatttacttattcatatgaatgaagtttctcaatgtttaaatccttgaaaatgaaatatgggaataatattgatgccaaacttgtctaattttgttgataagtaatattcattcatggatatatgaacaaatgagggaaagctcctcctgtcttagagatgaatctttaatagcaatttaaatataaaggtttaagttacttgtcaaaacttgcagtatatttactttatttaattgtgtactgaaagtagttgtcatgctaactcaatagaaaagaaaaacattttaacacatagagacttacagttgtagaaaattgaaattttatatttttattttgcaaagaagtataataatcaagaaaatactttaagcttaaaatgtgtaatcttaggctaaatactgtagaagtgggatagaaataactattcaaggagagaaaaatgaataatataaaatttcttaagagcctgcttgtggtcttttaagtgatgaggattgcagatcatgctagtactttattccattggataaactttaagaaattatgtaacaattttatttttacagtctaatttttgtaatacactggaaaatccaatcttcttttgcttttaaaatttgggataaaaaattgtagctttccacttagaaaggtgtaagaggtaacatagtgttccaggatatttttggaggtataggagcaaaaatattgctgctgaagagcacaactctgcagccttcatgaaggggacctgagtgcttgcctttgaacctgggctttgctctattcagacagattgcagaaggagtgcaacgattttaaatttagtggtactcttcctgtggaagtggttttctccctgaacagagtatttctagggatttccctggctttggggccagctcacaagagtgtgtagggcgaaggagtcggtgaggctcccagtctcccatcacagtggccaaccctacccactgtttcctgctttgacttgtttgtttaaacttttaaataagatttggtttaaacaaaatttccaaaaagagatgtttcccattttaacctgtttgtttgtttgtttgaactttttttaagcaaaatttcatcagcaaattctctaccacacaagataaaacaaagtgagagagagcgagacaacttgttttaaacatttgaaggttttagaggactggtacagtgcttttgatgaaggcacaacatctaagaaaggaaaatgcaagtcagtgtgcatcccctgctttaatctgacgtacttttctgtttctatgcatcaccaaataccaagattcacctcttacaggttatttcagagctataggagaacataaaggtcacttccaagccaacttagcatttatctgctgttctgcaggaagtctttcagacttcgaatgcctaagatggggcagccaccactccccaccactgagactcagtgagcgtaaatgatttgcccaagcttgctcacatgaatgtgcatagggttaacacagttattcttattcttccagggcttatgaattttgaaaatctgataaaagccgtggtcagatttcttcaaaacaaatgcatgcttgcagtagtttagagaatctcagatggttcatgacctactaagtctgtccatgtttaatgtggcccaagttcaagattctgtgttaactgtaaggcaactgatagggattttgtgtggaggtatggagaatggatgatgtttaaaaatcttctttgagtaacagttttcctctgaaacctgcttggggtgggcaggccttctcatacctgctcctactctgcattatagtctgcaggatgctgctctgtcctgtgttactaagcaagttaaatactaaaacaagaggaaattcctctctagaagcatccacatgctctgctagtctttaatgttctctggaaggctggttcaactggaagttgctggaaaggagtcagagactgggtcattagaataacatcctgtgcctgtgtaagccttcattaagtaccatgattatctttaattttactttaataaagaactgggctggtgcagtggctcatgcctctaatcccagcactttgggaggccaaggtgggcagatcacttgaggtcaggagttcgagaacagcctggcaacatggtaaaacctcgtctctactaaaaatgcaaaaattagccaggcatagtggcacatgtctgtagtcccagctacttgggaggctgaggcaggagaatcgcttgaacccagaaggcagaggtggcagtgagccgagacactccagccttggcaacagagtgagactctttctcaaaaaacaaaacaaacaaacaagcaaaaaaactaataatgattgcagggtgaagagaaaagcagagagaaagtggaagaagcaaatgccttgacctaacttttcacacaaggaggtaccagaggctagtaggtgtcccatggcttgccacgttccaggtggcttacaaagttggcaagaatagtgccacagaaaggagatcttgttctttttgtctacattgtagaccacagctttgtgcttttagaaaggcggaatcaaacaatgtccctcccttgaccctttgtcctcctgcccacatctgcctgtttctctccttcctcttatagctaaactttcttaacttccttgcctcccccttactctccagcccactgcccgaccatcctatcaaagtgtccctgcaaacttcattgctgacatcctcattaccaaaccaaatgaagactttccacccttatcttccttgacctttctgtagcagtaaataccactacttccttttgcctaaaatgcttcccttagctcttctgttgttcttctgctctaatgtttgagaaacttttctgagtcttcttctgaatctacctcaatcctctgccttcccttgcagaggtaagtgtttctctaggttcccacctccatggccctattctcttctcattcttctgctttcctgggaagtaaagatgacctccttatggtcatctgtttccaatgtcctctaatcagcatctccgtttctgaatattctcttgagcaggaggtccacaatttaaatgcgcaacaaacatgtgagcatacagctgaggaagctactgacagaggcttctcaagggcaaggactattacttactcaggtctgaatccccagccatggtagggcacatactcaatactcaataaacattttatggataaatatatgaatgaataatggcagaggaataactgaaagtaagacaaaaatatgctaaataagaaaatgttggaaaaatacataataattataactgaatgcattacttttacagtagtgataatagctaagtgaacaaataaaatggtgaaaacagacataattccagtcctcatagaatgcacattctattggtagagaagacaatgaaacaaatactaataactacacaacagtactaaacaagtaaacatgaaaaatattaacagaatatagccataagtgctaggtaggaaatgaaacttatgtgatagaatgactgtgtcactatgttggtcaggaacgtcagggaagacctctttaatgagataatgtttaagtggagagaagaatgactgcaagaaaccagccagtgagaagcaggaagaagagcattaaaggaagaagaaaaagctatttcaaaggccttaaggtggaagcaaactgcagtgtgttcaaagaacatgaagacattagtgtggccagaatggaatgagcaatggagagaaaaatacgagccgggggtagtgacagatcacatcgggctttgggatccaaaacaaggggatgagattttattctaagtgcaatgataagccaacggaagctgggcacggtggctcacatctgtaatcccaacactttatgaggccaaggcaggcagatcccttgaggtcagaagttcaagaccagccttgccaacatggcgaaaccaactccactaaaaaatacaaaaattagctgggcatggtggcgcatgcctgtaatcccagctactcagaaggctgagacaggagaatcgcttgaacccaggagacagaggttgcagtgagctgagatggcactactgcactccagcctgctgaagattgggagatcctagaggttaactgaaaaggtagtttgagaccatatcttgtgggtcacaaataccagttggcagaagggatacttctgaacagagaagtatcatgaacacatgcacttaatggtggtatgattttttttgtggggctgggggacagggtcttgctctgttgcccaggctgaagtgcagtggcatgatctgggttcactgaaacctccacctcctggcctcaagtgatcttcccatctcagcctcctgagtaactgggactacaggcatgcatcaccacacccggctaattttttgtagagataagttctcactatattgcccaggctggcctggagcccctgggctcaagcaatactttttctttggcctccaaaaatgctgatattataggggtgagagtagtgcgatacttttttttttttaaatgagttacaatcagggagattgcactgcaaaagaagaggctattgcaatggtcccagtgagagttaaagagggacaggtttggtctggcatcagtgggaatgcaaataggggaggtgaatatgagagttgttgaggatgcagaactatacaacttgttggtagcaaagcccagatgttacaagctattacagctaatacattagttcccttatgtttctggacggtggtggtgttagtggtgtggcacagatattggtagcccagcttaggggtggaaaaagaaatacagtgagaaaagaggttgtctctaagccaaagagcaaattatgaatatagacaagaagggacccaggacatcaacacttagaatccaagcatatatttaatttagactaccaattgccattattttgagtaaaatattagcattaaaaataaagtacgacacttaaaattttttaaaaagtctattggatcagagatgagttatatctctacaaatagtgaggatttgctctgtatttgacttcatgaagtttctgatttactttttaatcaaaaagattagacaccttgaagacaatataatgaatgtcatttataaaaccactgtgtgcctactctctaggtttaggtccagggttttttctaaacacagttttttatgtagtaagtcattttgatttttgaggatttgatcaataagcttctacttaaagatctctgaagatgcacattctaagagctggtggctagcccaggagagtctgaactattttagttgcattttgaaaaacaggtaatgaaaagaagagtaaggactggaagccacataaggtggttaaaaggtataaatggacgaaaatccagacctgctccttagcccactaaaactttttttttgttttgtttttgagacaagtcttgctctgtcacccaggctggagttcagtggtgtgatctcaactcactgccacctccacctcctgggttcaagagtttgtcctgcctcagcctcctgagtagctgggattacaggcacatgccaacatgcccagccagtttttgtaagtttagtaaatatggtgtttcaccatgttggccaggctgctcttgaactctcgacttcaagtgatctatgcgcctcggcctcccaaagtgctgggattacaggcatgagccactgagcccggccatagcccgctaaaactttgacaaacatcagtgcaatttaactataagttcccaatcaagagctactcctctgagatctatctgattgaaaataccccaccagaaaaaccttatcctcattttctcaggtcctaaaagttaattaaagccactctctgaacttgaagcaaaatttacacaggcagtttgaggtttctgaatctttggggccaaatgtgctcagaggaaaaggaagaggtcttgtctttgaaatattaaaaaccattccagggctggggccttagcacttcgctgtagagctcaagcctaatttcagggtaccaagagaggggcttctgaacataaagcccaggaggcaatcgagaagggttcttaccctgggatccacatggaggtctgggaacctcctgtggttgtctctaaaggttggtgtttatgtcgatgtttttgctttcatctgggaaagacaagttgtaactttcatcaaaatctcaaagaactctctgatccaataagttcatacctttgaaatagaggaggatgccaaggagagtagaaggaagagaggaataactgctcatttaagttaaccaattcagaagtatgacatgcaaaaagacaggacaaaagtaattcatatccttaggtcattgtggttcaaacttaagacaggctcaaactccttcctcttctctttatcatactcttattcctgttttccccaacacagaaacccacattataagtacttgaaaagtgtgctatagtaaagcaaagcagtaggatgaatcaggtgtatgcggtacttttttctggagtcccacagaaaggtgctcaaaaacagagacctgcctggttcctccatagccacagactgcaggatttcggaccctgggactatgtgggatactcttggaaagtctgaggaaaattggaagtagcttaaccatgtgcattttatctaggtgcatataacattgctgagttcaaaatgcctagctatccttggatcttccctgaattagaagtagcctaaccacgtgcatcttatccatgagcatataacattgctgagttcaaaatgcctagctatccttggatcttccctgaatcctaaaccccactattcctaagaattttctttttattgtaacaataatggctaacatttactaatcacttactatgtgtcaggctcagatctggatgcttttcagcaaaatcttatttaatcctcatgatgaaactatagagtattattactatatccattttatagaagaagaaactgagtcattaacaagattgagtcttagggcagaaaaggaaactatgtggatattccagatcagtcccagaagattcataggctcacagaaagaaatgggagggatggggatgagaaactattcaattgtaagcttgtcccagggcacctacccagtcttccatttattccatcatttatcccagagagaagtacagtcttggaaaatggggtgacaggtttaccatgatctattctcagagagcccctataaattctagtaggaggaacagcagctgcggagccagaggacaggccccagatcccaacatcatgtagcctaacagtgaagcttagataaaacacagcctctgtaaaccacgatggctttatttgtaaaatagaaatagcaacctcaactcacaagggtgttgggagggtcaaagtggacagcaagtttaaaagtactcacaaaatctaataggcaattcaacataaaactccatggctatcgctgttcctcactttctgaacctttacctgcctgactttactccataccactccaactcacttcaaccacttcccatgcagaaaaaaataaactcaccatctcctctgtgactctgctggttttctgccttctgcccaacccagactgcttacagtctcactgcctcccctcagtgtcaggctgtttagaaaaacaacttcctattcacattccagaaactcaccacagcccttcccatgaagttagaatgttgataatgcaagagtaatgttggcagcttagaaatagtggttgccaagaggcaaggggtcacccccttccatggaagatggtctggaggcaggcgcaaggtgaattactcctggatatcccaggctgagcaatgtgggaacagtacacacacaaaggtttccttggattatgatataagctccaatttaaagtagtacatttggaaaacatgctttgaattaattacaatgtgattttccagtgcccattttccagtaattatgacatgtcagtgaatgtttactattccggcagccttctgagggaaagaagcaaaattagtagcacaaaaaaaaatagagagaaatggaaaaagccactaacagttttctggcgcttgggaaattttattggtaagtttcaaaatgacgtattaaatagacataggtcatgtgaaaggaattctgcttcttatatcagaaataaaaaggtatacaaatagatacctttttattttcctcttcccatgggatgtgtaggaccaaaaagctgttggcatagtggttaagacttcagctgtgctgttaaactgcccgagacccatcctggctcctcttctggctatctactgggcaaactacttaagctctctatgcctctgtttcctcaactgtaaaacagaataacagaacttgcctcaccgggttgttgtaggatgaaatgagttaatatgtacagagtgattgaaatgacacttggcccacaattgatgctcaacaaatgttagtgattattattacttttcagattgatctcagacagcaaaatcaagtatcaagtatttagtttcaagtcagaaagccataactcctatttatactcttggaattctattgtacagtagtaggtattattcttcattcacttcatgatggttacagcttgtaaataggcatctcatggataaatttaaaatggaatgaagtagaaacattggaagaaagtctaaaggtaaagatgaattagggtatataaggctgcatttgcacgttggaatttgggaccaagaagaaaaaattaattatatagtagaagtagaaaagatggtgaaggaaatgctgttgaaggaatgactgtaggggaataagggaaacttagagagaggaaaaaatgaggaacttcttggcagcatgatgcagttcagagtccagaccctagagtcagactgcctggctccaccacctaccagctgtgttgggcgttactaatctccctataactcagtttcctcagtgatgtggtttggctgtgtccccacccaaatctcatctggaattgtagctcccataattcccacaggttgtgggaggcacctggtagatcattgaatcatgggggtggtttcccccatactgttctcatggtagtgaataagtcgcatgagagctgatggttttataaggggaaaccccttttgtttggttctcatttctctctcttccctgctgccatgtaagacgtgtcttttgctttctaccatgattgtgaggactccccatccacgtggaactgtgagtccattaaacctttttttttttaataagttatccagtctcgggtatgtctctatcagcatcatgagaacagaataatacactcagcaatgtgaataataaggataataatcaccaaatacatagacatgtaaggaccattaaatgaatttaatgtgtttggaacaatacctatcacgctgttaagtgtaagtttaagtgttggctattattctataagacttgcctccatgtctttctgttcttactttcactcaccagcccctctttttggcattgcctcatgttagaaaaaatatatatagtctcagatggggatgaggaagtgtggtatgtagactagtaggttctttttttgagacagggtctcactctgcggcccaggctggagtgcagtggcatgattactgcttgctccagccttgacctcctgggctcaagcaattctcccacctcagcctcctgagtagctgggactatagatgtgtgccatcactactggctaattaaaaaaaaaaatctctagagatagggtctctctatatttcccaggctggtcttgaattcctgggctcaagtgatcctttcacctcagcctcccaaaatgttgggattacaggcatgagccaccatgcccagcctggtagtttcttatttataataagtttgatattaataagttcaattgatcatatgtttttaagtttgatattgttaaattttagtgaatataaggaaagcataaaaagattcctatgcaggtgacattagcaagatggtggagtaggagatgtcagccttatgccccaacaaaaaaacaaacatagacagttatacacaaaccaaaatagccctcacaagggtggggagttgggggatggggctcaagagcctgttaaagaatttggaacaacacaatggagaaaagaaagaatatccatgtagaagaatcaccggtgagactggcatatatgagacaccaggagatagctacgaataaagaaatttgtaggctatctgtgtcagtcatgtgacacagagccactgaggcccccagtgtcctgctccacagaggacactggcatcttttatccaacagccattcccatagcaggatgctaaaaagggaaacacagttgcactacccctcacaccccctcaccaagaagcagctattgttgcactgccccaggactggggccagggttaccacctctcacaagtctatgtgtgttcctgatccccaaaagttgtggctgctctacagatattcacactctggactgtggctctgtggctgcagtgcacctcctcatgtctcagacactggagtcactgctgttgtgaactagatctcaccctgggaccccaagccaagttctctctgtgaaagtctttgctccagacactagttcagccactgtagaaaggtaacccatattctcaactccagagctgctgtagtaatgtgcacacctgcgctccagaccctgtctctgaggctgtactacacacacccacacctccaacaccagagccaccactatagtgagctagtgaacaccctgggtcctagagtcaaggtttctctgtgcctgtccatgctctagtcaccagctcagccaccaaggagagctagcccacaccctggatcctggagccactgtagctctgcgtatgcatgcagtaaagtccctggctccttagctgctttataagtacctgcattttacacaccattatcaatgtgatagtaagtatgcctgtgccttgggcactggtaccattgctacaattgaatctggtgctgtggtccctccatgcatgcccatgcttcaggccttggctcttggccactccatgggcactgttcatcagacaccagtgtcaccaccaccaggagcaggcctgcaagttagacctaattccaagagggatgtcctcagtcatgacttcccaggtggggaaaaaaagagatatggaggacttgtcacaattgaaaacctcaacagcctcattgccactgtagatacccacagtgttggcctctaaggatccctgtagtattcactaacaccaacctcagctgacagatctgcatggagaccacacagctttgcccctactgaagtcagaacttttgcatcccacccagccagcatcctcgcattattccacataagaaggtatttctccaccaaagtcagcccatacagcctgaaattggggcagatccaccagatgctcagacagcagtgtaaggcagcaagaaacatgaaaacccaaattaaaatatcaccacctaagaaacacaataatttcccagtagctgacccaaaagaaatggagtactacaaatggcctgacaatggattcaagataattgtttttaaagaagctcagttactttgaagcaaacacagagaaacaatttggtgaaatcagagaaacaataaatgcacaacataagaaatgtaacagaaagattgaaatcataaaagaaattggagctgaaaaatataatgaatgaagtgagaaatgcagtagaaatcaccagtagcagacttgatcaagcagaagaaagaatctgtgaactgaagacaggtttttgaaaatatacagtgagaggagaaaaaagaatgaaaagaaatgatgaaagcctacaagatttatgggacagcatcaagagagctaacattcagccagactcagtggctcatgccataatcccagcgctttgggaggccaaggtgagtggatcacctgaggtcaggagtcaagaccagcctgaccaacatggtgaaacccagtctctactaaaaatacaaaaaaattagccagggattgtggcacatgcctgtaatcccagctactggggagactgaggcagcagaatctcttcaacctagaaggcaaaggttgcagtgagctgagatcatgccactgcactccagcctgggtgacagagtgagactgcatctcaaaaaataaaaacaaaaattaaattaaaaattaaaaaagagagctaatgttcacattacagtagtttaagaaggagaaaatagaggaaaagggggtcagaaagcatatttaaagattgctagctgaaaatttcccaaatctgaaataaaatattaatattcaggtacaggaagcttaaaaatctccagtcaggttcaatccaaaaaagactacaccaagacataataatcaaactatcaaaaatcaaagacaaagacaggatcctaaaatcagcaagagaaaagaagcatatcacagacaagaattgcaataaggctatcacaagatttctcagcagaatgcttctaggcccagagagagtgagatgatatattcaaagtgttgaaagagaaaaaactgccaaccaagagtcccatccttcagaaataaagaagagataaagactttcccaaacaaataaaagctgaggtagttcatcaacacgagacctgccttacaagaaatgttaaagggaattcttcaagctgaaagaaagggatgttaattaattacatgaaaatctacgaaagtataaaagtcacaggtaaaaataaaaatacagtcaaattcagaattttccaatattataattgtgctgtataaatcacttatatctttagaatgaaggttaaaagacaaaactattaaaaataattataaccacaataagttaacagatacacaatataaaagatgtaaattataacatcaaaagcataaagtctgaaaaatattaaaaacctataaaatgtggagggagagtaaaagtgtggagtttttttatccttgaagttaaattttatcagcttaaaatagcctgttataactattatatgttttatctaagtctcacagtaactacaaagcaacaacatcacattaaaaggattattcaccatgatcatgtgtaatttacccctgggatgcaaggatggttcaacataagaaaatctataaatgtgatacacacattagcagaatgaaggacaaaagccatataatcatctcaatatatgcagaaaaagcatttgacaaattttaccataattttatgataacaattggtaaagaaggaatagtgccctcaggcaataggaaggaataataccctcaggtgtggaaagaaagtaacttcaacaaaataaaggccatatacataagcccacagctaacattatagtcaatagtgaaaggttgaaagcttttcctgtaagatcaggagcaaggcaaggatattcacttttgccacttctatgcagcacagtactggaaatccaagccagagtaattgggcaagagaaagaaataaaagacatccaaatcacaagaacttgtctatgatttcagacaacatgatcttatatatagaaaaccctaaaacatgatcttatatgtagaaaaccctaaagacttcataaaaaaaaacttttagaactaataaatgaatttagtatagttacaggatacaaaatcaacatgcaaaaatcagcagtgtttctcatacactaacaacaaactatctgaaaaagaaattaagaaaataatctcattataccagctacaaaaaaacacacttaggaataaatttaaccaaaaagataaaagatctatatactgaaaaccatgaaacaaattgaagaagacaaaggaattgaaagatatcccatatttatgaatttgaaaaattaatattgttaaaatgtctatactacccaaagcagtctgcagattcaatgtaattcctatcaaaatttcaatggcatttttcagagaaataaaaaataacaatcttgaaattcatatagaaccacaaaaaaatcctgaatagccaaagcaatcttaagcaaaaagaacaaagctagaagcagcacactgcctgatttcaaaatatactacaaagctatagtaattcaaacagcatactggcataaaaatagatacttagaccaatgaaacatagtagaaagataaggaatagattcatgcatttacagtcaattgatttttgataaagatgccaagaacattcaatggtgaaaggagggtctctttaataaatgatattgggaaaactggatatctatataaagaagcttgaaattggattcttgtctcacatacataaatcaaaggaaaatggattaaagacttaaatataagtcctgaaactataaaacgattagaagaaaacacacataaaaagctccatgacagcttgcagtgagccgagatcacgccactgcactccagcctgggcgacagagcaagactccgtctcaaaaaaaaaaaaaaaaaaaaagctccatgacattaatcttggcaacgactttgtatatgaccacaaaagcacaggcaacaaaagcaaaaataaacaaatgggataacttcaaactaaaaagctttttccaaagcaaaggaaacaattgacagagtgaagagacaacctatggagctgaagaaaatatttacaaaccatgtatctgatagaagattaatatgcaaaatatgtaagaaactcaattgcaaaatgcacacacacactcgcgtacacacacacacacacacatataactcaatttaaaaatgggcaaagaacctgaatagacatttctccaaataagacatataaatggccaacaggtatatttaaaatatttgactaatcatcagggaaatgcaaattacaaccacaatgagatattacctcatacctgttagaatgactactataaaaaagatgaaaggctgggtgcagcggcttatgcctgtaatcccagcactttgggaggccgaggctggcggatcacgaggtcaggagattgagaccatcctggctaacgcagtgaaaccacgtctctattaaaaatacaaaaaaattagccacgcgtggcggagggtgcctgtagtcccagctactcaggaggctgaggcaggagaatggcgtgaacctgggaggcagagcttgcagcttgcagtgagtcaaaattgcaccactgtactccagactgggtgacagagcgagactctgtctcaaaaaaaaaaataaaaagatgaaagataacaagtgttggtaaggatgcaaagaaaagggaccactgcacactgttgctgggaatgcgaattggtagagccattatggaaaatggtatggagtttcctccatatgacacaatcccaccactgggtatgtagccaaaaaaaaaaaatgaaatcagtatgtcaaagaaatgctaaactcccatgttttttgcagcattattcacaatagccaaaatatgaaatgaacctaggtgtctgtcaatggacaaacggctttcaaaaaaaagtggtatatacacacaatgaaatactactgagtctttaaaaagaagggaatccttggctcagcactgtggctcacgcctgtaatgccagcactttgggaggccgaggcgggcggatcatctgaggtcaggagtttgagaccagcctgaccaacatggagaaaccccgtctctactaaaaatacaaaattttccaggcgtggtggcacatgcctgtaatcccagctactcaggaaggctgaggcgggagaatcacttgaactcgggaggtgcaggttgcggtgagccaagatcgcgccattgcactctagcctgtgcaacaagagtgaaactccgtctcaaaaaaaaaaaaaaacccaaaaaagaagaaggaaatcctgtcatttgcaacaacatggatgaacctgtaggactttatgttaaataaaataaaccaggcatagaaagaccaatatgtgatctcacttatatttggaatctaaaaacactgaactcatagaagcagaaagtagaaaggtagttactaaggactggaggtgaggtgtgggaattcggaagatgttggtcaaaggatacagagtctcagttaggaagagtaagttcaagagatctattgtaccacatggtcactacagtttataacaatgtattatatacagatgattcctgacataaaatgtttcaacttaggatttttgactatatcatggtgcaagagccatatttattcagtatagatttatgatggggttatgcttggataaacccattgtaaattggaaatatcgtaagttgaaaatgcactttcaactttcaacattttcagcttatgatgatgggtttatcaggatgtaacatcattgtaacttgaggggcatctgtacttgaaaattgcaaaaagagtagcttgtaaatgttctcatcacacaaaaaataataatgtgaggtcactgatatgttaattagcttaatttagccatttcacaaaagtatagatatatcaaaacattgtgttgtacaccataaatatatataatttttatttatcaattacagttaaattcatacatacatacatatacacatacccaccaaaaataaagaaaaaagaaaatgaaaaagaagaatctctaggaataggaatgagaagaaaaaactgaatttgtttaaaagctactcaggctcaataccattttctcatatggatataatctgtgtagaaaatttgggttgtcactaaaaatgggatataattccaatataatttaattagtagtgttatatatctggtttgtattttttttatgtcttcagattataccatacattcccagagggcagggatcctttcctatattaatcttccatcacctgaagtatctagcagagggcagagagacactcagcaaatacttgttgattcattggttgattcattagaccccaaggggacacaatgaaagtgctccctcccatgttcctctctgaattctatttatctcattacactggtgcattcaaatacacaagaaatagctaagtccctttgagactcctgagagtgtgctagcatagggattcagtcatgagtatatctcatgaagcccatggttttgttgggggtgggggagcagatattaaataaaaatcacacaaataaattcaggaagaaaagaatgtggtacaatgaaagggcatgataggaattggaaaactcctttaagagaacagacacttctcaaaagaagacatttatgcagccaacagacacatgaaaaaaaatgctcgttatcactggccatcagagaaatgcaaatcaaaaccacaacgagataccatctcacaccagttagaatggcaatcattaaaaagtcaggaaacaacaggtgctggagaggatgtggagaaataggaacacttttacactgttggtgggactgtaaactagttcaaccatggtggaagacagtgtggcgattcctcagggatctagaactagaaataccatttgacccagccatcccattactaggtatatacccaaa

SEQ ID NO: 552 - DNA, 31642 bp, Homo sapiens
atactgaaaactcagccatgggcttcagaacaagacccagctgtctcaggctcttggctctggcaagcaggatgtctcactgtcacaaacccagaattttcaccaaggagaaggtgaccaggggaacaggccggagagcggcctccagtgttgatgactgtttaagagccaaaatattccagtaattgtgtgacatggggatccctggcccaaataacgctgcaaccacaggaataggctcactgccaggaaaccaggaaaccgatatttggagcaatagacagactactcttgtacagtggaaaagtccttgcagaagggaggaagatggaaggggaaagcccaaaagcgttcctctcccttcctgcccctaaaatatagccctgagctggacatgagtgcagcctcaggagaacttgacgaagaaatgttccatacaggaaattgcctggcgaggccattttgagttagttataccagctctgggcttcactcaggagaagctgtccagtaaatgcctgagggcacccaaggcctctgggattcaggggaatgcacgctctcctttgtaccccttgattttgttggcccaaaagcaagcctgctagctcaaagagtgattcatttccccctgtgccttctgggaagttggattctgtttttcaacaaccaggcaagaaatgaagtaaggcccaggctgactcgccccctcttctgtccctacagaggtacatgggtgagtggattccagggtggaagacaaacctgaaagaaggccaaggtctagggttactatggcaacagcatggcagggcgtggtgatgttgaatgaccgcggccccgaagtgatgaaggagagagaaaggaagcaggtcttcctcaattcagccttgagagtgaagcctccttattctgattaatctcaaccctccactactcaaaaatagttgatggctccctattgcctacaaaataaggttcaaaggcctctatttatagtcaaggccctccctgatctggtcaccccctgcctgttctgcctcagttcctcctcttgctctcatgtacccagtggctgcagtcacagaaagtcttgttttcccaggtttcctatagcgtcctacctctaagaatctgcactctctcaagatctcacagataccactcacctccctaaggcagactgtcatcccaccatcaaacgtggttgacccgataagaatgtttgcccccacccccaccatccctattagataggacatttcaaaggtggggacctgttgaccctgctgaccctgcattccttcagctcacctggccccagtgccagctggatatgagagaggcccaactgatatttgttgcatgaatgaatgaataaatgaatgaatgaatagaaaaggttaagccagaagcaaggtcaccgagctatttgttctgcatcaccaccccttgacatggccctggaattgattgggcaaatatttagttcagctcctcagatttcaaaatgcccttttggagcattaaaaaaaaaaaaaattaaaaagacttcatgcaggagatcttgcctctttagagcagtgcctgagtccacttttcccgttgctgctcccctgtggggtctctcatttgtgtggcccttgttacaccgctagagaggtaggcctctcaacagcagcaatgagtgctcggaggaaccgtgcctgtttgtgagttcagaagttatcttccagcaggaaaacaaagtctttctgtactttgcaactaggggaaaaggcagaggaagccaatgtgagtggcagtgatgtagcctagtggaaggtgacaagtttgcacgactctagtaaattggtgtgtagagaaatgcagcgtgggtttattcggtttttcattctttcattcaacatctagttacagagtggggtttggccatgtttgagataggagaaaacaaactttttttcaagttctcaacactacagttcacctctggtcaccaaaatgtgtgtgggatttctccaaccaccaaattgtccagcagacactaactgggtgtcctgcagttcaattcaattcaattccaacactatctacctggagataatgttggatcccatcagttaagagctctgtcgcacaagactgcccctacttcagatgccagttgcaagtagtaggctgtcacctatactttatgaccaactggctataaagtgaggttcccacaactccctcctcaggttcagttcattagctaggagggctcacagaactcagggaaacacttacgcttactggtctattttattaataaaggatacagatgaacagccagataaaagagagtcagagggccaggtatagggtactgggcgcagagcttccatgtcctccctcagtgtaccaccctccagaagcctccgtctttcagctgccccaaagtgcccaaaccctgtcctttttggggtttttatggaggtttcattacacaggcatgattgattacatcattggccactggtgaccaactcaacctgcagcctctctcccatctcaggaggtcatgaggaggggggtgagctgaaagctccaaccctctaattccatggttggtttccctggtaaccagattctttatgagcctacccaggagcccaccaagacttgcctcgctagaaaaaagatgttcctgtcacccaagaaactgcaagggatccaggagctcttcatcagatgctcttgtcactctggaaattactaagctctcgggaatcaggtcaaagaccaaatattaaacaaacgattctcttagtacccctatctacaaggatcctagaggcactgtctcaggtactcgagccagagactaaatgtatatttcttattattaatatgtcacagtttcacaggctgctagccaggaagccagagggacctccccagtgtaaaatttggattcagacaaggctgcagtctcagcttcttcactaacaatgcactgtggggcaatcgctttacctgtttgggtcttaatttcctcacctgtacatggcagtgtcctctgggcacagagacctactgcagctgtggcagtggaaatgggaggatggacatgggatccgctgaagacacagacctgggagcccctggcttctgactccatggagtgggtgaagggcacaccagtctgcttcatccctgactgcctgggagtgggcccttatcgaagaagaggcagaactaatatgaacagctcctgtgctctgagcacctgcaatgagcaaggcacggtgccgagtgcttgccaggaggtatgaagaggccgcaagcatccaagtatagaacctggactttggagccaggatgcttaaatctgaatctgaaatccagcaattactgagtgtatttgtttgctagtgctgctctaaggaaggaccataaatgatgtggtttaaccaacagaaatacattgtctctcagttctggaggccaggaatctaagatcagtgaggaagaatctattccacacctctcccccagcttcggaaggttttctggcaatcttgaatgtcccttaaatgtaggagcatcacctcaatctctgcctttctcctcctgtggtgttctttctgcgtgactgctggtggccaaattcctcctttgtgaaagaacactagtaatatcggagtaggggcccactctactctgttatgacctcattttaactaattacgtctgcaaggaccctatttctaaataaggtcatatcctggggtgctccaggtatgggcttcaacacgtgaatttggagggttgggggcaattcaacccataacaccgggtgagggacttgggtggtctctctgtgcctcagttccctcacctatggaatggagatgacaatacctaactcataaacctatcgtgggtgtttgctgagttcctgtacgtaaagcacttaagctagtggttcagcattagtgccttacaaatgttaactgctgttatctcattcatcttttgtaacaactgtgtgctgtgcaacaagggtgacaactggtatgcctgccagagctgggcaggtcacacaaacagacgaagtgggctgccagtgatggggcccaggcaggtgagacagtaagagcccccatttaaaggcattctgctcaacattgttacataataatctatggcatgaaactcacctatggaggcgagagctccttgttgctcttgatgtcaatggaaaaaattgaccatgacctacctggtccttaggtggggttaacagctattctgaaagaagaatgctgatttgacaagaactgggcgtgaagccaaccatgtggtctagaaaggacacaattgcctttaagccaaggcctaagcctatcaagactgagttaatgaggctgccccatcaagccagcggaggtcagccctcaccagccctggctggctctctggctgcagagttgctgagcagggctggagaacagaccaaatggggccagccaagttcgcacatcctcagagccacccgctcaagtgtttagctctcctggggtgattgacttcagtgggagcgtggctctgccatgattcagacttctggcctccagaactgtgagagagtgaattcctattgtttcaagccacccagtttgtggtgattaattatggcagccaactaacattcctcttttcctccaatttcataagaacaggtgttgctcttcttgacactcagctgtgtgttctcttggcctcctgctccctgggggagtctccttccattaataaccacctttaacctccctttcagcttcttcccccaaacctgggaagtccctccttccaagccacagctccctctgccccacctccttcccagccttctcatcaagaagcaatctgccttgaccatctctttgacttctcagcctgctggccctgggctcctgctcccaccttcccacccagatcaccctggtggattccatggaccagtgaccatcctcatctacttgaatgttctgctgcatctgacactgacagtgatatcccttgtcctcccttgtttactgccctggtcctcctccttcccagccatcatcacctttgtgagctctctccctctctgctcaggcttatgccgagggtctcagcgttctatgcttcatcctcttctcttgtcctctccttgccccaggacacccctgatcccatgtgcttccttcattttatttcctgtctctgttcttgcctccaaatctctctttagacccattcacctgtgtcatctctgccagcaggcaccacaggcccttcaggctcactaggtccaaaactgaactcatcatcctccatacaggcttccaaaacctacccctcagctcacaccaggtccattctccttccttaatgtgtctcctcctctccagcctcacccccgcttccttggcccacaccaccatcatctctcgcttggattatcacagcagtgtcacttggtcctgtcttgatctccaggtgaccatacccgtgacagcccaagataatttatccctcctttacttacagaatgaagttcaaccctggttcccaacccagcaggacttccaagccctccatctggccctgatctggcttctctctgtcctcccttcctcctctctgatgggctcccggtgccccaccacccccttagcctgtactgctatcactcctgtggttctctcagcccaaaatgcagcctcccactgctgtgctgtaagctattctgtctgttcactcctctccacccagccagggctgataaaaacctagacaaggttcaaaaacccagatccaaggtcaccaccttcacaaagcttttcctattccattcctctctccaaccacgggagaatggaccattcctccctgtgtgtctttattgtggagacatgtgtcagagcatcgactctctatctttagttcatctattgagatattgatctctcttcttgaggccaggggtattttctgggacatggttagatctcaataaacattgatactggagggatgaaatgaaggaaggatggatagaaggctataaggatgggtggatggataaatggatggatggatggatggatggatggatggatggatagatggatggatggaaaaatggatagatggatgggtggatggatgaatggatggatggatggatggatggatggatgaatggatgaatatatgggtggatggatggaaggaaggaaggaaggaaggaaggaaggaaggaaggaaggaaggatggtagaagaaaggtagtaccagtatgctttagctcatgcaggcaaacagatgatgggcagagggaagcatggtggctgattacaggaggatcatagcagatgtttaaggcaagattgacagccccacaaagactgagaagagaagataagaaaaatgggaaagttattaagacacaagacctagatcaggagctagaagctggatcccagaacaaggcaagagcctaatgactcgagtagccaactcatcccagtttgccaaggtctttgccagttttagcactgaatatcccacaccatcggaaattactcagtcccagcaaattggaatggttggtcaccctactagtaattaagaccagtgccccacttcagagcagaagcatcagccaggccctgagtgacatcttgtaggctcttgaactggtctcactcaatccccatgaggcccaataccatggaacagagggcagggaggctgagggccaagcagaggagcacctgtgctcagcagggcaaggcatcacaggggccaacattggtttccctgcccttctcccagaaaccacctccccactttgatcctttcccatgccctgctaggctctaggacaccaaattctcatattctagccactggccctccctaggcagtcaccctgggtgttatggactgaattgcttctcccgcaaattcttatgttgaagttttagccctcagtgtgactgtagagattgggcttttagggaggtaattaaagttaaataaggttataagggtggcactctaatctgataagattggtgcccttttaagaagaggaagagtaatcagagagctcgctctcttcctctgcccaatccctctcttggggggtgtgtgtgtgtgtatgtgtgtgtgtgtgtgtgtgtgtccagtgtgggctcacagggaagaggtcatgggcgaacagagtgaaggcaaccatctataagtgccagagagccctcaccagagaccaaccctgacggcaccttgaccttggatttccagcgtccagaactgtaagaaaatacatttctattgtttaagacatccagtgtgtgtttaagccaggccagtgtgaggtattttgttacagcagccagagaagactgatacactggggtgccatgcccccgagactccttccaaatctctcctttcaaaacgcaccaccctcagtcctgattccttcagagctctttctgcatggcagtgggagtcatgagttacctcagactttcccccaaattctcaagacattccttaagatgtaagcttgggaaacggcatgtgatgtctttccctcgtgggtggtcagagcacagacagcacacacaggctggagacggcccacaggaaaggtgggctaaccacctttcccaaagtagtttcatctggaacccatttgggcggtgttacactagtttctgatggctgctctaagaagttatcacaaacagtggctcagacaacacaaaattcttctttcatggttgaagaggccagaggcctcactgggctagaatgaggatattggcagggctccactctttctggaggctctaggggaggatccattcctttccctctccagcttctagaagcttcctcactccttggcacctggctccgacatcacattgacttttcccttcctgcttctaccatcacatcaccttcttctgactccaatctcctgcctctttcttgcaaggatccttgtgattgtaattaggacccagctggataatccatgacaatctcttcaagatccttaacttaatcacatctgcaaagtcccttttgtcatagaacgataacattcacaggttctgggtattaggacacggataacttcggggttccattactcacccataactggtatgcagtgctgatttccatcctgtaggtacggtttagggatctctaggtcaatgagataatggactcttgctcatgttacatggcataatgggaagaaagccaaacctagaaaaagagggactcaggttcccttgttagagcctcttcttactaactgtgggattaggggctgattccctgacctgctgtgttctgtcttctctccaattcaatgggaatgaactgtgagggcactgagcaaaaactaaggtctcaatacctagtagtagtgggacttgcctctggatacccagtagtgatcctgccgcctgtttctggatatcctacagtagcaatcccacctgtttctggatatcctacagtagtgatcctgcctgtttctggatatcctacagtagcaatcccgcctgtttctggatatcctacagtagtgatcctgcctgcttctggatacccagaagtgatcatgcctggttctagatacccagtagtgattgtgtttcctctagatacccagtaggtattgtgcttgcttctagagatgtagtagtagctggacttagctctagatacccagtgctcatctctagactgggctgagatcagtgtctcccttgaagggttattgtaaggatgaaaaaagataatgcgtttaaagcacttggtgtagtaggtggtctttttaaaagtgtgaataaatactagttcttattatttctgtggatatccaacagccacataattgggccccaaagccatgaagaaggaagaggaaatgtcttaaaggttgtcgatggacagtgtttgctgaacatcaaaatcactttccaggtattacctctgatttgctctaccaactccacaccccacctgcagccacataaccttccatgatcacggccatgcacaacacaccatgtcccccaggcaaggggaccttagaaacataaccaggcttgagacagcactctgcaccggtgtcttggaaatgctcttaagagtgtatggctgagttagggaaccaggatttcaaagtagaaagggagaatctacccaagcccatagaaatcctgaatccactcctttctcagcaacaagcactggcctgggagtcagccacttatgcaccaaccccactctgcccctaattaaatgcatgactttgaaaattcccctcattcttctgagccccaattcagtgattggtgcaatcacaggcttggctacagtgacccattcattgcaggcatggtgagtctctcaatccctctcatttccactagaatctaactgttgggatctatgacccagtcagcatagcaggcctgtggggagctctcaggttcaagcatatgccccccctaatctacaagaaattagctgcagaaaaccaaggaatagaacctggaaaaagagagggtttgctagagctgtccctttccctgtctctggaatgccaacaatagggaggctctttggtcttgtctctcaggagtgcccatgccattccaggaaaatgatggcccagctggtggtgtaaggcttggggggcagcgagtgggcatcgtggtgaaagcctcgggatcagggagctgcgtctgcaggcaggcctgctggccggaaacctgccaggaaaggaaggggctgtcccggggcggggccagggaggggtggagacagggccggctgtggtcagtgacaaatgctggctgcaatccagccagccctctgccctttctgagcccgagggactgccacctccactgtgtgcacactcagctacgggacacagtaagtaccgatgccgcaaagggaggtccccagggcttgagggcatgtgaggcgaggagaggatggactctagagttttggggtttggggtctgcaaagctctgaaggagtctcatctctgcagtttcaggtatccaaggcagcagaggtgagtgggtcccccgagctctgtgaccttatgctccacactaactctggcagagcctccgtttcctcataggtaagatggaaataattacaccctctggatggtgtgactgaagattaaatacagcgggtgctctcactcagcacatctggccatgtctgcagacacatttggttgccacaactggaaggggggtgggggttagtgacatctagaggccagcgatgctgctgatgatcccacaatgcccaggacaagatcacaaagcatcatcctgttcaaaaggtcaacaggatcaaggttgagagaccctgaaataaggccatggggacaaaatgtcggctggataggaggtgctcagtaagtggcagcttctgttgttttctgtgcctggagtcttgggcctttagaaatcaggaacaatgatccaatattatcggcttccgtgagataagggcatcttgcctggaggctgccacccaggccggtcatggcagctgctcatgaaggacagtaacaatttggcagtttgttaaatgaacaaaatgtagaaataaagtaagcagaatttttagtttttctgaaggtagggcttttggccagatatgcagcaataaaagagcaaactgcttccttgggccagtgtccttgctcatagatcaggaaaccgaagcatgaagaatacaggcggcagatgcctgaaggtaacggacgtgttcatggtgctgacggtgatgataagtgacagatgtagactcatctccaaacttgtcaggttatagacattaaatatgtgcaactttatgaatagcagtcatgtctcaatcaagtggttttaataaagaaataataggaagccagagctgagagacagggagggagttgttcaaggtcacctggcaagtgagctccggggcggggagagctcagctctgggtggccagcctggctttttccactgctcagtgtccagcttgcagtctaatgtctctgaattacagagaaggagactggtcagttcattcattcattcattctacaaaggtttatggagcatctctcctgactgcaagctcttgaaggtgagagcagcacaaatgagggtcccatggagagagaggccggaatgaaaaatgtcaatgacaaatgcatatataaaggcacatgtgtaattgaaagagctttgagagaaagagtcaagggactgttccagagaatagccatggaaggggaaaaggtccagtgtgataaggtattgcaaagaagtgacatttaagcaaaagcctgcagcctatgcagaagttggcctcagtgagaaaggttgggggagggttccagtagagagggaaggtatgcaaaggcccagagttaggacagaacttgctgtgtttgagaaactgggaaaagaagagtgagcctgggggtatcacgtgatccagggcagagcaggtccaggccaggtgcagccaggtcacagcagccctagtgggttagagcacaaatcaaagtttagcatttatctgaaacacaggagttggccatgagtttcttaggcgaggaagcgctgtgaccatatttatgattgaaggagattcttttatatgctgtatatagaaagcctttcagggcaaagaaaggaagctactggggtagccctgggggagatgaagggagcttccactgggggcagtaagaaagccagggaaaggcggcagctttaagacctgttttggagatagaacggacaagctttgctgatgggctggagtggaacaggaagtcaagattacttcttctgggaagttctgttcctgggtctttaggatctagaggaagctgtgactttgtctctcatctctgcctgggctccaagcctcacatccctttttgtaattagaagatattggacagaccgtcctcactaacacaattcccacagctgagtccagggtagaactgggcaggacttcactgcccaacacgggaaatatcagtcagcagatttgggtttcggggatggtggtgggccagcgggaagactgaccagggcctacccatcacatccccaccacctcccacctcaattcaccttggcctgagatgacaggtgaacatgactgatcctctctcttccctctgcagaaacactaaagccagggaccaggagaggggcagcccaaccaagctttcaaagcactcagtagaggctggtctgggggatgggaggctcccagggcttcacctgtctctgtcaaagccatgtatttccaccagaggcccaagagtgcgatggcaaaccctggatttgaaactaagaaacgtaaaacaagcactgaggactccactgcctcttgagtgacctctctgaccctctgtttcttctgcactgttaggataatgatactaactccatgttgttgtagagaagtataaatgagctaatacaggtgaaccgcctggggataccaggaggtgaggtcgaggaggaacgaggtatcactcctcagagccactcagagacaggctgtgcacgagtcagaggaacctggattttaattccggttccatcactcagtagctgaaacaagctattccacttcacttagcctcagtctattcaatctgtaaaatagagtgagtttacttttggaaaactctgtaaaatagagagcttacttttggtgaaggttaaacatagtaatatttatggagtgtctagtatgtctttaataattagtggttttactgaaaagtagagagagttggcccagagggagcaagatttctgggtctcaaacatgtagcccaggagagcctaagtgaacctggggccctctccaaacagatcctgggggagactcagtgcacacccggagaagcagctcctccccatcggatctctagtgcttggcagggggcggggtcttgagggggtgtccacaacacatggcagactgcagatgaagaaactgaggcccagagggggtgaggcttgcccagggtgacctagtagctgaatagatgggagaatggaggccagggcctcactgagactctctggtcagctgcccctgggctgtatccaataaggaaactcccctgcttctgaagctgttctcgaaattatcagctcagtgtgaccctgtggggggttgagccacattgtttctttagaagcatctccatacatggctggttccaacccttggcaggagggaccatattgtgctgtaaaatagactcatttagagaagccggagattaaagcacccacctatgtccttcaaagctctccaggcaagtgccatggtgggaacaggtagggagtgtcagtggggggaagcccagactctgctcactcattatctgcagattagggctattgttggtggctactaagtcagggatttcaaaatcaggaagatgcagccaggaaaagaggaggcaggactctgcagaggaggcaggactctgcagagtcagagtgataaccgagtctgagtccaagctttgccagtgttagcaagcgactccatctctctgaacctcggattacccatctgtaaaatagagctagcagcaagatgtacctttttgggtggtgcagggctgaaggagttggcacagtgcctgaaagagggtgcgggcaatgcgcccaactgctgtggctgctgggtttggtgccaggttcgattctgcaggcagaaacttctacatgaggctccttctcggaaggagctcaggacacaatttggaggctgggctggcaagggtgacctgctggagctattcaacttcacttaaagacaggcctgcagtccaagcctgcccaattcctgagaccattctctctccactgctgagccccacggccactctgcaagggatttcccacccacctgtttggggccctttggagtttggttttaattgggtcacgggatgctgtgacaggctgcccctgcctggtggggatctggggtcactgatgacattgtgcccatggagagagcccagcagaaagggattccctccaaggcgacacacagggcaaagctcacatcagaagccaggcaggccctctgcacctggtaattagccagcctgggtgctgtcaggctcacacgtgtgtgtgtgtgtgtgtgtgtgtgtgtgtgtgtgtgtgtaaagcatgtaccctatggtacagttgagaatatggaggcctcagatggggcttttgccagaaactgccatgcctactgctcacacttccatagcacgtgcccccaagcaccccatggtgtaggtgctgttattatcactatcttacagttatggagcagtggctcaaggtgtaactgacttgcccaaaatcacactacaaggacacagcagggctgagatttgaacccaggcagtggcttcagagcctgagctgtttcctactgcagagggaggaggcaagacttctacccgtagccagatggggaggcatgggcacaggaacggctcttgggtgaagtggagggaggaagaggaggactgaaggccaaggccacgtcaggagtgatgggagaccccacaaaggcctccctgagaagagctagagacaaagatgagtgcctcctcatctggaagatgaaaagatgtctttgcctgcatgggctgctgtcacaaagtcccaggggctagggggcttcaacaacagaaatttctttctttacaactctggaagctggaagtctgagattaaggcaccagcaggatttgttccttccaaggcccctctccttggctcacaggtggctgccttctccctgtcttcacctggtcttccctctgtgcatgtctctatcctgatctcctctttttaatttttgtgtaaggacgtagtcatattgggttggggcccactctagtgacctcattctaactcagtcccctctttaaaagccctatctccagatatagtcacattctggggtattgaaggtaaggacttcagcatatgcattttgggggcacaattcagccagaacaggaggacggtggggatgtccacatgaagaggttcaggcagaattcctttaggaggggaagatgtctctctgtgggacaagggtggcatggagcagcccctgggggaaggagaaggggacagtttgcatactggtattctgcctaccccagggtggacactcactcagcgtttgctgaatgaacagggcaaggccagcagtgctgatggtcccaggcatgtagctggtctgagttcatagaaggaccacagcgccctgccatgtgccaaaccaggacaccagagtgaaggccagaagctcacatggaagcagcttagttccctggtaacctcgagatgctgatgagacagagcagagcagagggaaccctctccctccatatcccatcctccaaaatgtgtcccttgatgtggatgggtagacaggattcctgccctggcagccagacccctgccttgggtctgcacctcctctccctccttcctctccccgtcatccctaaatcttgtcctcgagccactgccaccctgtgtaaaccctcatgcccagtcttgcgggtgccatcccttctctttgaagctgaatggaccaaacatacccattgagtgttgggtggggacatctctggaaagtcagcacctggaccagctccacccctctctgaggacaccttctttccctttcagaacaaagaacagccaccatgcagctcttcctcctcttgtgcctggtgcttctcagccctcagggggcctcccttcaccgccaccacccccgggagatgaagaagagagtcgaggacctccatgtaggtgccacggtggcccccagcagcagaagggactttacctttgacctctacagggccttggcttccgctgcccccagccagagcatcttcttctcccctgtgagcatctccatgagcctggccatgctctccctgggggctgggtccagcacaaagatgcagatcctggagggcctgggcctcaacctccagaaaagctcagagaaggagctgcacagaggctttcagcagctccttcaggaactcaaccagcccagagatggcttccagctgagcctcggcaatgcccttttcaccgacctggtggtagacctgcaggacaccttcgtaagtgccatgaagacgctgtacctggcagacactttccctaccaactttagggactctgcaggggccatgaagcagatcaatgattatgtggcaaagcaaacgaagggcaagattgtggacttgcttaagaacctcgatagcaatgcggtcgtgatcatggtgaattacatcttctttaaaggtaaggcccttgggcccaaacctgcactttctttggcttttctgctgcttttatctaaagaatacccaattccctcacatacataaaagacggggagtacgttaagttcttttgggtgcctgttgagaaaaattaagtaaacaagcagccagagaaggtaagatgaatgccttcttgctgtggatgggattagtgaggctgagatgctgtttcctccacggaggaagagctggttgctgtcttcgggcccctggggacatctgaagccccagctttctacaggctctgaagtatgaacccattgtggccaccatggcaaagacaccaacaccttagccactcagggcaggacacagaccccagaagggcttaaagggcatttcccagtcccccgtatccctcagatcttggcccctctgccctcatagaggccaagactccctcagacaaatgcttgttcctctgaaatgcctcctcctgactcctcagcaagagctgacctctgcttatctccccgacactccttgtaagcattcctgctcgcctctgcagctcctgccagttgctgaccctggggaaagcaagagtggatagagaggagaagagaggagaggagagggtgggaagggttgcgaaggaaggtaaattgttaacacctccccttcctatggtcacagatcatgagtatctttggccatttgggtggctataacaaaataccataaactgggtggcttagcaacaacaaacatatatttctcatagttctggaggctgagaagtccaggatcaaggcactggcagatgcagtgcccattccttggttcatagagagtgccttcttagtatatccttgctggaaggaggaaggcagctctctgtggtctcttttgtaaggacaccgatcctgttcatgacagctccacccccatgacctaatcaactcccaaaggccccctgtcctaataccaccaccttgggggttaggtttcaacatatgaacaatgtggggacacaaacattgagaccacagcagtgagtgtcgaacttggactctgagatttcctatcccctggtgcagggcagtccccattacaccagattgctgagggcagctgggaaataagctaaggacggtattgactggggtcttccttcgataacgattaagaagttggaaacaggccaggcatggtggctcacgcctataatcccaacattttaggaggccgagatgggcagatcacctgaggtcaggagttcgagatcagcctggccaacatagtgaaaccccgtctctactaaaaaatacagaaattagccaggcatggtggtgggcgcctgtaattccagctacttgggaggctgaggcaggagaatcacttgaacctgggaggtgggggctgtagtgagccaaaattgcgccactgcactccagcatgggtcacagagcgagactccatctcaaaaagaagaaaaaaagaaaaaaaagaaaaaaagaaataaaataaaataaaaagaagttggaaacaatcacttgtagcgttttgttcagaagttcccataggaaggtcagagaagggtcattgaagacttcccaatgggaaaaaccattcatttccaggatccatactaacttctttctaaaatttaaatcaaaatattggaatgaaagtgcaaacagagaagttcacccagatatcaggtagcattcacagccagccacatttttcaccctcttcacttggagatttggtcttgagtaaaacgttagagaatcagagaacatcaggggtccagggcctctgaagatgtgaaaaccaacctccttgttttgcaaatgtggaaggaaaagtcccacgaaaagtccaagaatgtgcccaatgttataaagagacttgccttcatattcaagaggttcaacagtcactgctctggggctgccataaagatggtctccgctggctatctttactgtcttcactccttttatttgcagctgagaatttctaattctgacacaaaattctttttcatttttcccttttttcatctttagctaagtgggagacaagcttcaaccacaaaggcacccaagagcaagacttctacgtgacctcggagactgtggtgcgggtacccatgatgagccgcgaggatcagtatcactacctcctggaccggaacctctcctgcagggtggtgggggtcccctaccaaggcaatgccacggctttgttcattctccccagtgagggaaagatgcagcaggtggagaatggactgagtgagaaaacgctgaggaagtggcttaagatgttcaaaaagaggtactttcagactaccccagggccagcctaaacccacacagccccagggagacacacacgccctaccagggccacacagcactggtgggaaggactcacccagccaaggagctgcctccaggcccagaggcatcctgtgacatccaagtcctgggggcctagcccagttggagggacaagagctggaaactgggttccttagggtggtgccagagtgggcagagacctctgggcagcccacgtccaagtccagagcaaggggaggctcatcctagaaaagaggccagaggagccataaccaccattgttccttgggttaaggagtccttttttaaaaccatcaaaactaagaatccagtgcattatgaatccaaggggtgaggctcagtgtgccaatgccccagaacagtctaagaaagctccttttccctttccaggcagctcgagctttaccttcccaaattctccattgagggctcctatcagctggagaaagtcctccccagtctggggatcagtaacgtcttcacctcccatgctgatctgtccggcatcagcaaccactcaaatatccaggtgtctgaggtgggttcagaagctcctatgcatctgcttcccaaggtctattctgttctattctttctattctactctaccccatttcattccattccattccactcaactccactccactccactccactccagttcactctattcaattccactccactccactccagttcactttattcaattccactccactccactccagttcactctattcagttccactccactccactccactccagttcactctattccattccactccattccactcctccactcctctcatccactccactctactcctccactccacatctccactccactcctccactccactcctccactccactcatccactccactcctccactccactcctccactccactcctccactccactccactcatccactccactcttccattccactccattccactcctccactccactcttccactccactccattccactcctccactccactccactctattctattctattccattccattctactctattctattccattccattgcagtcaactccactccactctctactattctattccactcctctcccctccactccattccattgcagtccactccactgcactccactcctttattctgttctgttctattctattctattctattctattctattctattctattctattctattctattctattctctccctctccctctcttttcccacaagtagtgaaagtttcactttgtgtcttatccttcatgtaatgggaagccatatccaccactgttccttgagttaaggagtcctgttttaaacaatcaaaactaagaaggcacttcctagctatgtgatctccaaaaaatacttgactctctgagcttcctttctctcttctataaaattgaagaattacaccttgctcaaagatgccatgagaattcaatgacagacacatgcgaagtcaccccccagcacagtgcctggggcagagtagctgctccattgttccatttcctacttgctccatggctcagttgaacagatacttagaggttgatgcccataggcagaagctttgccatttgctatgatgacttcacctgcccctagtggcctggtgatgcctggtgtctcccctgcagatggtgcacaaagctgtggtggaggtggacgagtcgggaaccagagcagcggcagccacggggacaatattcactttcaggtcggcccgcctgaactctcagaggctagtgttcaacaggccctttctgatgttcattgtggataacaacatcctcttccttggcaaagtgaaccgcccctgaggtggggcttctcctgaaatctacaggcctcagggtgggagatgaagggggctaagctatggcccatctgtatgctggtagctagtgatttacacaggtttagttgactaatgaggcattacaaataatattactctatgatgattgcttccacccacacgactgcaacatacaggtgccttggggaaatgtggagaacattcaatcttgccgtcactattcatcaatgaagattaacactgagatccagagaggctggatgacttgctcaagttcaccagcatggtagtggcaaagagaggtccagagtcctggcccttgatgcccagctcagtgccacaaagctcaataggagggatgttccagtggatgagggccaccaggaagcacaggtccaaggctggtcccacacttatcagcagcaacaactgtcagttcatcctgcatgggaaaaatgttggaatgggagtctgaaatggggctactgtttcagtcctaatgtgctgtgtgacattgggacaacactttccctctctggacctcagtttccctctgtatacaaggatcagattcttgctgtgacccaagaactcctgaaatcatatagaaaggctggggtgggccctgtcattcgtggttgatttcaatacactcaagtgccattcatcctttaagaaaaacatctggatatcaaggtggaaatggcccatttaatgattgattatatcattttgtggatatagttataatctgatgggcctggctgggagtggaagaagggaagccttttgcaaatagtagagtatcagttgcaggtgccaatgactaactttttgaattctatgttggcattaacaataaagcattttgcaaacactggttataactgtctttatggaggcagctctgggaatggtgacattgatagcttaccatgctccaggccgggtgcctggcccttcacctggatggtcgcatttgcccctcataagactcccatgaagaaaggcaccactgttatcccatctgttattcacagatgggaaaggcaaggcttgaagtggttaggtggcttacccagtcacatatcttctaagtggtgcagccagaatttggcggggggagtgcgaccaagaaccctacactcagtcctgtgctctgtgctgtggaggagagatgaccaggagcagaaacttcattcagggacatctcaggcaccagctcccccatgagccagctaagttccctccctcccttcaccaagcaccatgtgtttcctcatgtgccgaatgaagaggattagatactcaagaatggaatgagtgggtgagtgagtccttcgctgcacccaagtctgattttctgtgcgcctgctcaccccaccctgcatgttctaagcatgcttccataaggctgtgccccaccctctgattctagagtctggactgtatcagaggtgagtgcctactagaggtaacaaggtcaggaccccaaaccttgtccatcccccaaagtactgagcccccaccatgcaccagcccatgccagatgctttgcacttgtgatatcacccatcccttgacaacccagcaagttctattattgttcccattttacaggcaataacataagtgctttcccagggtcccacgctggtgacagtgagggcccagggtctgagagcccagatcgcacatgtgcgggctggtggcaggggagatggcagcaaccagactcagacatttctctgcagttgtgctgtgggctcagggtggctctttatgaaggggccccttcatggggtcatgcactcctgtgtgttttcccttgcatcatgccttgcctgtcttggcaaatatttctctggagtttacccagccagtccaaggtcacagggaagccctgtctgtgtctcacacagaaggtcaacgtccagcactgtccaaactttactcagcaaacagtcacaaagcagctcctgtgtggggggtcaggggtgggctcactgtggtctctgctgcatgtcacacattgaagcactgtgctgggggtcatcacaggctgtttaactcaattgtcacatgagcctgggtgcacaaaatggtagagcagctcagagagagatggacagacagcatgaacctctgaggagtcaggttttcttggatgaagggacactaagatggctttggagcgtgagaaggacttcacctagcaaatgtgggaaaggagtgagacctccaggcagagggactggctggagacgagcgtgatgtggtgagccatggagtgtatgggtccccacagaacttcagtctgggcctgcacagggcatgtggaggagacaaggaggagggaggtggccgtgccggcggttcagtgacagagatcctaaatgggaggccaatcctaaatgggatgatctctttcatcccaatttcagggtagtttggtcatccacgccacattccaagtgtcccctgggccctttctctccctcacccccctgtctgcacatgagtagatgcctccatgcagccctcccaggacgctcacctctatccacagatgcttctccaaaacccaccaggccctcccatggaacgagctcacctacagggtaaaatcaggtcacggtcacatatagcctgactactcccctcaggaccctcattcacagccactgtattaatttgctggggctgccaaaacaaagtgtcctcatctgggaggctgcagtagatttgctgaaattgatttgctagcgttgctgaaattgattcaagcttgattctggagcttgaatcgaagatcaaggcaagtgcagggctggtttccctgaggcctctccccttggtttgcaggtggctctcctctccctatgtcttcacatggtcctcctctgcatgtgcctgagttctaacttcctctcctctcctcatctccaccagtcttatagaattagggccccccaatgacctcattctaacttaataacctctttaaagtctctatctccaaatacagtcacattttgaaatattgagggttaggacttcagtgtatgaattttgggaggatgcaactcagccaggctcactcttatcattacagctgcactagtgccatgcctggttcccagtggacaccccaggaacagccatccatccagagtgatattctgtgacatcccctacactccacagctcatcacatcacactcgtctccagtcggtctgtctgcctggaagtcccacacctgttcccacatccactgtctgggaggtccttttcatgcttcaaagccagctcagtgtcctcctttgtacaaaaaaatgtcctgacctctcagaacttcattctttctctctttctgtcgatctttgtctgaactcctctatcattttgtgcacccaggaacgtgtgacaattgagttgaacaggctgcaaaaacgaaaaagaagaaagaaatgctgagttaaacaggctgcaatgacccccagcacggtgcttcaatgcatgaaacgcatcaatgacttgcagcagaggccacactcagcccccctctgccctttgagtttttgcagctcttgccaagatcattcttgttcttagaaagcccaccattattttcctttctagccatatggattctaaaagttcctcttgtgagctgtaatcagaatgcagagaagtaatacaaggttagggcccaggactctttctcccacctctccctgcagagactcagatttttttaaaaaatgaccttggtcttcgggggaagaacttcccaccacagtgaacagccatgcccagcctacacttgactgtgcggcttacttagctcatccatccaaaggctattcctgggttgcctagtggaaatccaggcatggagctagtgcaagcacaatgataagagtgagcctggcagacactgaccccagcaataatcaggtaaacaaataaacagaactacaaactatgatgacaagaattcatccatccacagatattcactgaatggccactgtgtgcctggcactgttccaagtgctgaagaaaaatgaagaaaacaaaaatccctgcccttatagaggagacattataatgtgacaagataacataatgaaaaagaatgaagaataaaatagaaaagtaaaatggattgcatgtcacttgatgacaagtactgtggaatgaggccgtcatctaaatggagcacagaaagtggaacatggcgacatctcagccaaaagacccggcagacaccatcttggccaagggatcgaggttggcatcgccagctgtgagcagtgctgacatcttattatcttcgatatggcgtcatgagcaggctgcctcctcttggtgggatcttcccccaaacccagaacctcagtctaatcacaagaaaatgacagccaatcccaagttcagggacatttggcaaaatagcccaccactcctacttaaaagtgtcgaggtcttgaaaggcaaggaaaccctgggaaatcgtctttggccggaggaaactcagcagacatgacgactaaatgcaatgtagaatcctcggacagaaaaggacattagtaggacagctggtgaaacccaagtaagtccaggctgtaccaatgtccacttcccagttctgaggaacatgctgtggtctgtccacatttacattaggagaagcagggagagcgtatatgggacctctctgtattgtttttataacttttctgtaaatccaaaactgtcttaaaatagtttttttaaattatactttaagttctggggtacaggtgcagaatatgcaggtttgttacataggtatacatgtaccatggtggtttgctgcaccccctttttttaagaaaatgtttcaaaaagaaaaacagccaagtaggggagggcacacgagtggggttgggaattgcaaaggcagaagcaggagaccagttaaggaagaaaacggggcactaagagagacaatcaggaggacctgctgcagccagggccctgaggggctccctgaggtggtgccattgaagcggagttctgagggacaatcaggtgtagacactgtgagtctcagaagtgggaaaaggggagtgctgtgcacaaaattgagagacggtgcctgtggcagcagctgaggagggaaagagaaggtggggtgggaggcccatcccttccttggccacaaggacactgagtagggtgctgagatgggagtaacagtaataataacaggcagcacttggaggctgcgtcccgtgtgtctggcactcgcctaagccctttgtgcacattggctgagttaatgcagaggtgaactgagaggcacctggggtaggggctgggggacaggaagcaggtgacatctccagtcctctccagcgtccttagagcaggtctacagtactgatccttctctgccacccttctccaagaccaccttggtgggagtaaggggctctaaggtgacaacacacacaggagccacagacacaagacacaagacacttttgactcccaggagaacctagtatgggcatccacacacccttcctgatggtgactttttatgtagacatgcagagtgcagttaaccagctgttcctgcacacatctggattgctactcacacatctgtgcacacacacacacagcctcctggagcactgtggcttctgggtggctaacacagctaccacctctggttgtgctgagctgagcacccattgcctgctggggtggggagagggcaggcactttccctgcgcgaccccgtttaaccctctctgccccactgatgtggtccctgttgtccccgatgcacagaggaagaacctgtgtcaggacccccagagcggtgtctccactaagcagaagtctctgtttctctcctggcctctcccagaggggctgctctgaagcatgtggatttgatcaggataatcaaggtaaatgatccttatcttgatccatcacaaatgttaaggtacaaggctgtggagatggagagtgggtggagtctctgctgcccggtatcctaagctgggtgatcgcaagcagacacacacatgaccacctcttgggccatgcagggggaatgaatgtaatgaggccgatgttacagggttattgaaggctcaggggagaccaggccaaaaaaaaaaaaaaaaaaaaagctatgacctgagacctccctatagcagtgtttctcaaactctgattaacgttacttgaggagcttgttaaaaatacatactcctggccctgatcagataaatcagaatatttgacacagagtctttaagctccccctcgggattcaaatgcacacagatttttggtgctttgccgcctacagtacaagagagggcaggactgtcctgttcagtgcactgtgacccggacgctcaggcccacggaactcccctactccccctgctccctgcggtgccacccacctagctttcgtgcctgagggtggtcctcagactcctcctagaacaggcccagaggctcttagctatgtaagtattcattcctccaatcactgcagagcactcaccaggtaacaagcacgcacacccaggcgagttccccatgctcgtccccacgttgatatctcagactctacaagtcttcagctgctgcctaggactctgtaagtccttgagcttgggacccctaccacacacaagcgctgggcgtgccccacaggcggggaagtgctggccatatacacccagtgaagtgggaattccagataatgagtaactttttagcaaagtacccatgccctttgaattgtgaggtgtttttgtttgctaaatctgacaattctacctgtagggaacagggatgattgagaagcagctgctccgatggccagaagccaacagccttccctgcagagatgcgggaagtcccagggacagcaggaaagtccaggcactgcactggcagtgggattggggcttgggtcagaagagggtcagggccacaaggaaggaccctgggaggcttcctgctacataatatgagggccgggagcataacaaaggattgccttatccatgattgcatcatcaaactgaagcctgagacagaacattctgtgaggtggccttgttcactgcagaggagctgactcacacagttttgtctgggaagttgcaacctgtgccaggagtagccagcctgggagtaacaaagaggcttttctactgcaggttttcctagagctcctctccctccctcccctggccaaaggtgagctctgcagggagggtccggctctaggggactttgctcctgggcatcctagctgcagagattggtggggcttgtccagaaaggggggtcttctggacctggggatgatgcagttgggcctcagggtactgggaggccagtaggggtgcttcaaactggccagtaacctgaaggactcatattcttaaggatatcctggtggccacgtagaaaacagtcaggtggggtgagggtggaagtaaggaccagctcagaggtcactgagggtgcagccagacaggctgggacccacgtgggcagcagaggtggagagtagggatgtggagggggagacccagccccacgctgggggccctgaggggaggtggaggctgagccaggagaagaggcaccacccactcacttcctgcttgctgaatgactgtgaggagcaggagaaggagcaaaagagcaagtgaggaagtcaagggggttatttgggggcaatgctccatgtgagggtagctaaggacaggtgccaaggaggcccctgtgtcaaaatcccaggtcaaaatgttagttaccagagacctctgataaagacagagccacaggtaaaacgcagcggcacaacccctcgaccctaaaatcagaagcctatctgtgtcctggcaaggagagaagcacgagtgatcatccacaccgccaggacgcaagcccgttatttctgatgcaaaacccaggctccctccagggctggcacagaggactgccagaggagtcagggggcctccaccttccccagctgcgcaacctcagagggtgtctccttatctctggggtcactgtgtcttcatggccaggctgggcacaggtcagctgggagtggagctgtgtttgcagggaaggaacgagggtggacgtcgaagccaacctgcctggttcagaatcctggctcagcttggcacttaccagcagtggtggtgaggccttgggaatgagctccgcctccctgtacttccgtttcctcatatctaaaattgagggagtaatgggacccgcctcagtgggtgttcatgtggattccatgtgctcttaagcataaagaacagagcagctatgatgaccatcatctatgtcactgggcctccggaagtgagggaaggagaggcagatttgcttaagtagaaggaaggcggaggaaggtagtaaggcgtcagccatgtggcacagattgtattatgagatttactggttttcttacttcgtcctcaaatttccctccttacccacttcccatgattcctgagagtcaagaggacgggagctgtggaatgtgttagtcatctactgctgcagagtaaatagcccatgattatctcacggagttcctgagggtcaggaatccaggattgctgttggccagggcaatcccagaaggctcacttgtggggctgttggtagaaggtctcagttcctccctatgtgggctactcacagggctgctcaaatgtgacttagagagagagagagagagagagagagagagagagagagagaggcttgtttgtttagtgtccaggaccgagagaggatatagagagaaagcacaaaagagagagagaaaaaaagagaaaggcagagagagagatagagacagagacacagacagttgttgaatgtccaggaccaagagagagacaaaagacagaaagcacaaaatagaggggaaaagagaaagacagagagagtaagggacagagagagggggacacagagagagaacccatggcagaagcagcagtctttttttttttttttttttttttgagacagagtctcactctgtcgcccaggctggagtgcagtggcgtgatctcggctcactgcaagctctgcctcccaggttcacaccattctcctgcctcagcctcccaagtagctgggactacaggcgcccgccaacacgcccagctaattttttgtatttttagtagagacggggtttcactgtgttagccaggatggtctcgatctcctgacctcgtgatctgcccgcctcggcctcccaaagtgctgagattacaggtctgagccaccacgcctggccagaagcatcagtctttttataacccaatctcggaaatgacaccccaccccttctgccttagaaagaagtcactaagtccagtccaatgtgagagaaagtaattaagctctatctcttcaaggaagtggtatcagacatttgtggacacatttgtaaaatgaccagagcgttagaacctcagaatccagcagactaattgccctcatagtagattattaatgttttaaaaaatggatggactagctgaaggaataaatgaacgagtgagtgagcaggatatttctgtctcatttcacatgcagaaaaggcactgaggctcagaggaattaggacatgtgtgaggttctctaggcagtaaggggtgggggctggcctggtttgccagaactcggagatgcagcatgcagcgtgcagcagttctgaaatggaagccagggatggcaagctacagcagccactccctcccggagggagaacggacccaacaccaaggaggaagggatgactcagcagccctcaaaacagagtcaggagttctccctgcttttgccaaaccctctgcaggcacctcttatccatacagggacgcagccaaaggcctagctgtgctgaaggaaatttgcaaatcctgcctcaaatctgcagccagtatctcccccagcagcctccaaaccaggccagcacgaacccagccagagagcagcataggtgttgggcaaaaacaggctattgactccatccttttctaacagagaccagagtcctctggccttccacagagaaggtggggccttctcagggttctctggatctgctggtgtcagtcagtatctatttcttcttcctaagaattcttttttttttttttgagatggagtttttgctctgttgcccaggctggaatgcaatggcacaatctcagctcactgaaacctctgcctgccgggttcaagggattctcctgcctcaacctcccgagtaactgggattacaggcacccaccaccacacagggctaatttttgtatttttagtagagacaaggtttcaccatgttggccaggctggtctcaaactcttgatctcaggtgatccacctgcctcagcctcccaaagtgctagaattacaggcatgagccactgagcccagcctcctaagaattcttaaaggagctacggttgacaaaagagtttcagagaggtaaagttatggccctaaagtcacccagcaagtagatgtggcaaagccatgttgcaaaagaagccctggtgggtgacactctttggatggcccctgcctctccggaaggcaccagcgttggtttctctccgcctcaccttcccatgcaggtgggcacgtttgtgcttgggctcctgctggttatgccccagaagcacactcttccctatctgcagtcccagcccatgtgtggacacaacccatttcctagggtgttccttagcccactgcaccaagtcagcatttaggaatcaa

SEQ ID NO: 553 - DNA, 41331 bp, Homo sapiens
ccagctctgcctggctctctagcacctgggggaggggggaggggctgggccttggtttccccgagagagtccctttcacacatgggaccagccaacatgagctcatcaggtcacaggcagccgcagcctcctgccacacaggaagaagattcctgacccacaattatcattgcaaaggagtattttgtaggtaagtcctctggagcccaaaacaccaggcagggaagaccctggctgcccttggcacccacagacaccagctcccactggctcacgtccttgccctggacaagaagtaggagaggatgaagaaggccacaattagacccacggccatgccacatagaagcttccggttgtcttgtccggaccttgccattgtggaaaagcgcttcacgctccctgtaagcaggctggtcatgcttgtgaaatccgagtcctaagggaggaatcccagcaagatcacacagaagtggtgatttgaccacccacccgcaccagtgctgaaggagacactgcaggctctgcagcaggtagtgctagggcagggcactgatacacgcacaccgtgggcccttaccatgccatccaggtaccggttctgatcctctgcatccctatcgatgtccagggcgagctgttcagcagacagagagggcagggttgggccagagcagacacataatacagcactcaccctccccagaccagataaaccctgccaacaactctgccagacacagtggggctgcagcagacagaaaggtccaggtgtcagctggggcctcatgcaggtgagcacagccacgaattggatgaggatggaaaactgcctgaaactcctctgggccctctgccttccctctgatccccattccccaaaggcaccaggtggaggtaagaggacagaccaccactgaccgatttgagcctggtgactttggaggccaggctgtcagccattcgcttgttctcccggtctagaatctcttccacagcgcccgggctctgagctgagaaaagagaggggctgaagggttgcatccatcggtgagcacggcccctgacccctctcactccaaccacatctgggtgagtcagaaatctagggggccctaaccaaggttccagcaggtgaatcttgcacatgagacaggctgcataaaggacgatgtgtgtaagggcctgtcatgtgaacacatgtcctgtgtacacatcaaggtggggatgggcaagcacccacaatgggttcggtccaaccagcaccttctgagactgtgtagcaaaaactggacccagccctggggtgctagtatgatgtgacacttgcatccagggaggtcaccatctgtgtatgtggagcccattcttatagaaaaagagtaaactctgctaagagcatagaaaagacttgggaaaagtacccagcaaggcagcagaaaggctcctgcagagacgacctttgagctaggtcctgaagaggtggcaaggaaccaggacagaacattgggaaggccctttaccgcacagaaaatggctgagcaaagttcccaatttccccgagacgggagctgaggtcgaccaggagcgggatccttggtctgcatcccgcatggggcttcctgcaacacccagggcagagtgctcgcagaggcctggcctgtgacaggctgggccaggggataaggaagttctgtcacatcaggtgcgtgagaaccacctcctccctagcttcagtgtcaggaagggatgccagcgtccttccagccacttcatatttataaattcctttaatcatcataacacctcacagagacaggcatcaatatcccactttgcagacaagaacacgggctccaggaggggaaatggggccaccgaggccaaagtaagagtcctgcttggacaccagcggagcacagcctctactcctagggcctggcctcgggacctgtcgaatgccgactcccgctcaccccgaacccatgcagaacgatctcacagggggcggcggggagtggggagaccccgctgctgcgcgacccctcgctggagctgctgggccgccacgcgcgccttcggtcctaacggcagtgccggccgaaacccggccctgctcggacccggaaggatccgaatccgcccccctgacagggtcctctcggccgaggtcaccccagctgggccagaggcaggcgcacgcggctctacaggcagcggcgtcggtttcggcccggccctgcccccaacggctccgctctcccgcgctcaccccgagcccagtccgccatcgtgccctgccccggctcctcgacgcggacaccgacgcggccacagccgcctcagacgtggcgcagtcgcggggaaagagcttccggccccgcccccagctagcgatggccccgcctccgcaccgaccacgcccctagatagcccagccccttccgcttcgggctcgctgacttccggcttagggccgagggtggggaactgccgggcgcggaagcgatgggcatatctgtggcttattttcagcactgtcgcgcagacagtggcgcgatctcagctcactgcagcccccgcctgccgggctcccaaggtgctgggattacagcagcaccgcggatgtgacgtttggtgttcctgtgaacgtggggcggggcggggccgtttgcttgctcagtgcctagacgatggtggtggaaagacgcttctgtgggttaggtcctaacggttaggaaggattcacaggcgggtcatgaggaaggagcagacccctcgggcagaagcccgcgaggagcactgggtgtggtgggggcaggggtgcctcctctgtcaagtggagatcggcgcctcgctcgtgcctgcgagtgcgcgccgcgtcgaatacagccgtacagaacgcactacaggaaagtgaagccgggagagagactgggaggcggcgcggggactgggggccgtagacgcctttgctcccgggcacttgttagaagagcgagtggatcgcgcttcctgtgcgtcactgaatcctcatgacggccactgaaacggacacgcaggatctttgcttttcaagagggaactgagtccaggccagactgggttgctcccctttctctcggcccctccacctttgcaagtgctgctccttctgcctggagtggctcctccagtcttttcccggctcacttcccaccgtccggtgtcagcaaaaacagcacttcctcacagcccgttgcagcccagcagtcgccttttgcttcttttgaagcacagccctgtgaccgcctcgtgtccttttgtttttccttgtcccccttcccctctggaacataagctccacaaaggcagggacctgggaatcccgttcgcctgcattccccagcaaacgcctaacgaacccaatggcccaggactgaaaattcctttccacttcggctttcccctctacatcccatcggttctgtggagctcgaggggcgtcactgtgtgtgtggcagggcacggtgggggctgagatcgtttcctgttggaacttctggcccaagaagcgcgggtcacaaggagaggggtcagttcggttcagagcgactcagcccctcgactcgggtcttaaaacctccgagccgccagttctgcctcaggccgcgcccccttaaagcgccaccagacgctgcgccccgttaaagcgccaccagacgccgcgccccgtcccggcctcccccgcgcgctggcgcggggctttctgggccagggcggggccggcgaactgcggcccggaacggctgaggaagggcccgtcccgccttccccggcgcgccatggagccccgggcggttgcagaagccgtggagacgggtgaggaggatgtgattatggaagctctgcggtcatacaaccaggaggtaagcggccgcctgaggccggggggcgggcacggagggggtggggcagggtcgtgcgcgggtagcagggagggcgtgggtgaggcagaggctgtgtcagcaagcgtaggggacgcggcggggtgcggggggcaggtctgggatgcagtgttgcggggagagtgggggtgcacccgttgggtggcaggcgtgtagggatgggggcgagtgccgaccctgccatccgttctgagcagtggctgctgcctgagttagaggccaataggccgcccgcatcagcggacgcggatcctacccctctgtggatttgaattcactagttctctctgcagcactcccagagcttcacgtttgatgatgcccaacaggaggaccggaaggtgggtgctggcccaaggggtaaaggggcagggacgggtggccccaggaagaagggcctggtggagccgctcttctccctgcccacagagactggcggagctgctggtctccgtcctggaacagggcttgccaccctcccaccgtgtcatctggctgcagagtgtccgaatcctgtcccgggaccgcaactgcctggacccgttcaccagccgccagagcctgcaggcactagcctgctatgctgacatctctgtctctgaggggtccgtcccagagtccgcagacatggatgttgtactggagtccctcaagtgcctgtgcaacctcgtgctcagcagccctgtggcacagatgctggcagcagaggcccgcctagtggtgaagctcacagagcgtgtggggctgtaccgtgagaggagcttcccccacgatgtccagttctttgacttgcggctcctcttcctgctaacggcactccgcaccgatgtgcgccagcagctgtttcaggagctgaaaggagtgcgcctgctaactgacacactggagctgacgctgggggtgactcctgaagggaaccccccacccacgctccttccttcccaagagactgagcgggccatggagatcctcaaagtgctcttcaacatcaccctggactccatcaagggggaggtggacgaggtgagcactgaccttaacccatggatgggtctcaactcagctccaacatttcctggacctgcttcctactgggtaccttcaggtttctgggtgtcagacatggagaggacaggacctcccagcctgttgggacaaggccaaggagatgccagttctgggctgggacctcaggaaaggcttctgagggaagtagaggccccttctggctcttgctgcctggcaggagggctgtgtggtgtctggggagactgtaagagatcctccaccatgaggctgtgagtggggctgagacagagtgtgacttcatccctaaggtatgtgttagcattcctaatcagggaagtgctcttagaagaatactcatggagtttttaggaagacagcagtggtcatcttttgcccccagcactacccagagtcacctaggaagaccccaggggaccaggtatgcagtacaggaggtgcacagtcattgccacacagtcctggagtgcaacagacagtggagcctcagcaggcagcagtgggatgagtggggctcctcacaggaacccttctttctttggtcaggaagacgctgccctttaccgacacctggggacccttctccggcactgtgtgatgatcgctactgctggagaccgcacagaggagttccacgggtgagaatggggctttttctgggagggaagtgtgcccacatgtctagatggtcgtcctcaaccccggctctgaaccagaaccacctgagagcccaggccccaccctagagagtctgacgttgtctgggtgagtgagactggacatagccatgaatttgggggcaggaatgtgccaactgggccttgggtagtggcaacagtatggtacttactagggcacattggttccttgtccccgtttttggtctacctgcccctaggctggtctgggtttccagagatggtctggcgctttggctcagacagggtcggggaggcagtgtgtctcagtgcccccacttccccaggggaccccactgtacagctgagtggcagtgcctctcagatcagtccctgcccttggctttggtccctagcgctgcccctttgggactcagatgccagctcatgtaatgtgtggttcagcggagtcacaaagattgcacctgtgctcagggattagccctgttgaaacccctacctccatctgtccccagccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaaggtaggctggggatggctgtgcaggctcccccagtggctctggcactggttctcctgcacagatgtggtcagtgcttccacactgtccacactggtacgtggagattgtcttggtggtgtgatatgggcgactcttccggttgttctgtggtccagcctggcaagaagccagacccttcctccatgagaagcatgtggacaccttccacacacttgaaggtttcacttcttaaatctttggggatctttactgagtggtccagagaagccccccagtccctacttttaagtcttaaacacaggcagcccttgattacaagcatagttgtccctcagcatcctgaggagacccataggaacctcagatcaaagcttccttctgattgctgtgactgcactacagggcatctggacagctggggctctaaccatcttccaggagcttgcagaaagcaggctggagtacaataaaccgagatttagtagacctcctgggaatctacctgcctaagcaagggacacacaaggtgcctgcgagccagtcaggatagggagctggcactggacacacagctagggggttgtctgtgcccgtcgctgccactgctggtgctggggtccaggcacattatgctaggagggtcaagaactccctgctctgtccacgaagtacacagagcggggattcggttctcgtttctttttgccaccaacatctgagggcaatgtgtgtgcgagtctaaagctttaattgctttgtgttttcttcccagctctggtttatagttgaagtaattagacttaaagcagttatttctcccaagtcacaaagcttacgagtacctctgagttacgctctatccctgtccttttcaaaagtgacacagacacccaccacccactcttggccttctgctgactaactgcagaggggcctcttcccaaacctctgccgccaggaccagctgttgtgtatgttggtgggaaggggtggtggggaggtgtaactctgtgccagtcacaagttaggcaggggcatagccccagtgacagagaatcctctacagacacacaggctgaaggagagtgtagctcccgtgctgagcgtgctgactgaatgtgcccggatgcaccgcccagccaggaagttcctgaaggcccaggtataaggctgaggagctggtgctcctgggggatgtggtttcggccctgatcacagacccttggctgctctaagcccaagcttagggatggccacctccccaggtgctgccccctctgcgggatgtgaggacacggcctgaggttggggagatgctgcggaacaagcttgtccgcctcatgacacacctggacacagatgtgaagagggtggctgccgagttcttgtttgtcctgtgctctgagagtggtgagttatggagacccaggtcccagcccaccccacctcagccaggcttgcacactgacctctgccttgcccctcagtgccccgattcatcaagtacacaggctatgggaatgctgctggccttctggctgccaggggcctcatggcaggaggccggcccgagggccagtactcagaggatgaggacacagacacagatgagtacaaggaagccaaagccaggtgtgtacccccaacacaccctcgggtctccactcacagccccatagtccctgcttccacacccatgtggacccctgtagggtgggacaggatgacaaatgggcaagagcttccagaatcaagcacctgttcctaagtgctatctgggataccagaaggtggcagatggcaggagctggttacctgtgccgcttctggagggaggcctcttcctgcagttgccttgcccacctcaccccactgggaaaataggtggcttgcctcctgtcctggagagtcactaatgcattccccacattccacccactgggaaacagcataaaccctgtgaccgggagggtggaggagaagccgcctaaccctatggagggcatgacagaggagcagaaggagcacgaggccatgaagctggtgaccatgtttgacaagctctccaggtgtgtggcatgaggaggaggggcctgcagctgggagaagggagagctgacccacatcctgtcttgtgagccccaggaggtaggatcagaggagagcttaggatcctggtattaggttgcattgctcacgtttgaaatcacttgccctggaggaaatcccccaggggatgggtatattgagatcagtattgtgccccttttacagatgataactgaggcccagagaaattaagagactgtctaaggccgggcgtggtagctcacgcctataatcccagcactttgggagactgaggcaggtagatcacaaggtcaggagatcgagaccatcctggccaacatggtgaaaccccatctctgctaaaatacaaaaaaaaagttagctgggcgtggtggtgggcgcctgtagtcccagctgctcgggaggttgaggcaggggaatcacttgaacccaggaggcagagcttgcagtgagctgacattgtgccaccgcactccagcctggcaacagagtgagacttcgtctcaaaaaaaaaaaagagactaatgtcgccagatttattggagatggcccagtgtccaaattaagagcctgcttaaggccaatttagatgtttaaaataggaaactgcttaaagccaggaggcagcagttagggtttgggcccagttaacagaaggtccaaccaggcttccccagtaaatgggagcagcctacttggtagagaggaaggtagcagccacgggtgagtaggacccctgcctggccaactgggccccttccccagccccactgcacctttccccaacaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgcacacaaagcaagcaccatctgggattggcacactggcagagccagtgtgttggggtatgtgctgcacttcccagggagaaaacctgtcagaactttccatacgagtatatcagaacacacccttccaaggtatgtatgctctgttgttcctgtcctgtcttcactgagcgcagggctggaggcctcttagacattctccttggtcctcgttcagctgcccactgtagtatccacagtgcccgagttctcgctggttttggcaattaaacctccttcctactggtttagactacacttacaacaaggaaaatgcccctcgtgtgaccatagattgagatttataccacataccacacatagccacagaaacatcatcttgaaataaagaagagttttggacaaaaatgtatgtgtaaattatcaaataaaggggccaggcacagtggctcatgcctgtaatcccagcactttgggaggccgaggtgggtggatcacttgaagccaggagttcgagaccagcctggccaacatagcaaaaccttgtctctattacaaatatgcccatgtgctaggtgtggtgggacacacctgtaatcccagctacccaggagaatcgcttaaacccgggaggcggaagttgcagtgagctgagatcataacaccgcactccaccctgagtgacagggcaagactcaaaaaataaaaaaggaacattaactagggttagaaactaacttcattctttttagaattcaacagttttcctaggtcaccaattccaccttttgttcttattaaggcgcaaagtcacaggacccccttcctgggagtcactgtcattaaatctattgccgtcagctcagcccagggtaggcaaggttcaagaatgggaagtgcttttgtctggggaaacacgcaggtaatgtgatgctaggaaggaggatgtgcaggtgggtgagagcccaggagggagcagctggtgcctgacagggtgagccatcagggctgggcctgggtacagccccaggagaaggagcctgtgcagaagtagcagttcagtggattccacctcctatgtcacaatccagcaggtggccaggactcagcctgggttttaagtgagtaatgccttccctgtctcagagattagctctaacagtgtcactagaggaagccctggcgagggtgggggggcgtagtgtggggacaaggaggccagatagaaagtgctggaatgttctggaacagatctgtttctggaggagaggctgagtatggagagtcaacagaatgtgaccaccttcagagggaggagctgggccgtctccaataaatccagggacaaatgccttcagtcctcagactgttccaatagaggggacgccacgtatcccagggttccctttccaactcatgtcaacacctgcagtccctttgaggagactaaatgtatttcatgctggaaagaacagattttctctcattaaaaatagccccactaaaggagaccaacatgctagaagtgcggcaccagggcctcaagactacacttcggaacatgaagagggctggggaccgctcggcccaagtctggatcttgtaaccaacagatgccgagcttgccgttcaactaggcacagaaagcagactcggtctgggattccagttggtctgattcagttcaagagggtcacagtcagaagaaagctttttccattaggagcttcagcagagtgaagagttcaacacagcaaacaggcaggcagctcctttgtatatgtgacggggtggccctgactgtaaacacagccctaccagtcactgcagctcatggcctgagaagacattccagtggcagcctcgggtgtccactcagttcacatattctggtttcacctgcccaagctgtcttcaggcatgaggtcttgtcagaattgggatgtggatgtctcctatgttaccatttattgtgtgggggcagccatcatcctatttgtctggtccatcaagctggaatacagaagacagagggtatcagctatctgtttacacacccaggcaggccagcagatctctgttcaaacagctctagctgcagacatgcaaaatatttcacaaaacaagctgctttctgcaaatactgctgctgctgtgctgggctaagaggatcccagcaggcctgggcagaacagggtggctaaatggagagcctcattctatgggtcttaaagtacccaaatcaatatgtactgatgctcatgtgcttaaaagcattcactatttggaaaagtaaccccttggatagtaatgctgtaaaaaacagaaaatgaaatcataacccattttacatacatttctctgaaactagattatacagttcaaatcctattaagccacttccaaaactccacaggagctaccagagttacaatctgcttttctatgaaaacaggaagttgggccgggcctgctggctcatgcctataatcccagcactttgggaggctgaggcaggtggatcacccgaggtcaggagtttgagaccagcctgactaacatgatgaaatcccatctctaataaaagtacagaaattagccaggcatggtggcacatgcctgtaatcccagctgctcaggaggctgaggcaggagaatcacttgaacccaggaggcagggctgcagtgagccaaaatcgtgccattgcactccagcttgggcaacaagagtgaaactccattacaaaaaaaagaaaatatgaagttggagcaggaaaaggatccctcaaaaaagcctgctgggctgatctaagatctccgctgccttgtgagctggccaggaggcactcgcctctcagcgtttaagcctcattgttagctgggttccctgcctccataatgaagtgaccatgattggtaaaaaatcagcctgcaaccagaggttggaggtcttggactggtggaggtgaggagagtgctgaccccatggccctgagccatgaggcagccacagctgtggacaaggaaaaaggatcaggatttcctaagacatctgccttggaaggcaagaggagcatcaactgtgatatattgtagttgatatggtttggctgtgtccccacccaaatctcaccttgaattgtaatcatccccatgtgtcaagggtggggccaagtggaagtaactgaatcatgggggcgggtctttcccacactcttcttctgatagtgaataagtctcacaagatctgatagttttataaagggcagttcccccgcacacgtcctcttgcctgccaccttgtaagacagtactttgctcctgctttgccttccactatgattgtgaggcccccacagccatatggaactgtgagtccattaaacctctttcctttataaattacccagtctcaggtatgcctttatgagcagccagagaacagactaatacactggtgaaatcccctttggacagtgttacacctgcctgtaatcatgacactggactttaaatgcttaatgctaccacctcccattgaaaacccttaatatcaaggctacacatgctacatgattcttatgggaaactgcattttctgtaacttcacttgtttataggcggtttgaaatctcttagaaagcatcaaggctctttggctttcctcagcggattataattgatcaatggctctcataccaattacttccgaaaagcatcactcatgtagccttcatcccacatagatgcagagaactttagcttctcaaagttctttaacccgtatcatcttagaatcacataccaggccttagagggacactgttggctgctttattttagggagtgaaggtaacgcctatagtctgttaagaatacagactcatcagccctgagtgtctggaccgtgtccctgcttggcctgttagcatctgtttcctcatctctaaatggaggtattgaaagtaacacccagtcaggtccaggtagtgcctggtgcaggattcacagcatcatcagctattactgttactgtgttaaccaacggggctccatatcaggtggaccataccctagagcagtgagaagggcagccccttggatggtcctcctcagcagtctgtaccttcccagtttcccgctgcacaaggtcccgcatctcttctgtccagcccagaagctccactaggctttccacgccgtgaaccacgtcccccagctgggccacgtccctgctgcgaggatgccaagccaagggccccaccaagtcccggttgatgagcagtcggggaactgagctccgcacggcctcggtcaagctggcaaaaggctccacctgaaaaatgggccaaacgtgaggggcacagtgtccactttacaagctcctcaggatgtttcatgccacagccaccgaggccttggaggagcagcagattggcagtcagagcctgcgatatagggaaaacccaccaccaatctcatttcttcagctgagctcctgccgcttggcctccgtgacggttttctcccctccgcctctctctctctctcccacttcttgctgtttccacacatccttgcttttccccacctccgttccaaggctcatcagggatccaaccttcctgcctcctctttgtgagcacgttctgttctccctgtcctccccacctcgctgtctcccagcatgacgcagagggacaacagcacagactcgtccatctcctctggctagccctgcttgctctgacagccaccaccagcatcgggcacccagacgagctggtgcccccgagcaggagttactgttacgtctctccatggtcttccccacccagcctctagagaggcctagctcggtgccatcaggcttcttcatacagctctcaaagcttcttttaagaggaacaaggtaaaaaaatggatacattaataaatggcattaaaactggctcattatctgggaggaaaatactccattcctacctcccactgaaaaaaattcaaatggattaaaggtttcaatgtaaacaaaacagttcttgaagaaaactaaggatttacaagtaaggatagggaagaacgttctaggcgtaaaaactgaagtcagataaggcaaaggaaaatgacagatctgactatgtaaatactattatctcggtatctacataaaactactatgtagaaaatttaaaatttttaaaaacctctcatcatcataaactgcaaaaatatttacaacatatgacaatagtttatattgctaattgataaactcatttataaacatataatttatgaactaatttataatgctaatttataatgaaatttatattaacagctgggcatggtggttcacacctataatcccagcactttgggaggccgaggcgggcagatcagctgaggtcaggagttcaagaccagcctggccaacatagtgaaaccacgtctctactaaaaatacaaaacttagctgggcgtggtggcacgcacctataatccgagctactcgggaggttgaggcaggagaatggcttgagcctgggaggtggaggttgcagtgagccgagatcgcgccactgaacctccagcctgggagacagagcaagactctgtctcaaaaaaaaaaaaaaaaaaaagaaagaagtttatattaacattaaaatgtaattatattatttaatttatactaaaattaaaactaatttatattgctaatttataatgacccaatgaaaaatggtcaagaggtacaaatatacaatccaaagagaagaaacacaactggcaataaacatgaaaagatgaacttcattctttactacagaaaggcaaaatccgcacccccctccacacacacacatgcattttttaaccaatttgatttgtgtgattttggttttggtgaggatgtgataaaatggctacataaaaacacagtttgtggcagtgtaattgttacatctttctggaaggcaagttctcaatatttatcagcatttacccttcaggagttcttgcatgggtagataaggatgatacacagggatattcaccacagcatttacccttcaggagtacttgcatgggtagataaggatgacacacagggatattcaccggaaggcaagttctcagtatttatcagcatttacccttccagagtacttgcatgggtagataaggatgatacacagggatattcactacagcatttacccttcaggagtacttgcatgggtagataaggatgacacacagggatattcaccggaaggcaagttctcagtatttatcagcatttacccttccagagtacttgcatgggtagataaggatgatacacagggatattcactacagcatttacccttcaggagtacttgcatgagtagataaggatgatacacagggatattcactacagcacgggatctcattctgttacccaggctggaatgcagtggcatgatcatagttcactataacctcaaattcctgggctcaagcaatcctccttcctcagcctctcaaatagctgcaactacacagaccatgcctggctatctttttattttttgtagagacgaggtctgactatactgcccaggctggtctcaaatgcctagcttcaggcaatcttcctgccttggcctcccagagtgctgggataacaggtgtgagccacggtgcctggcccagcattacttttaatgtaaaaattatatactatttattatcattgtccatcagtaagaaattgcttacataaattttgtattaaatccacaaaatctatgttaaagctcttgtggctgaatatgtttcagaatttttgagattttagaaaagatcatatggtttacatcccacgttatgtcacacctaaaggggatctggagtggtactccacagtcaaacacattaacatttcgtccacaaagcacatgagatagagtctgtgcgtgacaccagctcattcagttcatgatggcaccagccttacagacatgggtttctcagttgggacctcatatccgtgtaagggaaactgttggcattaacaacgcagcacatctccatggactcacattgttacgtgaaaacagcaggctgcagaatagaatgtacagtgctgtccaacttttagtttaaaattaccatctgtacgtatgcatttgtacaaaaaaaagaaagctgagaggacacagaataaaatgctaacagttggtgggattaaaaagttgatcctttgctttatatctttatataatgtacgaatcttttcaaagacacacatgatacacttataatcaggaaaaaggccattttcatttcacttcaacaataaagatggctggtggcccaagtgtccacacctggtggccagcacggtcagctggtctcagcccacactgtgctgaccaccatggcccctctgactgctcctcctgtgtctgtccctccatcctaggcctagcatggcattctcatgtctgtccacaccctgggctctcctgtctgctcactccagcaccccagctcctgcctctgggccttcctggactccagactcatgtccacctgctcaacacctccagtccgcagcacatcctcaaatccgtggaaacaaggctgagttcctgagctcccccaaacccacctaccaggcttctccatctcaggaagcggcggctccgtctttccagctgctccagccacagccctggggtccttgggaatccacggcctcccatgcactgtgccagcgtacccactctgcgttcacacacacccagactccagcacccctcagcctctgctggctttacctggcccccagccagtgccagccggtgattacctacaagggccctgctgggtctgctgctcccagtcttgcccccatggtgggctcacagcccagcacccaacggagtcctctcaacttcagactctggcctggaacccaagctgaacccattcaccttctgaggtggcgccagcctcccatgagatgacacttgtgccccaccttcttctctgctccagccccgtggccatcaatgctgacttcgccccaccctccttgctgcttgtcacctgtgcagtgtcccctgccagaccctcctcacctcggtaaactcttagatccaactccacctgcctgacttgacactgcagctggttcccaacccttctagcctttctatcctacttgttatctttctcataacatcaatcatctcctaacaaactatataacttcttacactgacatctgaccgtgtatgtccaaagcactggagcagggcccagcacacaatgaatgcctgaacaaacacatgctctgggcccctgtggctgccctgggcccctctgagcacaggtctttctggcccttctgtcctcggtgcctacatccagtcacgcacacactgacttcatggtctcatttcttgctctcatcacagcttttaggaatttcctgagctgcagacgcagacgcagaacagctgcttgaacacatccagggcatgtttcccgacacctcagacacacacagaaccgagctgggcatcctccctcccaaatcacgcctcaccagcaagtgccctgaccttacagaccaagccagacgcctccttctcacgtccccaaaacatcacagactgcgagtccagtccccctcctcgccatccctcaggcgaccacagctccaccttctccaggaccagcctcctggcactgcttgctccactctccactccccaaaggcctccctgaccccaagggtgcagctacgtccccgggccagtccctgtggatttatcactcctcccactgcagcatcagtattcctgatctgacctgggaggccctgcccctccacctcgcccccacacccccatccttctcccttctcctcacacgtggtgccccacccacacctataccacctccaaagcccagcagcttcccaccttcctgtctcctgcacaggctgctgctccctcagcctggaaccccagctgaatccattcaccttcccaaagtggcaccagccctggaagggcccatgagatgactcctgtacccctcccttcccctgccctccagcctcctccctgcacaggcctgccgacagcccatgagatgactcctgtacccctcccttcccctgccctccagcctcctccctgcacaggcctgccgacagcccatgaggtgactcctgtacccctcccttcccctgccctccagactcctccctgcacaggcctgccgacagcccatgagatgactcctgtacccctcccttcccctgccctccagcctcctccctgcacaggcctgctgacaaacctccagggaggtcccaaggatgagcagcagatctgccatggggaaatcaaccacatgcagcaagaacctctggggcagcggctccccaaagaacacaatgtcgggcttcacaacgccggtgcagaccgggcagcggggaaccctgtctgccatcacgtcagcctggaaaacagagaaaacaggcctgaggaagatgcctgcaacaccctgtaaaaggaaaaggcaacaagttcttattaaagtctcaaacattctcccccaaaaaaggtgagagagggatcatgaacccccatgtacccagcttcaggaattaccagttttcatagctaattgtttcacagccctccggaatctgggaggaggtattggagcctttaaaagcaaatcttggacatcatatgtttcacccataattacttcggcaggcatctagcgtatctaacaccatgctctatccctgggatggcagccagagacatccaggcgctaaggaaacacctggtagaccacaccagtcctcaaacagtagtctgcaggcatttggcctacaccgaacactattcagtcagaaaggtgaaactgtctctggtttgagcttcggtgatcatgccattgcctcagccctgggaggcattcaggtcagcttcactcactggctggcattattaggagtaacaacatctgccaaacactgcttccttactggccaaggtgaagtggacacaacttccctttgcgtcaagattaatataaataaatgccttggagcagatggaaaagggagagagttacagaggaagacacctgactttctaaggtaaacctttacagctaacggggcttgttttaagcaggctcagcccagcaaaaagcaacagatacaaaagacaaaagaaagagacccacgaaagatttcagatattcttggatacacagtaaaactgtattatatttaaattaaaaagaaaaaactgttatcttggaggcatggggtatagcaaaaaaaaaaattaaggaagcaaaaaaaaaagatgaacttgaaatatctatcaaaggccaggcgcagtggctcagctctgtaatcccaggacttcgggaggccgaggtgggcagatcacgaggtcaggagatcgagactgtcttggccaacatggtgaaaccctgtctctactaaaacacaaaaaattagccaggcgtggtgatgcgtgcctgtaatcccagctacttgggaggctgaggcaggggaatcacttgaacctgggaggcggaggttgctgtgagctgagattgcaccactgcactccagcctgggcaacaaagcgagactctgtctcaaaaaacaaaacaaaacaaaacaaaacaaaaaactatctattaaagatataaaattattaaaaaattatgtaataatgtagcagacttgaaaaataaccaaatagaacttctagaaataaaaagtacaggaaccaaaattaaaactcaatgtctgttttgagttgctgtttgggaaaaaagaaagaaagaaacactcaatggaaggaccttataacagaatacaatattagtaaactggaaaaaagaccagaagaaattacccagaatgcagcacaagaagcagcaattacaggacagaagagtgatcaggaacagcaggagagagaaggtctaatgtatgttcaatcagaggtccctaaagagaggggccagatagtgggctaggggcaactcatatccgaagagataacggcagagtatgatccagcaaccatgaaagacgccaacccgcagattcaggatctcaagcaagtgagggctactgagccagcctgagggtgcccacaggaaaaacatgagtcacggcacatctgtgcttgtttctgtcccaagaggttctcaggaggtttagtaattacatgtggtccttcaaagagggagggtggctgtgaggtgagtggttacgtacttgtgagacttcagtaagtgcccagtaaatgtacattttacctaagatagaaggaaacagaggaagagaactaagcagacctctcagggaagggtgaaggaaccattaatctcatcttgtctttaatctgtatctgggaagataaaccagtaatccacattagcagtgtagagtctttgaaaagggctggtttctgtttagcccttagtgaagaagcctaatggtggctggggagggaggggtacagtgaggcgcgtctgacctcctctcctgctacggccaggaactcaagcttccaaggtttctctggggttcccttgaccaaggggagggctccattcagttggttgcagggcttagaattttattttatattttatttttttgagatggcatctcgctctgtcacccaggctggagtgcagtggcatgatctcggttcactacaacttctgcctcctgggttccagcaattctcctgcctcagcctcccgagtagctgggattacagatgggtgccaccacaaatggctcatctttgtatttttagtagagacggggtttcaccatgttggccaggctggtctcaaactcctaactcaggtgatccacccgcctcagcttcccaaagtactgggattacaggcaggagccaccgcgcccagcctagaattttattttatttttcttaaggaaggcctacaattattattattatttttttttttttgagatggagtttcgctcttgtttcccaggctggagtgcaatggcctaatctcagctcaccgcaacctccgcctccctggttcaagcaattcgcctgcctcagcctcccgagtatctgagattataggcatgcaccatcacgcccggctaattttgtatttttagtagatatggggtttctccatgttggtcaggctggtctcaaactcctgacctcaggcgatccacccacccggcctcccaaagtactgggattacgggcgtgagccaccatgaccaactggcctacaaattttaagcagaagaaataaaagaaaattcatatggaaaaccacagtggagaaaccgcaaaactccaaagacaaaagtcttaaaaaacaggcagagaggccagacacggtggctcatgcctgtcatcccagcactttgggaggccgaggcgggtggatcatgaggtcaggagttcgacaccagcctcaccaacatagtgaaaccccatctctactaaaaatacaaaaattagctgggcatggtggcgcatgcctgcaatcccagctactcaggaggatgaggcaagagaatcgcttgaacctgagagggggaggttgcaatgagctgagatcataccactgcactccagcctgggcaacagagcaagactctatctcaaaaaaacaaaaaatccaaacaacaacaacaaaaataaaacaggcagagaacagatagcaacagtttcagaaatttatatgaaaagccaaaagattcagaccagccaacacagtactgaaggagaagaacaaaggtggggaattaacatcaacctgttgcccaaattatctattttattctcttatttatttatttattttgttttgagatggagtctcactctgtcacccaggctggagtgcagtggtgcgatctcagctcacagcaacctcccctcccaggttcaagcaattcttctgcctcagcctcctgagtagctgggattacaggtgcaccaccacacctggctaatttttgtatttttagtagagatgggatttcaccattttggcaggctgctctcaagcttcccacctcaggtgacccgcctgtctaggcctcccaaagtgctggaattacaggcgtgagccactgtgcccagtcccaaataatctcttttaaatgcaaatcccttcacatcattttcctgcctaaaaatcctccaatgcctcccatgatcgtcaggatacagttcaaaccctaacagagcaagcaggcctcccacactccaggtctctgctgccagaaacagactcttacatccagacggcctcatctcaaaggtgcttcccagcctactctgttcctacagctgagtcagtgtagtgtccagtacatatttatagtaaaattcgtatggcacccagttgtaactgttggatgactccaccttattttaatttctattcacatccacagaacccagcaaagggcctggcactgaggagactaaactatttgttgaataaattggtcattcaatgaatgagttgaccaaaacaataatacgtatatatcaagtttctactatgtgctggactcacacttcctaatttcaaaacttactacaaagctacagtaaccaaaacattatagtgcaggcacaaggatatacagataacaatggaatagaattgagactctagaaataacccatacacctatggccaactgattttcaacaacaatgccaagaccacagtttttttaaacaaatggtgctggaacaattacatatccacataaaagaaaatgaagctggatccctaccttacagcgcacacaaaaattaactcaaaatggatcaaagaactaaatgtaaaagctttaaactataaaactcttataagaaaacaggagtaaaacaataccatttctcagatatgattccaaaagagtgagaaaataaatagacaaactagatttcatcaaaatcaaaacttctatgcatcaaaagacatcaacaaagtaaaaaagacaacctacagaatgacagaaaatatttgcaaatcatgtctctgataaggatctagcttccagaatatataaaggactctcttaacaataaaaaagacaacacaattaaacaatgcgcaaaggacttcaatctccaaagatatacaaatggccaaaaagcacatggaaagatgtttgatatcatgaatcattaggaaaatgccaatcagtgctacagtgggttaccacctcccacccactgggatagctgtaattaaaaaatggaaagtaagtgttgggatgtggaaaagatgaaacccttgcccactgttggtggaatgtaaaatggtccagcttctgcagataacagtatattcgttcctcaaaaagttaaaacgggccgggcgcagtggctctcgcctgtaatcccacactttgggagaaagaggcaggcggatcacgaggtcaagagatcgagacatcctggccaacatggtgaaactactctactaaatacaaaaattagccgggcgtggtggtgtgtgcctgtagtcccagctactcaggaagctgaggcaggagaatcgcttgaacccaggaggcggatggtacagtgagccgagattgcgccactgcactccagcctggtgataagagctagactccgtctcaaaacaaacaaacaaaaaagttaaacatgggcagggcatggtggctcacgcctgtaatcttagcactttgggaggccgaggcgggtgaaccacctgaggtcaggaatgcaagagcagcctggccaacatggtgaaaccccatctctactagaaatacaaaaaacattagctgggcatggtggcaggcacctgtaatcccagcttctcaggaggctgaggcaggagaatcgcttgaacccgggaggcagaggttgtattgagccgaaatcgcgccattgcactccagcctgggtgacagtgtaagactgtgtctcaaaaaataaataaataaatatagctaaacgtggagttacccagcaatacttgtaggtatcatactcaaaagaataaaaaacaaggactctcaaacgaatacttgcatatgctccacagcagaactatacacaagagcagaaaggtgggacaacccaaacacccatccatgtacaaacaaaccaactgtggtgcatacatcagtggaacatttagccatgaaacaggatgaaatactaacacaagctacaaggcgaaggagcgagaaacattttcaggaaataagctcggcacaaaaggccatctgattgccgggcgtggtggctcacgcctgtaatcccagctacttaggaggctgaggcagaagaattccttgaatccgggagacggaggttgcagtgagccgagatcgcccactgcactccagcctgggcgacagagtgagactcaatctcaaaaaaaaaaaaaaaaagtgggcagctggaattggctgaagggagattcattttccctacatatttctatattgtcttaaatttttttacaagcatgtattgattttctaatttacaaataaaatgtttcacactattattgttcaactgtcctttcgagacaatgcttataaaataccacttttccagatcaccccaacagcaaactgcagaaggacaaccaacagcaggataactcacccgaatgtcctcccctgggaagggtctttggcagactgtgcaggtggcagaggcaaaggttccatgagcttcaaccagctttgaggcagggatgcccgacactgaaattcaagccaaagcgaagtgttgctgccgcctccgagatgagcacgcaaggccaagagcacaacttctgggcttggcaggactcctggaaggaggcacagccccttggggttgtgatgtcctcaagcctggttttcatgcccgtatcacctacatgcgccatcaaccagaataaggcaggggagcaaaggggcacctagctggagccaaatcacggttaaaacaaagcctgtcaaaactcagtacgaaaaaccatttgataaaagctcaaataaaattatatccagccgggcacagtggcccacacctgtaatcccagcactttgggaggccgaggtgggcagatcatttgaggctaggagttcaagaccggcctggccatcatggtgaaaccgtacctctactaaaaatacaaaaattagccagatgtggtggcaggcacctgtagtgccagctactcggggaggctgagacaggagaatcgcttgaacccgggaggtggaagttgcagtgagctgaggtcgtgccaccgcactccagtttgggtaagagagcgagattctgtctcaaaaaaaaaaaaaaaaattacacctaataccaggctgggtgcagtggctcatgcctgtaatcccagtgctttggaaggccaaggcaggaggatcacttgaggccaggagtttgagaccagcctcagcaacatagtgagacttgtcttaaaaaatttttttaattagccaggcatggtagtgcatgcccgtagtcccagctattccagaggctgaggcaaaaggatcacttcggcccaagagttcaggctatagtgagctatgatcatgccactgcactctagcctgggcaacagagccaagaccctgtctcaaaaatttatatctaatatccaggaacatatcttctattctacagataccaagttaaaatgaggatataaatatcataaattccaaaagaattgcttggtagaaacagacaaaaagtgacttcttatgaaagttgtgttagtattaactggttctgaaaggctgcggtggcacagccagggtcccagctgcaggaggcttcccaagtccctgtcgctgccctaactcagcagtgctgaatctcacagccaggagctcccaccttcccacaaggcctgccctgctgcacctctgggagaagagcccaccaacatggggcatccgctgctgcctctgtggttccaagtcaggggatccttctggcaaggaaacacattcctggagccaaggtgccacctctttttaactgacaacacatcagcagtctctccgggagcctggctcccggagagctgactgtcccagcacctgtctgcatcactgcacgtaaggaaaaggccccaccaagtgcttccgttaggtgcacggccagaagttggcacaacctgtgaatcgctggtttgggcaccatatggatacggtcaagaaatcaccacagactaagtgtgaccatattaaggaattactagtgattcttcagtgtgaatcactatcagagttgtttttattttttaattatttttatttttatttatttttttgagacagaatctccctctgtcgcccaggctggagtgaagtggcacgatctcggctcactgcaacctccgcctgctgggttcaagagattctcctgtctcagcctcccgagtacctgggattacaggcacacaccaccacgcctggctaattttttgtatttttagtagagacggggttttgccacgttggccaggctggtctcgaactcccgacctcaggtgatctacctgcctcggcctcccaaaatgctgggattacaggtgtgatcccacacctgtaatccggcacccggccggagttgtttttaaagtattctctagagctatccattcatgtgtttatagattatttctagattaaattcatgatgtgagagatttgcttcaaaataatctggggatttggaagaaggtggtgaggacgcaggaagaactggctgtgtgctggtgatgaggacaggacggttcgttacattgctctctttgtgtgtgctcaaaaaaattccataatacacttcttaaaagagagaagaaaaaaagagatcatcacaccagattggcaaaacaatgtcaacttctgcccaaaatacacagctctgcaggtatgcaggagaacaagcagtggcctttaaacacccagaggacattttccttgggaacaaagccctaactagttggctcaaaaaaagtcccaaggaagaagcataagcgataggttttggccgtccccagaaacaggcacccgagcatcccctgtgagaaacaggcacccgagcctccctgggagaaacaggcacccgagcctccgtgggagaaaaagaatgtgtgcgactcacagagggctcacctctctcaagcccatcgatgttctgcgtgtagagccgcagaagcagccccttgtcatgaagcagccggagaaagtagtgagtgacgttgggcttgtagtttccagggtacagctccttggccaaagtgaaaaagggcttggggttgtgaaagaagaatgggagttcaaaaatggcctcggggtacgggagatcgtactgctggaggttgctgtacaggccactccccggcgatctgcagggagagaagaaaggctctgaggcctttggaagaggacagggaagtggaataaactgggcagtggggagggcaggagtcaggggaggggagcgcagaaggcaggtgggactgtgggcagtacctgaagtctggaatgccactgggtgtgctgatgccggcccccaccatgaccaccaccctctggcaggctctggcccgaatcagctcagctacatcctgcagggaaagcttccccttgtcactgctgcctccacttccaacaacacttgaagcacccacagaaaaagatatggaccttcttccacctttaatactgacagaaaaaaacacagcagcaaaggaaacagatagcaaccaatctcaggatagcaagaacgagcatggctctgccctctgcaccaccgccaccctcgagaatgagcatgtgtgtctccccaggcctctcaaaataatcacctttcttagacgactattggggtacaacaaaaagcagtcataaatcagaaatcaagacttacttgggagcaaaaaattcaggttaatgggaactgtgctcatttcataattcagtacactcagtaggcactcaactctgactgactgcaaacctccaaaggggtctcctaatgaaaactggttaaggagtcaagaagcaaagagggaaaaccctggttctaaaaccatctcaccacctattaagcgccccacttcacacagcatttcagacatctattcacttaaggtcgttccccaaacagctactgtgctcctactaaacacgaactgttaagagaagcacaaaaggaatgaaagttattattgctgttgagtgcctgctgagggcaaggtatcacgaagggtgcctgagtacattcctcatttacgtaaataaaatgtttgtgagtcactgaaaaacacataaacggcgttttaccaaatgtctggaacatacgtaagatgtatggcttaaagtacatgctgcatggtgtgaaattcactgggagtgggggaccctgaggggcaggcatgggtgcaacctgggagggacactgtgcaaaggacacaaacaacaaattcagagagctcaaaaatccaaagccaaactggaggaagcccatgcaatggactactcctcacacgcagccctatgcctcctgctttagggccagtggtagcaaggatttttgttttgttttgttttgttttgttttgagacggagtctcgctctgttgcccaggctggagtgcagtgtcgcgatctcggctcactgcaagctccgcctcccaggttcacgccattctcctgcctcagcctcccgagtagctgggactacaggcacccgccaccacgcctggctaatttccttgtatttttagtaaagacggggtttcactgtgttagccaggatggtctcgatctcctgacctcgtgatccgcccgtctcggccttccaaagtgctggaattacaggcgtgagccaccgcgcccggccgcaaggatttgttttaacagttttgcagagtatcacagatattagaatgcgctccacgtgtttgtaggtcctggtccctgctccatccatagcacctagaacagagtctggcacagaataagagctcagtcagggcttcttggatgaacgactgactcttcgggatctttgtttttttttgagacggagtttttgctctttcgcccgggctggagtgcaatggtgccatctcggctcactgcaacctctgccttccgggttcaagtgattctcctgcctccgcctcctgagtagctaggattacaggcgcccgccaccacgcccggctaatttttgtaatttcagtagaaatggggtttcaccatgttggcccagctggtctcgaactcctgacctcgttatccacccgtctcatcctcccaaagtgctgggattacaggcgtgagctaccgcgcccggccaactcttcaggatctattaaacttttttcttttttttttcccacaggtagataagagtcttgctctgtcacccaggctggagtgcagtggctcaatcatagctcactgcagccttgaactcctggactcaagggatcctcttgccttagtctcaggagtaactgggacaacaggcttgcgccaccatgcccggctaatttttaaatttttggtagagatgggggtctcgttatgttgcccaggctgctcttgaactcctggcctcgagcgatccccgtctcagcctccgaaagtgctggtattacaagtgtgagctaccacttcgagactcacttttcaccaacattttcagcagttgtgtcagacagcaagtcaatgtgccattatttacttaaatattcatccattatagggcatctgatacctaacaaccatggaccttaagattttttcctatgtagcctcagttcttagatgcaattactatggagacgggtacgatcacatgccagtgggagtattaaccgcacaacatttatgagggatcattaaagcgttaaatgcatatacttttggacctagcaatcccagtactaggaatttatgcaaacagtgaggtgccaacaaggttattcaccacagcatgatgcacaataactaaaggttagaacgtatttcaatgagggaatggtgaaataaacgacaaaacccccataagtgacgtccacagatcagcataaagacggaggccccggtgttggaacgcacgtaaactcccagacatgccgcaaaggaaacacggcaaggtgagaaagagtgggcgaggtgtcgacaacgaacacgcaagaagtgcttgtccttgcccaaaatacctcgaaaagaagaaactgggagctgctgccctcggctgcctccggaatgccctgggcacctcgggtctgggaggcctctgcaaggggcgcgccgggtccaagggctcaccgcgggccccatggctgcctctcagccccgcactcacatcgtccctgccgccaagcaccagccgacagccgcaggcctgaaacggccccacgcctcccccggcctcgacccgttcaactacccggccccacagccggagggctgccgcggcgcgccaaccccagaacgccatgttccgcgcagtccaaggagtcctccggactcgccccgcccccggcgccccggccccgcctccgcctcccacccccgcccccggcgccccagccccgcctccgcctaccgcccccgcccccggcgccccggtcccgcctccgcgccccgcccccgcctccttgccgacgcctccggcgcgcccaggtagacgtagaggcgagtagaggaagttccctagtctggtgtctcatctctcgccccggaggtcaaacctggagccagcatttctgtaccctgcgctcacacctttttcaacccggatggcggtgatagttaatactttctgagcgcttttactatggtcaggcattatatttacacctaatcctcgcaaaacactactgggaagatcctcatttgacaggagcaattccgggtcacaaaggctgacaccacaaagctagtccgtagcgggttcgaccacaggcgcccacactctttgacgcctcaatggcacagccaagtgcgcgggaagtgggctgcaaacgccggagagttttgtccggagcgcagagacgcgctgtaaccgagcaaccagcggggcccgcccccggcctgctacggcgctcccagcctgccccgcgccgctcggcgccggaagtgagtgagcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagtgagcgccgagcagacgggccctgggccccggcgatagagggagacggagggggcaggcgggcggaggagcggacccttgatgggctgagggcgcccagacccaagttggggggaaacggggacgtgtagcgaccggctgtgccggcaaggtttgctgaggaaccttgagtggcagggtcgaggaataagagggatgacagaccacgagggccaagagctgtagccaggatgtttcggtctgagattcactgcttccttaacgggggactgagactgaggcttctgaactcctacctcgggtcttactaaaacggttcaggagtagcctttgattttagctcttgattccatctaacaagcaaacacactttcagggccaccacccactttgggaaacatgttggtgattcgtgcttagccttgtcatagtgtaactgtatctacagttatctttctcatggtctggagttgataaaccagaggctagtacagctttgctgttttccctattcattctgcagctggttgcacggggtgcaaccacttccgccgtcccattgtctttaccttccattgtatttctcatgggctttctgcccctagaaagatcttaaagtttaggtttgtttagaaacaggatgaattgcagagcaattaaattcttgctaagcactaacctccttttaatatgagtagaataaattgctggcattgggctggagctattccatagaaaatacatctcctgtagtaacctccctgttaaccctagcatttaatataatacctttcacatagatgttccatacatgttttgatgatgtttagcattcagcagccttctgctattagcagtttttgagagcaaattaatgtttggcaaataatggtttgtgttggatagcacttggtaattttcaaagcattttatctgcgttattaaatattagcctttgggttttggatgaagcgctatgtcactgtccctgaggttttaaatattagcttatttaatcctttattcatccttttcacagaggaggaaactgaagctcattttaattgccttccctgagatactcagctaataggtagaagagccagcatctcaagttagatatgtatgattccaaagttctcgtttccagtgaaacctcacaataaccctttgagttaatctagattaatgttctccatttcatacctgggaaaactgagtcttagagaagttaagtgatctcaaagtgacatagccattcaatagcagagccaggaaaagaactcaggtttatcacatctgctttagcattctttctgctacaccgtagagactggttagtatggatttagtatcccttatcagaaatgcattggggcggccgggcgcagtggctcatgcctgtaatccctgctactcgggaggctgaggcaggagaatcacttgatcctgggaggcagaggttgcagtgagccgagatggcgccactgcactacagcctgggcaacagagtcagactctgtctcaaaaaagaaagaaagaaatgcattggggcaaaagtttttttggatttagtattttttcaaattttgaaatatttgcgatatatacttacccgttcagtatccataaatcaaaaatctgaaatctgagatgctccagtggtcatttcctttgagccctatgttggtgctcaaaaagttttggattttggagcattttgaattttggagttttggagttttggattagagatacccaacctgtatttgtgacttgatagaatcatcaaggctggaggtgtctgtgactggatattaggttagaggtcttaagggctgtatgtttttcaggttgtggcatcagctgacacttcaggtgcttgattttgtgcaggatccgtgctttgcccaaggagatggtctcattaaggtaaataatttgctataccagattagattatatgaatgtgctcaaggacttttgaaaataagataggctttatgctaataataataataagctccaatattcagcagtcactttacgtcaggtactggtctgagcgcttcacatatccttcatgacaacgctggtcagtagatactactatctcacttttttgatgtagaagcaaacataagactttaagtaacttaccatagatcactgctgataagtggcagaagaggattcaaacactgacattctggctttttttgaaattctagcataaagtattatcttacaacatgcctaagtatcttagttcataggcttctttttagtactctagttttagaaacaaagttcaaacccagttagagggtggagtaaggtatgaggaagattactatctgtgggaatcttagataacttccatcactccccttctttaagccgcactgcttgcttgcccagacacttctgtcctgggtagtgtggaaaataaaacaccttttgtacttcggttgagggtaggtggattggagggagagtcctgtatagtgtcatgctgcctctgtaatagaggacttttagaattttttcagcagtagacaaatacgcaccttctttcccagccttccccagatcccctgacacatccccacgaatttgctcactggtagcctcctctttgaagtttttcctgacatcttactctatgatggctttctctgattctgaatgaatcagagattcataccagcattgcaactgatagcttataattacattttgagtcatttctcctgaatacattacttttatatgctcgcaatagagcttaccaccttgctaccccaccacctgggcttgtaagattttcttgtggtttatagccatcaatttgacattttactattcagaggaacttacaatcatctgtaagcctggagattttgctgaacattcagtcttctggattatgtgggaaaatgataaatgagacctgctttttttttttttttttttttttttttgacggagtttcgctcttgttgcccgggctggagtgcaatggtgcgatcttggctcactgcaacttccacctcccgagttcaagcgattcttctgcctcagcgtcccaagtagctgggattacaggtgcccaccaccacagccagctgatttttgtatttcttagtagagatggggtttcaccagtgttggccaggctggtctcagactcctgacctcaggtgatctgcctgccttggcctcccagagtgctgggattataggcaggagccactgtgcctggcctgagacctgtcttaatacttgttccctaaggttctaaatcatcacgatagatgattcataattgtttatctctgtcctttggtttcttatctttaaatcacttttctacacatgacaaaatatttcctcaacctcatggtaaggtgatgtttatttaggttggcagatctgagtttacttttcccatagacagaataaacctttaaaatttgttgggatccagctagcataagtgtaaaatggatagtatttttgaatttatagtcaccagaagtaattttgactttctggacttagtgggcttcttttttaaggtaattttttagattaatacatgtcaggaaagttcaaacatttccttctaataaggaagatatctttgaaatagtcttttgtaataaaaatgccattttatttatttattattattattttttgagacggagtttcattcttatcacccaggctggagtgcaatggcacagtctcagctcactacatcctcctcctcccgggttccagtgattctcctgccacagcctccagagtagctgggattacaggcacccgccaccacgcctggataatttttgtatttttagtagagacagggtttcatcatgttgaccaggctggtctcaaactcctaacctcaggcgatccacccgccttggcctcccaaagtgctgggattacaggtgtgaaccaccacctggccaccattttatttattttgggtgggcaaagggacagagtctcgcactgtcgcccaggctggagtgcaatggcagatctcagctcgctgcaacctccgtctccccagttcaagccattctcatgcctcagcctcccaagtagctgggattacaagcgtgtgccaccacacctggctaatttttgtagttttagtagagatggcatttcaccatgttggccaggctggtcttgaactcctgtcctcacgtgatccaccagcctcggcctcccaaagtgctacataacagacgtgagccacagcaccgggacaaaaatgccattttatttagttgactgtttcttgtgtgcctgattggaatatgtaattgctacaggggtgttttcatccttctaccttcatatcccagaggaactacaggctctcctaatccaaagttaaggtcatttggaggttccctctcctactgtgcccacactaggcgctcttggcccagttacccctaactcaggggttattgtcagctctccttctctgtgaccggcccacatctgagtgagtctggttcgttacccctaaatctctctcaaattattcatccatcctcattacggttgctccctcactctcctgtcttggccagtactagcctctgactgttctctctcagtctctttcacctgctgtcctctctgccccaggcgtgtttctaaaatagaaatgatcatgtgtgtcctctggttcggccttgcactctggacagagaccaatcttcagtgcttcctagtctgtgtccctcagaaatgcccctgaaacataatgtatttttttcttcagtgcttttgcacatgtttgttactgtctggaatgttcttctctcagcttcttcccctcccacaccaaatggccacctctctaaccgcccttcattccttgaaactcagtattgccacttctacagtaacctttgaagcctctccctttggctgatgcacttctgcccctttttttttctttctttctttttgctcttaaactcactgtattgtcatttatttgtttaaagactgtcttcagtggaccaggagctccttgaagacacatcatttgtcttacacgttctatgttgtagtatctagtatggagtctgaggaagtgctcaagtgtgctgaatggctaagaaatttgaaaacggtgcataattagctttaattaaaatctgaaggaactccattctgtttgattagcaaacatttctctttttgttttaaattttatttcattaacttaataggtgaacaaaatgtgtatttcaaatctaattgaaattcatctgaaacatgtttacacagaagatagatataagatttcaagtaacttattgtacagtccattgtccattttaagatattctttcttccaaaaaaactgcgttgaatgtcaaaaaaaatcttttatactccataaaattgagatgcaaacttctgatataaatttttttcactgtcaactccgatgataaagatgggaggcacaagcgttcacagttcagttaaatgatgcaaacgaaaagcttctgttttcctttgatacaaattagaagcctccattcaggtctcttacagtagtaccgcatacttgatcctgatactacattatgtctttttctttttctcttttttttttgagatggagtttcactcttgttgcctaggctggaatgcaatggcacaatctcagctcacagcaacctctgcctccctggttcaagcgattcttctgcctcagcctcccaagtagctgggactacaggcgcgcgccaccatgcccagctgatttttgtatttttagtagagacggggtttcaccatgttgaccaggatggttccaatctcttgacctcatgatccacccacctctgcctcccaaagtgctgggattacaggcgtgagccactgcgcccggatggttacgtctttttctttccctttttttacttccctctccttgttgaagactttggtcaccacctcctgtttttttgtgtccttgtttttaatttaggtatcatttatgctgcacacaacattactgacttaacgtggtgggaaatgtacaagatagaggctgccattttcctgtttgagctgggcccagattctgcttttatattgaacatcacgattccattctctagagaacattttatttttctcaagaaatgcattaagtccaactgctaaacatagatcttgaatctctagctgtaggattttcaacagtcttacttatggggattcaccttccttccacaatggtcttattatttaaatgagtaggacagatacaaataaacctgaacatagatcttgaatctctggctgtaggattttcaacagccttacttatgggattcaccttccttccacagtggtcttcttattatttaaataagcaggatagatacaaataaacctgtcctggtaggctggggaccacacggcagcgcaggccatcttcacaagggtccaaataccaacagcccggaagccacagggagagaactgagggagcgtttcaatctgatagtctatttagcttacagtacctggaagaaagaatataggaatctgtctggaggttcttataggtcagtactctaattcccaaaactagaagaaacctaatattccttagtaatctgttgatcatttatgtgaatgtaagtaagccctgatatggtctcctatcattctgcaaacatgcattgcttactgtgtgctgggcactgtggcttgcacactcccaacttgatagcattgatgcagcttctttaccaaagatagtgtttggggtcttcgttttgcagaataaaagacatcctataatttctctccatgttttggtttcacagctttatgaaaactttatcagtgaatttgaacacaggtaaaagcctctcatccgtttttcactttgaaaatgagtgcattgatgctcggcggtgctcaaaggctggtggcttttatttcagggtgaaccctttgtccctcgtggaaatcattcttcatgtagttagacagatgactggtaagtctcactttgttttataaaggagcagatccaaatggtggttaaaattgaaatataagttaactgaacttttgtgttttctgtatcagatattatgtttttattatactttatggtcaaaacctaaagattaccctacctaagggtgtcttggttagcagaaaccagtctgttgatggtccttctgattgttccttcttttccagatcctaatgtggctcttacttttctggaaaagactcgtgagaaggtaaatgtggcatgtgggcaataccttttagtaccttttagagtatgtatgacttaacagcttgtgttcatgctcactgtccagacctttagagaccacaaggcctctagtcatcaaggttaagttaatgtacaagtagctagcttcctttgttagtcaactgcccacattctgaggtttcttgtttttgtttttgatgtcttaggtgaaaagtagtgatgaggcagtgatcctgtgtaaaacagcaattggagctctaaaattaaacatcggggacctacaggttacaaaggtgagatcaccataatacagatttatctttggtttaaaattatttaaaaccctaggaaaaaaaataacctatttttcttctttactgtttattttaaaacatttttacattacagaaaagttgcaaaaataacacaaagaactactataccccaacctaaatttcccattgcaaacctttttttttttttttttttaaagacggagtctcgctctgtttcccaggctggagtgcaatggtgcaatctcggcccaccgcaacctccgcctcacgggttcaagcaattctcctgcctcaacctcctgagtagctggaattacaggcgcgtgcctccctgcccggctaatttttttgtatttttagtagagacagggtttcgccatgttggccaggctggtctggaactcctgacctcaagtgatccctctgcctcagcctcccaaagtgctgggattacagccgtgagccgctgcgcccagcccccccgattgctaaccttttaccgcttttgcctttgtgtgtgtctgtagcttttttccaaaaccacttaggagtaagttgctgatacaatgcctgttgcccttaaacaaaagagcactcccctgtgtgaccacagcacatccgtctaataatgactccacatggcctcagtcagcccaaagcacattggttctccctgaccaaggtcagcctacacaccactggcatgtcacgtgctatttctccatcttccttctgcctcctaaatgttgttgaagtatcctgtctatttttatgtctttcttatgttcaattatgttttggtgcagttgggagacaggtatggatgtgggtggcagtgaaaccgacatgtggctggtccacctggttgaaccagaacgtgtgtgtgtgtgtgtgtgtgtgtgtgtgtgtgtgtgtgtttgcatgtgtgttcgtgtgtttgtgtgtgtttgtgtgtgtgtgtttgtgtgtgtgtgtgtttgctaatcacaatgttaaagaaaatattgggggtaagggttaaagtgttcatgtcctcattgccctgaaaagatactttttattgtttattgtcagtcctaacccatatgcatacttagtgcattttattttcaaatattttaagacatattgaaagctataagtcacagtacagaatgctgtaataggcatccatgtgccccaaccagcttaggaaggaatgaagccacacggcacagtcagggtcccagtacccttcagaccacacttctcccccagccaggctccctctcatgcccatgcatttccttgtccttcattaaataggggtgtgtaactcaagcgttttaacattggctcaatactaggtttcagagtcatgtgggtatgtgtaaccaatgtgctgttactcctatacggtatttcattgtataagtgtttcacaacatatgtatccagtctcctattgaagagatttagggccaggtgcgatggtcacacctgtaatcccagcactttgggaggctgaggcaggtggatcacaaggtcaggagttcaagaccaacccagccaagatggtaaaaccccgtctctactaaaaccacaaaaattagccggg

SEQ ID NO: 554 - DNA, 28491 bp, Homo sapiens
tattacaggcacccgccactacgcccagctaactttttgtatttttagtagagacggggtttcaccatgttgaccaggatggtctcaaactcctgacctagtgatttgcccacctcggcctcccaaagtgctgggattacaggcatgagccaccgcacctgggcaatttttgtatttttagtagagacgaggtttcatcatgttacccaggctggtctcgatctcctgagctcaagtgatccacatgcctcagcctctctaagtgctgggatgacaggcgtgagccaccacacccagcctggggtgatagtgttttcgatctgatacctctttcatttcctgaaggcagttggcgtccctgcacccgccgtcattcctctgattttttccgtagcaacagcatcacctgggggcctcctacctcctgcgacctggggctgggcactgtcaggagctggtgctcaccgaggatgagaagaagctgctggctaaagaaggcatcaccctgcccactcagctgcccctcactaaggtgagtctggggggacttccagccctggatccatctccccttcgtgcacttacctgcatgtgtgtcccacctttatttatttatttagagtagagtctttctctgtcactgaggctgggatgcagtggcacgatctcagcttgctgcaacctctgcctctcagattccagcgattctcccgcctcagcctcctgagtagctgggattacagccatgcgccaccacgcccagctaatttttgtatctttagtagagacagggtttcaccatgttggccaggctggtctcgagctcctgacctcatgtgatcctcctgcctcggtctcccaaagtgctgggattccaggcgtgagccaccgcactggctatgtgtctcacctttagaacacccgtactagaatgctatgctgtgtctgtcaccagagccaaaacaatcagtcagaagccccattgtaaattcaactcagagggtaattatcaacatccaggaatgaatggcggactccaggtggcagcaatttgggtgcagcaaacttttttttttttttggagatagggtcttgctgtgtcccgctggagtgcagtggtgccatcatagctcacttcagccttgacctcctgggctcaagagatcctcccgcctcagcctctcaagtagctaggatgacaggtgcacgccactacacttggctaatttaattttttttttttttttgtagaaatggggtcttgttatgttgcccaggctgggctgggactcctgggttcaagtgattctcccaccttggcctcccaaagtgttgggattacaggcatgagccatcatgcctggccctgcagacatgttttgattggactgtactgcattttatacatttttgaattgcttgataatgtttttctgaccggtagattttacaagagaactcagtgacttgaggctgggcacggtggctcacacctgtaatcccagcactgtgggaggctgaggcagaggatcacttgaggtcaggagttcgagactagcctggccaacatggtgaaaccccgtctctactaaaattacaaaaattagctgtgcctggtggtgggcaactgtaaggtgcttctcagcctcccagcttctcaggaggctgaggcaggaggatctcccttgaacccgggaggtggaggttgcagtgagccgagatggtaccactgcactccagcctgggtgacaagagcgaaactctgtcaaaacaaaaacaaaaacaaaaaaactaaaaacataaacaaaacaaaatccaaaaaaccaactcaattacttgaatgtcctctgtttcatattctcaaacctccatatgcaccagtcaatggctgggtagctgtttgggttctctagctaaccacagtccccacccagcctgctgcactcagtatcaatgcctgagtttgatattctcatctgttttttttttttttctattgagacaggttctgactctgttgcccaggctggagtggagtgaggtgatcttggctcactccaacttccccctctggagtacaagtgattctcccacatcagcctccctagcagctgggactacaggtgtatgccattatgcctagctaatttttttttttttcctgagacggagtttcgcttttgttgcccaggctggagtgcagtggcgcgatctcggctcactgcaacctccgcttcccaggttcaagtgattctcctgcctcagcctcctaagtagctgggattacaggcacgcgccaccacgcctggctaatttttttttttttttttttttttgagtagagacagagtttcaccatgttggccaggatggtctcgatctcttgaccttgtgatctgcccagctcagcctcccaaagtgttgggattacaggtgtgagccactgcgcccagcatttttttttttccttagagacagggtcttgctatgttgcccaggctggtctcaaactcctggcctcaagcagtcctctgaccttggcctcccaaagtgttaagattacaggtgtgagccaccgtgcctggccccatctgtttctattgttgttgttgtttgttttgagataggatctcactttgtcgctcaggctggagtgcagtggtacaatctgcaggtagcagctaactgcaaccttgaactcctggtctcaagggatcctcctgcctcagcctcccaagtagctgggactataggcatgcaccaccacacccagctgattttgtggttgttgttttgttttagtagagacagggtctttactaaatgttgcccagtctagtcttgaactcctggacttatgcgatcctcttgccttggcctcccaaagtgctgggattacagcactgtgaaccaccgcgcccagcctgacattcccatttgaagacacttattggccgggtgtggtgtctcatgcctgtaatcccagctctttgggaggcaaagatgggcggatcacctgaggtcaggagtttgagaccagcctggccaacatggtgaaaccctgtctctactaaaaatacaaaaattagccaggcatggtgttgtgcacctgtaatcccagctacttgggaagctggggtgggagaatcacttgaaccctgggggtggaggttgcagtgagctgagatcttgccactgcactccagcctgggtgacaagagcgaaacaagaaagaaagaaagaaagagagagagagagagagagagaaaaggaaggaaagaaaagaaagaaagaaagaaaggaaaagaaagaaaagaaagaaagaaaggaaagaaagaaaggaagaaaagaaggaaagaaaggaagaaaaggaaagaaagagagaaagagaaagagaaagagagaaagagagaaagggagaaaggaaggaagggagggagggagggagggaggggaaaagaaaggaaagaaaagaaagaaacgtaagaaagaagaaaaaaattattaattagtcttaaaacacttgctgtcgccagggaaaggtgatgtttccagggatggccacaaggtggtggagtggtacccatgcccaaagtctggtgggcagttgcccattttacagtattgggagctgggaaaagaccctcagaacccaggcacctcccagagactctgtgagggtttgggcaaagggtagcttcaagtcattaggaatctgcctctgggtccttggctccgggatgtcttgtatgcaaagaggatggggtgaagttgtggggtcgaggttaggtgaagtggggtcaggacagtggggactgtcgcaccatccccaaagtgaagactttaattttttaattttaattattttatttatttatttatttatttatttatctatttatttattgagatggagtttcgctcttgttgcccaggctggattgcaatggcacgatcttggctcactgcaacctccgcctcccgggttcatgccattctcctgcctcagcctcccgagtagctgggattacaggcacccgccaccatgcctggctaatttttgtatttttagtagagacggtgtttcaccatgttggccaggctggtctcgaactcctgacctcaggtgatacgcctgcctcggcctcccaaagtgctgggattacaggcgagagctactgcccccggactccaagtggggactttctggcctgaaaccctcctccccatttcacttggcagtacgaggagcgagtgctgaaaaaaatccgccggaaaatccggaacaagcagtcggcgcaagaaagcaggaagaagaagaaggaatatatcgatggcctggagactcggtgggtagtgctggacccagactctacactcgtggaggaaactgaggcccagagagaaggagatgtggctaaggccacacagcttagagtctgacaaaattggaggtgattctcctctctgggagagatcatgcttcttactgattgcagggatggaaagatgcctagtgatggtgtaggacaagggtttgggggaccctttgccccctagaaggtgtgcggaaaaaggacaaagtgtgacccatcctattctgaccctctgcctgaagatagacacttcctttttgtgtgtgtggaagggtctccttctatcacccaggctggagtgcagtggtgcgatcttggctcactgcaacctccacctcccgggttcaagcgattctcctgcctcagcctctccagaagctgggattacaggtgcatggccaccacgcccagctaatttctttgtatttttggtagagatggggtttcactgtgttgcccaggctagtctcaaactcctgacctcaggtgatctggccgcctcagcctcccaaagtgctgggattacaggcgtgagccactgcgcctggtctctcccctttcttaaatgcaatctgctaagctcctgatcatctttatccagggtcattccccccaccaccctatgtcctgggtaattgtatcccattttacagacacaaaagctgagatcagagagtggagtggcccaaggtcatggggagagggagagatgaaacttgaatctcggccgggcgccgtggctcacacttgtaatcccagcactttgggaggctgaggcaggcggatcacgagttcaggagatcgagaccacggtgaaactctgtctttacaaaaaatccaaaaaaattaactgggcttggtggcgggtgcctgtagtcccagctactcgggaggctgaggcaggagaatggcgtgaacccagaaggcagagcttgcagtgagtcgagattgtgccactgcattccagcctgggcgacagagcgagactccatctcaaaaaacaaacaaacaaaaaaagaaacttgagtctcccaggatgcctggttgtcctgatatttcatcttctggaaacatcactgcctgaatctaggaggctcagcttttttttttttttttttttttttgacacagagtttcattcttgttgcccaggctggagtgcaatggtgcgatcttgactcactgcaacctccacttcccgggttcaatcgattctcctgccttagcctcccaagttcccaagtagctggaattataggcgcccaccaccacacctggctaattttgcatttttagtacaggcagggtttcaccatgttggccaggctggtcttgaactcctgacctcaggtgatccgcccaccacggcctcccaaagtgctgggattacaggtgtgaaccaccacacccatccagggggctcagctttgaatgaagccccctccatattaatgcagaaatgggacctaggaaccaggcagatgtgggttcaaatcccagccctgtctgacctgccgagtaaccttggatgaatgacttcccctctctggccttgggttctcttggcttgtaacgtgaggcctctgggggagatgtcagtggggccagctggtgactggcatatgctgaatgtcgatgcgtcttcctcctttcaggatgtcagcttgcactgctcagaatcaggagttacagaggaaagtcttgcatctcgagaagcaaaacctgtgagtctgggtccagctggggcagaggacaggggaagcagccccagagtccctttgcaggaagagcagagagcccatgtgatggcagaatgacatagggaataagagttttacctatgggccgcgtgcagtggctcacgcctgtaatctcagcactttgggaggccgaggcgggtggatcacctgaggtcaggagttcaaaaccagcctggccaacatggtgaaaccccgtctctactaaaaatacaaaaaaattagccaggcgtggtggcgggcacctgcagtcccagctactcgagaggctgaggcaggagaattgcttgaactcgggaggcggaggttgccgtgagccgagatcgcaccactgcactccagcctgggtgacagagcaaggctctgtctcaaaaataaataaataaggcctggtgtggtggctcacgcctgtaatcccagcactttgggaggctgaggtgggcggatcacaaggtcgggagatcaagaccatcctggctaacacggtgaaaccccgtctctactaaaaatacaaaaaaaattagctgggtgtggtggtgggcgcctgtagtcccagctactcgggaggctgaggcaggagaatggtgtgaacctgggaggcggagcttgcagtgagctgccatcccaccactcactccagcctgggcgatggagcaagactctgtctcaaaataaataaataaataaataaacaaataaataaataaataaaataaataataaagagccagaggcccttgaagaatggatggaatttggactttagcggggctgggggaccccggaaatggacgagaagcagaaccgaggccctttagggctcagcggaggcctgcctgtctctctaaggtccctcttggagcaactgaagaaactccaggccattgtggtgcagtccaccagcaagtcagcccagacaggcacctgtgtcgcagtgagtcctggtgcccccaggcaagccggggacctaggcttctgtagaggggcccatagggaggtgacaatgagtccaagctctccttgtgccccagctcaagtatgatccagtctggtctttggggcctcagtttccctgcctgtgggatggagatgcttgcaggggaggggagggagggggtgactctgccgctgtctccaccaggtcctgttgctgtcctttgccctcatcatcctcccctccatcagcccttttggccccaacaaaaccgagagccctggggactttgcgcctgtacgaggtaggggatccccacctttgaaacccttgtctggtctccccaagtccccgtcctgggcctctgggggagggggagaagacccctgtgcccttgttccctgaggctgggggccagggaagggagcataggaccccacctccaccttgtcccctgtgatgccccccttccccaatcagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctcccaggcccctctgcccaggggtgccttggggatgctgcactgggcagctacccacctggggatgggacgtgaggccaagaccccagcagagatgccagaatgggggaggcacagctcatagccacacacccagggcctgactgaggcccacgcaggaaccgacactcagacacaaggcaaagagggccacaggacccgggaaatacacacagagccaggagcagaagcaaagagcagacacacatacagcctgaaacagacctggacagacagacacagcctgaaacagacccggacagacagacacagcctgaaacagacccagacaaacagacagacagacacagcctgaaacagacccagacagacagacagacagcctgaaacagacccagacacagcctgaaacagatccggacagacagacagaaacagcctgaaacagacccagacagacagacagacacagcctgaaacagacccggacagacagacagacacagcctgaaacagacccggacagacagacagacacagcctgaaacagacccggacagacagacagacacagcctgaaacagacctagacagacagacacagattgaaacagacccagacaaacagacagacacagcctgaaacagacccagacacagcctgaaacagacccggacagacagacagacacagcctgaaacagacccagacagacagacagacacagcctgaaacagacccagacagacagaccgacgcagcctgaaagagacccagacagagagacaggcagacacagcctaaaacagacctggacagacaggcagacgtagtctgaaacagacctgaacagacagacagacgcacacacacaacagatgcgcagcaactccccgcccagggacccctcccggcctccctcgcacactgggaggaggaagccgccgagactgcagggagcctggccccggagccccgggtgcgccctggtctttggagcagccacggcccacaatcaccccccttttctaagactgcctgatccgaaataaagtattttgacagaaccttgttttggtgtggaggcggagtctggggctcctcgactccccagaaggaggggctgggccagcctgggatgggtgagtgaggtgtgggctccacacccccgccagatgcccgcgctggagcagcggagggagaggcgccgggcacgacttcagcaccttggagagcggcggcgggcggagtgcggggaggcaggcgtggcgcttccaaggtgtcccctccggagttgcggggaaggcagctgccttcccggggatctgggcggcccaccctgctcattttgcgggcgaggacaccgaggcgtcggaagtggagggactgcctaaggtcacagctggggagagtggaacccggctgctcctgcgctcgtctgtggggtcgcccccactgcgggctgtgcgcgcctgcccgggcgccatcgcaaaatcgcgcccaaagcacaggtggggactcatagcctgggggtaaatgttaaacaacaacaaaaagcatgtgcataagtgtataactacaaactgagtgctcagaaaatgccagctgccttattggcttcatcatcagaaaactggcctgatccctccagaggcggggtggggggagaggtgagcccttgttcctcggcccccaggcttgaggggcagggattgcaacggagcccaagcagctggtccagggaggaggggaccacgaactcctgacccaggggggcgaggacctgccacaaatagggaatttaaacactcactgggcacagtggctcacgcccgttaagtccagcactttgggaggccaaggtggcctgactgcttgagcccaggagtttgagaccagcctgagtcacatagtgagacccccatctctacaaaaaatgcaaacaattagctgggtgtggtggcacacacctataatcccagctactctggaggctgaggcaggagaattgcttgaacctaggaggcagaggctgcagtgagctgagatcacgccactgcattccagccttggtgacagagtgagactctggctcaataaaataaagtaaacacactgagatgcaagaaagaaattgtttttattgcattgaggacttttccagaagcctggtggacccacgtctccctccagccccaaaggcagtgcaagcctctactgatcccccacttcaaggtgggtctcccctcctgcagggcccatggaggaggggtagggtgggctgtagggggcccagaagggaggccctggggacagagggagttcactcctgtttaagctggagaccagggagggcccagcctcacctctggacaacacagcaagtcagaggctggggtgtggcaggggctcacctgtcacctctggggtgtggcttcttcccggaaccgcaccagaggcccctggagcccagggagggaccacggagggcaggtgtaacccctggcctggagcacagctctcagagccctgaggctcccggggacagaaacaagtaacaaagtgagaccacgagagaaaaagaatccacagtttctacaaaaagccccaccctccccaagcaccctggtcagctggggaccgccttggccttcacccttttggggggtctgtggggggcagggctggtgggccgctcccgtttggggctggcgggctctgagccgttgtgctgggcgcagggctcctgcttggggccggcggggatagagccgttgatccgggtgggagattcctccttgggctccagcttgggggtgggcgggcggggcaggggtggcagcgccctctccagcacacgggggccgtcccaggcggggatctccagccccaggtgcttcatgagccgggtcatgacctcgtcaacgtagccatggatgcggaggtcagcatggcggtcctgccgaggggcgggacgggtcaggcgtgggggacagagggtgcatggtggccctgggcaggggtaggctcagacacctacgtgcttggtgggctgcaggttgacgatgaccaggcggcctccccggcgcttggtagccagcggcaggttcccgctgggccggatctgcagcgatgtacccagcgtgatggacaggtcggcgttcctggggccggggagcgtgggctgagcctgatgccctgctcctgccaacatcccgagccagccctgggggccggttcacacctaggccatctgtgctcaccggggcggtcaaggccagccccactcccgagtcagcctttgggatcccgccctgccctcctctgcggtccgttggcggggtcattgatctgggcgggcccttagacacttccggggagtatcacagtgtggtaagagcttggacacctagggtgggaccctggctcggtcacctcccggctgggcagcactggatagaggagacacctggcggaagccttggtttccttgtgtagcacccacccagagccatgaggtgacgagtgtgtgtgagtgcgtgtgtgcagcccctggcctggcccacctgctccaggaagcctcccctcactgcctgtgagcctcagccactgtcccatgctggagctggctgtgtttctgctgtcgtcccgccccgccccaccatgggctccctgggggtggggggtcagacctgctggcctcatcggcgagtgccaggtcccggtcgggcagggagtcctcccagtctaggatggtgtccctcagctctcccctgcaatgaggaagctgaggagagtcctcaggggcctcgcagcctcccctggagcccagggcatgggtgggggtggctcacctgcaggctcgcagcccccttgccttagccacggtgcagagccggcccgtggccttcaggcccatggtgcccacgactgtgtctcggacgtactgcctgtgtcagggaggaagggggaggatgggaccaggtgagctcccatgggtgactctcgcactgtttctagggtgacgttctcccagggaggtggggggtggacaggtgaccagaactagcacccagcgacacggaacgagtagccttccatgaataacgggctgggatgctgctcggtgcccggagcacagaaaacaaagcaggaaactgtcccagacagacgaaggggctcgagagacaagacccagcatgggatcccggaccaggagaaacaggaacaattggagcatgggggcgacaggccgagtctggattcgggattagagaaggcgatgtccactttacttttcctgactttaatcgttatactgggccgggcgtggtggctcacgcctgtcatcccagcactttgggaggctgaggcgggcagatcacaaggtcaggagttcgacaccagcctggccaatatggtgaaaccccgtctctactaaaaatacaaatattagccaggtgtggtggcgggcgcctgcagttgcagctacttggatggctgaggcagaataattgcctgaacccgggaggcggaggttgcagtgagccgagattgccccactgtactccagcctggatgacagagcgggactgtctcaaaaaaaaggagaaacacagagataagaaggcccctgtggctgtaggtccaggaccaccaagggtggctggctgccaccagcagccaggaaaaggcaggaaaaatcctcccctacaggttgcagaggggcatggccctgcagacacctggattttggacttctggtccccagaactgtgagatcacaaatttctattgttctacgctgctcatctgtggcaggttgctacagcagtgccaggacacggatgtaccccccacaggagggaggcacggcccccccaaatccctccaggaggaagacatgccccccaaatccctccaggagggagacatactccttatatccccccaagagggagacacgcccccagatccccccaggagggccacaccccagtccccccataccctctgggtctctgggacatcggattcgacccccaaccccctctggcagagcccccacccctgcacccaggtggcactcacgtcttacacttggcacattcttccacaaacatgttcccgtggagctctgccagtttgtccctgtgggaagagcaggaagaggcttgatggtgggaaaggatccctggatgcccaggctttggagctggtgctaagcccctctcctccaggaaggcttcccggactcctctcccacaacattgatcaactccttctttctggctcttctagctcctggctccaccattcatctgctgtgcatctctgggcaagtggaccaacctctctgagcccaaggaatcattaacccccaaggctgaacccaccttagataacgggaagccctttccactcacaaaatgcccgtccccctccgagagcatatgggaacctcttgatgtcaccaggtcagaagcacaggaattcaaattcccagtttataatggaagaaaccgagacattgaatggccctgaagcatgagatccaatcccagctttattttatttatttatttattttgagacagagttttgctcttgttgcccaggttggagtgcaatggtgcaatctcagctcaccacaacctcaatggcacaatctcagctcaccacaacctctgcctccggggttcaagtgattctcctgcctcagcctcctgagtagctgggactacaggcgcccgccaccacgccgggctaattttttgtatttttagtagagacagggtttcaccgtgttagccaggatggtctcgatctcctgagcttgtgatccacccgcctcggcctcccaaagtgccgggattacaggcgtgagccactgtacccagcctaatttttctgtttttagtagagacggggttttaccatgtggccgggatggtctcgatctcctgacctcatgatccgcccgccttggcctcccaaagtgctgagattccaggcataagtcaccacacctgaccctcctttgcttttttttttttcaagacagagtcttgctctgtcacccaagctggagtgcagtggcgccatctcggctcactgcaacctctgcctcccgggttcaagcgattctcctgactcagcctcccgagtagctgggattacaggcatgcgccaccacgcccagctaatttttgtactcttagtagagatggggtttcaacatgttggccaggctggtctcgaactcttgacctcgtgatccgcctgcctcggcctcccaaagtgctgggattacagatgtgagccaccatgcccggcccctcgtttgcttttataagcagagaaaaatctcttcctcacccctcacccctggctgccgagctcctcgtctcaacaactgacctggctgtcattggttgccccaggggtgagacctggcaaagaggggcaggggagggccacacttttattgggaaatcagcctgccccagagcacaggttcacttcagtgtcagacacgtttagtgtcagattaataaagatggatattaaaaacacaacaggccaagcgtggtggctcacacctgtaaccccagcactttgggaggctgaggcgggcagatcacctgaggtcaggagttcaagaccagcctggccaacatggagaaaccccgtctctactaaaaatacaaaattagctgggtgtgatggcgcatgcctgtaatcccagttactagggaggctgaggcaggagaatcgcttgaacctgggaggctgagcggagatcacgccattgcactccagcctgggcaacaagaacgaaactcggtctcaaaaacaacaacaacaacaaaaaacaaactgcaacttctagaccctgacagctctcctccccttagccccatctcgagggaaattctgcctctggcctcagccgggacagctctgagccatgggactcagagatctccacacactgggccaagaactcagggctagaatcttatagaaccaggaaaaggggactctccccctaaaaatgcaaacacggtttgtggggccccaagctcttttgtgggggcggggccagggtgttacctggggaagcctgagcgcacatggagcccgtccacgttctggctgaccaggaagcggaggaggcccacgcgctccagctgcaccagcgccatgtgggtctgcgtgggccgcgcgctctcaaaggtggtgtcgaacttgggggccagacctcgctcctccatggtccagactccgtggggacccctgaaggtggcaggccgggagagatggacggggagaggggaacagaaaaagagacagagggagaatcagagaggtatagagagaaagttggagagagagaaaatcaggagacagagagagacagggagacagagagagggaatcagaaacagaaatagagggtgagttgcaagaacagggagagggggatagaacaagacacagacagagagataaagagttaaagacaaagcaagtcagagacagaattggagagagacagagagagggagaggcagagagagagagatgaattcacacgaaggcaaaaatgacttattctattcaaccaacactgctgctgcaatgagcccgacgatgctcacatgggcccaagccctgccctccagaagcccttgatcttgggggagacaggtggacacagatcctctggccccaagagtcaagcctggatcagaggaggtacctgggcctggggaagccccgtggaggtgggggccctggggcacgtggaagggcttcctggaggaggctaagcagtttcttgaagggtgagagggaagatcagacagaaggggtaaacaaaggcctgggtgctgggaagagcccatgagtttaggagaaaatgcaagtgttttgggggctgcagcaggagcaggaggggctgaagttggagaggtgattcagggctggggcaggaagggcttcagcttccagcacaaggtattcagaactctacactgcctggcaatggggagccacagcaggttatggaagaggagaaggaggagaaattcacgccttggctttttttttttttttttttttttttttttgagatggagtctggctctgttgcccaggctggagtacaatggcatgatcctggctgactgcaacctctgcctcccgggttcaagcgattctcccacctcggccttccaagtagctgcgattacaggtgcctgccaccacacctggctacgcttgcaaatatgaaagactacatttcccagcaacccttgcagccaggtgtgatcaggtgaccgtgttctggccaatgaggtgagtggaatgctggttgtgacaagggacacatctttttgttttgtttttagacggagcctcactctgtcgcccaggctggagtgcagtggtgcaatctcggctcactgcctccacctcccaggttcaagcaattctcctgcctcagcctcccgagtagctgggactacagatgtgtgccaccacaactggctaatttttgtatttttagtagagacagggattcaccatattggccaggctggtctggaattcttgaccttgtgatccaccatgcccagccaagggacacatcttaaagggagtacccaggacacatccaggaggaaagcagatggatgtgttctcattcccagatgtgtgtggctcgcagggaagcctctggcagcctggtaggccttgcctcgacttcccctgcacaatcacagacctgaagtcggggatgccagaggcagtgctgatgccggcacccgtgtggaacaccacactggaagactgccagaccagcctcgccagttcccacaccttccgctccagctcctccggggggtcgaagatctgtggggggagagagcagacggaggggtcaaaacagttcccccaagtggcaaggccacgcacgagccacagactgagctgtccctgtcttgcctgagggaggaaaatggattggaaaaggcagcttgtcctcatgcccctcctcttcctacaaccttccatgcctcccacctgccttgtcaaagccctagcccttcccacggcccaccaggccctgcactacctcccttgccccctccctgccctcttctcctccctctccctgcctcactctgctccagccacacaggtctcctccttgttcctctatcacaccaggcacagtcccgcctcagggccacaccctttaatgctcttcccccagatacccacatggctccctccctcacctcctgtaacttgtggcttagatgtcacttcagtgacagtgatgcctcccttggccaactggtttccatgcaacccctagtcagtctcccttactagaaggaggggtttttaatctgtgttgctcctggctgtggccttagtacctagaaagtgcctgagctacagtaagtgctctataaatgttggtggaataaagtgactaacaggccgggtatggtggctcacgcctataatcccagcactttgggaagccaaggtgggtggatcacttgagatcaagagttcaagagcagactggccaacatggtgaaaccccgcctctactaaaaatacaaaaattagccaggcgtggtggcaggtgcctgtagtctcatctactctactcaggaggctgaggcaggagaatcgcttgaacctaggaggcggaggttgcagtgagccgagatcgcgccactgcactccagcctgggcgacagagaaactccatctcaaaaatataataataataataataaagtgactaacagcagcagtgaagagtggggcttctggacgggcgcacaccatcagcgctcattaaatgcatgagtcagaatgcatgggccagccttatggaatggggccatcttcacctcgtttgcagaaagtttggagatggagacccaaaagggaagtgacttccccaaagtcccacagtgcgtggagggggcagccgatccctccacttcccctctgagtggctggagggatctttctggcacattctgtccagtcccctcgccagggcaaaacccttccccatcaccctcaggataaagtgccaactccccagcctggcatttgagccccgtcctggcccggctctggaaacctcccaggcctaatcgttctccaggtgtgtttattcccacctccctttgcgcctgtcgtcccctcttcctggaactacatcccctctctccccgatcagccccgacagggtgaccacagagttgggcgtgttggcgtcccccggcgcgcaggggcgtcacttcccgccccttcctcactgggaagtccctcccattgtctagcctcagtgccccctgatattcccacaatgcccccctgccatccggccgctcccagcccgcggccctggggcgcgatgctcgggaccctcagacgcgctcacctccgggaggccgcacttgcccttgtccgcgtacggcgacagccccgccgcgtaattcaccgacatcctcgactgccccacgggaacaataaagtttcccttgttgaggccgcttccgccggaagcggggcggggcggggaagaaggaggaaccgcgttccagtcctgcgcacccggcctcccacggcaaggcgcatgcgcctcttgctgacgccgcaggcgacatgttatctgctgtcagaaggaagcctgcctctttgcatgcaggtgtttgcggggcttgggaaggggctccccgatgacccgggcgggaaattggggcggccgcctacgtgagagttctccagtcacctctaaaatgcgggacacaggctatccatgtccccacaaccccttttacggattagtaaattccgtaaggacagagccggacagcagggaccccagcctaagggttttgaatgccacgcagagttacctgaatatctcatttgtgtgtgtgtgtgtgtgtgtgtgtgtgtgtgtgacggagcctcgctctgttgcccaggctggagtgcagtggcgcaatctcggttcactgcaacctccgcctcttgggttcaagcgattctcctgcctcagcctccctagtagctgggattacaggcgcccgccaccacacccagcaaatttttgtattttttagtagagacggggtttctccatgttggtcaggctggtcccgaactcctgacctcaggtgatctgaccgcctcggcctcccaaagtgctgggattacaggcgtgagccactgcgtccggccaagttatctgagtatcatccaactggaggttctgcattctgcaggacaggtcctgctcaaggtcaatggggctggtggcctggaggactcatttaagaatcatgtgttgagtacctactttgtactgggcacactggagagcaaaggtggtaccatctatgccctggtggctgcgggtggacacaaacatgtgaccaggtaatggtgacatggtgtggttggggtgcaatgggtgatgcagagggcacagggcagtgagggggctcacaggaggcacctgacccaggctgggggcatccgggagggcttcctggaggaggggatgttgcagcaaagatctaaaaagtgagtgagccgggcgcagtggctcacacctgtaatcccagcactttgggaggccaaggcaggtggatcacctgagattgggagttcgagaccaccctgaccaacatggagaaaccccgtctctactaaaaatacaaaattagctgggtgtggtggcctgtaatcgcagctgctcgggaggctgaggcaggagaattgcttgaacccaggaggcggagattgcggtgagccggagatcgcgccattgcactccagcctgggcaacaagcatgaaactccgtctcaaaaataaataaataaataaataaagagtgcatgagtcaggtagagccggttggggtgacatgaagtacagaaagaatgttcctggtggggggaacagcaagtgcaaaggctgagaaagaggaagagcatggctccttccagaaactgaaatcagtccagtgatgatagggaagatcgtgggtgtcttcccgccagagccagttggccaacaggcagtccgctgccagcctgtctcctccctcggctcatccccggccccctggggcggccgcctgctcagagccgatcaggtgtcagagtggagcggctggagctgctcgtggcccagctgggagtgggtaaccggagccggcagtgggcactgtggccgggagctcggggcactggagctgcaggaggtaggggaggaaggaggtgggagaggcccaggacggaggatccccttatggccccaggcccctgagcccttgtatgtgggagaaagaagccgtgctgagtcctagccaggctgcggagctacccaggtaccctgacacacacatgcactcgttcacccacgcacttcccacttgccggcctgtgccctgcctagcttcctccaaggcaggtgctcaacatcccacccggccatcaggcccttcttatttaccatcacctcttccagcaagcagcttcctaaatttagcaggcgtttctccctcccccaagcccacggattgtcttctcccaagcagcctgtgaactcctctgttgggtgtcttattaccccctgctttgggtgtgattgaatcctccagtcagaggtagaagaaaaaagggtaggtagtgagtgaatgggcaccggtggaggggtagatgaatggatgggtgggtggatggatggggggcgaataggtggattggtggtttggtagatgggtgaatgggtagatgtatggatggatgggtggatggatgaatgggtgggtgattgggcaaatggatggagggatggataagtggatggatggatggatggaaggatccatggatggactggtgggtgggtggatggatgcactggtgggtgggtgggtggatggatggattggtggttgggtgggtggatggagggatggataagtggatggatgagtggatgggtgggtgggtggatgggtggatgggtgtgtgattgggtgggcagatgggtggatggatggatgcttgggcagatggatggatgggtggttgggtggatggatgaagggatggataagtggatggatgggtggatgagtggatggatgaatggtgggagttggtaggtgtttgggtgggtggatggatgtgtgggtgaaatctgattaaagggtgatgaagaaccatgagaacatgaattgggtgggtgggtttgtgggtggtggccagtgggtggttatacagtgcttaggtgggaggatggatgtccaggtgagtgcataggtggtaaatgcgtggaagggtggcttggagaattcacgagtagataggtggacaggtagaggccatgccaacccctactccttggtaagaggcaaatacagattctccatcacagaaatccctttcacacatagggcctcacagtcacacccctcaaaaaacacaccccctcaagataggcctgcctgacctccgtgcctgcccatgcggaacgtagaacaggcccaggtggacagaagtgcacgtgtgcacacgccccacactcaacgtcacacacatgcatgcagccattgccccagacctccacccactatgggtgaattgctgtcacatggaggttccctctgactatgtagcaaacatgcctctgtgctgagagccgtcagccctggcttcagtccccagggagcccctgactgttgaaaaggacagaatcagcccagacccttccagcccatggagccaggggtgaggcagaggcagagacccagccagggtaggcgggaacccaatttggggagttagatctctgcttgggaacaagaggcaaagctgataagagcaagggattttggaactgggctttgaaggatgagtaggagttcagagaagaaaaaagaaaccattctaggcagaaataactgcacaggtaaaagttaggagaccagaaaaggcttgatctgtttggaccgcaggaaataccagtgagatgcatttatgaagcccctcatgtttggccaggctctgtgtagggaccatgctgaaaactgaccatgagttggtcaagaaaggatcatttctgtcactgtatagatgagggaagtaaaacagagagggcaagtaaactgccaaaggacacacagcaggtaggagatagagcaggtctgtgtcttgctctaggggccaggactggtcaggaaggaggaagcggtccttttgaggagggcgaggcaacggaccctgccgcccaccaggactggtgtccctcaccttacccccacccttgccctcctcaggtggcctgtggagaggagaaacacagggcaccaactatgaagactctcagggcgcgatttaagaagacagaggtgagtgtgaggccctagatgcccgatacacccctgcaacttcagccttctgtctcctggggcttggctgaagatccaccctttcattccagtacccacctcttctcctttcctctctgctgccccctagcgtcatgacctccccactgctccccgtacaagctttccagcccaggcctttacccaggccctagtccgctctccatggaattccttctcgccgcattgccaccaatcagaccctcctaattcctcacaatttggccccagtaccacctccccgtccaatctccgctctccccggccacagtaaccccttgcttttccaaggacccactttcccgaggatcctgatcttttgctttggtgtgtgtgtactcagcacatatttatatagcaggcgctgttccaggcacaggggaatcagccagggaatagggcaggcaaaaatccttgccctcgtggagccgaccgctgagtacgggagatgaacacgaaacaagataaataagtgacaatgtgtattttgtgtcgcaaagacagacaaagcaggaaaagggaattgaagcattcagggcaggggaggtggctgcagttttaaagagggtggccagggaaggcttcccagaggaggtggtattaaagcaaagattagaaagggaaggggagggctgggcgtggtggctcacacctgtaatcccagcattttgggaggccaaggcaggcagatcacgtgaggtcaggagttcaagacgagcctggccaacatggtgaaacgttgtctctactaaaaatacaaaaattagctgggcacggtggcgggcacctgtaatcccagctacttgggaggctgaggcaggagaattgcttgaacctgggaggtggaggttgcagtgagctgagattgtgccattgcactgcagcctgggcaacagagtgagactccatctcaaaaaagaaaaaaaaaagaaaaagggaaggggagtgggggagagagtttgcaggaattgcattccaagtggctggaacagccagtgcaaaggccctgaggtagatccagctgtcttctcttgcatccgtgtctttggctatgaactcctagaaagacatgcttcttcctccattgtccccattcttctcagccccctcaagtccctgtggcggccaattcagggcacagatggggaggatgaaagggagggctcacctccagggacaggcaatcagccttcctgagcacctctttgtgcctggcctgggtgggcaagcttgacttggagcctttagttttcgtatcatgggatacaacatccccatctggtgtggcctggagaaatcagggagtctgcctggaggaggtggcaccggagcagagcctggaagaatagggaggatttagagaagtgaaggcaggcacgtgaggagcggggcacggacctgtgtgggtaaagattcggaggctggaccaggtctgcttgatgcacaggcataacaggcagattctcttggcaggagcagagagtgcgagtgagtgggagctcaggatctttgaaagccatttttgaaaagccaaaaagagaggcctgtggaacaagcctggatttcattttttattttattttattttatttttgagatggagtttccctcttgtcgcccaggctggagtgccgtggcttgatctcggctcactgcaacctccacctcccgggttcaagtaattttcttgcctcagcctcccgagtagctgggattacaggcacgcaccaccatgcccagctaattttgtatttttagtagaggcaggacttcaccatgttggccaggccggtcttgaactcctgacctcaggtcatccacccgccttggcctcccaaaatgctgggattacaggcatgagccaccacgcttggtccatttttttttttttttttttttttgagacagagtctctttctgtcacccaggctggagtgcagtggtgctatctcaaccgactacagcctccaactcctgggctcaaacgatcctcctgcctcagcctcccaaagtgcagagactataggcgtgcaccaccacactgggctaatttttattttttgtacagatggggtgtagctgtgttgcccaggctggtcttaaactcctggcctcaagcgatcctcctaactcccacccagagtgatgggattacaggcgtgagccactgcgcccagccaagcctgggatagaatcaggtggctctgagttcaaatccttcctctgtccctggtgtcctgggtgactctggggatgtcatgccccctctgtggcttccttcagttgtttgggctcatttgatttgatttgatttcatttatttttgagacagagtctcactctgttgctgaggctggaatgcagtggcacgatctctgctcactgcaacctctgcctcctgagttcaagcaattctcctgcctcagccttccaaatagctgggactacaggcgcctgccactatggctggctaaatattttgtatttttagtagagacagggtttcactatgttggtcaggctggtctcgagcttccgacctcaggtgatttgcccgcctcagcctcccaaagtgctggaattacaggcgtgagccactgcactccgcccattttattttgtttttaaactatttattaattatcatgtacccattcatttcattattcatttttattttatttaaaacattttaatttaatatcattggattcactttattttttttaatttttctttcttcttttttttttttttttttttttgaaggagtctcactctgttgctcaggctggagtgcagtgttgtgatcttggctcactgcaagctccacttcctggattcaagctattcttttcttatgccgcagcctcccaagtaggtgggactacaggcacgcactaccacgcccagcaattttttttgtatttttagtagagatgggtttcaccatgttggccaggctggtctcaaactcctgacttcaagtgatccacccaccttggccttccaaagggttgccattataggcatgagccaccatgcccggccctaagtttttttttttaagagatggggtctcactatgttgtccaggctggtctcaaactcctgggctcaagagatcctcccgcttcagccaagtagctgggactacagatgtgcagtactgtgcccggcttatttattttcatttttgttgatttttgagcactataaaaaatataagatgtgctttgcaggtgtcagctcatttaatcctcaccaccgtgttatgaggcaggagcttttattatcttcattttatagatgagggagggaagcccagagaggttaagacacctgctcaaggtcacacagctaggaagtgagacacaagccttcccccagggctgcgttactatgaacatgattggcctggaggtgggaggggagtgcattgattgaaaagagaatgggtggagacagacagcgggagagaaagaggtgaaaaacggtccattaactgcctacaaaatgtggcattgggtgagcttcattcactgtggagtgatcctaaaatttttcttcccacgtggactcaattcctcgatgatagttgacccttgaacaattacagcccaccctcctgcacagtcaaaaatccatgtataggctgggcgtggtggctcacatctgtaatcccagcactttggaaggccgaggtgggtgggtcacgaggtcaggagatcgaggccatcctcattaacacggtgaaaccccgtctctactaaaaatacaaaaaatcagccgggcgtggtggcgggcgcctgtagtcccagctactcgggaggctgaggcatgaacctgggaggtggagcttgcagtgagccgagatggagccattgcactccagcctgggcaacagagcgagactccgtctcgaaaaaaaaaaaaaaatctggctcggcatggtggctcacgtctgtaatcccagcactttgagaggcagaggcgggcagatcacctgaggtcaggagttcgagaccagcctggccaacatggtgaaaccccctctctactaaaaatgcaaaaattagccaggcagccgggcatggtggtgggcacctgtaatcccagctactcaggaggctgaggaaggaaaatctcttgaacccaggaggcagaagttgcagtgagccgagatcacgccattgcacgattgcccagcctgggtgacagagcgagactccgtctcaaaaaacgaacaaaaaaatccatgtgtaagtggacctgggcattcaaacccatatttttcaggggtcaactcctgaatgctttttttccccaagcattcctcagaagtagtagccactggtaaaccaagccatatgattgcttaatttccaaagcatagttatatttaatatttaagtaaatctttcaagaagtgtgggtggctaaaaaagagatacctcattcgggatgtgggtgtgttttgatatgtttgcaatgggaggggtcgggacaaagtcaaaattggatggggacaggataggtgttaaaacctcagacgggtgtgagggcctctgagagtgtctggagctggaggggcctgaggttagcccatagcctgggctggaactgttgcagcagatgggaggcctggctgttgctgggaagctgcagggcctccatcctcccctcccagagcaccttgccatccatccctccacctgcccttctccagtttcgcagcaggcagccggagtcaagttcagcttttgttcagcagccccgagggaagaaagcaaacacccatgactgcaggggccaggcccccccctcctgtcactgggaccttgtgttccgtgtcttctagccactgctacccctctcctcctctccttagggcactctccggcctttcctggtccctaacaccggctttttcttatttatgtatttacttttattttattttctttcttttatttttatttatttatttatttatttttgggacagagtctcgctgtgttgccaggctggagtgcaatggcatgatctcggctcactgcaagctccgcctcccgggttcaagagattatcctctctcagcctcccgtgtagctgggattacaggtgcacgccaccacacctggctaatttttgtgtttttagtagagacggggtttcatcatgttggccaggttggtctcgaactcctgacctcagatgatccgcctgcctcagcctcccaaagtgctgggattacagacgtgaaccaccgtccccagcctatttatttatttattttgagacagagtcttgctctgttgcccaggctggagtgcagtggtgtgatcttggctcactgcaacctccgcctcccgggttcaagggattctcctgcctcagcctcccgagtagctgagattacaggtgcctatcaccacgtctagctaattttttttttttggtatttttaatagagatgggttttgccatgttggccaggctggtctcaaactactgacctccaatgagccatccgcctcagcctcccaaagtgctgggattacaggcgagagccactgtgcccaaccaacaccgtttctttctttggggtcccaacagttggcattgcttactctgatcccccttgggctgtccgtgggcctcagtgtttccatccataaaatgggagttacctggagctgttcacttggggcttcactgacctcctgcctttactttaggtttcaggaaaatctcccaagtgggaagattggggtttctagagagtcacagactccatacatcaatgcttcctggaaagtcctctttctctttctgtcttttttctttttatatttttattttttacttaagtatgcattttttttttttcagaggtgaggtcttaccacgttgcccaggctggtcttgaactcctggcctcaagcgatcctcccgccttagcctcccaaagtgctgggattacaggcgtgagccaccgcgcccggccaggcctcgtattttcatttttcaccgagccctgcaaaacctatagctggtcctgcatggaatacagcagtgactaagatagacaaaaat

SEQ ID NO: 555 - DNA, 45510 bp, Homo sapiens
gcactccagcctgggtgacagagtgaaaccatgtctcaaaaaaaaaaaaaacaaacaaataaataaaagcacatcaaatatattgtgttatcccactgatccaacaaaaaaatgtgtatatgcttatgtattattttatttttatagtttaatatgtatatttccagaaagatatgcaagaaatattcatagttaatttacttcattttacacccttatgcacagtttgaagtttttgtttggtagatttttatcacatgtgtattactttcattgcaaaaagaaaattgagatggaatttgctcagctgggatcatgtagtcatccagttacttttgggactggaaccagaccaggtctcctgacttgtctcttttgacttttgcgcactgccttctcttctaagctcaacaaccagacttagggcagagagggctctgcctcctttccatctgtccaatggctgagaactgggggtatgaaactgtcagtgctcagggatgatgacattctaggtttttgggcttctgcctattggattccttttctggctgcaccactaaaagtagataataagcaaatgacaaattccttctcttttctgagactcagtttccccacctgcatagtggtagcgtgggtgtgggtggtgaagtgaagctcactccttcaatgtcctgagaaccttttagctgatgctgctgctcctccaggcttgggagcatggggctcaggagttttcattccttgagccaggcttccccctgctggtctctgccagtagcgctcggtaagcttccagtaaagtgttctaactggccgttggtggggcaggagctggagaagctcgacatcctgcagtgggtgagacagttgtgcacagtgaagaattgtctcacctcctgcatggctttccaataaacagatgatctgagcttggaacgaactcccctttacaaacatcaacaaagtggtttgggtttgtgctgttttgtgttgttttgctgtgtttagagatggtctctgttgcccaggctggagtgcagtggcatgataatacctcacagcagcctccaactcccaggcccaagagatccacccacctcagcctcccatgcacctgggactacaggctggtgccaccacacctggcttgtttttgttgttgttttgcatttaagatatattgaattgcaaagaccctgtaaatcaagggatgcttgaacttagcttggtccagagcaagagttgttcaccatctcacaaaatcatgtcaccagtgccacttgtgtgggaatcaccttttcaacccacttgtgtccatctgcatttgtagccataactctttgcgagtatgtaaccaaggagctctgagacttctgtttaacagatggagaactaaatattactaaattagcacaaagatatatgaaatacagacactttatttcatttatgaaggctgtttaaaatatatattattgccatgttttatgtttttaaatttttggtagcacaataagaaagctatattgtgaaaaattatgttcttatttatgtatcttttggttgcctgttttttttcagcctgactgatactgtccccagatatctaccacataaattctctatgccccttatagtgtaatttttctttttcttttttccctcaatcatcttgtggtccccatcacctcctaaaggatatggtctccaagtgttttgaagaatcagaggccaagtgtatcttggacatgtggggagttgctatgggcctccacgacagtatgagtggctccaagtcctcaagtgtcactaaagctcaagattttgaccctatgcttatacacaaggcccaactcatttgcaatgctcacacctctcctcatcttcccttcttccacactttgtaatttcttttggtatgccattcccttctcagttaaccttattacccttcctctgttagtatacatgaataagtcgggtctgttctttaccttaatccatacctctgatctttttttgtctgtacttcctagatgggtatgacttctgctccatctattctcttaaatctaaactttattcttctaagtaggcatacacatctgacaatttcattatatcttctaaagaagtcatgcctcagcatttacatactgaaaagttttgttttatttttatttttatttttagatggagtcttgctctgtcacccaggctgaagtgcagtggcacaatcttggctcactgcaacctctgcctcctggtttcaagcaattctcctgccttggcgtcccgagtagctgggattacaggcccctgccatcacacccggctaattttttgtatttttagtagagatggggtttcaccatgttggccaggattgtctcaaacccctgacctcgggtgatccgcctgcttcagcctcccaaagtgctgggatcacaagtgtgagccaccacccccggccgaagttatgttttatgataactacttgcatttctcctttcattttacagttaaggtatcatattgatttgttaaatttaatttatcttgtctatgaattttattgcagagtagtatgaaatatttgtattcacttaaagtggaaagacaatctgcacacctggaggagatatttgcaacatttacaactggcaaaggtttattaccaagaatatataaagaagtcttataaatcaacaagaaagaagaaaaacaacagaaagaaatggacaaaagaaaaagcattttataaaagaagaaatgctcatggccagcaaacatatggagatgttcaaactcatgtgaaatgtaaatcaagacccaataagataagcttttatgtccactaaaatggcaaaatgttaatagctagacaatccaagtattggagaacatacagatccatgggatctcttacatatcgcttataagggtacgcattaggacataggacactcacttagaaaaagtgtggcattatcttgcaaaatcaaacactcacataggctgctgtgcaggtcctgagtctgtttgccctcagatccactctttgctatgcccttatgtcctcagttttccagcaggatctcggcagccatgtcatcttgcttccagttgggctcagttaataaaagagagagaatggaaggtggaaagaagggagaagccaaggtgtttctcaccagcaccctccccttctcctctcaggtaacatcccctgtggtggccacagctctccgatgggtccagttcccacaggaaagccagccatgattctaacttctaccaggtgaccctggccctgggctctggtgacactaaccttttgtttctctagtcctggggaggggtagtaacagcttcctgctattattaatttatggattgcctcattgcctcctgtgaggcttctcagctattgattaccatactactcagcaataaaaaggaaaaaactattgatacatgcaacaactttgtcggaccacaagagaattttaccaactaaaaaagccagtctcacattgttacatactatatgattccacttacataaccttctagaaatgacaaaattattgaggtgaagaacagattagtggttgccaagggttaaagacagggttggggttggagaaagaaatcagtgtacctaaaaagaagcagccagagggatctttgtggtgacgggacagttctgtatcttgattgtggtggtggttatacaaatctacgtgtaataaagttttatgtgtgcatagaactatgtacatactcaaacaaatgcatgtaaccctggtgaaatctgaataaggtctgtggattgtgccaataccagtgacctggttttgatactgtattatagctatctaagacattattatcaggagaaaatgggggaaaggtacatgtacttttctgtactatttttgcaacttctcgtgaatctgttactatttcaaaattaaaagtatctgaaaatccatagagtggtttctgttttttctgattagaccctgactgatactcctacaaccccacaattccttccgctcctagatgtatatttacctagcagataggccccagagaaactcataaatgcatgtgtagcagttattcatgacagaagaaaacccaaccactcataaataggaaaataaataaattgtggtacaaacacgaacaaaatcttatacagcagtgcagatgaatgtaatatgctatacacagcaatatggataagcctgaactcataatgcaatgttgagtgaaaagggcagggctcaggacattatttataagtgttttatcaatgtaaaaacacagcatttgttataaattttaaaattacctaaaatgatacaacatattgcttagatatatacaggtgcatgtgtgggtgtgtttttgcttatgttgctgtgatatttattattattttttcctaatcactagaaaatgtgggaattatattaattgttaaacataagggaaggataggtcaggcgcagtggctcatgcctgtaatcccagcactttgggaggccaaggcaggtggatcacctgaggtcaggagttcgagaccagcctgaccaacatggagaaaccccgtctctactaaaaatacaaaattagctaggcatggtggcacgtgcctgtaatcccagctacttgggaggctgaggcaagagaatccaggaggcggaggttacggagagccgagattgtgtcattgcactccagcctgggcaacaagagtgaaactccgtaaaaaaaaaaaaaaaaaaaaaaaccataagggaaagataaacacaaaattcaggaaagtggtcacagagcggacaggatagagaatgaacataggtgtcgccactgttccagttctcatgtggggaggcaggctcatgggtgttcaatatattatttgaaagatgatagatgatagatagatagatagatagacaggttgatggataatggctagatgataaatagatagatatatagataataaatagacaattgatagatgacagatatagatgattgataggtaaatagatgattgatagataaataggtagcagatagattgattgatcgactgatagataaaagcaaaagagagtcatgcaaagaccaaccaatgacagtgagtcatgaatcaaggatcacaacgaatggctctacgacttgaggtctactgcattatctatgtctccatttattattaaaaggaggtatggagtctaataactctgggacctccaatctaatgagaacagaaatccatgtgctctcggattcagaaaactgatgcccattcttgtgccccatcagggttcttctgaaagctttttggtttctcagactccagtatccatctgtcctatccctaggttccaggctttttctactctggacttgccaacctctcattagttaattcattttcttaacacaacttgctcagcatttagtatgtatcaagtgctcagacctggagacacagcaatgagcagaagacaccaggtctctgtcctcatggaacttacattttgtagtttggtggggcagactgggagggggtgaaagttgttcgggaacaaaagcaaataaacaagataataattacagcttgtggtcattggtatgaaggagagatgggagtgagaggggcaggcagcaaagcctttctgagaaggagacatctgaactgagaagcagagggtgcagaaaaggcaggactaaagctggggaaacagtgcagttccagaggggacagcgagtgcaaaggcctggaggcaggacagactttggcctgtttcaggaacagaaaggaggccactatgcctgcagtgtactgactgagggcatagtgatagcagactccagaggtcatttacagggagggcaccagctgtgaccaagatacaacctgagtctcctggcacttattttcctgtttgcacagattgcttgcttcctggtggtcataatttcctctacttctctgaatcttacccactcctatagaccaggtcctgcccatctcctcccagaaacttcctcaactctcccagctcttgggtatggggggcacctaatatgtgtttggcagtgggtgactctcttcactctcttacctccaagccagtatttcttaaggtatggctttctgaccatctgaattacaatcccctaaaatctacctaggttttaaaagtatttttagtgaaatatttgaattatggtgaatagaatactgatcattcatgtacttaatatctgcttctaagaccattaccatttgtccatatttgcttctgttttattttcattttttaagaaacaaaacacattacaaatacatacatgtgcttatcaaaaggtcccaatctggacctactcactcagaattcctggaagtaaagctaggaatatgcgtttttgcagattttacattccttcctcactccccttcccttacccacaaagtttttttttgttttttgtttttgtttttgtttttgttttttgagacagagttttgttcttgttgcccaggctggagttcagtggcgtgatctcggctcactacaacctccacctcctgggttcaaaagattctcctgcctcagcctcctgagtagctgggattacaggcacgtgccaccacactcagctaatgttttgtatttttagtagagatgaggttacaccatgttggccaggttggtctcaaactcctgacctcaggtgatccacttgcctcagcctcccagagttcagggattacaggcatgagccactgcacctggccagtggtttttatacacagtgaatattgacaattactgatagtgccattttcaatcttctcatccaagtagttcttccttatagctaatccagggggtctttgctatgcatgagaatcccctggggaatttttttaaaatacagatgtccaggcccctccctaatctagtaaaccagactgggcagggatgttaggaatctctgccattaaaaccttgctggtgggtttttaacggtagcagaggttggggcagaggaggacccacctcctgtctgaaacactcctggtgatcatcaaagtgaggattcagatgtccttccacttgctgtctcccagaaggatgtcaacaagcctttcctatgcccctgcggagtactgggcagggctgcaaccgaaagatattggtcaggcatgatggagaagccctgacctatgtccgggatgcagtttgagctcagacattaactcagtgggtggacttggaggtacggttggcagatctagcaaagaaataggatgactgcttaagttcaaatttcagatttccaacaaataattttttagtagaagtatgtcctaaatgttgcatgcgacgtatgtgtactacaaaatgatttgctgtttatttgaaattcaaatttaactaggagtcttttatctggaaatcctacttgagggagtatcttccgcgtctctgaacctctgaacctgtttccccatctgggaaatgagagggctggactagatggcctctgtgggtcatgacagcttagaggttaagatgcattgcgcaggtctaggagattttcttctcagccccagcagggggagccctaacccgcctcagccgcttcaccagctaatggctcagccaggaggcagccgggtcccgctggctctggggggccgtctggaaaccaggttgtaagacctgggagagtccaggtttgctcatccctaggacagcctattcagaaggagagaaagggagatcaaagtctctgaagataggaccatctcagccagcgccccatctgccaagatttagaagagaagactgaacccctagaggggtaggcacttttccaggttcacacatctgtcctgaaaattagattcctatcaccctgtccaggactcctttgcatctttagagtacctatgtttttctgtttccagctggaagtgtttaaccattgcagtcctgtagccaaaaccaatgcagaccccaaccagcccagtagagcctaacaggagtgagacagccccgcgtcccttcacagagggagtgtggtctggaagaaggaaacattatgactcatggataaagtacccgtctaggcagtgaggaaagagcagacccctcacatttaagttgggagtggtagttgatgatgatgatgataattattatggtgactataatgattatttattggctttctctatgctgggacacaacaacctatgagacaaggatcattatcgtcaggatttttactgatgaggaaacaagttcagagtgttgggtcattggactaatgagattccatccagttctgcagcaggagtgggagggagggctgcttccattctctggcccctttgacctgggtgcctccaatttcatcaagagcctggccaactcctcctcaatgaaaggtacagggggccaggattatctccaaaggacccacaccttcccatgaagagtcagtgcctaaaggaagggatgctcaccacttcagtttaggagatgattttaggagagttacgaatttggcattaagattgaattaattacagttcaattatcctttggtctttctatcaaggagaacatctctaagatttcttcttgaaacaagaaacagcattctttaagaagcatgaggcaaggccaggcagggtggctcatgcctgtaatcccagcactttgagaggccgaggcgggcagatcatgaggtcaagagatcgagaccatcctggccaacatggtgaaaccccgtctctactaaaaatacaaatcttagctgggcctggtggcacacacctgaggcaggagaatcgcttgaacccaggaggcggaggttgcagtgagccaagatcacgccactgcactccagcctggtgacagagtgagacaccgtctaaaaaaaaagaagcataaggcacatttataactgcataacattgttttttcattgtatgtgcatttttaccatatttacctttaaggtttatctctatggtaaatgatactaatttttcatctaaggtaatgatacaatttattttaaatgttaaaatttttgtttttttttttttaaaaaaattgatttgaagtggggagaaggacagatagaaggaggatatagaagctctacccttaagggttctggattctgagggaccctgttaactcagctgatgaattttgctgaagccagcagggcatgcagccctaccctgtcctcccgcccggggccctgagctgattcatacatcatggctctttgatgctgatttttttttttaaactttggagctccctatagtgaaacatccagatatgagggaggaagctccaggttccagttctccccctttatcggtgcctcatcacatgaccaagtcacccaagctccctgaacgtcagtaagttggtggcagagctaccgtgatagtaacatgtattccatgtatgatctgccctgggctgaccaagggacagactgcatcattcagtccacagggcaaatgttacatctcccacctacctgaaggagcacccggtccaagtcattttccatgatagttctctgctttatttcctttacagcacgtttttatcagaaacagtattgcaaatttatgtgtggtctgcctgctagaatgttagaaagctccaggggagcaaggatcacgcacgctgcctactcataagatcccctaacacattgcaggtacctgatgaatgtcgccgaatgactgaatgagccaatgctgaaatttacttcaattcctctctctacagattcctagagattatgagactagtgctgggcttgcattcctcaaatggccagcaccaaatgggccaatctctcctactgctcgccctcccactgtgtagaagagaacaccagaatacagtttgattttttaggagcttttattgttttagtaatcttaacataacttaaaataagagaggggaaatgacatctggagatctaggtatgtggcccattgcaattgagcacatttcttgggtctgtttctctatctctaaggggagtctcaaaaccccagctcaaaatacgacactaacatgatgaacatgcatgagctttgaaaagtgctctgtagtcttatgatgatctagaagagcactgtccaatagaactttctgtgatgatgaaaagattctacttctgacctattcaatagggtaaccactaatcatgcatggctctcaagcacttgaaatgttgctagtgtgattggggagctgcgttttgaatgttaactaatttaaatttaaatcttaaaaagttacatgtgggtagtggctgccgtacggaacagtacagcactagaataatgctgtgtcctcctgttacacatactcatggtctctcctactctcccttcatcacacctgtgacatcttgcaatttatatttgattgtgtcattatctaatgtattcctcctggactctaagctccaaatgaacaaatgctttgtctactttgccataactgtgtccccagtgcttggcatgggacctggtgcagagtaaatacatcataaatattttgtgaatgaatgaatgaatgaatgaccatgattaataaaaggatatagctgctcagtctggtgctgataatggtggtagtgatcaaaagggttaaaccacaggtcattaaatgaaaacagctaacttagtgcttacaggaaccatacactccctgtgtataaacatgccggtgtgtgtgtacaggtgtgtgtgtgcaaaagcataatgtgtttgcaaaggtttgcatttgtgtagtcatgtgtagacatgtatgctcatgtgtttttgtgtcaggataataaggtgactaagactaagacacatgcaaatcacccaggaaggcagtttctaagtcattactttttattttgaaggatttgtgaaactcttcacatcatggtgagagtttgtatgattaataagaagcagctttttcatgaaatgcttggaggtgaacgagttctcagcctgtgagatccgaccatcccattaactttgaagtttctcttgattaatagaagaaaaaaggggagggtgaagaaaaggaggaacatgctaaaaaccttatgacaatcatccaaatgtgaggaaagaacaaccgattcaccaactccactttttctattttacaactttctacatctcactcttgattttggccttcctggctgaaacagcctggcagtccctagagcccctgagaagagccctggttctccaaaagacagaggaggagaagccctgcaggatgcgctgaccacttcccagagaactgacagtccgtgctcccaaaagtttgaaccaacagcctaatgtgaaaagaaactgcactgaaaggtaaaggaggaaatggtgatgaactgggcttatgtgagaatgtctatattttcataacacagccccagaatctttctctcagttacagcctcaggcaaaccacgttctggttggtgggttctgcagggatctctcccaccactgagcctctagtcccaaaaccatccttgacaacatcgtgtgtctgttacttccctttgcccacctccaggccacctggggaagcccacaggcagccaagaccctgaaatgaaatgaacacaaagtctgactcggtaagtattagtttcaaacagaacactaaagagaaaagttgaagctgcaatgtgtgtttaaggcagagcccagcagatccgtgtccacccatgtgccaataagacaatgggcaaagctacaaatggcaagagaaaaatgggactattaatgcgtgtggaaaaggccttaatagttaagttacagctaagaatgtcatgtcttgggttagaattttcatttttagcaccgttaatgtattcacttaaatctatgttagcaccttgtctccaggcagaacaacaaaccatccaaacattttaaacattgggggaaacacgaaggggagggttaaagagagaatccggtactgtggaaggagtggatttagatcacaagatccttgtcgatatcctctgcaaagcaagaaaagagcacggttaaaaataaggctgtgtcgatgataacgcacttcccaaggagtcagtggactcccacccatccccaggggcaggggtctaggtggccatgcaaggtcacccaggaagtcagtgacggaggaatctcgctctctctgtctctggcctgtccctgtctcttacacacgctgccaagttacacttcctgtttcctctctgtgtgcctgccagttcccaaaatagtgtttagcacgggtgagtgctaacgcttgaggaagggaaagagagagggacagttggatggacagagaaggatcaggaagacgcccaagagacaggagtcaaataggcagagagagcagagacaggcagagaggacagacaacagacagaccaagagagcggagagtggggggatgacaacccagcaccctgggagcagtgtttctgcccatgccccttgcttctttgttcagacactcactctgcttgatgccgaagcagccggcccactcatccagggcgatgtacttgtcattgtccaggtcacaggtctcgaaaaagcgggtggtgcaatgctccatggggatgaggggagcacgcagtggagccagctcggtgtgggagaggtacctgcagggaaggaggcaggggagggcctgaggcatggaaaagctccacacccagccttgggaggcaaccggggagttagcctgccccagagcatggaggaaaggatatttaaagcaggacaaaaagccagaatcccaggtctacccctagctctgccactgactgctctgagactcagagaacagcagtgcaccattcggaacctcagtttctccttccagcaaagaggaggagatggccataattactaacggcccttccagctctaaggtttcagggtctcaaaaacaaaggtctgtttggtgtatttgattgtttcctaattggctgagaactggggacacagaaacttaaaatcaaaattcagcacttctgctatgggtagatcaaaatctagcatgacacagcactgtatattgtctatggacacacatttatacatctataaatgcctagtaaagggtctaaaaatgacacaccaatctggtgacagtgctgccttctggggaggaatgtggaaagggactgggattggcagtgagggtcaacgggagctctaaccatcttcatagagctttgcttgtgtatcctgtaatgtctgagagggaggccctttggatgtctctcccactgtcctccctccctattctccctgctggccttagactccagagcatgtgtataatttttttctttgtttcccagagcccccaactacttgtccctaaagatccacaaaggatctccagggaacaatgtgactccagttgtcttcttaacctctagacctcgcagccccacccagctcaccaaagaaatcacacaatgtttgaactgataggaacattctcctccccttcattgtactggtggaaaactgaggcccagggaggggcagggatgcaggcaaggtcacctacagccctgggatgggaggaggaggaagcgggtccccttgcccaagctggacccctttcccagatgtgctgttcttgcaccccatctgaaagcctccctccaggccctctgttgcagtgggatcaaattgctttgcctgagctccagatgttcccctttgacttttcccctccctgccataatgagtgactcagttggatcccagccatggcaaaagcctgggagagaagtggccgggagattcccagagcccaggagaccccagccctcaggatcactggcagggttggcagactccaggcacacaggctggacaaagagcgaggggtgaacatcctagagaggaagttccctgagtatgtgagtagggcagcccttcctttcccctctgtgtgatgctctgcttccacaacccaaggacgaagaaaaaaccactctgggaaggtgcaggtgtagcttgctccatctgaggctgagcaggggctctcacttcatcaccacaagagaagttcagaaggtagtgacaggttatgaacagagtataagtccatgagggcaaggaccatgccagctctgactgctgttcaatcccctgcctagaatagtgcagggcacaaaatgcacactccataagcatttgctaactggccagctgcctgcctgttcggcagtgcagttgcacagggcctcataactcgtttggacaagggacaagagccctcaaactgggggcttgcaaaatagacaggcttttttggataacttccagggtcagttgggccctattggggctgagccttaggagggggcttagacagtgccaggtggctgctctgcccctggatgttctgctgaaggacagggggcgtgtggctgacccaaccttgtcccctgccaccccttggagcctggtactccttcttaattcacactccttcattatccagatatccacgcctagtacttgcaggattatggagctattttgagctcctactgactttcacctcagcatgagagtgtcttatcggtttctttgtcccaggtccacatcttttctccagatgcctcatccttctgctccaatccccaggcaaactgtggatgccagggcttggagcagtataggctgctgagaggctttctggccatagctagtgcacctgccagccttgagctctgttcactctagggtctggggtcttacccgtcaatggggtgctggtccagctggccgaactgccagtgtacagggaagatgtacatgttatagttcttctcgaagtcccgggccagcagctccacggggtggtctcctgcctccaggcgcttctcattctcatggatcttcttcacctgagggagtagagactgtgtgtgacaagaggtccatggagattgtctggaccagtcgggccctcccacccctcccagaaggccagagcaggcagagactagccagaccaaagctcacagcgaggggagggaggtgtcatagatgggtactagcatctcattcacaaaaatagaagcctgggatgacctcaaagaattctccatatagctacccacatcaaaatcacctggcgaaggccgggcacacactcacacctgtaatcccagcgctttgggaggctgaggcaggcagatcacctgaggccaggagttttgagaccagcctggccaacacagtgaaactccatctctactaaaaatacaaaaattagccaggtgtggtagcatgcctgcagtcccagctactcaggaggctgaggcaggggaatcacttgaacccaggaggtggaggttgcagtgaaccgagatcgcaccactgcactccagcctggcaacagagtgagactttgcctcaaaaaaataaaataaacataaatcacctggggagtatttagaatgcagcttcctgggccttgctttctagagacactgtttcagtggcctgagatggggccaaggaatctgcattttatcagcttcttggggtagttaatatgctcattaaagcttaagatccacagactccaaaggaaaaaggaatagggctgtttgtgtctcttttgtttaacgttaggttaagcaaagggagcaggtctctgctgcaggacttctcagagcctctaagatgttaatgtgcaccacagcctccaaaggcaggaagagaagtacgtgtcctggtgctcaggggtaaatgcacgctccggagcaggatgccgccctgcagctgggggcccagttctaggaatgggactggatcttcaccagcacggggccagcaaggccagagagaccacttacccgcagcttctgcttctcagtcagaaggttgttgtcctcatccctctcatacagggtgaccaggacgttcttgagccagtcccgcatgcgcagggggaattcggtcagctcagagtccaggcaaggggggatgtctaggttccaaacacaagggcggtcagcacagaccctgcctgggccgtgctccccaccccaggcccccacccacccacataccacctgcattggtggccttggcacagtggctcaacctctccaggccacagtttcttcacaggacaatgagcagaggagattatgtgtgggaagaatgccctagaaatgcattgtgcaaaggcatggctgctgctttcctcagcctaatctgctctgctcagggaaatggatggctcctgcaccttactgggtgctgggctttgggtgtgatcctagctgagactgagcccatgttgttcacgtcaaccactggcaggtgtttgaagctgggaggctgagggatcacatctatccacaggcccagcttggcagggagtggggagtagaggactcaggaatgtgtaaccaccagaaccttcttagaaatgattccaacctggtctttggaacttagaatcccaaatgttggacctgaagatttcatccaagtccacacttttcttttccttttcttttcttttttctttttttcttcttttttttttttttagacagggtctcactctgttgcccaggctggagtgcagtggcacaatcacggctcactgcagcctcagcctcctggactcaaccaatcctccctcctcagcctcctgagtagctgggactacaggcacatgccaccatacccagctaatttttgtatattttccagagacaaggttttgccacgttgcccagactggtctcgaactcctgagctcaagtgatcctccctactcggcctcccaaagtgctgggattacaggcgtgagccaccgcgcctgacccaggttcacactttgtactggacttattagaggtcagcatggagagaagggacttgctcaaggccacaatgtcagagcctcatccagcatccagggcagtgtggtcacctgggggcttaggggtctgttcttccctcatcattgaaccagggaaagtcccctctgtgaggctaccttcatcatcagctggggtctgggagagaatatctggtgataaaaaccttaggagttgaagtgagtgggcaacatgcctcagggaaagcaaagccacttcataaagactccttaagacaggctctctagtcttgctgcccagggacttcctacccatgcttcttcccccaaccctccttttctactctgtaccttctcaatttcatacctggggtcccacgaggagaactttgtttcccaccccctacatacttttctgcaccctgtacacctgaggtaggtgagtggctctcctcattgccatcgggtgccagaatacacaagacccacagtgtggatgttgccttggagggggagcaggtgtggtcttgggggtctcccatgatagggaggatactgaacaaggcacttggccccactgagtttgcagctggggtcactaaccaaagatcagaccacaccctggcatccctccccagacaactgactcccaggtttccagaagagggtgcttatcctctctcttcggagggcagataggaatgtaatggagtaaaagggtgaagatatgacagtaccaagtaacagggcccaaagcaaaccgacaggcatgcccttattttaaagcattcaaaatcagatattttcaaaatattttgtaggcccaggtcaaacatcatttttgctttacagtgttgaagcaagaaagattcaacttagcctgagagaagaaattcttcctcattagagaaatgaaatgcagttgtctcagatgctagtgagagactccagaaatcttccctgatgttgaccttccataatcgctcagtccttccccagaaagtgccctgaactcagagttgagaggagccaactcatagacaattacctcattttataaatggggatgccgagactcagaaagggagagagatttgcccaagatcacccagcatgggggtggcagagacagcatcagtgccagctcagagctctctccccaagacaggagtctggaagggcccaaggacactcacatttgcaaggcccgatgtagtccaggtggagcttgtggcccttcttggtgccctccagggtgcactttgtggcaaagaagtggcaggaagagtcgaaggtcttgttgtcattgctgcacacctgttggcaaagcacagagtaccccctccttcattcccaaagcccttcgctgataccaatatccttgtccatttcagagatggggacactgagggttaagcaaggaatgtcattagcctgaggtcatatagtgagttagtgatagggctgggccacaaatccactttttgggttcccaggtcaatgctcagcccaggctgagagccatcgatggtctctgagcagaggcatgactgagtcagttctgagatatagggaaaaaaatcctggaagatatttgaagagaaagttaaagacaggaatgggagagaaacaagagtgttcaaagaagagttaacatagcaggcctggaattgttatccttagaaaaggcctgcttgtaaggtcagcctgtggctggtgtctgggaacttagctgggaaacagttctctgcactgttgtaaatctttccctaactgataagagtggctcgctatgcctggactgtttgtacaaacaatctggtttatgctgaacatctgctttccttctggaagtgtgaaattctggtgcatgctaggcaaagggtacctatgtgaccagcctccaattaaaactttgggtgctgagtctctaatgaacttccctggaaagaaacatcactcacatgtggctgcctctttgtagctggggtaagaatgcactctgatgacccctcttgggagtcagtcagtctccacccagattcctccagactctgctagtgtctttttcccttacgatccagctgtatatcctgaatatgtcgctgtactaaaccttaggtgtgagtacaactgtatgctgagccaatggagtcctagtcgatctctgaacataggggtggccaagcagagatgttgagggctggacatgcagtggccgtaagtagctgtgttaggaggaggggagcctgtgttgaacatcctgtccgtacttatttagtatagcttatatgtcactgcagagggagaactgatgggcactggtgactgggcactgggagtggggaggggtgaggaggaggaaaatgttaacaatgatattaaaatgtggagcccagaggctatgtagtctctggagaaactgaagatggagaagccagatgggaggctgtaggaatagtgctggccctagatttgctgccatgagctagactgccactagcatgatggtaggcaggagcaggcactcaaaaaatatttacttggacggatggatggatcctattggagagaagggacatatttgagagataatttaaaattaagtagcatttattggatacttgttatgtaccaaacatttctgacacatctccacaacagatctatgagttaaggactatttttatcctctctttggatgtgagaaaactgagacctgaaaaggttcggcaacttagcttaaatctcacacctaataagtgatggagatgaggtttgaagtcaaccttcagtttggccccagaacccgtatttttggacctgattctttgctgatgctgttatactcttagctctaagagtctggcacagggcttggaacctgatggtgctgtttaaagtcttgctggttgctgaaaagatccagtgccaggcagagcactctgactcatcccctctttcctgctgggactaggtctagcaaggggacttctgagactggcactgccccatagaaccaccaagccaacagtttcctgagcagacatcctgtattccgaagtgcccaatcccttccccctgcccctgtctctcagccctcaccttctcaaactcgccaatgggggctgggcagctggtggggtcctggcacacgcacatgggggtgttgttctcatccagctcgcacaccttgccgtgtttgcagtggtggttctggcagggatctgtagggcagaaagacaagggagttagcatcacctggactagcacatccacccccatcctacctggacagatctcagggctgacagtccttgactgtggcccccactctgggctttggacagccctgagtcctgcctgctcttgcactgagcctcacagtcaacatttagggcagcagctggttcagcctggggattagaggtttagcttgagatagaggtcaggcacttctggggggctggaggctcagtctgggacccagaaacactagataccatatggctttcctgaagattgaagcaaccattgtgttcctgggtctccattgaacaatcacagtggggcatttctggattccagaataagctttctagaatggcttagaaagtcagctgttgacactgagccagggagctgaggcccaacaaaacagacttaagtggcagtaaaggaaaagggagaagagcctcaaagtccatgctggacaatagagcctggtaaacaccggatgaggtgggcgtggaggcgggaaggaacatgactcagtagatgtccctctgttcaacagaaaccctgtgcccagctagatcaaataccattagctatcccctcaggatgagagcttaatgtggccttttcctcgcaatgctttattttgggtgttttaataatcctttagcggatgcctactcagcttgtctgaaaacttcccggcagccctgggacaagggtctgccatcttcatcagccccatatgagagatgagaaactgaggctccgagatgctaagcaagctggcgtggagaagcctaggttcaaagcttggttggaccgcttccaaagtccttgctcttaaccccttgagtacaaatgctttgcacctagggctggagccagagcccctaggtcatttctctcccagggcactaacgcatggatagcatggtacggattatgtcaggttgcatttcctcaggacctcgtttccttggactgtgtgaaatagaatgagcttatgagtgtgcaagttcctgatctcttctctcagttctacttctctgtggggcacgggctgatacagaagcaatgggagatttcggtgaccagatgtgatcagcgacctccgtgggactgggaaactcagctttggactcagggcaaagagctatgaggggagaagcccatttccagctggagaactctccttcctaccacacacatggatggcctggaaaccgatcttgcccagatcccaggggactgagtgccacagtttcccacttgttaagtcaaagccgtgtttccttcatagcccactgaggaccccaccctgcatttctgctggaaggagcctcatgtaggctgtcctcgtgccccaggcccaggcagccaagggcagcttggatgtgccaagttacagggaagggacatactttccgccaccacctcctcttcggtttcctctgcaccatcatcaaattctcctacttccacctggacaggattagctcccacagatacctggaattgagggagaagaatgggtgaaatggccccactcccatcccagacccataagggtagctgaagggttccaggtcacagaaagcacaaacgcagggttgggaatccagatttaatctataggcctgctgtgttttgcagtatgcctgggattctgttgagctgccttagaggtcaccaggggtgttagggaaagagagtgtgaaaggaaaatataccttggaccccaaaatcactaagctaaggggaaaagtcaagctgagaactgcataggacaaacctgcctcctattctatgcagtcatccctctgaggctcacctgagacaaacgcttatctgattgcttcctctcccctattgtttatgtaaaaatgcagattcactgagccagattaaattgtgtattcaggggaaggctgatcaaggactcaaaggaatgcaaccatttgtctcttatctacttctaacctggaagccctcacttctcaagttgtcttgccttagcgaactcaaccaatgcacaatttagacatgttgattgaagtctcgtgtctccctaaaatgtatgaaagcaaactgtactcccgaccaccttggacacatgtctcagaacttcctgaggctgtgtcacaggcacattcttaaccttggcaaagtaaactttctaaattgactgagatctatgttcacaagagggtgtcaagcctccacccctgccagccacacccaagcatctcccctttcctctgtgtgtgtgtgtgtgtgtgtgtgtgtgtgtgtgtgtgtgtgcttgtttgtttgtttgtttttgagatggagtctcatgctgtcgcccagggtagagtacagtggcgagatcttggctaactgcaacctccacctcccgggttcaagcgattctcctacctcagcctcccgagtagctgggattacaggcacccgccaccacgcccagctaattttttgtatttttagtagagacagggtttcaccatgttggccacactggtcttgaactcctgacctcgtgaattgcctgcctcggcctcccaaaggattacagggattacaggcatgagccaccgcacccggcctcctctgttttacgtttgcaaaaactgtgggtaatcatggaagaacaactgttgcatagcttaaaaaacaaaaattttaaggtcctggtccccaaacgtagggttccgttgaaggtttgggaagcattcaggagtgtgtcaggatgtgggatatactcagggtttgcatctatgctatgtgtgtacagggagacgaatgccccactctagcattgagacccacagcatccgccctaatttctcagggcacagatacaggtagagaggggctaaggggctgcggtcactgcccacatacctcagtcacctctgccacagtttcttccaccacctctgtctcatcaggcagggcttcttgctgctgttggaaagagaaagtagcgttcagaggggtcaggaataaggccagcttcacctccaaagtgcctgtggcctcggatacaggctaggggagcttggagagcagcttactggagatccccaaagttgtgcctcatggactgccatggtgagggacagaacaaagaagaagccagtcatgtgagcaccgtggaacactcaagcagctcccattttatatattttatatcctaggtgtctacctaagatttagcttggaaaagtatttctgctgctttgaattcttataaagtctgaaaatcactgatccagaccaattctttcactttacagataggaaaattgacatccagaggggatgacactgtgaattttaacagatgtcatcatcttcctcacagtgtgatattattagtagtattattaggcaatttttcttgccatttcaacttggagtaggaggaagcaagaaaacacacaactttgaggcccttagctggctggagctgcttcaaaacttaatgccaactttgagaaacttttgcctccatctaccagcctgatcaagattgccagggtctgccatcactcccacttcttagtaaacagaggatgaggggatcacaggttgaaagaaattgcactttttgcctgccctgtttcttcctcctctccttgtgaaggcttccagatgagctgtggataactactcctgtccctgcatgcaatgcttcgaggaactgtctgtcaatcaaggggccccactctcacctggccaagaagctggctcaggacccaagctcagccagattggctctcattttttgaatttataaaaaccttcttggcacattctctcaagatgtgaaaattgctggagttgattcattcagacagcaatatctcagagactgtccattagttcttaactcccaaagcctagagctgcccttttccagtcctccccaaggcctttaatattataatctacctctgtatcttcccctccttccccaatttagtcagattgaactgttgcttacaaccaaacaaccctcactgtttcagaagccaacacattcctctctctatagcttgaatctcttctaataccacccctaccagaaatcccccacatcctgtctcctgcctgcttgaattcctcatatgacaaagaggtcatttccttctaaagcaatcctagttcattgctgggaggctctgactactaagaagtttatctaacattacatggaactctctcttctctgatacctccacccaatggtcctcatcccagtttttatcccgagcttcctaacttaagaaaaaaaaaagaccactaacttgaaatggggaagtccctgttccctttcagcatccagggctggcaggctcagaacccctggtgctagcggtaggaatgaaaacaagaagacatgatatttaggtacttacaggggctgccaaggccctcccggccaggcaaaggagaaagaagatccaggccctcatggtgctgggaaccctatggggaggagagattgagagttcagtgagggtgagacttccttatggagatttccttctgaattcctgatatgtgcaagataatgttagatggtacaagttaaatgatagtgaaaaacatgaggaggttggttccatttaatattctttcaattctgcttatatgagaagaaagtctcagtttggtgccaagatgtcttaaacacctcctttatactcatctatctccttttttaacaaaaagagaataagcctccagctcagagcttccacaggaagttatatccagctggaactgaatcaagttgttttgttttttttatgtgtttgtttttacagtttccttctatttatgacaaaggtacacagagttttttccatttatggtagtgatataaaatctgcttttgtaatacatttattaaagtttttgcaaagtgattcaactaaggtgatgggctaactagttaagtttgggcaatgccaaaccagatcatcttcaaggtcccttcaatccctgatattctaaaattatttttttccctaaacccaatctctcctcttcctcctctgtcgcctcctccccctccttcctactccctctgcaatgggagaagttaataggcaggaacttcttgccagtttgggacaatgagatccacattctaaaacaaagaacaatagtcttggaatgtaacccatggaaacttgagggtggccacatttttctccattctacccagaagagacagcacttctttaggtcctgtacggaaaccatccagatgcttccatgtgttgcagaggggatgttagctgagatctagaaaatacctctgttctggtaactgttaaggcctcattctctaaatgccaagctctagactctaatactctcatgactataagggattttggagcagtatctcctctgaggattcaaaactaaaatgctattcctaacagaggctctgtggtggagacatttcatttcttgcactaactaaatggcttttcattctcaagtgactttagaaagttctttcttttactgatctaaatgtgcctccctcaaactttctgatctgtctaccccatctcccctgcagccacaaagaacaaacctgctctctctacccacaaataaccttccatcaggagcaacagtggccatgtcttccctctttcttctcccaaaacctccctgtcaggctcatcatcccttatttcttccaagacttctcaactgaccaaatggtggtgggaggtaacccggcatcatggagaaaaatactcagcttgaaattaaatgccagggggtcttgttctaccacagtagtatcaagtcttttggtctctctagaccttggttcccccatctatcaattgaaatgggtagactaggtgaactttgaagtggcagcctcggtccttaaaatgctcttaagacaccccaagcacattctggtcttgacacatatggtctcctctgggatcatatgtcttcacttgtactatagcatttgggaagcagaaacaggcagaggaagagcccacttcataatggtcctttcttgggcttaaagagacacaaaacctcaccccctattgcacagagtgaatgaagtaaaactaacagaaatgtaaaggacctgggggtttggtattgcttcacaataaccccaacttccagaggagtctagtcttcccttttgaggcagcttgtggaatgttcctcccctcacacagttgttcacttgttccccaggcttaagtggaaaaatctcccttcttgcttccccttttggaagacgcaagataaataactcctgcatgtggcttgggacaaatggaacagaaaagaaaacatcaaggaaggacttgtctgagatagtttgaggttgaaggatcaaagtgaaatagcagctaaaacaaaacaaaacaaaaagttaccctgtctgagctataatgacagggaagtcatgttattgaagaaatagcccagctaggactggaaatgtagtaagcttcagattagaaagacaggaagacagacatttccctgagtctgcgtccttcatatgagcagagtaaccgcgctcccctctgtgaccaggggaaggtttcgctgggcggctcttctgtctgtcctgcctcctcatcttcctgaattccttttccagctgcacactcaccctccctgccacccccatccctgctgttgcagccagaagagaaaaataactctaagtcttatagtgctgcttcatagtttctaaagcactgtcacataacactgtctcctagagccttctgacaatgctgggaagtaggcagacaggcatggaagggttcttagtcccactgtcctaatggggaatctgaggttgagagggaggaagcacttgtccaaagtcatgcaacaattcaggccctctccaaataggcaagcgttctcactcatggagttggggtgagcctaataggaattacgctcagacaagtgggagtgggggagaaatgcagagagactgttaagaacagaacgcaaaatcttggaatacaccttaaaagttttggaagaaaactgtaaacacaaacacaaaatctgggtcctgcccagcacccggtgctacaccaccagtccaagagcacttttcccccagatgatgagatgggagggaagggaagcggctgaactattccagatgcacagccatctccctgcctccccacgagatacctctctgaggctctctaaactaccactgaccaaagagccctgtgtccatcctgcaaagctaatggagtataacagtcaccccagcaaggtcagaacacagtatcaaaccccagcattcagaactcacagctgtgatcctttgccaatcaaacctaggtgtagcgtgcctggcgaaaatttaaattcccttcatataaatgaccaatattaaacaaaaactccctcctttgtatttctttagtctgtgatgatgcatacatttatcattttcagggtgttttcataatccagcaccccactgggggctcaagtcacatatttctgcccaatagtacagatgagaagaccaaggcctagaggaaaggagaaaactgccaacggctaacagcagtgagtgagtgactgggtggcagggctagggtgagaacccgtgcaaccctaccccaccactggtatgtctctacctctgcacactatttcccttggcagctacccgctcccaggtggtcacctgaatggggctcagttgggccttgaactggcctgagttcctgggaaggaaaatgcccagggccaggggaggaagagaaggcatatttcccttggcatggtggccatcaaatgcagacagttttagccccctcccagccgccactgcctcctgttccgtacatcgagtcccttccttttgcctttatttgctctggagactgctgaaaacccgtccttggctgccagcaggacctgaagctgaggtcacttctctctctggaaagactctgaggatggaaaagtacagccagcccccaggtttgtccctcaaaacataaagggcctcctttgggctctccttggacgttaaaaagccactgaacgttagaacaggggggatacctcagaatcatagaatcatggactgtgggtctcagaatgatagacttaggatgtgaagcaaagaaactgagttgccatcattaaatcttatttgggtggaaagaacttatggagtaatgcaacccaacaggacttcccaagatgatgaacacattctatatctacgtggtccactatgatagctactggttacaagtggttactgaatgcttgaaatgttgccagtgcaaatgaagaactgagttttaaattgtatttcattttaaccaatttttttatttaaaaattttatgcaaaaggactgaggccaatccaaaatatcttacttaacccataccttgttgaaatactgcaatagagaatagtggaaaacatcttttttttttttttttttttttttttttgagacacggtctccctctgtcacccagactggagtgtggttggcgcaatctcagctcactgcaacctctgcctcctgggctcaagtgattctcccatctcagcctcccgagtagctgagatcacaggcacttgtgactacacccagcgaatttttcttttcttttcttttttgtagagatggggcttcattatgttgcccaggctggtctcgaactcctgacctcaagccatccgcccgcctcagcctcccaaagaggtgggattataggcgtgagccaccatgcccatctattttaatcaacttaaatctaaatagccacatgtggctagtggctaccatggtagacagagtgataataaactatgaggcagtatagcataaaggtaagctcataggctctggagccagaatatacaggttcaaatcctggctcaccacttagtaattgtatgacctttagaaatcaactttacctcttggggcctcaatttgttccccaatgtgtaaaatggaaacaataacataccaatctttaaaggctcatgggtgatttacacaagagaatccaaataaagaggtaagcaatgttgtcgttgggaagagcatcttataaagtccgaggttcccagaatctccatcccccgaaagaattcagtgcaaaattccagtgctttataagcccagggagaaaggggtgtttgggtggaacaaaggacatattgcccctgttggtctgggtaagtccagcctccagaggatacagtgacgaagaccaggcccagggctggcctcttacttgggcagctgataccagccaagcatctcactctcactatttggcttggaaacaagggctccaaaaacacatgttgctggtaaacaagcccaaagagaggaaaacaagcctagaggctaataaaggaagccaagagccaggccctccagggagttgggactcggaaggagcctggggtctgctgacatggggaccgagccaggcaggccagagaggtggccacatgcagctacaatggcactcctgctcacacccctgggagcagacacagcagctcagaggtggcctcatgacgtggaagtcaggagagctgagagcaagtcagcatgtctcccagctcactgtgcgaattcaggggagtctcctctgctctccagaactaacacccccagcttgtctgtataaggtcagtgctcaaaattatgtaagccagaaaatcctttatttcaatgaagtcttctgcagagtccgatatttcaaacagctgaaatcttttagcatgtactgaaccatgtgaatgagtattatctagttaatcaataagtgtgaaattaaaaaacaagagcaggctgggcgcaatggctcacgcctgtaatcccagcactttgggaggccaaggagggtagatcacctgaggtcagcagttcgagaccagcctggccaacatgatgaaaccccgtctctactaaaaatacaaaaaattagccgggcatggtggcgggcgcctaaaatcccagcaactcgggaggctgaggcaggagagtcacttgaacctgggaggcagaggttgcagtgagccaagattgtgccattgcactctcgcctgggcaacaagagtgaaactccctctcaaaaaaatccacaaaaaagaaaagcagataaaagtggagtggagctgaggagtgggagtcctacacacagggacattccctaagataccttggaacatctgtactttctcctaggaacacaatatggaacccttaggcaaggtggtcctttaggttcttttcagctctgattttccggatcaacttgggcagaagctttttagagccttacctctctccacttgccccttgactccctgcttccacttctatttcctgctggaaggaaagacgctaaaggaaacttttaaggtgtggtagctaaaacttaggactggagagcttctggggcaactcagaggtggctccagagtttggggctggaatcagcccgagattccataaagacatctgagatgccacatttcactgtggctagcagaggctggggtggagcttcaggcttcatccttggctccctctagggcaccgctgctgcattgtggtgaccacaaatgaaaggatgagaaataacatcaaagtgtccaggctattgcatctggaaaagcctccgagatcccaaagatagcaaatatgtggcatatgtgacaaacacgtggcctccacctacccctcctgcacatgtggcagacattactaatcaatcgcttgacctcttctcctaaagcttagagagtcatcagaatcctgaacacagttcttctgacagccactaccgatgaattagtgatgttgtcaggccacatgaaacctctgtgtgctgcctcttattgtagaggtagagaaattgaggcttagagaaggaaaatacctcactggaggtcacacggcaagctggtgtctaagccaaatttccagatgttcaaaaacatccagatgtttgctttgctttttttatctgataggtctgaaatcctaatgccatgactaacatcaagatgacccagagtgatccccagatgagagaagttaataccaagtttctgaaagaaaccagctctgacaacaattgttgtctatgttcatgttttccttgcagacataaagttctatagcttgatgggtgagagcagagatgatttcctgtctaagctgccagttgaggagaggctgtttctctaaataattccgtcaagtcactacttgctggccctggccctgcacagcccagctgtccctgggttcaggattgaggttgggagggagggagggagggagggaggcatcagggtctgtgctgtagaaacaaggtcctcagggttgctgaaagctcaaggctggttttcccttctctcctttgaaactgacgtttgggagggagccagctagaagcaagggagcagccgcctacaggcacatcatgcagggcctttgggcctaatgacaaagccacgtgggctggaataggcattgcaggccagccaacgggagagacaaagtgctgctcaccacttagtatccatggggcttgtgtgcataagtgtgtttccaaactgaacaaatggggattgggggggaaggcaaggtgaatatcaaaatggctccaaacacgtggaagtttggctcagacgccagcttgctatgtgacctccagtgagttattttctcttcctgagcctcagtttctctctctctgagacatagaggtggttggtgataaatgtaggttacacgtctgtctcattgtcatgatccatattatgtttgactgtgcatatgtttgactgtgcacatccatccatgtgtggctgcaagtggcggtgtgtgtttgtatacctgatggcatgtctgtgtaagttacatacagcctgacttagcatctgtctgtttcagcctgtaataggcgagggtcagaattttcacattcattgagatatattcctggaacttgtctgtaaatcattgtcatccaggaagaggtgtgtgagtgaatgactttctgtgtctgctcctgtaatgaggcacttatttttagctgagccagtgggtgcctgttgatgaaatcgatgtttatactcttcatccctatgggtttgtacctgtccctgtttatctctgcatatttatctacctacataaacaacttcaaaagccaaatattctactgtttacctcacatcctcagctctttcctttccttcaccattctttcttatttatagcttgttttcagcaaggaaagctgctctcatgaatagcaaaccccagccacactgttgattgacaaatctctacagatggataaggattacagcatgatggttatgcaactcaagatcccctagcccatcttttcttgttttcttttcaactgggggtgcagtaaggcggtgttaaaaatgcaggcaagctattcctttgaataaaagcggtatctgggatttaggtttataggacttcagagttagaagggtgcctgggaaatcatctagcttagaaactctatttaacagtttgggaaactgcagcctcaagagaggaagtgtctttcccaatgtcaggcactgggagttagaacacacttttttttttttttttcacccttggccaatgcttttcctacatagagggcacaacagtcttgggaaatacacaagaagttccccaaatcaaaatgaagataaacaatattatgattttaaaatttttcctgtcagtacttctagtaaaggaaagttctatacaaaccccaagatgatggagctgccaggaaaaaaaaaaaaaaaaaaagctgagaatgatttcactaggtctttggatgcctttaatccatcagttctaaaaccctttgcattatgagggaatgccacaattcgcaaagtgcttccctgtgcattatcccatttcttctacacactatctaccccctagaggtggctgctgttactgttctttaactgtagagggaatggggcccagaaagaagtattagttcaaggtcaaatggtaccttcagggcacagccagagctaaaacccaggtcttcaaacacccttgcaaggagattatcatggcccaaggcttccccggaatcctgagagatcacaagggcagggcctagaatttgctgcaggccttgaatttgggggtggggtacgttcagactgatgttcttagagggtttcaagggtcccctccagccagcaggcagagaccctgaaaaaaaggttaccgtggcaactcgcattcctcggagagtgagtcaggcagagaagagccttctggtgggtgggacttggagaaagtttcaaaagttgattccttctccaggcaacccccttcttctcctccctccccctctttgctctaggctatgtcgatgtggcagctgatagctgagagttaactctctctttcctcaaccactcccttttcagaaggcttcatcctccagcaaatacacacatttgttaccagtcctcactccatccccacgtcatgccctctaatccatttgagaatatcttaaagctgaaagctgtgaccacccatattcatcctctctctctctctctctccctctctctctcacacacacacacacacacacacacacacacacacagtgcatacaatttttaggggcttagagatggcttgaggcccattcaaagaccactccatagaccctggttaagaaatcttcctttgaatattttagaggacacaaagcaccccaaagagccttcagtttcagccttctttcattacagatggggcactaaatccaggggagacacttacctaagatcacacataaaatgcatgcccgaagcctgtgtcctacttctgctttgcttctcactaaaccaccagcacttggggcgtatagaaatttaactctaaagcattactagagaaaacattttctctaatgaaaaaaatgctgtcctttcctgaggaaaatgcatgcctctctgttcccttttgggcagactgggaatcctggaagacataactcatcccagtgccccccttcccttggagtccttggagtccctttccctaaggaagtccacttgacagccagttcacggagccagtggcggcgaagaaaggtagtggatttgtctgaagaagaactgacaccctgacaggctggacactagtcttgggtggattacggaaggggaccctggaattctctccctcttcccttccccctttcccccttctgagaatatctcccccagcacactccacctcccattacacccatgtcttggttgacgatatctgatgtctgggttttcagatctagataaactaagggctactgcctgtgtttaccatcccaaggaactcaggacaggaacaacacctaacccaagactgaggttgtgatggtgccatttcaggcagaatggtgctgaaatttgtgtattggggggacggaaggtggtgtttgggagtgaggagaattagaggaaaacagaaggcttcccagaggtgtggattaatggtgaagcctccccctttgcctttcagagatcaactgattgttcgtgcaaagtcccttttggaaaacagaacccctgaccgagatctggaggacagactccggttgctggccaggtccctgtggcagctgtgatgggatcagattcccaggaaaggaggaggctgccacatttgcaaagggagcaaagaggacaggcaggcagcctctgaaaccagagacagacacagagaaaaacagagagtgagaaaatgctcccccgaagacatagtgagattattttctgtaaacctgtaagggaagacaaagttacacagtgagtccaccttctgaaaagcaacaggcagacaggaccgagggccatgctcttaaggggagccgtgatggagccgggaggagaggcgcatcctcagcagagcttccctcccttgcacacgagctgacggcgtgaacgggggtgtcggggttggtgcaactatagaagggaaaggctgggcgggggtcacacatacctcagtggcaggcaggcaggcggcaggcagagcgcgctctccgggcagtctgaaggaccgcgggaatgtggaggggtttagagacaggcaacaggaaaccactcagagctctgggctgggtctatctcccctccaccccgtggtccctcctcctcctgtctcctccttcccccggcctcctccttctcccatagccaaagctgtctctgtctttcatttctttcctcctctttttgcggtgggctgtcctgaccaaacgtcccaaccctgcctgcctcatctgttccggggctgctgcctaaaccgactcacagagtgccagggctggacaggcctggagggatgacccagaacagcctctttcttgttcagagggcaagtgaggcctggagactgcaaggaattacccaatggcccccaggggcagaaccaggcccaagtgtcttgatcttctaaccagtgagctttacaggagtcctccctaatattaggcaatgctgagaagggccaagcaattcaagggggttgtatttgccacaaaggcaaggccaggacttaccactgtacagacaagacaagctgctactagtggtatcatccttgatgatttggaactggtcttaaaaaaaaaaatcccactcaaactccacttgtaccactaatagacacataagggattagacatctagctggtggacctgtgccaccagtattgaacagataaggtaattgatgatattgatgataatcataggagtaacaatagccaaagtttactgaggatttaataatcttcacagcaaccccttatcttaggcattgtaattatgaccattttaataataaggaaacatagatgctaagtaacttgcctatgatcacctggcaaaaagtggtatgagagggctgattctacgtttcaacttgggtcactcctgttatatatgaactgctcagtgcaacaggtcttggttgaatgtttattttgtgcctaacactctgggaggtatgagaattaataaatacctggtccttgtcctcaaaaagttttgtggtttccggtttttttgtttgtttgttttgttttgttttgagacagagtctcactcactctgtcgcccaggctggagtgcagtggtatgatttcggctcactgcaacctctgcctcccgggttcaagcaattatcgcgcctcagcctccagagtagctgggattacaggcgcacatgccacaacacccagctaatttattgtatttttagtagaaatggggtttcaacatgttgcccaggctggtctcgaactcctgagcttgggcaatccgaatgccttggcttcccaaagtgctaggattacaggcgtgagccaccgcacccagcttagctttgtggtttcttaaattcttttttaatttttttagacgagttaagtgcagaactgagaagggaaaaaaagtacaaggaattcaatctgtgactgtgaacaatcaatcgagataactcactattcaaggagctttggatcttgctgaaaggttgtgccttacacatacacccacttacatgagtggtacagactctaaggcttatcccagggcttcagattggtggattcctgaaagaggtggacctggaagcatgggttgggtttgaataccatggaaaggaagaaggcagagaacaccctcatgatacacttccatccgctgtggcccctgtctctcttgccattctctcctcctaccactgtcctctgtgcccacgctgctccagccatgccaacttccttccagtccttcaactaccccaaagcttctcccaccccaggattttttttttttttttgagacagactctcactttgttgcccaggctggagggctgtggcgcaatctcaactcactgcaacctccacctcctgggttcaagtgattctgctgcctcagcctctcaagaagctgggattacaggcatgcaccaccacaccaggctaatttttgtatttttagtagagacagggtttcaccatgttggccagactggtctcgaactcctgaccacaagtgatccgcccgccttggcctctctaagtgttgggattacaagtctgagccaccatgcccagtatctttgcatttgctcttacctctgccagagacactcttccacctgattttcctgtgcctattctaatgtcacctccttagggccactcaatctacttgcctctctcacaggcacagttcatcgccttacactgttttatttcctccccatcacctgtcattctcagaaaccatttgtttccccaactagacagaagcttggtgagagcagggacttcacatgtctgtttactgctttgttcccagcatgttgaccagtgccccacacaaagctggcttgcaatattttattcaataaatatatgaacttccgacttgcccatctgaaaaaagagagggttgtcttttactagggttccagcctggaacactgccccacacccaagagaccctcaaaccactaaagtggaatataaaagttagggtgtttggtccttttgagaacctaaaggaagcaatgaactttctctgcagaaaaatccacaaacacccaagaaggagtcttctccaaatgacccccaagggccgggtgcagtagtatgttcctggagtcccagctactctgaggctgaagcaggaggattgcttaaggccagaagcctgagactagcctcggtgacagagcaagatgctgtctgtaataataataaaataataataataataataaggccaggcatggtggctcactcctgtaattccagccctttgggaggctgaggcaggtagatcacctgcggtcaggagttcgacaccaggctggccaacatggcaaaaccctgtctctactagaaatacaaaagaaattagttgggcatcatggcacgtgcctgtaatcccagctacatgggaggctgaggcaggagaatcgcttgaacccaagaggcggaggttgcagtgagccgagatggcaccattgcactctagccttggagacagagcaagactccgtctctaaataaataaataaagaccccccaaggcctctcaccctggttcaaaagccaagtgcttttggctgctgaatacagggtgctggtggactctccacatatctgttttgccatccggacagatgtatatttttataggattggttgctatagctcccaggcattatgggactaaaattagcagaagctttgtatttttattcataaactaaaatgatgattctgatgaggatgaaccagtggaactcttcccagtttttggctggtgttcccatgtggctttcagttcaggaagtggaagtctggttggggctgggctgaagctctggaagagagatccctcctgagggccacttccaggtctctgtggggacaccctgagccagaatcactcccagaaagaaaacttggtaggttttatatctaaggataagagcacatggctgggtgcagtggctcacacctgtaatcccaacactttgggaggcagaggtgggtggatcacctgaggtcaggagttcggtgaccaggctgaccaacatagtgaaaccccgtctctactaaaaatacaaaattagccaggcttggtggctcacgcctgtaatcccagctacttgggaagctgaggcagaactgcttgaactcaggaggcggaggttgcagtgagctgagatagcaccattgcactccagcctgggcaacaagagtgaaactccacctcaaaaggcaaaaaaaaaaaaaaaaaaaaaaaaaagcatcctggggcaacaggagcctctgaagcaaggatgactctgacctagaaaggaagaccactaggactaaggctggtcttcctgccacctgccaagggctttataggaagggagagaagcacaacgcagccaggtgtgatagacctgggtgtgagtcccactctgctattgagtcactgagtgactttgggcccatccctgcccctctgaactacaccttttctttctttctttttaattgtgttaatagaggcaaggtcttgctaggttgcccaggctggtcttgaactcctggcctcaagcaatcctcctgccttggcctcccaatgtgctagtattacaagcatgagccattgtacctgaccctacaccttttcatttataaaataggttggacagcagaatagtagtaataagagccagcatttattaaacacctactatgtgccaagcacctgctaagctctttgcatatattgtctgacttaactcttataaatctggaactgttattattcccattttataaatgtggaaaatgaagttcatatcaataatttgctcaagcttatgcaccaagtatatggtaaatcagagattcaaatccaggtttaagggacaccagagcccaagtgcttgactactgcacgctacttccccctcaactcctctccagctctgacatacgtggacttcagaccatacacccctctcccgagtcaagaatgttgctgatccaacattaggctgaatcagcttttcatcttgtaaagcaatccatcagtatattggggtccctgctgcctgcccactgccctctccaaccactctccagctatgctcttctaggcacttctcactttaccctgatcctgccctcctgacctagcaccccagccacagccttagaactcaagggactgcctgggaaatgtccacatgtgcctgccatccaggctccgtacacccccagtacatcagctacctcgttcgttcattcagtctttattgtgctttgcatcaggcactggggatatagcaataaataggacagacaaggctctgccctcttgcactttacattccaataggtgaaggcaggccgtgagctcatttcaggttgtgatcagttctatggaagaaacaaggaagatgaaatgaaaaagcaatggaggatgacttcagatagggtcattagcataggcatcttggaggaggcaagatgaggaagatgttgaagcatgagtcaatgagaagggctgagagaagagtactcaaggagaggggagaacaagcaccaaaaccctgatgtgaggagagcttggctttttcaagtaactgaaagtgtggctagaattacctactgggggagatttcccatctcctcccgttcttcctcgtccttttctcctccattttcctgttgttcattcctaccctttttacacccttttagccacttcaacatactttcttgtccactatctcagtgaatgccacagcagtcctgtgaaagagttagggtagggattagaacctatagtgtagatatggagaaactgaggcctctatcactcagggaagctggggctcaaaaccaggtctcctgactcctggctaaaaaccagattcttaaccacaccaagaacctgcttgtctttctgctcactgactccagagactctgtcactagctctgagaccagcctatggaccacctgatgaaccatctctgggagctggactggggccaggtaaactattcctacacagggacaggaatacttgcacagggagcaagaggtctgaactctggaaatagagcaggaaggctctgtggatttggcttctggcaaggaggaaagcaaccaagcataaagttaaacaaataaaagccggacaaagaaacatcccctaaggccatgcattaaaaacagcatcgggatctcagcagttcagatctccaggtcataactcctgagtgagcctttcgggttaaaaaaactcaacaaaacttacataggagaacttgagggcccatgagggaccaggtttcattggagcaattgtcactaaactgagaaggcagacaatcatattcaatattacaaagcagatggtgggcaaaacactttatgtccattatctcatttaactcaacaacacttatgcagaatatttgtttttctatcattactatagtaaattaccacaaatttggtgacttaaaaacaacacaaatttattatcttatagttttggaggtcagaagtcctaaaatcaaggtgtcgttgggttccttccggaggaaggatgaatctgttgaggaaagaatctgtttccttacctttttgttgttgttgttttgttttttgagacagagtttcactcttgatgcccatgctagagtgcaatggtgcaatcttgccgcaccgccacctccacctcccgggttcaagcaattctcctgcctcagcctcgagagtagctgggattacaggcatgtgccaccacatctggctaattttgtatttttagtagagacagggtttctccattttggtcaggctggtctcaaactcctgacctcaggtgatctgcctgcctgggcctcccaaagtgctgggattacaggcataagccactgtgccctgcctattttcttacctttttcagtttctagaggccaccctcattccttggcttgtgaaccctcactctgtcttctaagcacatcactccaactctgcttctgccttgacatcttttcctgactttgaccctctggccttcaacttttaagaacccttgtcattacattgggcccacctaaataacctaaaataatcttcccacctttaaatccttaaattaatctgcaaagccccctctgccatgtaagatagcctgtttataggttctgaggattagggcacgtccatctttggaggggccattactttgtctaccatagatgggtacaattaccattctcattttaaagatgagtaaagaaaagttctgagaactaaatcacttggtcaaggtcccacagtggagaagccaggaacacacacaggtagctccactccagagccctctctccatgacttccccaggtactcaactgcccattctgcccttctggccatggctgcctccctgcccccactggccccaaacccaaacccattcatccttcaagctcagattggatcgcttctattttttcaaagcttagaactgacagggccctttagccctattcaatcccagattttccatgtgtggctgggaaaattgaggtttaaagagcccaaggttacagtgtggacagctaggcctggggcctctctctcccaggctgaagccagctctggcctgttccaaatctccggagggagggactgggcaggctgacctctttgggatggggattatgtatcagaactctcaaatataccctttgtgtggctggctgaatgtcaaggctgccaagctaagaaggttcaagcacattggaggctgactcagcctgttgccttgttactgtatctttccccaggcagcccttcccattgtctgaagggcacaaagaacccattgtcatctggccctgggtccccgaagcagagcatccaccaaccaggccaaggccaaacagaggaagatgaaatttaacctcagcaccctccccacttgcaacacacccactgagcagttgaaggtttctcctttagctctttgtagctcacaaaggactttttttttttttttttctgagacggagtctcgttctgtcacccaggctggagcatagtcgcacaatcttggctcactgcatcctccacctcctgggttcaagcaattctcctgcctcagcctcctgagtagctaggattacaggcgtgtgccaccaggcctggctaattttttgtattttttagtagaggcagggtttcaccaagttggccaggctagtcttgaactcctaacctagtgatctgcccacctcagcctcccaaagtactgggattacaggcgtgagctaccgtgtctggcccacaaaggacttttatcaccctaatcttattgagtggcacatttagtctacaaagtagaaaggtcaggattcactaagcccattttgggcttgggcgggcagacagacagacttgcccaaagtcacacagttggcccatggtggggctgaaatgaaagctcccaaactcttaacagtcaagactctttccactgcacccactgcctccacccagggtcccagtaagagtttaccaaggcaccgccttctcacagaggctccctctccactgaggtgacaaatgttaataatgcgttggctgcaccttttcatgttgacatgttgacacaaacccactggtcttagtctgtttttgtgttgttataacagaatacctggaactgggtgatttataataaacagaaatttaatggctcatgattctggagctgggaagtccaagattgaggactagcatctggcaaaggtcttcatgctgtatcatgccatggtagaagggcaaagagagggagagaaagagagcaagagatagaacttgcaacctcaaaccctaattgatgttaatcaactcgtaagggcagagccctcatgacctaagcatctcccgataggccccacctcccaacactgctgcattgaggattaagttttcaacacatgcttttaggggtacatgttccaaccatagcatcacccgaggagaaagaagcactcatttgagttctgatttgggttcttcccttagtaggacctgtgccctgaggccctgcttatactctgaccttaagcagctcacttttcctttccaaacctgagtgttcttatctgtaaaatgagcatgattaaaatatttcactctcctgggtacaaagtcagtgtaagattcaagtgaacatagattttagggagtcagcaaatataagaggatgtttaggaggcctagtttttgagtcagaactctgggcttgggtcctgggtcaaagttatttaactctagaagacttgaggcatgttatcaacctccagcctcagcttcctcaagtgtaaagttcttgtgaggtgcttgtgaggattaaatgagatcatatatgtaacgcatttggcccactgctacatgaatgaagcacttcataaatgtcagctatcttataagtagattatctaattcaacattttccaaagtgtgtttcacaaaatattagtcctataacatattccagaaagatagggggaccctgggttcaagcacgtttgtgaaatgcagcactcactaccttcctcgtggatattcctgaggcaccttgaaaccttaaaagctctgaaaatgtctgctgaaaagaaacctgttgaactctgttaaagctatcacagagtcctctttttcatgaatttttaatgcattccacagaacttcgtttcctaacaaactccttgggggaatgtttatttgctccaacaccctcgtttgaagaagaaactgaggttcagaaaggtaaagtgagctggcctgggtctcccggccaataaatagcagagctggggcttgactcaagctaactaactcttcgacctactgctctttttattaaaccacactgagaaaacaccttcggctcttgatgtggccaatcactctccaaaggttaaagatttgtactattggtttcacagcccttcagcctttttccagggctctgtatccataactttgacggtgcagggctccctgctgctctggggagggtcggaggagctcggcaccagattggctcagtctgccccaacccccgggtctgtaatattgccgctgctggtccaggtccagggaacactcacacgcaggcatcaattttcttctgaaaccccacccacacgcctggaaatcttctctgaaggaggggaaaagcccaataacccagacccgacaacgtggcagctcttacacattccttgacgtggcccacaaaccaaacgtttcttcaatttagctgcagtgaggccaggaataatgacggccccgccagcccagagacgtggcagcctatgctgcatgactcagtcagcctgagaggtagcctgaacgctccgtcctctggggtctctgggctggggcagatggctgacgaggaagggcgatctggactaagcagctcagccccatccccttcccccacccgtctcttcttctccactgcc

SEQ ID NO: 556 - DNA, 160758 bp, Homo sapiens
ttggccaggctagtcttgagcaatcctcctgcctcagcctcctaaagtgctgggattacaggcatgagtcacggtgtccagcctgcaagtaatttagtttgctttgaatgcatggcataatgaacagggagtagctgtttgttcattcattccttcaatcattcaacaaatattttttgagcacctatcctatttcaggctctatactaagggctaaggatgcaacaatgaacgttacctcagcagagttcactgttatgagatttggatacgactgtggaatgcactgaaaactaccctaaagagtttgtacttggttcttcagatcctcactgcgcaaactgtggactttagaccagcaacctgggagtgtaccggaagtttgttagaaatgcaaaatctcagccaggcaagcgtggtggctcgcgccagtaatcccagcactttgggagggcaaggcaggtggattgcttgagcccaggagtttgagactagcctgggcaacatggcggaaatcctgtctcttaaaaaaatgcaaaaaaatattagctgagtatggtggcaggcgcctgtagtcccaactacttgggaggctgagatgggaggatggcttgagcccagaaggcagacgttgcagtgagccaagattgtgccattgcactccagcctgggcaacatagtgagaccctgtttctacaaaaacaaaacaaaaaaacaaatccaaagtcttaggttctgccctagccacaaacttacagaatcagaatttgcatttcagcaagatccttaggtgattcttatgcacattagtgttagaggagcattgttgtaggccaactaagacaataagagagtatgtacattggtcactaagttaaaaaaaaaagaaaaaagagcatgtaaatgaatgagccagagtaagcaagaaagtaagagagctagtaagcatgcacaaaaataaggaagtaatctaatcaggattggattggatgtgaaagaaaccggacatgggactattactgtagttagatgagaagtggaaggggttagatgtgagagatagaatcttttgtaaaaagatagagcgggccgggcgcggtggctcatgcctgtaatcccagcactttgggaggccgaggtgggtggatcacaaggtcaggagttcaagaccagcctgaccaagatggcgaaaccccgtctctactaaaaatacaaaaaaattagccgggcgtgatggtgggcgcctgtaatcccagccactcgggaggctgaggcagagaactgcttgaatccgggaggtggaggttgcagtgagctgagatcgcgccactgcactccagcctgggcgacagagcgagactcgtctcaaaaaaaaaaaaaaaaaaatagagctttggctggctaacatggtgaaaccctgtctctactaaaaatacattaaaaaaaaaattaaaaaaaaaattagccaggcgtggtggcaggcgcctgtagtcccagctacttgggaggctgaggcaggagaatggcatgaatccgggaggcggagcctgcaatgagtcgagatcacgccactgcactccagcctgggcgacaaagtgagactccgtttcaaaaaaaaaaacaaaaacaacaacaaaaaaagatagagctttggttccattaactcatactgggaacattgcatatcattcaaagtaaaaaaaaatcagcaaatctagtaacagggtatttaagatgtcttaaaaggtgccagttatttgttttagacaaggcttattggtatgtctatttcctgttaacgccacaggtccaaggtctatttctaagtattgcagcatcaagcccttaatcatgtaagttcacacaggggtaatgataaggatcttggaaattaagtcattatatccaagtttacaaaaagctgatttgtaaaccagaaattcaatttattaatttgcaatagagtaattatctttccactaaccagagaattttttcagttattaccactgtcatttttttttcttttcttttttttttttttttttgagatagggtctcactctgtcttccaggccggagtgcagtactgcaatctcggctcactgcagccttgacttcaagcgatcctccacctccagggctcaaaccagcctcccacctcagcctccagaacagctgggactacaggagcatgctaccgcgcctggctagtctcaaactcctggactcaaatgatcctctcacctcagcctcccaaagtgttggaattactggcatgagccaccatgcccagccccagtgttaaattttttattacaactttttattttgaaatagtttaggactattttattttgaaatagtttagtttgctacaagaagtagcaaaaatagtagacagaattcccacgtacccttcacaaagctttgccccaatagcaccttgtcaaatccaggaaattgacaatcgatacaacactatcaactcaagtgcagaccttatttggatttcaccaggttttttcatgtacttatgtgtgtgtatttgtagttctctaaaattttatcacctgtagatttgagtaaccatcaccaaaatcaggatgcacaattgttccatcaccacaaaaaaatctctcgtgttaccccttaatactcagtcttttcccaaccctaatccttgccaaccactgatctgtcctccataactataatttttcattttgataatatcatataatggaatcattgtaactctgatttttttcccactaagcataatgcccttcagatccatgtaagttttttgtatgtattaagtttatttttatttttattttttttgagacagagtttcgctcttgtcgtccaggctggagtgaagtggcacaatctcggctcactgcaacctccgcttcctgggtttaagcaattctcccatctcagcctcccgagtaactgggactacaggtgcctgccaccatgcctggctaatttttgtatttttaatagagacggggtttcactatgttggccagggtggtcttgaactcctgacctagggtgatccaactgccgtggcctcccaaagtgcgaggattacaggcatgagccaccgtgcctggccaatagtttctttttattgctgaatagtattccattccctgatggaaccagtttgcttaaccattcaccaggtgatagatattttggttgttttctgtttttggctatcacaaataaaagctgctataagtacttgtgtgcaggtttttgtgtaaacataaattttaatttctttgggataaatgctcaggaatgagattgctgggtcagatggtaagtatgtatttaactttgtaggaaagtgccaaactgttttctggggcaaccagtataagatcttaaaacttccataagtaatacatgctcactgtaaaaaaaaaaaaaaaaagaataaaataaggtggaaatatataaaacgaaaagtaaaatgacaagtcatggaactgtactgcctctttcctgagtagtaactgttgttaggtttcctgtatattcaagaatgttttggctgggcgtggtggcccatgactgtaatcccagaactttgggaggctaaggcaggagaatttcttgagatcaggagtttgtaaccagcctgggcaacatagtgagatgccgtctctatcaaaaaaatgttttatgcatatgcaagcaaatacatgtgtatataaatatatatatattccaaaatgtgatcacagtatacaggtaattgcaacttgattttttctcataacttagacatatttttttttttttttgagacagagtctcgctctgttgcccaggctggagtgcagtggcatgatctcggctgactgcaagctctgcctcccgggttcactcacgccattctcctgcctcagcctcccgagtagccgggactacaggcgcccgccaccacgcccggctaatttttttgtatttttagtagagacagggtttcaccgtgttagccaggatggtctcgatctcctgacctcgtgatccacccacctcggcctccgaaagtgctgggattacaggtgtgagccaccgcgcccggcccatatttgcaatattaataaatatatacttgttttaatggtgggcataggactattgtatgcccaccattatccaatgtatctattgtatggatgtattataatttctttactcagtcccctgatgatgaccatttctattgttgtcagtttctattacaaagctataatgaaaatctttctatatatatttctttataatttgtatgagcatatctgtatggtaaactcctagaaatggaattgctagatcgattttacatttaactgctccgagatactttcaactttttctccagtttttaaaatttttgtagagatggggttttgctatgttgcccaggctggtctcaaactcctgggctcaagtgattctcctgccttggccttccagtgttagaattgcagatgtgagccactgcatccgaccttttaaaaatttttatttttcagtttttttttaaaatttactctcccctcaatgatatatgagagttctcagttctttaccaacactaagtattatcaacattttaaatctctggcaatctggtaggagagtttgtatttaatttgcatttattttattttattatttttttgagacagagtctcgctctttcgcccggctggagtgcagtgacacgatttaagctcagtgcaacctctgcttcctgggttcaagagattctcgtgcctcagcctcctgagtagctgggactacaggtgagctaccacgctcagctaatttttgtatttttagtagagacggggtttcaccatattggccaggatggtctcgagtgatctgcccgcctcggcctcccaaagtgctgggattacaggcgtgagccactgcgcccggccttaacttgcatttcttagtggcaaatgaagttgagcactattttatgtatgtattagccatctgtatttcttatttcttttttttcttttttttatttttgagaaggattctcgctctgtcgcccaggctggagtgcagtgacactatctcggctcactgcaacctccgcctcctgggttcaagcgattcttctgcctcagcctcctaagtaggtgggactacaggtgtgtgccaccatgaccatctaattttttgtatttttagtagagacggagtttccttgtgttagccaggatggtctcgatctcctgaccttgtgatccgcccgcctcggcctcccaaagtactgggattacaggcgtgagccaccgcgcccggcctagccatctgtatttcttctcccacaagtagactatattctttgtccacttttctactggagttttaaattttaccatattgattttgacagttctccgtatcttgaagaaattagcttttttcatccatatagcaaacattttctcacagtttctagtttatcttttgactttgtttctggtgtcttggtatacataattttttaatttctgtggacttaaatttatttatctacttttaggtttctgggttttatgtttagaatggtgtttaaaaatataaaaaatgggctggcgcggtggctcacgcctataatcccagccctttgggaggccaggcgggcggatcacgtgtggtcgggagttgaagaccagcctgaccaacatggagaaactccatctctactaaaaatacaaaaattagctgggcgtggtggcgcttgcctgtgatcccagcttactcaggaggctgaggcaggagaatcgcttgaaccctggaggtggaggttgcagtgagctgagatcgcaccactgcactccagcttgggtgacagagcgagagtttgtctcaaaaaaaaaaaaaaaaaagaaaataaaataaaatataaaatatatatatatgctgtccagaggagaagactatctggaaaacctaatttataatcagaagtctgttccatttgcatggagttaaagcaaagagatctgtgggatgttttagtccgtctatggtaaacctggaggattatctttgttgtactgtggcatatgaatttcttgtgaccagaacatttctgcatcaaatagtgtcttgccttttatatagtatcagaggtttgtaagttttaactattcaactctcctttttcactatttcttattaggcacccaaagcttctgcctttacaatattatctcataaaggacatgttacaaacaagattaaaattattttccatcagttatttcatttttcattatttcatatttcgtttgatggcattttctccctttgtcctcacattcaaagggtgaattgtttatatttttcagtaccccatgaaataaactccacttcttatgataggactggggcacctagcattctgtacatattgaagtcttgataagtatttttttgaaagagctctaacaaaaaaaatggttactgtaaaatattcttaaatattagtaaaaatttgctacaacatttatttctgatgttataccagtttgttattaatcttcagtggtatttttcacaaaatcagagctaatttgctaaacagaagaacttttcagttttgttctaagcataaaattgtttaaaatctcagttgctacatagataattaactgagaatacaaatttataaaatagataaaaaactatttgtaccatgtaccataaatgtgatgtttggagcagaaaatcagtagttttcagctaatactaagacaggaaatcatttaatatcaattgagattaaattggcacaattgaactaaattaatgtaaaaatgacttggtacacggcccaatttttctattacttcaagtggaattttgcattaacttatataactctgtaaattttccactactctctatttaatgttctagctgcatcattctgtaacttgaatctattaaaaactgtatagcattctaccaaagatggtctataaaagaaatggaaatttattttgaatagtattccactctccagagctttagaggtaagtaaaaatgtctcagattttacttcttgttattgatattcagatgtttctgtttaacttttattgtccagttgattaaatatactataactctttttgtaaagttgcagaaaaaacaataagcacagaggatgggagagaaactaacaagagatatggaaggaatataatttaaggactgaaaataatcgttatattacattaggaatgtttcagaagtgatatcggggtgaaagcttcatgatttacacggggctcaccctatttctcagttggaaaatttgttttgttattaatacgttttatttcttttcttctaattgaaatgtaatttaatatttaagaaatattttaaccaaaatttcaaaaatggaacagaaacgaagacttcttaagcaaacactattttatgaatctacgaacttctataacagcaatggagacactgcaataggtcacttcttcctgtccaaggaaaaagcggcgctttggaggggataggccctcctcgagtttttctcccccgagtaaagagctcttggcggtcaaaggtccaatacactggattcgaaacaaacaaaaaaaaagggtgacaaagattttagttaacaggggtcggaggagcagaaagggtcttttcgcacttcaaacatcttgggggagggatgggaaggcaggatgcgaagtaacctaaattcccaaccatttcgcgtggttgcacccgcccaggaaggcagtggatgcgcgggggaggcggggtaggtccccctccactccttttgcccaaatttcgatttccctccacttcgctcggtcctatctcttcccccgccccgagagtggcgaacaaattggtcgagcgcccggcctagcctagtagtccagttctttaggactcctagaacctggagatacagaccacgttttctcggagacgggaccagtgggctgtaaagcaaaacaatttttctttcttttccagggctaggtcttactggtagagaatcagctcgctctctctccacacccgaagcaaaaagcaaaacaaaaccaacccgtattccgcccccgatctagcccaagtagctccattaaaccatttaggatcaggtgccagagttaagcgacttgggttcttttggtgggaaggggtagggacaagggggcatcgaaggtacgggaactagggccacaggcccctcacaggggtgtgtcagaagaggggacttcgaagggtgatgcccgactgggctgccaccttagcgcctcgcgaggggcggaggggcccggggaacgagtcccggagcgaacccagccagcctctggattcccacggcccagggctccgccggacattcctaccgccctcccctcgacaccccactaaagacagaagaaccgcggctcgatcgggtccgcggcggaagcgcggccaaacgaatgagtaagtcaggcgcgggcacggcaccttgtttaccccactcggcggcgcgcccctgcgggcgcctggtttgcgggcggcgtcggagacgctgaacccgggagtcagtcggccacgattggtcggtgactgggaggaggacgctgggtgggagggctgggagccaggcgttgcagtggcaactctctgccgctagatgccgctccctcccaacgggagccgggcgcgggttcgtggccgacagatggcgcctgcgcgttccattcgcctccaagtcgccgaagagcgaacaccccaaacaatcccgaagcgccaccaaaaaaaaaaaaaaaaaaaaaaaaaaaaaaaaaaaaaaaaagaaaaaaaaccccgccggatccgaccgccactttcaaaaccccccaccgctctagaaccgcgggagcttccgtccctgagtagaattcgagggtgtaaagaagaggaaggggaaaaatatcttgtaccagcccaggggtgaagaagcccccggcctgagaaagaaggaggagtgggggaggcgaacagtctcgttgctgcctctgtgtacgctgaggggggaggtaagttataaaatggcggaggcgaagcttctagaagtttggaggggcacccggagggcgcttggcccaccgtgaggtgtgtatgattgaaacagggcgagagagaggagttgggagggaaagaggttgggcactctgttgccattgaatttcccctctgctttcttcgcccccatggggggcagccatggaacggggggcagagtccaggcgggaggatctttctcgcccccgcggcgccccccgccctcctttctcccttctccccccaagtcgctaccccaacacttccaaggaacttccagccccccttcctccctacctcctactcctagagtggctttctaccgcagggctcttcttttcgactaccctcgctgaagattttctcttccttccctcgcccaactctccctcggggcctctacggagaccccccccccccatgggtggcccaaaatggagaacgcggagcagcgcaagatggaggctccgcttctctgtgtagcagtagatttaggttccttttctccggcaggctcctaagcctaggagagcccgaactggaggtggggtggggtgcgagccgtagtcgggggaggaaagccgggaggctgtggttggggtgggggagagcgcggtgtcgcggtgaggggaaggcagagagcaaaatggtggtgctgggaacctaggggggaggggagaaaggaggctcagttgtgtatatttgggcctcggaccgagggaggcgagggaaaatctactctgatcacacccctccctcgtgccccctcccttctcccttcccctcctcccttccctccctcccccctccctccctctcttcctcccttcctagagagggaacaacattcatgtgacgggcccctctgcttctcccccgccccatcatctccagcgcgtggtgggggaactgctggggaaggcgattggcatcgatctctccatcccttccgaggcccgacttcggtcagttttcttcgggcaacaattttctaaattggctggggtctggcggtgttggcccccgcgcgcagaccttgccccgaagggggccctgcctgcctggcatgggcggaggggggaagggcgggagtggaaggctgtttgttggggggttttggcgccacttttgttttagttttagtgctgcttttcattcccacccccacccgcactgtctttctcaaggcacgaactgagctgatccttgccccaggtaggcagcctgtgcgttttcactccacacttttattcttgctcggggtcgactttcttttttcttctcccctggatccggagatctgcggacggcgattttgggacgaaaagggtcggatgggccgtgggagagagaaggtgtgggaaacagcatcaagtagttccgcaaaactttgagccccgttcccattttcttttggcctagaattgtgaacgtattgttgatttcggcctttttttccccccgtcgcgagaatgtcttgttttgcctttagttttttataaaccgctgtactttcgacatttagtttccgctcccccttggtgcatatgtcattttatttttaatccttaactgtaatgggttatcgtgtgattttcgtgcttcagtgctcggctttaatttttaatattgtattagtagtttcatccggtttgtgagactttctcttccgtggcctagaatgttttttatgttgttgcctaccacccctcttccctctccctccttctttctcttggatgtagtttttaaattgagggccatggtgttggattaaatggtaatttacagtttacatgatatatctattggaaacttttgatctgtaaggttagatttaaagtaaacgaggcgcttgtgttggtttgcaatggttccttaaaatgcgcgggccacccccttctcccaccataaagccccatcttcccttcacactggagtgtaaattccataccccttttctcccacggaccgccgtatttcgcagcagccacaccctgtatttgtctctgtggattggactcattatcagcttaatttagtgactcttaaaccaccatgatgggacttgcttaagcacgaagcttcttttcctgtttagtcctagtggttagtgtcgaaagaggaatcatcgaggtttcttgatgaaacctagtgcggtccaacctctgcctttttttctgttgtcttttttcctactccgggctgttggcggtgtcagcaccgctgctgggggcgggggtggaggggagaaagagtcgggttaccgaagtgcgtcattcctggctctagcagggcctgctcgggagctgctggtgtttgttactgtcctcgcagcacttttctgccaaccttctctctctgcgtattggttaggagcaaaagcaggaggcggtctcctaattctgtctgtagcctagcgcgttgcgtttaagggtatatctgaacttattttgttaaaaaaaaggctctgggaagtggatgcatttgtttaatgacatataattcaggtagtttaggcttgctctcatatactttccgatgaacagtggggttaattttcaacattttcaaccacttaacgttaaaatgcctggttttctttctacattgatatcaatctataattagggatcagaaggaccagtttaaggtatataagtgttcagcagtttttcaagtggttgaattgcagttttatgacacattatgttaaatagtcgatttttttttttcattttgaactaaggtgccacgttaagtaagttaattgcagatgtttaagttcgttttcatcacatttccctatttgtctttttaggtataattttaaatatgccctttgggtttatggacttcattaaaattcttaaagatggttatatctttgtgtttaactgaattcttaaatttatcacctaccaaagaattgtgtaaggcgtaaggcggctgtatagttacattgttggattttgacttaacatgctagtttttgatacttttgctatctttgggtagaagtgtacttagagaacatagtatcttcctcttaattctttttgaagataataatgagaggagggagtgggtaggaggtaggtgtgaagcagaagtggccttgagttgattattgtagctggatgaatacagaagcgctcattgttactattattctctctacttttgtgcgtgctgttaaacatttccatagtttaagataaactttttttgcagtagaatttccagattgtcttacagtcttgggggtaatgacttaagtttatatttacatgtcaaaattacttgcataggaaatttagccttgtgtaagtgattacacaatgcttggcaaaactttcaaaaaaaaaaaaacgtttaaacgggaactagtataaaacaggcaacataaatacttataaattggttgaactttaaatgtttataacttagcctgaatgtgctctacttttagtttcctttttaattctttgaaaacaggaaaattccatttgcaatttttgtaaattctgcttagtgtctatttcatcaagttggagttacagtgagtcagtatgaaagggatttactattaataggaggggctttggcagttgcagtaagtgacagtggaagggattgaggtaccatagggagcattcctggtagaaagatctaggtagctgaattcagtttcagaatttggtgtttaatgactaggtagagaagtgggttggaaaagaaatgtacttattagctattccttcccactgtgaagtaactatagtattctaaggtgtatcagagactggcagagagggtggagtgggtttttttttttttaactgataagaaaatgagtgtttacatttaaaatggtttaaatcacctcatgccccaaggatctggtgctataactagttagaagttgatatgtaaaatatttcaatattgtctgttaacattctgaccattacccgtaaacagtaaaaatgtgttgcaatgacaatccttggtctcccttaattagtgcatttgtgaactgctcctaaattctattaaggtaagtgccttttttttttttttttttggcagttctatactgttcagtgtcaggtttatttttttcccccaggagatacattttaaaaatacatgtcacagttccgaaaggaatccaaaacaatggatatttaatttatagcaaaatttcaccccaatctgggaacagacattttgtaactgttaccattagtctgtttgtgtatttcatattcaggattttagctttagaaggatgttaaaggaaaataggtgacatatttcaaatttttattcatatacaaatattcttagtagatggtaaggattgtggcatcagatttattttattgtggtgaggcaatagctaaactactacactaacacatgatgagtttggtaactttcaagtatatttagttaggattttttaaagcccaaatgctcaaataagattttcatgaaatcaaattctacatttctttttcaactgtattgacttctgcggtcacctgaggacttatgaattaaagtgaatgggatgggcttgggggacaggctaaggctcagatctattcctttgggaatttagggttagatgtgaaaatatgcagtttagtaatgcttaatattgtgcatgtttaactgataccacccacagtcatatgtgggaaggtagtaaacagagaatagcataatctttctgcttcgggttctttataatagatggcagacttcagtttttgatgctgcaagttgacttttgaacttaaaccaaaatcggcggggcacagtggctcacacctgtaataccaacactttgggaggctgagaggctgaagtggggggatcacttgagcccaaggagttcaagaccagcctgggcaacatagggagaccccatgtttatagataatttaaaaattaggtgtggtggtgcacacctgtggtcccagctatttgggaggctgaggcaggaggatcacctgagcccggtacatagaggctgcagtaagccacgattgcgccactgcacccagcctgggcaacagagcaagaccctgtctcaaaaaaaaattaaaaataaactaaaatgtacagtttactatataatggagtaccgttttgggagttggggagaatagcgagggagagggatagtttcaggtatgggcatcagtatatactgaagtgtgattgttggagagtaaggaaggaactttaaagacataggctattttaaaagtttttggctgggcaccatggctcacgcctgtaatcctagcactttggaaggctgaggcaggcggatcatgaggtcaggagttcaagaccagcctggccaacatggtgaaacccccatctctactaaaaatactaaaattagctggacgtggtggtgcgcgtctgtagtcccagctgcttgggaggctgaggcaggagaatcgcttgaacctgggaggcagaggttgcagtgagctgagatcgcgccactgcactgtagcctgggcgacagcgagactccgtttaaaaaaaaaaaaagttcttaacatttttctgcattggctacatgttcaggactttagttcgtgtttcagtactgtccctgtgtaataattctttatgtttctgggtatcataaatgatggttattgcgtgttctgattggcaaagatatatgataaagcaaaattatcagtttgatttttcagtctcttgagttgactgctttacgtttaatttacccaaattttatatttcttcagtgtaagtggtgttgcttagtggagtctaatttttgttgatgtgccttttaaaaatctatgcatcttcagcagctgtggtaatctgctacctgaattgtgtttttaatgtgtgcttgctatagatctttgatactcaccagtagacaccaagaagtctttacatatggttattgtagtaagtcaagaagagatttatttattttttgagacggagttttgctcttgttgcccaggctggagtgcagtggcatgatcttgggctccctgcaacctttgcctcccgggttcaagtgattctcctgcctcaacctcccagtagctgggattacaggtgtccgctaccacgcccagctaattttttgtgtttttagtagagacagagtttcaccatgttggtcagggtggtctcaaactcctgacctcaggtgatccacccaccacagcctcccaaagtgctgggattacaggcggagccaccgtgcctggccaagaagagattattgaaattgttttccattccttctgccgaagaaagagaggatgaataatgtcaatggtgtattttttttttttttttttttttttttgagacggagttttgctcttgttgcccaggctagagtgcaatggtgcgatcttggctcactgcaacctccacctactgggttcaagcgattctcctgcctcggcctcccgagtagctgggattacaggcatgtgccaccacaccgggctaattttgtacttttagtagagacggggttttttccatgttggtcaggctggtctcgaactcccgacctcaggtgatctgcctgcctcggccttccaaagttctgggattacaggcgtgagccactgcgcccagctggcctattcttttttattacagtcatgcattgcttaacggcgggcataccttctgagaaatgcatctttaggtgattttgttgtgtgagcatcatacagtgtacctacacacacctagatggaatagcctactatacatctatgccatatggtatgacctgttgctcctaggctacaatcctgtacagcatgttgctgtactgaatatcgtaggcagttataatacagtggtaagtatttgtgtttgaaaacaaaaaagatacaataaaaatacggtataaaagaaaaaatagtacacctctatagggcagctcccttataatcttatgggaccactgtcttttttttttttttagatggagtctccctctgtcgctcaggctggggtgcagtggcgagatcttggctcactgcaacctctgcctcctgagttcaagcgattctcctgccttagcctctcaagtagctgggattacagatgcatgccaccatacccggctaatctttgtatttttggtagagacgggctttcaccatattggtcaggctggtctcaaacgcctgacctcgtgatccgcctgcctcagcctccccaagtgctgggattacaggcatgagccactacacccagctgggaccaccgtcttatatgcagtctgttgtggactaaaatgtcattatatggcacatgactgtattttaattgggaaatacattactaggcttgatgagacaaactagggagatttcagtaagctctgcctaacttaagggaccattcaaaggtaaaatttctttgtaagaaataagttggctgggcgtggtgactcaccctctgaatcccagcactttggtaggccaaggtgggaagatctgttgagcccaggagtttgagaccatcctgggcaacgtagggagaccccatctctacaaaaaaatttaacaattagctgggtatggttgtgcagcctgtggccccagttactggggaggctgaggtgggaggatcacttgagccccagcaggttgagcctgcagtgagccatgatcatgcctttgcacttcagcctgggcaaaagagtaagaccctatctcaaaaagttgtttaaattctgttgtacatcgttcaaggggggtgaaaaacaagtcctatttacatttttgcaagaataacttttgaaacctgaagcattctaagaaacttaatttaactgctatttaagttcctactgaatgccagtaatgctttaatcttctgtttaatcttctcaaccactttgcaggataggttgtcctcatcattttacacgtggggaaattgacgctctcagagagtaaatgccttgtctcaagtcacatggattcacactcagattagcctggcctcaaaacctttgtgcttttttgttaaactcagttgtttcccttatctggtttaggtcttgggctatctgtcatcagagagcatgcattcttattttaattttacaaaatcaagattctttttcatgtatagtgcaaggtaaatatagatttttacccagagtcagataagttgctgcctgaggtctatattgtcttttaatagtaatagaagtagttgaaataaatctgagcattggttttgtttgcatatgcttattaaagtttgtgggataatgaattgtattcttgaattttttggggggggaatcatgtgatacatgaaatggtttcatagatattttttcttttaggtcatttatgctctatttaaaatggagattacatgtgtctgagaattgttccccagtccttcagcttgttttactgagtggttagattcgaagtaaaaagtttaggctaatctttaataattcagcgctctggttctttaggggtattttttgttatttaattgtaccttaaaaattcttttttattctgttaatatctcctgtttgcttatacttcctattttagttcatctttcactattaagttttcttgttcttactgttatcaggtgataaatagttaatatcagggccccaagttattaggttcattagtgatcggtatcttagtctcagttttctttttcctttctgttttttttttagatggagtttcgcgcttgttgcccaggctgtggtgcagtggcatgattggctcactgcaacctccgcctcccaggttcaagcgatttcctcgcctcagcctcccgagtagctgggactacaggcgcgtaccaccacacccggctaattttttgtatttttggtagagacgggatttccccatgttggccaggctggtctcgaactcctgacctcaggtgattcacccatctccaccccacaaagtgctgggattacaggcgtgagccaccgcacccggtcttcctgtttttttttttttttttttttttttttaattgtaactgaagttttttttatctgaaggaattctggttgttggacttatgacctaagataaatttatggagacaaggaaaacaaaatatatatatttgtgcttttcatagccatgagtcaaatttatatgtttatattgatcattcctttaagctttaacatgtaggaaatacttttttcccaggtgatgaacagcagtcttatactcagactctttgttcattgaggagtcttttcatccatatttccccctttgtattccaagaaaaccaagaactggtgttccatgacagaattattccccgaggcatccattgtatattataaattagtttctcccctgcacatctagaaagatattagttaggtatcattcttgggagacttcaggaatagtcactgaagtcattttctgagttctgtagtcaagtcattttctgagttctgtagttaacatgaggaacactggttgagaaaggctgctagaatattaagggacttggtttggcactaaataaagttttacttttcactgtcactttcctgttagtaactctaatatggcctctattaaaattcgtgatacaatgtgaatgctgttgatactgctattgctgtgggataaattggttagtgttgatttcaagcagttagtgctgcttagttgtttgaaagaatttaatgtgggacattaaatgcatcattttatttataagaaggaatattgtgggagcactgttcattatacagttcaaaatctataaaaagtcactgacagtgactaacatgaacaagaactaatactaactgaactcttaccatatgccagatactcttaaaaatgctttgtgtgtattagcttactttatcttagtaactctatgaggtaggatgaccatatgatttattgttcaagccaggatacttttgaacgtgaaagggattgcttcttggccttttggctaagatcaagggaagagtgagtgaaagggggcactcactgaatggcatgctgagataatagcagaaactaggactgtttgagagaaaggatgtgtgatgaccctaattaataccttctttttcagaagaaactgaagcatagggagaccaaataacttgcccacttagtaagcggtaagaagggatttaaaacctctgtagaggctgggcgcggtggctcatgcctgtaatcccagcactttgggaggccgaggcaggtggaccacctgaggtcaggagttcgagccagcctggccaatatggtgaaaccccgtctctactaaaaatataaaaattagccaggtgtggtggcatgtgcctgtaatcccagcttcttgggaggctgaggtaggagaattgcctgaagctgggggtagaggttacagtgagctgagattgcgtcactgcactccagcctgggcaacagagcaagactcttgtctctaaaataaaataaaacctgtagagatttctatgggaatgaaagtgatttaaattattttaaattgccatattctgggagtttgtttacttttacccttttgggggagtttttgttggtacatggtcaatagtaaaaagacaagatagtgttttttaaaatccaggagaatttccacttggatttttttcaagtggctgttagactgaggtgattatattgtcttaatgttgaaaagcaactttcctgagggccacctaagttaaaacaaaactctaagataacgacatctgagtttgttttccgtatgtattattcaggttccctttaccattttcttaggcagaaatgtggattgtagaaatttttactgagaagacagtagaaagaagatgaatacttttgtgactagggagaagtgttactagaaaagaaagaaaaaggtccagtttagagacttttgaaggtaaactgattctgtagcatagtttgagagttaagtcttgtagagattaatatgtcatttcataaaaaatatccctcttttattgtgatttttaaagctattttatatttctggcctgtttatgcttgtgctgtcacctgaaaaaatattactggtgaattcaaatgtggagaaatgattttggcacagttgtggaaacaactatattgtaaactaagatctttttttttcctttgagtgggagtgaatggtagtatctgatcttaaggagacttccagttttgttttcatacttggctattttaatagttcattgagtaatttgtgtttttttttttccctctagctagttgacgtttggaggttttgttggtgtaactatcattttttttttttctttttttttgaggtggagtcgcccaggctggagtgcagtggcgcaatctcagctcactgcaagctccacctccggggttcacgccattctcctgcctcagcctcccgagtagctgggactacaggcgcctgccaccatggccggctaatttttttgtatttttagtagagacggggtttcaccgtgttagccaggatggtcttgatctcctgacctcgtgatccgcccgcctcggcctcccaaagtgccgggattacaggcgtgagccaccgcgcccggccaatttttaaggtcttttatttagttcattgaaaccattatgagacaagatatagcttgaagggggactgcatttctcaccagatgaaggaatttgtggcctgtgtagtgactacgggagacaaaaggttattttgaggagatttgatttattatataagattaatgggctgggctaggtggctcatgcctgtattcccagcactttgggaggctgaggctggtggatcacttgagctcaggagttcaagaccagtctgggcaacatggtgaaactccccccctctaccaaaaatacaaaaaaaaaaaaaaaaaaaaaaaaagaaccgaatcagcctggcgtggtggcgctcacctgtggtctcagctactcaggaggcagaggtgggaggatcacttgagcctgggaggcggaggttgcagtgagctgagattgtgacattgtactccagcctgggtgatagagtgagacccccactcaaaagagaaaaaaaacagtagtaaaataaaataaaaaaaaaatgcagttggattttaaatactatattgctggtttttaagctggggtccatgaatgggatggagatttgtgaaccctctcaaattatgtacaaactgtatacatgcatttcatcagtttctctagggctcattgttaaaatcagctggtatttaaagtacttatgggggaccgggtgcggtagctcatcatgcctgtaatcccagcactttgggaggctgaggcaggcagatcatgaggtcaggagatcgagaccatcctggccaacacggtgagaccccgtctctactaaaataacaaaaaattagccgggcatggtggcgcgtgcctgtagtcccagctactcgggtggctgaggcaggggaattgcttgaacccgggaggctgagattgcagtgagccgagatcgtgccacagcactccagcctggcaacagagtgagactctgtctcaaaaaaaaaaaaaaaaaaaatagactgggcgcggtggctcacacctgtaatcccagcactttgggaggctgaggtgggcagatcacctgaggtcaggaattcaagactagcctgagcaatgtggagaaaccccatctctactaaaaatgcaaaattagctgggtgtggtggtgcatgcctgtagtcccagctattcgggaggctgaggcaggagaattgcttgaacctgggaggtggaggttgcagtgagctgagatcacgccattgcactccagcctggacaacaagagtgaaactccctctcaaaaaaaaaaaaaagtacctatgaaagatgggatatacaatggtaaactagattacatagtctctgcccttaggggaatatagtcagttggactttgtcactacagaagggttaaaaaaatacctattaaaataccgtgtattgggtttacattaaagaatattgggctaaaaccagccatcaatgcagttttggcactgtgttcctaatgtgagattagtgacatactgaaaaattagggctgcactgaaaaacttcagggaaaaataacaactgagaaaacaagcagaacaaccgagggctttaatgtagccttggaatgcttcagtctttggcagttgttaataaacaaagttaaaagagcccatgatcatcttttcttttcttttttcttttttttttttttgagacggagccttactctgttggccaggctggagtgtagtggcacaatcttggcttactgaaacctccacctcctgagttcaagtgattctcctgccttagcctcccaagtagttgggattacaggcacccgccaccaggcctggctaatttttgtatagagaaagggtttcactgtgttggccaggcttgtatcgaactcctgagctcaagtgataacacccgtcttggcctcccaaagtgctgggattacaggcatgagctaccgtgcctggccccatgatcatcttatatatgcagttactgttatccaaaggttgataccttctttttttttttttttttttgagatggagtctcgctctgtcgcccagactggagtgcagtggcgtgatctcggctcactgcaacctctgcctcctgggttcaggcgattctcctgcttcagcctcttgagtagctgggattacaggtgcatgccaccacgcctggctaatttttgtatttttagtacagatggggtttcaccatatttgtgaggctggtctcgaactcctgatgtagtgatccgcccgccttggcctcccaaagtgctgggattacaggcatgagccaccacacccggcctagtatttgattttcattacattcactcacccacacactcatcatataaaatgattgaggtttggtatacttgaagtattttcatttcaggattgggatatatgataacctctttccttagatttccaatctttttttcctttcaaaagcaagggtaatttttacagtcaccagtgtgtctactgccttgtacctaatttgcaaactttatggtggctagaatgttattacaaagaacatgtttgatatcttcttactaaaatagaggcattttttgtagtctaaagaaatagtatatatataaagataggaaaatgaacctttgagaatttcccttctacactattaaaaagaagaagataaaatgtaggaaatattattagcaaaaccataatatttttcctttgggatatgtccctccctgtttccaccactcattcagtccaaaagacattcctcagactttactcctggcaggagaattgaggaagtggtggtagtcatggttggcagagaagcagaagcatgaaggtatgtttttgaaaagcaaacttgtcaatgacaaatggatttttccagttgtgagtatacgtacttttttttgagccagagtttcgctcttgttgcccaggctggagtgcaatggcgtgatctcagctcaccggcaacctccgcctcctgggttcaagcgattctcctgcctcagcctcctgattagctgggattacaggcatgtgccaccatgtccggctaattttgtacttttagtagagatgggggtttctccatgttggtcaggctggtctcgaactcccaacctcaggtgatccgcccaccttggcctcccaaagtgctgggattacaggcatgagccaccatgccctgcggaatatgtactttttgagttttgattaaatatcagtgcataaagtgctactgttcattgaggaatatttagtagttatattcatatttgggtattctgaatatacttgaaaaatttcagaaggatcatttggacaatatgggattttattagaaaagttcctatagtaggacatttgttcctaatccttttaagttagactgaagcagttttctaagttactatggaaaaataggtttctgccgggagcagtggctcacacctataatcccaacactttgggaggcagaggtaggagcccaggagttccagaccggcctgggcaacagagcgagaccctgtctctaccaaaaattcaaaaattagccaggcatggcagtgtacatctgtaatctcagcaacttgggaggctgagatgggaggattacttgagcccaggaggttgaggctgcagtgagccaaggtcgtgccactgcactccaacctgggtgacagtagtgaccttttctcttaaaaaaaaatttaaaaagatgaaattaaattttaaaaaagaaagatttgtaactggaggcaattgtgtgtgcatatatgtataaatatatagtatttgaatgtacaatattggcaaatatccagatttatctcatagcaagattaaccttttcagtctaggaactgttttcatctgattttgaatccttgtttcattgtgcagtatatattatacaggttctcaaatggtaattgaattgaaaccttcgtttttttttaaagaaatgtaaacctgcattataattgcattattggtattcatatttaaaagctgcatattggaagaaaaatagtttcccatagttggttttacattaatgataaagtttgtatcgacaggataccacttacagcatcttcttactatatgacaagttgtactaggctccctaacatttaattttttgtttctcacaacaaccctattgaggttgtttactgaggttcagaattgttagagacttgcccaagatcacttagctaataagtggccaagcttactttttgaatccaattctgcctaattccagaacactcctttacatggtgatacactgcctcccagtgggatgatttatagatttcatagtgatactttctttggggaaagagaatataaaggatacaagaactctaaatggaaaagacagaggaggaagttaaacttctcatagtggtcaggaaccttttgggggattaagtaggaggaaagcttattttcagctgagagctgatggatgtttgaagttgcatgtgatatgtgtcatgttttataataaacatcaagtagcaactagaaaaggcttagcggcagggagatgataaagtttcttacactgtagtgatgataaagtttcttacactgtactgatgataaagtttcttatactgtactgttttaatcttgagtaaagtgacatctgaattaattttaaggaattaacctttatagaaaataaactgaaacaaaatgttaatctaaagcattgtctccataggtagtgttcccaccaaagaacaataattctaataagaataatctgttcaggtaaactggtctaagtcaggcagcattatgattccagtttgtgttttggttttcatattccactagcctcccttttctgctgttttttttccccccctccggtatctttacagtttctgtagttcttcataaaaagtagaaatgttttgatggcgatttccttattttacttttatgctgttactgctaacagtagacagccttatttgtgaggcactgaaatagaagtgatttcaaaaattaatccatttcgtgactcagaaacatttcctttaaaaataatgaaaaaaaatagaaaaattagtccatttaaatttccctacaagcctgtgaggtgttgatgctattattattttctgtttgtgtgtgaggaaacggaggcatagtgagcttaaactttttctaagcacacacatacttaggaagtgttggagccttaatgtgaacccaggcaatctggttcccaagtgtttttttttttttttttttttttttttgagatagggtctcattctgttgcccagggtggagtgcaagtggcactatcatggctcactgcagccttgactttctgggctcaagcggtactcttacctcagcctcctgagtaactgggactacaggtgcatgccaccaagcccagcttattttcatattttttgcagagatggggtcttaaccatattgcttaggctggttttgaactcgtgggctcaagccacctggccgctttggcctcccaagtgttgggattgcaggcgtgaaccaccgtgcctggccactactgagttctttttttttttttttttttaacttttaagttgagaggtacatgtgcaggatgtgcaggtttgttaacataggtaaacctgtggtttgctgcacagatcatcccatcacctaggtattaagcccagtttccattagctattcttcctgatgctcttcccccactcccacaggccccattgtgtgttgtttccccccatatgtccatgtgttctcatcattcagctcccacttataagtgagaacatgtggtgtttggttttctgttcctgagttcttaatgctacactaccatactgctgatcagtggacaataatgtgagtggtttcttcatcttggcagtgtacttttaagtcctctatttaattgtggagtatgtttgtgcatccttataggaattttaggagatagcagaggattgggcaaatctttgatcctcaagattccccagctgtacaataggtgtaatcccatttgccttataggttatttatagagactatatagtaatacaggttgagcatcccaaatccaaaatcttccaaaatctgaaaccttttaagcacccacgtgatgctccaaagaaatgttcattggaacattttggatatgggatgctcaactggtaagtataatacaaataatcccaaatccaaacaatattaatatttggattttggaatatttatgtttgaaacacttttggtcccaagcattttggataagggatactcaacctgtactttttctgggatttttctgtgtgccagataataggctgagggttttgctggcatggtaggccccccagatagctcagtaattccatttattgagtacattccatgtgtcagatacttgaggtaatatactacctttagttattacatgataggggatattatacccattttatggatgagaaaactgaacctaaagaaattcagtaatttgctcaaataggtttttactttgcggcctttgtacttgttgatccctctgcctggcttggtttctcatttctctaggatattttgctcaaatattaccctttcagtggaacgttccttggccatctcattaaaataatatcccttgctttgccagccctcctttttcagtttattttgcttaatattaccatcaaacatacatttacatgagttgtctctttccccactctagaatgttaagtgagaggaaggatatttgtcagccgcctttatattgctttaaccccagcacctagaacagtgcttggagtgtagtaagtatttaatatttgttgagctaatgtttatgtggcatccagggatacactggacttatttgcaagctgatcctgaagtaaactaatttcatatttaacagaccaaaatgggcattccttagaagtgaaatgctgtggcaggtgtttgggcctgttttgggtgggggttgggaggcagttgagtctcctgtagtttttagaggcctattctcatgaattgccttgagttccaggaggagtatatgccttcagctcagcttctaggttctgtagagccttttatctattagtacaggtctcttaaagctgctgcttcttacttaacttgcaacccctcattttgcccaaagattctttgagtgaccatttatagtgtatttgtgatgatcacagcatagagcttgatgtgaagcagagggttagctttgaacagggggatcctagctttgccatttataacttagtaggagataacatagcatacatatgtacatttctagatagatacatatgtgtgtatattttaaaaatgcattgtgctgaaactttcaataattaggttttggttaatatttaatattttgatagcacatagttttttctgacatcttggaatgcataccctttttgtttctgcttctcaaaacatttcttgcaataatgtgtgtagttggaacatagtagtaataatattttactgtactcttgcatccaaatgcaagctgattttggagagaaagagacattggattttagatacttcaaccttaagttgatattatgtaactgtggttcagcagagataagagcaggagatttttttgggatcattatgcatagtgtacattggcttttggtgggggtacttagaattaaagagccggagggtcagaggtgaaaacatcatgcttaacttggcaggaggaagaagtaggatcactgataagagtggtcaaagaggtaggagaaaatttaggataatgtagcatacaatccataagcatctcaaatttgaaaagaatccagatggcatgttctcccatctgggagatgcttttaaattgtatacagtataaaaactgttcttccaattatgtcaagttaaaattatctttaaagctgatatgatcaacaattatccttatgtagattgtttcctttgtcgcatctcatgggaattgggttcttctcccacactgggtcccaggttacaaataataggtttaagctgggaagtggtcagggacaggaagggagggcatatttggctttattgaattctacaaagtcaaatagaattgtattggaattattttacatgcaacattggtattagtgtggctgatcaaagaattgattgtacttaaatatgcaaatagtattaggataatacaatactgcaatttgatgtcctcttcaaaatagctctgaaaaatatgattggaatttctggagtctattttgaaaaggaaaactttttttttcttttttccttctgtacttcatgtgaaataagtgtgtaggcaactactttagtttctttaagttttgtgtaaaagctaacttgggtagaaataatgctggagatgagtatcttataaaaatcacttcatttttctgcttcttgagagaatattttacagggaaattattatcaatatgaaaaatgactcataattctacttttctcattccagaagttttttttcttaattttggtaaaatatatataaaatttgccattgtaaccattttaagtatacagttcagtggcattgagaacatttacgttgttgtgcaaccattgtcaccattcatacccagaatttttttactatctcataataaaactgtacccattaaacaatagggccctgttcctccctccctccctcgctccctcccacctcccagcccctggtaatcactgttcttctttctttatatttgactattctaagtatttcatgtaagtggaatgatacaaaatttgttctttgtggctatttcatttagcatgtattccaggtgatacatgttgtaacgtttatcagaattcattcctttttaaaagtgaataatattccattgtatgtatataccatattttgcttatctactcatcagttgacagatgcttgggttacttataccttttggctattataggcattattcaagcatgaataatggtgacaggaacattggtgtacaaatatctgttcaagtcactgcattcgattcttttgtgtatatacccagaagtggaattgctccacaaatatttgagtacctagtatatggcaggcactgtgctaagcactggggatgcagcagtgaaaaagaggggcctggttcttgcccttatggaatttacagtctagtagggaaaaaagatgttaaataagcagttgcagttaagtgggttaaatgttacaaaaacgttaagcacagagtgccgtgtgtatgtttcatataattgtaataatatatatatgttaagccaaaagagactataaaacatcaaatactttttccccttccaatataatcccctgcagcacctcactacccctggccacctaccacatggaaatgtcttctgctgcttttcttcacatttaaaaatgcaatgccgctgggtgaggtggctcacgcctgtaatcccagcactttgggaggctaaggtgggtggattgcttgaggctaggagttccagaagagactgggtaacagcaagaccctgtctctactaaaaaaaaaaaaaaaaaagccatagtggcatgtacccacagtcctagctactcgagaagctgaggctggaggatcccttgctcccaggagtttgaggctgcagtgagctgtggtcataccactgaactccagcttgggtggcagagtgagaccctgtctttaaaaaaaagaaaatgcatccagaatttactttttttgtttttttgagatggagtcttgctctgtcacccaggctggaatgcagtggcacgatcgtggcacgatcttggctcactgcaactttcgcaccactgcaacctccacctcctgggttcaagcgattcttgtgttttggccttctgagtagctgggattacagtgccaccacgcctggccaatttttgtatttttagtagagatggagtttcaccatgttggccaggctggtctcgaactcctgacctcaagtgatccgcccaccttggccttccaaaatgttgagattataggcgtgagccaccgcaccctgccggaatttacttttgaatatgatgtgaggcagggctgtacactttagtctttttttttttttttgcctttttttttgcccttttttttttttttgccgtatcatgaaccaaaaccaactactttccttgtacatttgtctgtttctatatcctcatttttaggtagcaatacttctataagtagctttatctttttccctatctaattgtgtccagcagttggaatcacgctgtcagtcagcatgaacatttttaaagctcttggtaactgaagttatattgttttctaatagggttgtactgattttacagtgccatcagtgctgtgatacgtggtaaccacattttccctgcttcggagatgttaaacagtccgtgcagttcctcagatttctttaatttgcatttctttgattactagctgaaattaatatttccccttgtttttcagcaaggtattgtgaatgtgactgacaaacttaagtttaacctgagagggccttataaattatgagtatacagtagtttttagtaaattactggcacttttttttttttagtatttagatgtatctactttttttaaattgagtttgtgtattttgtaatgtctgttcaccttatttgtggttctcctagttcatttcaatttactacttaggaaacctgaagtaatctatccatcctcttgtttagcctagtagtgctaagttgcattcagtggatagccaattcgtggatgagctgagttcaagtgttttgtaaatagagtatgagagaatcagtgggaagagcccagatttttttttcttactgtagtgtaatctttttagcagtgaagcctatagtgaaatgagatttttattagtaacttagcctgcttcttgatagtaatagttatttatagtcatgagccggacggataaagtaaaattggctgtttgacataattcttttgaaaaataattatataattgtatttatctttatgccaggtggtagtagtctacataaactacttccaggtaggaagtccgcagtattctccttttggggatttgtcagtaccaaggcattgcagaacctatggaaaaagatatcctttatgatatctgagaatgttctggactagctaactttagagtggttaaagagacactaacaacttagtggtgaaaaattttccaggtgtagaaagagaagttaggggcaaataaaacattgtatagagcagttaattttgtttcctttaacctgtgtcagaaaaagaataattttcttttcttttctttttttttttttttttttttgagacggggtttcgctcttgttgcccaggctggagtacaatggcgcgatcttggctcactgcaacctctgcctcccaggttcaagtgattcgcctgcctcagccttcctgagtagctgggattacaggcatgcgccaccatgcccggctaattttgtgtttttagtagagacggggttctctatgttgatcaggctggtcccgaactcccaacctcaggtgattcgctggcctcagcctcccaaagtgctgggattacaggcatgaagcatcatgcccggccaaaagaataattttcaaacatcctttatagattgacttatttaggaagatagaatgtattatttatagttttgctgaaaataatcatgcatgttacattacatttaaatgcagtgaatggagagccctgttcccctttcagcgtaatcatcttgttttattttcatgctagcatttaccagtacttggtattttctcatttttcttccccctcaatagactttaagctccatgggggcaaaaacttctctcttcaatgttgtaaacatggtgtctctaatagtgcctgatatatagcaggctctcaagaaatatttgttgaatgatttaatttagtgctttatctggatactgatcaaaatattttatttaatttaaatttttttttgaggtgaggtctcactctgtcaccgaggctggagtgatctcagttcactgcagcttctgcctcccagggctcaagtgatcctcccacctcagcctacggagtagttgggcccacaggcacacgccaccacacctggttcattttttgtatttttggtaaaggcagggcttcaccatgttgctcaggctggtctcgaactcctgagctcaagcaatctgtctgccctccttggcctcccaaagtggtgtgattacaggcacaagccaccgtgcccagcttctgattaaaatatttataaataaataaatttagtcttagttgtgaatataactgcatttctgaacctaccactcagattcttaaacatcagtctatgaagcaggaaaaagttttgagatctgagaggcttgtcagtattactgtagaatacaagaaattggagccaaggttaaaaaatacagtctgaagctcattaaatacttttttttttgctctatttaactatgtctgaactcattattggcatgttttcttctgatcagttgtccttacaagttaagacaaccgtttattccttttttttgaaacaaggtctcactttttcacccaggctggagtgcagtggtgtgatcacagctcattgtagccttggcgtcctgtgcccaagggatcctcctgccttagcctcctgagtagctgggactacagatgtctgccaccatgcctggctaatattttttattttttgtagagatggcgtcttactttgttccccaggctggtcattatgtgctttaatcaaatgtaatagtagcaatgattccacgatagttttagtttgcatagcactttcactctgtcttcatcataataatgatcctttagggagggaggtcttatggtattttttattttttatttttagacacgattttgctctgttgcccagactggaatacagtagcaagaccacatagctcactgcaacctcaaactcctgggctccagtaatccacccccttcagcctcctgagtagctgggattacaggcacgctctaccgtaccaggctaattttttttttttttattttcggtagatacgaggtcttgctatgttgcctaggctggtctcgaactcctgggcttaagccatcctccctgctccacagccagcctcttgtattcatgctactttacaaagaaggaattagcctttcagaggagctaagaaacttggcccagggttacacaattagaattagtaatatgaacactgggacatatatcctgtgttctctggttctggttctgtgttttttagaaccatagaattttagaggaggaagaagccttgaagagtagtactctaacctcacatatatatatatcatatatatgtgtcatatatcatatatacatatatgatatatatcatgtatatatgcatgtatctatatatacatatatgtatcatatatgtatatatgatatatatgatacatatgtgatacatatatgatatataatatatgtatatatgtgtgtatatatgggaaatatttatttacaaatatatatgatgttaatatatataataaactaactttataaagctaatatggcagagttaggattccaacccaggtctcttccttagatcagtcctgtgatctttctaatcttccatgtctttgattctggagatgtgtatgctacctgatgaaatgtctgataacaaaggtatttgagtttcttaatagttttctgtcacatgtttgttcttgtaatggtgaatagcttccaaaaacatttgaatttattttgaggcagcttgggatggtggaaagaacttatgctttagagacaagtagatttaagagcacctatgacacctttattgactgtgtgaccctgttgtttactaatctgtaaaatgggcagaatatcatctaccttgaactaaaacatagtgtattatgttgagtgtctgacatagaatgtgctcgataatgttaccattgttttagaaaatgttacagagatgaaatgtacttcattacagtatagaaagggacaactaagatgaaaaaacgttttggaaagcatttgaccaaaggttttatatctgcattcatacagattgatatgaataacttatgattttaaatgttagtgaacatttttttttttttagaatatcttttttgaaacagggcctgcgcagttttctctcaaacttctgggctcaagcaatcctcccacctcagccttctgagtagctgggactggaggtgtgcgccaccatgtccagctacttaaaaaaaaattttttttttaattttttttagacggagtctcgctctgtcacccaggctggagtgcagtggtgcgatctcagctcactgcaacctccaccccctgggttcaagcgattctcctgccttagcctcctgagtagctgggattacaggtgtgcgccaccatgcccagctaatttttgtgtttttagtacagacgggtttcaccatgttggtcaggctgatctcgaactcctgacctcgtgatccacccacctcagcctcccaaagtgctgggattacaggcgtgagccaccgtggtgtcgcccaggctggagtgcaatggagtgatgtcggttcactgcaacctccgcctcccaagttcaggcgattctcctgcctcaccctcctgagtacctgggactacaggcatgcaccaccatgcccggctaattttgtatttttagtagtgacggggttttgccttgttggccaggctggtctcaaactcctgatctcaggtgatctgcctgccttggcctcccaaagtgctgagattacaggcgtgagccaccatgcccggcctttaaatttttttgtagcgacgatatctccctgtgtttcccaggctagacatctatcattttaagttcttcataacttttcaaggaataggtgcaaatctctgcattttacaaatagaaaaaattgtagagatgcatcttgtctttaatcaagagccctaaagtaaatctacttgggtctaataatgagaaaataagggataattcaacataaaatctgtacataggaagcgttgttagttattacaatgaagtgttggggtcagtcttaatgtctaataataaatgagtagattatcacatctggtggaatctcataaaactattagaagtttgtattatgaatattacagaagtgcctagaagtgcatatggagatgaaaagttgtgtacaattgtatccattttgtggttatagttttgaaaaatctacaaagtcatacaggcatatacatgtggacaaaggctgggaaggaaaatgaaaataggtgatttttcagggtattataatgctatgtgattgttctgattatttttaaagataattttgtgtaataaagagggagaaaaccaagatgatatatttcccatgtagtgtgcactgaagagcattggcattaaaacagtcaggggttccacctagatgatgtggtttatagtatattgtatcttatactttgggggaattttaatagtcttgactactggcttttaattttttattagtaaacttttagcatactatcattcaacccattgcattttaccatggagtttcactattattttattattttcttcttcttcttgagaattatggccacaataagtagacttgtatgttatgtaaataaatcttaatggactttttttttttgagaatcttcaacttggtgtcattaaagaagcatttttaagcccgagatatatgttccattgcagtattatgagggaaatcatccattataaacttctatgcccatagctttttgtgtagcttgtcttgtcaatcagcaaagcaaatactttactgctctctgccttccaaattacttcatatattttatggttgatatactttatggtatgtgtgttcttttctgtttcattgcttccataaaaaagactggttgaggtgttagtttgatttcttctctttttccattcatctgtgagtactactacaagacacagtgcaccattgattcttgcattcctcatttacattctgattttaaaagaagcttgttaaaaagaatttgcctgggtaaatggtactatagtcttggtggtttgaaaacttagagaatgctttttcagttgtttcattccagttaagcatattgttaaactgataaggttcattctctctgtgtgtctctgtctatctgtgtgtgtcttgcctgtctctcccaccaccttctcccctcagcccccaccattttgttttaaactaatcttcagggagtatgtccacagtgaaactattcagagttccctgtactgtatgtaattccttggaatgtttgcctttcttgagttgttgtgtattttacagaagtagttagtatccggtagacttaatgagttttgtagcatggtcttcacatcttcaaagagtttttgactgtttagagcatactacttcaaaagaaggaataattttattaataattgtgtaaaaataatgatccctgcccatagcaaaaatttagtacaaaaggggtataaagtgaaagatttcatttcttccattccaagtttttagaagtaaccactgctgatagttttttgtatcctagaaatttcctaatcataaacgaattgaattatatgtattgcattgtaacttgctcttttcactttattatagtaccttatattttacaatatcagcatattttaaagcagcatatacattgtatttataaatctaatcatccccatggcttttagaaatgcaaaaattttatttaaaactcatatatgtatatgtatgtgacttagtgttttttcttccaggaaaagtggtattatataattattttctttttttctttctttttttttttttttgagacagaattttgctctgttgcccaggctggagtgcagtggctccatctcggctcactgcaacctccgcctcccgtgttcaagcagttctctgcctcagcctcccgagtagctgggattacaggcgcccgccaccatgcctgggtaatttttgtatttttagtggaaacagggtttcgccatcttggccaggctggtcttgaactcctgaccttgtgatccacccacctcagcctcccaaagtgctgggattacaggcgtgagccaccacccctggcaattatttctttatactacgttagcctaacatttttttttgttgcattgaggatgtgatttagggcatactttatgttaaaagtgttactggtagagggtcttgactgcaagttgtccaggttcttggcattttgaacgaagaattggacaaaacacacatcaaagcaaggaaagaatgaagcaaggaaagcagatatttattgaaaatgaaagtacactccacagagtagaagcggctggaccagcggctcaagagccctggttacaggatcttctggggtccaaataccctctagaggttttccgttggccacttggtgtacaccccatgcaaatgaagtagtggcctgtgatcagtctgattgattgtggaaagcaagcaattgggggctgaagtgaagttacaaagttacgctcctatgcaaactttgtaactatacaaagtgatactcttaagaaaggtactttcagttttccctctgccacacagaggtactttagtatggagagttacttaggtatggagggttgaggttttccttttgatttagttctaggaagtcagggtgaataggccttattccacctgcctccagaccccattctcttgcctcaaaagaacaaactttactatgtacatattttgatggtgtcttttcagagttgtgtttaagatgcagtttttgttctcaatgtccacagtcttaatacagaaggtagctaatgaaacaaaaatactagaatagagtcattattgtaatgatggaaacttacataaagtataggaacagaaagaggtagtgattatctcagagatttcaaggagtgtgtcttacagaggaggcgtagtgattgaggttcagtagtttatcacgacattccaaaccacctgacctccatctcgcataactctaactgctcttagttccctggggacaccaggctgtttgcctagatatttctttgcttgggctgtttctaatgcctagaatattcctgtacccacttgccagcataacagtacatgtccttccagatttagattgaggttacttgaaaaccatacctgaggtttcctttcccagaagagctactttctggtgccctgaggcttcctaagcatattcatgccagtgtgctttcagtgtaccctatagtaatcacttgtgtgacaccttcactatactttaaattcactggggggagagagtatgttttattcattttccctgaacattttattatgaaaaactccaatgtacataattgtatagtgaatactcatatacctatcacctagatttgacttttagctttttgctctacagtcagcccttcatatccatggttacccatttgtggattcagccagtatttgaaaaaacctgctttaatctgcactgaacatatagagattttttcttgtcattttccactaagtaatatggtataacaatttttttttttttgagacggagtctgactctgttgcccaggttggagtgcaatggcatgatctcagctcactgcaacctccgcctcccgggttcaaatgattctcctgcctcagcctcccaagtagctgggactacaagcatgtgccaccatgcctggctaatttttgtatttttagtatagatggtgtttcaccatgttggcaaggctggtcttgaactcctgacctcaggtgatctgcccgcctctgcctccctaagtgctgggattacaggcgtgagccaccatgcccggcccaacaactattttctttttttttttttttgagacagagtttcgctcttgttgcccaggctggagtgcaatggcgcgatctcggctcaccgcaacctccgcctcccgggttcaagcgattctcccgcctcagccttccgagtagctgggattacaggtgcacgccaccacgcccagctaattttgtatttttagtagagacggggtttttccctgttggtcaggctggtctcgaactcccaacctcaggtgatccacccgcctcagcgggattacagtgctgggattagaggcgtgagcaacgacgcctggccacaacaactattttcatagcactttcattatatttgctattacaagtaatctagaagtgatttaaagtatatgggaggatgtacgtaggttagatgcaaatattgggccattttatataagggacttgagcaactatggattttggtgtccttggggtgtgctggaaccaatcccccatggatactgagggatgactgtatttgttttgtcaggtaccatccatctagcttttgtgctctgcgtttttaaacatgcactccaaagtaagttgcagacattggtgtatgtcacctctgaagaattcagcattaaaatccttaattttatttattattaactctttattttaatccttttttacattttaaaatgtgtattatttttatcatcaggcctaccacagtgctgctacagatatacttaatatttgaattgaaatctcttaaaatttttaaattttactttttttttaaatttccgtagcctttttactttgtgcatttgagtctaagtttactgcactcgaagagatcaattcattgagggctgtagtagggagagtttcatggaacaaatgctgtgtttttcttggagacagggtctccctctgtctcccaggctggagtgcagtggctcaatctcggctcactgaaacgtctacctcccagacttaagcaattctccaacatcaacctcccaagtagctgggaccacaggcacacaccaccatgtccagctaatttttgaatttttttgtagagacggggtctcaccatgttccccaggctggtctgaaattcctgagctcaagagatctgcccgccttggcctccgaaagtgctggggttacaggcgtgagctactgtgcctgtcctatggttttaactggtccttaaagaatgattctgcattgagtacaaagggggtggttatggttacaggctggagaaacagagatgggaatgagtactttccatggaataatgagacaaacattgtgattgaaactgtaggttcaattttattaatagaaaaagcaggtctttggtttttgcaggatcttgttgggattgattatatttaaatataagtgcctaaaaatgataccttgtatttttcttaaacgatacatttttctagttgggtaaacttttgagttatttagactaaaaactgggtggcttagtgtttctgtagaagatagaaaatgaacagaggagccagtcacagtgactcacacctgtaatcccagccctttaggaggctgagtccaggagttcaagaccagcctgggcaacttggtgagaccttgactctacacaaaaaacaatttttaaaaaaattccatttaaagaaaatcggggaagatcccagtggtgagttgaaatctatatggaatgaacttcctggagattttcaatctcgcttaccttaaatttgagcaatacctttcaggaaaggtacattttttttttcttgtggaaagaagagtagtgtggccactggtggcttattctctggaaagcttcttaaggacattctggggaaatgcatcattgagctgtgggttcctggcatttgagtgaataatgttcagatgattaagtggcccaaggcaggaagcagggagaatgtttgcttctcttccctagctactcatacctcctgtttctctaaaactgggtaatcctatatataacaggttgctgattccatgacttagaatagcttttcttaaagtggagtatggattcacctatattaggggatttatgaataatacaaatacctgagacctgtatacagatctactgaatgagtccttggatgtcggacctgtgaccatgcatttaaacgaacattttatatgatttttatgcatattggaatttaagagaactgctctcatataggtggaattttccataatttatttattaaacaaccacctataggcattatgggggagttactgctcctctttaggaagtataattacaggcagtaaatgctgtcttagtccatttgtgttttgctgtaacagaacacccgaggctgggtaatttataaacaaaagaggttttagctcagtgttctacagtctggaaaataagagaagcattgcaccatatctacttggcttctggtgatggttacttgctaggtcaaaacatggtagataaggtcaaaggggaagtggacacattcaaagagagaacccaagggatagcttggctttatagcaacagccccactctcttgggaatgaatccatttccaggagaactaatccagtctcaccagagtgagaactcagaatctcactcattaccaaaagattggcaacaagtcattcatgagggatctgccaccatgacccaaacacctctcagtaggctttacctcccaacacagccacgttggggatcaaatttcaacatgagttttggtggggacaaacaaaccatatctaacccaaagcaaatgcctattgctttataataagattgatggtaaagtgcagctgttggggattttctgctgctcaagattttgctaaagatcgttttgtgtacacaattgtaaggaaactattatttttattgcatgtattgaatgaagagtaagatatttcaggggtttctatgtgatagttttagatagttccttaagtacaaaggaaggaaattaagaccttatgtttgaaattgagtgattcacaatactttaagagtgtagtcttatttttgttctgaagagctattatgtggattatcctagtaagacaagtatatatttatgagacaaatatgtagaagatgagttcaagcctagattcttgcctcttagctgtgtgaccttgggaaaagcttttaacttaaaaacaaattcagcgttgattagtatttaggggaagttgatttgctgtagaaaccatgttatgctattacttgcgtaagtattttggtaacacttctggtattaccatggtagtataaaagcatttttttccctctcgtataatacagaaacaacaacgtaaacaaaaaacctctgcaaactcctatttttagcacacttggagacataaaatgtgccgattacaaaaaatgtgtagaggggccggtaggtcgtgcatcaaagaagtgtggagaatagtgagctggcccagagatggtagatcttagaaagcttgactgtaaaatacaataatatcctttgtatgtgacaatgggagcaggtaaagagatgagcaggctacaagataaagcctttatggaaaaggtttagtcacgactagggagatatggtagggcttttgcacaacgaatccgttttagcaggaaatcatctctgtggaagcagtggagagaacttttgacttaagaagcctgaaaggctatttatcctaacatataaagagctctttggagtcagtaagaaaaagatcattagcagtggctcacgcctgtaatctcagcactttgggaggccgaggcgggtggatcacgaggtgaggagatcgagaccatcctggctaacatggtgaaaccccgcctctactaaaaatacaaaaaattagctgggcatggtggcgggcgcctgtagtcccagctactcgggaggctgaggcaggagaatggcgtgaacccgggaggcagagcttgcagtgagtcgagattgcactgctgcactccagcctgggtgacaaagcaagactctgtttcagaaaaaaaaaagaaatcattagcttgttaagaaaatgcaagcagcatttatgaaaaagataatatgaatggcgcttaaataagaaaaatagagaagtgcttattaaaatgacagatatcccttcttagacctgtttggttcctgatttccttagcaagagttcagatagtgattaatactgcattatccaaatctgtttggttgatgttttgagtaacaagggatttattgaaaatgtatgcttggttcctgagattgtgaagtagaattttgtgtagggaggttcaccagtatcctgaataccactgttcacttagcagattgccaaaaatctctaaagtcttgacagcactgttggtgactgtatagaaactgacagatccgtacatacattgccggtggaagtataattcgatataacccccgaacatggagggcaattttgatatctgttaaaattacaaatgcatatcgcctttggccaatgccttcaatcatgtttcagtcagtatgagggactacttatgtgttaattggttaaaacaatcacagcaacatagaattaaatattaaatattattcagatagctgaaacagatagctttgaggttccaatgtagatgttgatgaaataacatcagaagaaagcatttgagtatgggcaggcgaacactgatggacataaattaaaaaattaagatatttatatacagtctaatttacactttttagcggatagttctgggagttttgacaaatgtatacagttgtctaaccatcactacaattaagatatagatcagttccagtacctctatttccacatccctccaatattccttggtagtccttctttcctccccaaccatagcccctggcaaccactgatttctttctcatttatatgttttttttgctctttccagactgtcatatacatggagtcatatagtaagtagccagttgagtctggcttctttcacttagcataatgcatttgagattcatccggggtgttgtgttagcagaaatttgttcctttttattactgagtagtattccattgtatgagtataacataatttgcttatccatttaccaccagttgaaggacatttgggttatttctgcttttggtgactacaaataaagctgcctagaagttttgatagttttaggtttttacatttgagtctagcatccattttgagttaaatttttgcatatggtacaaggtatggaaagaattaactttttttgacatatggatatccagtcattccagcaccatttgttgaaaagactatctttcttcattgaattgccttggcacctttgtcaaaaatcaaatgaccatatgtgtgtaggtccatttcaggactttctattctatttcattgatctgtcttgatcaccattcgcactgtcttaccgtagctttatagaaagccttgacatcaagtagtgtgagtcttccaactttgttctttttcaaaatggttttggttattctaacttctttgccttttcacctaagaatcagcttgctgattttgaaaaaaattttagtagaattttgatgagacagatttctaaaaattgtggtagcatatatataacaaaattttctattttaacttttgaagtgcacagtttagtggcattaagtacattcacattgttttgcaactatcgctaccatctgtttctagcaacttaaaaaattttcccaaactgaaactctggacccataaacaatgactccacagtggaggaccactacacccagcacctggcaaaccaccattctactttgtctctttgaatctgacacctttaggtacttcatcccgtatttgtagaataatagaatatttgtccttttgtgactggcttttatttcacttagcccattgtcttcaaggtttatccttggttggttggttggtttttgtttttttgagacagagtctcattctgtcacctaggcgggagtgcattggcacgatctcggctcactgcaacctcctccgcctcccaggttcaagtgattctctcgcctcggcctcccaggtagctgggattataggcacccgtcaccctgcctggctaaattttgtatttttagtagagacaaggtttcaccatgttggccaggctggtctctaactcctaatctcaggtgatccgcccacctcggcctcccaaagtgctgggatcacaggcgtgagccactgcgcctggtcccttgttgtttaatatgtcagagtttataatctattgtatgtatataccacattttgtttgtccattcatctgttgatggctcctcgggttgcttccacattgactgttgtgaataatgtcgctatgaacatgggtacataaatgtctttttgagtgcttgctttgaattctttggggtatatgcccagaagtgcaattactggatcatatggtaatactgtgtttaattttttttttttttttttgcgatggagtctcactctgtcacccaggctggagtgtggtggcatgatctccgttcactgcaacctctgcttcccagtttcgagattctcctgcctcagcctcctgggtagctgggattacaggtgctcgccaccatgcccaactaattttttttttttttttaagtagagatgggattttgccatgttggccaggctggtctcgaactcctgacctcaagtaatccacccgtcttagcctctcaaagtgctgggattacaggtgtgagccaccacgccctgccgtgtgtgtgtatgtgttttttttttttttaaggaacagttatatcgttttccacagttacatccccacagtttcagtttctccattttctcaccaatatttttttgtctgtctatccatctatctatctatctatctatctatctatctatctatctatctatctaactaactgatggccttcgtaatagatatgaagtcaaatcttaatgtgatttgatttgtacttccctaataattagtgacctgagtctctttcaagtgctttggatagatttttaaatatagttttaaatattcttataaaagttgtatatgtacattgtagaaaaaatctacagataactaaaaataagaaagcaaaaccaggccggacatagtggctcatgcttgtaatccaagtgctttgggaggccaaggccgggagtatcacgagaccagcctgggcaacatagcgagaccccatctctacagaaaatgaaaaaaaaaaattagccaagcatggtggtgcctgggtgcatgtctgtagtcccagctattcaggaggctgaggcaggaggatcacttgagcccaggagttcgaggtgacagtgctctccagcctgggtgacagtgagactctgtctctaaaaaaatagaaagaaaataaaaccatcctgtttttatctttcagacatttttctatacacatatatatgtgccattaaaaaagaaacaccccttcagagtagaggaagcagagagacattattctatacatgtgcttttgtgtctgtcttgtctttttcttccctccttttcttccttttttatttagctccaccatttcatgtcagtaacatttaattttaatgcccagtccacattcacatttctccaagtattcataaacatgtatcatatctggtttatccaaaccatacatgcattgaatctggtttctctctccctcctcctaccctcctccctcccccttctctccctgtctctctcagacaggatctccctctgtcacccaggctagagtgcagtggcataatcatagctcactgcaatctcccaacttgtgggttcaagtgattctctggcctcagccacccaagtagctgggactacgggtgtgtgtccccatgtatgcctaatttttttgtttgtttgtttgagacagtcttgcctctgtcgctcagggtggagtgcagtggtgctatctcggctcactgcaacaacctccgcctcctgggccaaagtgatcctcctgcctcagcctcctgagtagctgggactagagatgtgtgtcaccatgcccatctaatttttatatattttgtgtagccggggtttctgcatgttgctcagactggtcttgaattcttgggctcaagtgatccacccacttggcctcctgaagtgttgggattacagctgtgagccaccctgcccggccatagtttttttttttttttattttttgtagcgacagggtcttgctatgttgcccaggctggtcttgaactcctggtctcaagtgatccttccatgtgaatctggtctcttaagcctcaactctaataacctagcacagctcaccctccttttatataaactacagtcatgtgctgaataatgacgtttcagtcaacgatggaccacgtacagcatgatcgtcctataatattgtaatggagctaaaaattcctttcacctagtcatgtcgtagcctttataacgtcttagtgcagtgcatttctcatgtgtttgtggggatgctggtgtaaattaacctgccctgccagttgtataaaagtatagcacatacagttatgtatagtacataatacttggtaataactgtgttacttgtttacatatttactatttatcattattttagaatgtactattacttataacaaattgtggccaggcatggtggctgatgcctgtaatcccaacactttgggaggctgagacgggaggatcagttgagcccaggagcttgagatcatcctgggcaacatagtgagatgccatctttacaagaaaaatacccaaaaaaattagccagacatggtggtgcatgcctgtagtctcagctacttgagaggctgaggcaagaggatcgcttgagccagggagttcaaggttgcagtgagcagtgatcacaccactgcattccaccctggatgagagagtgagacgagaccctgtctcaagggaaaaaaagaaaaagttaactgtaaaacagtcttaggtccttcagtgggtattccagaaaaaggcactgttatgacagatgacagctccacatgttattgtccctgaagaccttccagtaggacaagatgtagaagtgtaagacagttatattgatgatcctgaccctatgtaggcctaggctaatgtatatttgtgtcttagcgtttaacgaaaaagtttgaaaacaaaacaaataaaaattttaaaaatagaaaacttacagaataagaatataaagaaagtatttttctacagctgtgcaatatgtgttttaagctaagtgttataattaggagtcagtgtaaaagtttataaaacaaaaaagttacagtaaatgaagtttaatttattattgaagaagaaaaaaaatttttttttctttagagacggagtcttgctttgtcacccaggctggagtgcagtggcgcaatcttggctcactgcaacctcggccttctgggttcaagcgattctcctgcctcagcctcccgagtagctgggactacaggcgcgtgccaccacgcctggctaattttttctatttttagtagagatggggtttcaccgtgttagccaggatggtcttgatctcctgacctcttgatccatccgcctcggcctcccaaagtgctgagattacaggcgtgagccactgcacccggccaaaatatttaaaaaaatacattcagtgtctcctaaatgtacagtgtttataaagtgtacaatagtgtctagtaatgtcctagaccttcacgttcactcaccactcactcactgactcactcagagcaactttcagtcctgcaagctccattcatggtgagtaccctatacaggtataccattttttatcttttatatggtatttttactgtacccttttttaggtttatatatgcttatatacacaaatacttaccattgtgttagttgcctacagtatttagtacagtaacatactgtataggtttgtagcctaggagcagtaagctatgccatgtaacctagtgtgtagtaagcctaggctataccatccaggcttgtgtaagtacactctgtgatatttgcacaacgacgaattgcccagtgatgcatttctcagaacttaccccattgttaagcagcacatgactatatattgaggtataatttacatacaatagacatcacccatgatatatactcccttgcaaccatccacaacaatcaagataacatcatggctgggtggctcacacctgtaatctcagcactttgggaagctgaggcaggagtatcgcttgaggctaggagtttgagtcaggcctaggcagcaaagcaagaccctgtctctacaaaataaacacacaaaaacacaaaaatattagctgagcatggtgggatgcagttactgaggagggaggatggcttgagcccaggaatttgaggttgcagtgaactgtgatcatgccactgcactgtagtctgggcgacagagggagaccctgtctcaagacaacaacaacataaaaaccccatctccattaccctcaagtttcttcttgcctcctttctgtcaaggtagattagtttgcattttttgtaatttagaatttcatataagtaaaatcttacaatagtagatacaccacagtcttcatataatcccaactctttgggaggccaaggcgggagcattgcttgcactcgggagttataggtttgaatatatcctaggtgattttgtatatttgttgtatctttcctgtagatacgttagtgatgataaagttaattcctggcttagggtgatgactgtccaattttcttattgtactgctaggttttcaccttatgagtagaaaattacctgtgtggttttacttgggaactaaaagatggccagttctgcgtcagccatacacctgattttttttgagacgaagtttcactcttgttacccaggctggagtgcaatggcgcgatcttggctcactacaacctctgcctcccaggttcaagcgattctcctgcttcagcctcctgagtagctgggattagaggtgcctgccaccacgcttggcaatttttctttctttctttctttctttttttttttttttgtatttttagtagagacggggtttcaccttgttggccaggctggtcttgaactcctgacctcaggtgatccacccgcctaggcctcccaaagtgttgggattacaggtgtgagccactgcacccggccacacctgattttttgtttgtttgtttttttgaggtggagtcttgttctgtcacccaggctggtgtgcagtggtgcgatctcggctcactgcaacttctacctcctgggttcatgcaattctcctgcctcagcctcccgagtagctgggattacagggatgtgccaccacgcctggctaatttttgtatttttagtagagacagggtttcaccatgttgaccagggtggtctcaaactcctgacctcaagtgatccactcaactcagcctcccaaagtgctggattacaggcgtgagccaccgagtccagcccacacctgatatttttaattacagttgctaatcttgtttgcgtcactgatttcattgttagttagggaataatttccaaaatcactcctgtattcactggcttctttagttttctttcatcaactgagattgcttgttacctgaaatataatttttttttaatatattttttgagactgagttttgttcttgtcactcaggctggagtgcaatggcgtgatctcagctcactgcaccctccaccttccgggttcaagcgattctcctgcctcagcctcccgagtagctgggattacaggcgcctgccaccacgcccggcaattttttttgtatttttagtagaaatggggtttcaccatgttggccaggctggtcttgaactcctgacctcaggtgatccaccctccttggcctctcaaagtgctgggattacaggcgtgagccaccgtgcccagcctgaaatataattcttaatgaaaaggtagggtaaatacttaattttttcctttagttaccaattttcaaattaaggtgttaatttagtaactataatgataacatagatttgttcttttatctttttttgaggtttattatagatttttattggtttaatatattttaatacactatagtcatgtgtatttgtttttgatgtattttaaaaatcagtttatattgatactcctgatgaaacattttttgctttaacttttttatggtaaaatacagataacatatacatttgaaccatttttaagtgtacagttcagtagcattaagtgctttcacatttgttgtgcagccgtcaccaccatccatctctggaactttttcttttttgaaaactttctagaggttcatatttattggcatttgacctagagtcttcctcatgggcaaggtgcagccctgggcaggactatcagcatcctgctgtctcctcaattctgttaatccaccaatcctaatccctcctaaccccactcatagtccagagaagataaaaagttcagggacatggtgtactgctctccagatcctttcccagctgaaactctatacccatttagcactaatttcccattttccctagcccaagataaccaaccaccattctactttctctttgaatttgactcctaggtacctcacatatatattcctatttagtggaattgtagactatttatccttttgtgactggcttatttcacttagcactgttttctaggttcatccatgttgtagcttctgtcataatttccttcccttttaaggctgaataattttccattgtgtatatgtaccatattttgttcatccattcattcattgatagatacttgagttgcttctaccttttggcaattgtgagtgatgctgttatgaacatgggtgtacaaatgtctgttttgagtccttgttttgctttcgtgcattctattaaaaatgttaaggttctttgctttttacttttttttctcttttatccaccttttgactttattcttaaagttttatcttggtataataatttatggtatgttgcagaattaggagcaaagtcccgtgtgtccttcactcagtttcccccaatggtaacatttttcataattacagcacaatgtcaagaccgggaaattgacattgatacagtccatatacaggtgtcccttggtatctgtgggggattggttccagaaccctcgatgataccaaaatccatggatgcttaagtttattagataaaatggcatagtgttttcacataacctacacacatcttcctgtatactttaaatcatctttcgattacttataacacctaatataatataaatgccgtgtaaatagttatattgtattgattttatttgtattttttttattgttgttatttttcattgtgttttttccctgaatattttctatctgtggttggttgaatctgagcatggggaacccatggatatggagggctaactgtatttattcagatcttgctagttatacatggactcatttagataactatgtttgcatgttttatgtgtataattctatgcagttttatcatgtgtggataggtgtaagcactaccaccaccatcaccatcaccatcaagacacagaactgtcccatcatcacagatatccctcacactactcatttagttacactcactcccccaccccttctctccttcctctatttggtttctaatctgtgtcaaccactaacctgttattcataattttgacattttcatggagtcatataaatggaaatcatactgtatataactattgagtttttgttttgttttgtttttgcatttagcatagtttccttgggatccatccatgttgttatatttcagtaattcatttctttctattactgagatgtagtctgcggtacagatgtaccacagtttgtttaaccatgtactcattgagggatttttgggtttgtattagttttttagggctgcctaacaaagtagcacaaactgggtggcttaaacaacagaaatttattgttctggaggcaagaagtccaagatcaaggagttggcagggttagttccttctgagagaatctattctgtccccctctcttagcttctggtggtttgctggcaatctttggtgtcctttggctggtagaagcattacctcccatctctgccttcattttcacatggtgttctccttgtgtgtatgtctctttgcaaattgtccttttttttattagagtaccactcatattgcattcctccctaaggacttcgttttaacttgataacttcagtaaagatcctgactccaaataaggtcatattctgaggtactgggggataggacttcaacatatgaatgtttgggagacacaattaaacccatagcagagttgctttcatgttttggctattacaaacaaaggtcctatggatgtttatgtacatgtttttacgtagacataggttttcatttctctgggataaatgctcaggtgtaaggttactggtggttatggtaagtgcatgtatggtttttaaagaaacgtctaagctctttgccagagtggctgtagtttacatttccaccagcagtgtataagaatcagtttctctgcatctttgctatcatttggtgttgtcactattttttttttttttttttttgagagggagtctcgctctgttgcccaggctggagtgcagtggcacaatttgagctcactgcaagctctgcctcccgggttcacaccattctcctgcctcagcctcccgagtagctgggactacaggtgcccaccaccacgcccggctaatttttttgtatttttagtagagacggggtttcactgtgttcatcaggatggtcttgatctcctgaccttgtgatccgcccacctcggcctcccaaagtgttgggattacaggcgtgagccaccgtgcccgggctgtcactatttttttattttggcaattcttacagatgtagtgatatcatgttgtggttttaatttgtgttttcttctattcagtttaacatgtgttttaaaagtttgtttgctaattatctcttttatacttaatatcttgattcttagggtcattaacaagattgcttgccttctcctatagtataaagaaaataacttcagaaaaacagaattagtgtagcagacaacagaagtattgtatgaagtttaattttctttccttcttttttttaaaaatagagacatagtcttgctctgtcacctaggctgcagtgcagtgacctaatcacagctcactgcagcctcgtactcctgggctcaagcgatctctctctctctctctctttcttccctccccctccaccctttccccctctcccttccccgctttcctccctctccctccctctccttttttgtagagaacaggtctcgctgtgttgaccaggctggtctcaaacccctggcctcaagcgatccccccaccttggcctcccaaagtgctgggattacaagtgtgagccatcccatcctgctttaaattttcttctttttgtccttaaaattcttcccactaaggataagcaaagtgttgtgttctgacctcactttatatgaatactttctctgtatgtctgtgttattgatttgatgtacatgattaggtttttttttccaatttgtctttaatttcagaaatttctgtttctatgacagtgacataacctaacaaaattcagtttcatttgaatgagtatgacattttccttattcaaaagttaaaattatatgcaaaggtatatatagaagtcttccacagattcctgtctcgtatatttcttttatcatcccttcctccttacaacttggaaaaagtgtttcttgttaatcctctcagtatttttttgtgcaaacaaatacatccattcatatacatgttcttactttgtgaaaggcatcacattttacattatattacataatttgatgtaaacttaaatattaagtagcagacctaacagaagactttcagagttgtgttaatgctgttttttatgttgtgagagttgaatctgctacactgacttccacattattttgtgatctatgagttatgatcaacatgagatagtaggttcactagtaactaagttcaagtatgtaacactggaaaaactgcttgttgctttatgactttgggcagaaaaacagacaggtgaaatgcagttgaatactttgtaaattatggttagccaaagtaggtgacataggactaacctgtgaaaggggacataatgaagtaaaacattcaagtaaaatgacatgataatggcatatttggcaaacatcttcagaatagattatatgtagaagttggaggagaaaagtttttccctttcctagttgcaatttattattattattaattttctttctttttttttttttttgagatggagtttcactcttgttgcccaggctagagtgcaatggtgcgatctcggctcactgcaacctccgcttcccaggttcaagcgattctcctgcctcagcctcctgagttgctgggattacaggcatgcgccaccacgcctggctaatttttgtattttagtagagacagggtttcaccatgttggtcaggctggtctcaaactcccgacctcaggtgatccgcctgcctcagcctcccaaagtgctgggattacaggcgtgagccaccgtgcccagccctattattaattttttagagacagtctcgctgtgttgcccaggctagtttcaaacgcttgggctcaagtaatcctcctgcctcagtctcctaaagtgctggattaggggcatgagccaccatgcccagctgctagttgcaattaatttattaatcaggatagctaagcacagtcatttatggtgggtggagggagacagagggagagggagattgtgtttcatgatgaaaagatcattttgagtatttttgccaaaataataatcatagaataagatggagatccttgcatatgaataatcttctcaatcatgttgttctcagtgttgctacgttatttggcagataactttttgccaggaggataattataacacatttttttttgaaagagttttctaattgagaagtttctttcctgactaatgacttaacaaataaaccattgttacaacaaactgtgtcataacagcaaagttgcaataactatgaatctaagatagtttcaagttctctgtagtagagtgtactttcaagtctatccaaaacaaaaacgttagctctaatatatatttgtttttaataatatattgctcttaatattaaatatatgttgagtcattatttcgcctcctttcttagcatctcgatagttcttttggggatattgattttgcaggatgctttaatgtatttgttgttgtttagaaataaggcagtcttttggtcatagttctagggaaggtttaaaaacttcagtcatcttagagctcagattgagttggtctgtttggatggcatgctaaagtatatgaaatttgcttggttacagggcaaaatgtgagagtcccctaatgatatctggtaccagtaatctaaccaggtaggtaggtaggtaggtaggtaggtaggtaggtaggtaggtaggtaggtagatagatagatagatagatagatagatagatatctcttcttactggatctttttcatgctgtatgcttcctctcgagtttaatggaatcaagtgttgcattttagggtaattcctaaatcttagtatcatcacatgaggccatttagtatgctaaccgttggatgcagttagtttgcgttgctgctggaagattgttgctgctttttaccctggctttaagttgtgtgctcttgtgggtaactatgggacttgacttgtactgtcatattttgaacaagggaaataaatgtttaacatttgttaaataggtttcaatgacagttttcatactctatggtgagcaacttaaatgtaaggttagctctggttgttcaagtgtttccatgtttttttggaaaagttagattatttcttttgatattttgctgtaaatttaacataagctttggtgcattttaccttattaaacgggagacaaaaagtctcaaaatattctgagtgtagatatcaatgattagtgtcttaatttacaaaatgacatctcaatagatcagtagttatatggtatgtggtatgcttgtttagtagaaaggtgttcttaaatgatcgatgatttaagtaaaatcctgtgagtttataccatatgagagaagcttgcttgataaaagaggtttcaaatttaattttttattgtggtaaacaacaacatttaccatttaaccattttttaagtgtataattgagtaacgttaaatatatccaactgctgtgaaacagatctacagaaatttttcatcttgaaagccagaaactctatacctattaaacaacaactcccgtttttctcttcccctagtccctggtaaccattctactttctgtttctatgaatttgactacttcagatacctcataagttgaatcatatggtatttgtcttttttgtgactagcttatttcagttagcataatgcccttagggtccatccgtgttgtaatgtagtacagatgttccttccttttaaaaggtgtgtaactcattttatgtatctactacattttgtttatccatatctgttctattccactggtctatttgtctttatgccagtacctcacagttttgattactgtagctttgtacagtaagttctcacttagtgccgttcttaggttcttggaaacttgggctttaagcaaagcggtgtacagcagatctttgaacaatatcaatttgttcagtgttgttttgttataatgttgatgaggaaaaaaattggtttcattcattatacgtcattttgcttaacattggagtttccaagaacctgttggtgatattgaggactttctctaaaatgctttgaaattaggaagtgtgagtcctccaactttgttcttttcttcctaaaattgtttgggctttttggggtcccttgagattctatatgaattttcagcttaatttttttcatttttgcaaaaagtgctattggaattttgatagggattgtgttgaatctgtagatttctttgggtagtatggacttcatgataatattaagtcttcgaattcatgaacacaggatgcctttctatttgtgtcatctttcatttcagcagtattttgtagttttcagtgtacaagtcttctacgtgcttggttaggtttagtattttacagtttttgatgctgttgtaaatggaattgttttcttaatttcctttttggattgttagtatatacaagaattttgtgtgttgatttaatatcctgcgactttattgaatttgtggttattagttctaagagtttttatgtgtgtgtaaactttgggattttctacatataagattgtgtcatctgggaacagagataattttacttctttctttctttctaacttggatgccttttatttgttacttttcctgcctaattgctttggctaggccttccaatactatgttgaatagacacgtagtgggagtgggcatccttgccttgttctgtatgttagagtaaaaactttcagtcttttacccttgagtataatattagctatgagtttttgacttttactatgtagagatagcgtcttagtccattttctgttccttacaacagaatatctgaaattaggtactttataaagaaaaagaatttatttcttacagttaaggaggctgagaagtccaagttttgagggtccacatctgatgagagtcttcttgctagtgggaactctgcacagttcctaggtgttgcaaggcatcacatggcaatgggactgagggtgcttgctcaggtctctttctcttctaaagccacctgtcccactctcataactattaaatcattaatccagtaatccatgaatggattaacctattcatgatggcagagccctccttacccaatctcctattaaagaccccacttctcagtactgccacattggggattaaatttccacgagtttttgaggggacaaatattcaaaccatagcaggtgatttttttctagttttaacttgagtgttttttatagtgaaagggtgttgaatcttgtcaaatgcttttcctgcatcaactgagatgatcatgtggtttttgtccttcattctgttgatgtcctgtgttacattgattgatttttgtatgttgaaacagtcttgcatttcagcaataaatctcacttggtcatggtgtataatattttaaatgttttaaatgatgaattctggtttgctagtattttgttaggaattttcgcatcaatattcatcagggatattggtctgtagttttcttatagtgtctttttctggcttgaatttaatttttaaaatgtaatttgcatgccttactctttgtctaggaatgtttaagattagagagaattaaaagaattttagagtaccacatatgtgtctcctgttgttaccactgtgtggaattaccaagtgaagaatcaaactcttagatctgaaatacgaattgggaagtactatagtgtgttgacaaactgaattatgaaagcatatttgatttctgaacttgaatatgcatataattcaagcctatgaattgtgtactgtggttgttagctaaaaggttagtgggtaatatcaagtggctggtaatgctaaatattttaataaggtcagctaatcagaagtgaaaggaacaaaaaaattggacatgtgacatatatgtgttcttatatagtcatgctaaaatgaaaaaagaggcattacatattaatagtcaccacatttttaaattttgggttaaaatttttcattctctataaagtggtttatttttcacattggttttattgtttttaatctactgaattgttttttggctacagttctatcttcattatcatgcaaattattaataaaaattcagtaattcattgagatactttttactaccttgagtaaataaatgtgaaaacttgtgatgtaatctattgagagtatgtgaaatgaaaatttagatttcccccaacatcaagcaggattatcctgtgttcatctactcttctatgaaatctgcctttttttgaaatttgccagtgagccagtgatgcccagtgtgaaatggtttagatggcaataatatattgtgcttatatcatgctgtataccatttaacccttcttgtaaatttgatttttggatctggatattcatttataccagctaatatggtctcattggaaatgttgatagccactacaccaagttgtaattacccatgtttatttgttatgtcttaacattacaaattgacatcacaagttacatcacaaagttatgttaataagatggagatgtatacacatgcacacacacacacacaaacacacacacacacacacacacacgcacaccagtccagaaagctaactgtagaatgtggtattcagatataagtgagatgaagagtggataatgacagtattaaaacaattattagctattgaccttggcagactgagaaatgattttaaggtgatagtatatgataaaacaaatattctatctgttttgatatttgtcttaggatagagccagataatgtctagtcagctgcagcttattagggctgactggggaaaatagtagtcttcaaattagatagcagatatgtatccaatatgtcaactataatatggtatccagtgtctagcagcagccagtgccagtatggtcagacagatgagaggacaatattgcggcattcaggttaaggcaactcaagagacaaatggagactttttagggtgggtttatgggcaggattccagtaccagaatgaaggtagatgtattacagcaggaacatgtcagacggggtaggatctttgggtgattcaggtacaggttacaattgagtactgagcacaagttggctctgtgggaataggacataagccttttcttgtctccctccaacccctaactaagggggttgctaagttcacaaggcgtgctaggttttctacagacatcaaaaatggtcattgagaactgggacagcctgagtatgtaggtttgtcaaggtgatcacagttgtggtgatggctcgagtcatgttttgaaagtattggggaaagtgagtagacaagaaaactaggaatattgctgtgcacctactataatacgcttaaaaataggaagggagcaggtggatgtatcccgttttgtaaattttagtttctggcagtgtgtagtgatgctgtatctgtagactgccccagcttgctccttccccaattcctgaaaataaaagttatttttgtaatgttgtggccttaggcctgttcagtttgtctacttagttattttagaaaggccttttactttggcctccttccatcctttatatatatgtatgtataaaatttttttttttttgagacagtcttgctctgttgcccaggctggagtgcagtggcacgatctcggctcactgcagcctccacctcctgggtttaagcgattctcatgcctcagcctctggagtagctgggattacaggcctgtgccaccatgcccagctaatttttgtatttttagtagagatggtatttctccacgttggccaggctggtctggaactcctggcctcaagtgatctgcctgtcttggcctcccaaagtgctgggattacaggcctgagctactgcacccggcctgtcctttatattatttttaaagtttgtaaatatagatttcctactattagttaggaaatatagacagggtcattaatcttcttacatatgcagatttcttccaggcatgccttctctggtttacctattcctgtaccagagcagggactaccattaggaattctgtaggactccatccaggtttgtgtaaaagaaaagatatttgcgaatgatatatgtggtagctgtaatgtgagtgtgttgtcaagaaacttttaggttaagattttactactgggctgagtacacatgatcattgcttagtttgacgtacttttctttttttttttttttttttttttttgagacggagtctcactctgtcgcccaggctggagtgcagtggcttgatcttggctcactgcaagctccacctcccgggttcacgccattcttctgcctcagcctcccgagtagctgggactacagacccccaaccaccaagtccggctaattttttgttgtttagtagagatggggtttcaccgtgttagccaggatggtctcgatctcttgacctcgtgatcctcccgcctcggcctcccaaagtgctgggattacaggtgtgagccaccgtgcctggcctagtttgaagtattttcaccatgtcatttacttagaatagtatagcacaaattagggagattaacagagggaggacaaatatcttttaggtaagaagaatttcttttttttttttttgagatggcatcttgctccgttgcccagtctagagtgcagtggcatgatcttggctcactgcaacctctgtcccccgggttcaagcgattctcctgcctcagcctcccaagtagctgggattacaggtgcatgccaccatgcccaactgatttttctattttagtagagatggggtttcaccatgttggtcttgaactcctgacctcgtgatccgcctgcctccacctcccaaagtgctgggattacaggtgggagccaccacacccggccgaattcttgttaaagattgttactcatcaaaggggcagtagtttttttctttttgaaggtagatatttatgtccacattttgggttagcttttcatttttttgcccgcatgtacatcatttgacatagaaatgatagtaactttcctgtttggatcaaatgtactactgcaggaagtagtctaccttttagcattcacaacctcaaactaaacaacagacttctgtatgctgtctcctgagaaagtacataggccaataaaaggaacatacctttgggtcttgttgtcaggagcctgtaagaaagtttatgttccctgctaatcttgagtaggcaaacataataaaggtaattttatgatagaactcagagtttttgtacatttaattttatatgattataaacatgaaatatgaatagattttagcagcatagttttgtaattccttaggtagcttaggtttttaaacagttttttttttctcctgaggacagtctcactctattgcccagactggagtgcagtggcatgttctcagctcactgtagccttgacctcccaggctcaagcgatcctcccacctcagcctctcaagtagctgggactataggcacgcgccaccatgcccagctagtagttcacgttttaacagagtacattaaaaactgaatttccccttcataatttccttttttgtactaacaataagattgtaaataaaaaattaaaaaattacccaccttgatttgttactgtattcctttgcttcttttttgttgttattatgtctgtttacccacattggtacacagtcataaatagtttcagtgtatgaatattacattaattacattgatgtactatcagtggtacttggttggatgaatttttagtatttagaagctttaaaaatcctatttcactagaatagggagttggccaggtcaataattttttctgtgtctatcagaccttgacacaacatttttttcttttaaaattatatgtacctgtctgggcgcagtggctcacacctgtaatctcagtactctgggaggttgaggtggacagattgcttgaccctgggagttcaagactagcctgggcaacatggtgaaaccctgtttctacaaaatacacaaaaattagctgggcatggtggtgctcgcctatagtctatggataattggacattttggtaattcctaattttaagtgtttgtattatagtgatggtggcattttagaagggtgtatacatttcctggatgtgatccttacatatagaagtatgtgacccttttgggaggagtgttaagggtatggcatgtggtgtgtgaatttgccagcttttagcagttgaatatttctgcatttttagtgagagaattaacataccagctacttaagtgttcccctcccctgtgctctccagtaatatattattaatatatggattctggggaaccttgttagtgatggctttgttggtagcttttcatttttttgtcttgagaccacttgggattgaattaaatacctttttttttttatggagatggagtctcactctgttgcccaggctggattgcagtggtgtgttctcggctcactgcaacctccgcttcccgggttcaagcgattctcctgcctcagcctcccgagtagctgggactataggtgcacaccactgtgcccagctaatttttgtatttttgttttagagacgaggtttcatcatgttggccagactggtcctgaacccctgacctcgtgatctgcccgcctcagcctcccaaagtgtttggattacaggcgtgagccaccgtgcctggcccctaaattaaagacctttaaaacagtaattattttggggggaaaaaaattaaatcatatcaaagcaagatattaggatgttttgtgtgtgcttttattttgttggggggtacttttgatgaatgtaggaagtcattctttttttggagttgcaaagattcaagcatcatcataatttttacttgcttgtattaatgtgctatagtaataggtatctgacaggtgtttcttgttattgaatttaacttgtaatctaaactttgagtaacagcccataaatatatactaattatggataacctgagaagttacggtgattaagtttcagcttttaggtctgtttatattaaaagcagtgttacttgaatttaatatttagaattagaaataacgcgatcatctgttactttttaatctaataattaatagcctttaatggcagctcactatacatgtgaacttaagcaagtagttttactttaatatatattgtttagcttatctacaaatgggattgcctggttttcagtaaggaaaagcagaagctagttgttgctggataggtttttttcccagaaggaaaatagtgattgagacttaatgcaaattttatttctatgctttatcctccaaagctgttagaatgttaactcttttatagtaggtatagagaattgttacatatgatgaaaacctcaaaagttttttctagacactaggagagagctccaccttgtgatcttggagcatattttttaaaaagttaataacccgcaatagtgcagaaattgtttggtgagtttgatttttaaactgatacttttctttgagcattacatgtttttatagttttgggttacccagctgaagtcaaatggtattaagcacatttgaagatactctgaatttgttaatgtaagtctgtgggggaaacacattggatggatggatggatggatggatggatggatggatggacagacggacggatggatggatagatggatggattgacagagtcttaccccattgcccaggctggagtgcaatggtgtgatcatggctcactgcagcttctacctcctgggctcaagcaatcttcctgcctcagcctcccaagtagctaggtctataggtgtgtgccatcatgcccggctgattttttgattttttgttgagatacggtctcactgtgttgtccaggctggtctcgaactcctgggtttaagccattctccaacctcatcctcccaaagcgctgggattgtaggtgtgagccatcatgcatggcctgcaaattgtatttatatgcagctgtagacatttaaaataaagatgtaaacattctcagctcttcctgtagattaaagtttacatttagaaactactaatcccaactcatccgttgggttccttcccttctaaattacaaagcaattttaatatttgtaattttttgttgagctatgatgaactgtttttatggcaaataagtcatttagagaatgactagcaaacactcggatacatggaatttagcactcttttttttttttttttttttttatttaagatggagtctcgctctgtcacccaggctggagtgcagtggcgcagtcttggctcactgcaagctccaccttccgggttcacgccattctcctgcctcagcctctggagtagctgggactacaggcgcctgccaccacgcctggctaattttttgtatttttagtagagatggggtttcaccatgttatccaggatggtctccctgaccttatgatccgcctgccttggcctcccaaagtgctgggattacaggcgtgagccaccgcgcccggccagcattcttatatttaataataataagtggcaagtaggtaccttctcgtagaaataataatcacatttcttaacaggtattaaggacaaggatcattgttctcctgttcactgttgtattctcattgcccagcactacatttggcacatggtggatactttcacttggttggatgaattttcaacatttagagactttaaaaaaatcttatttcactaggatagggaattggccagttcaataatttttctatcagaccctgacacaactttttttttcttttaaaaatatatgtacctggctgggcgcagtggctcacgcctgtaatctcagcactttgggaggctaaggtgggtgaattgcttgagcccaggagttcaagactaacctgagcagcatggtgaaaccctgtctctacaaaataagaaaaaattagctgggccatggtagtgtgtgcctatagtcccagctacttgggaggctgagatgggaggatcacttgagcctggggaggtcaaggctgtagtgagttgtgattgcgccactgcactccagtgcgggtgacagagtaagaccttgtctgtctgtctctattttttatatacgtataatacgcacatgcgcgcatctatcttgtcttgagagatacatcttacatctttgattttgcttttgtgtttgctttggtttctaattacaaagtacatgttagtatagcctatgctttgcaaaataatttggcctgggaatgcttctttcttttacagtagaaattaattttgtgctatttagaagaatccagtatatcgcacaatattcattttatttagtattctctgcttctcagagatgatgcattctttatattcatcacctgtgattccttaggtgactgtatttacgaactacctttaaagtgtgcttagaaattatattgaaggaaagcagcaactttggttttgatgaaatgctcagagacgcagacagatacagcaaggatcacatgaccttttttattttcatcttgccgtctagatgacctgacctgttcattagaatttattagttctgtgcctctccagttcctttaaaagaaacaaaatgattttcttttataaataagttagcattttaggaggtgaatgtgtatcttacatatgatgacaaacttcagaaaagaaaaaattagccagatgtggtgagtacctatagtcctagctactcagaaagctgaggtagaaggatctcttgagccctgaagtttgaggctgcagtgagctatgatttgtgccactgcactccagcctgggtgacagagtaagccctgtctcaacgaaaataagattttaaaatttatgtatgtatgtatgtttgagacagagtctcgctttgtcacccaggctggagtgcagtggcatgatctcagcttgcttcagcctcccgagtagctgggactacaggtgtgcaccaacacacgaggctaatttttgtatttttagtagagacagggtttcgccatgttggccaggctggtctggaactcctcacctcaagtgacctgcccgccttggcctcccaaagtgctgggattacaggcgtgagccactgcgcctggctgaaaacaagattttaaaatctgagtatctttcagaaaaaaaataaagtggtggtatatgttatttgattattcaggatttaatttgtggattattcattcttgtttctcctattgcctcatttgttattttgctgttcacaaaacataaaattaatatttttctgttttagcttaagtaagctaggaaatacaatgttttgaactttgtatattaattaaatattagtaaccattgatgatgttttctagagagataaaattaccaagacaaattgagctgtttcttgtgtgatatctaacctactgggagaagtcattaggagtttgtcagtatgttatatttgagcatttaatattaattggatatgtttaatcttacctgctttttctttaggtggccaccgagtactaaattcacttgggaataaaagaaaaacataagaaaattataagagaaaggtacacataagactaagagctttagactttagcttcagcctgttttctccttccttgtttgcttttaggtcattttcttcatttaggaaatgcatccttgactttcaaaacatagacataataccctttctgtctgccatttttacatgtactttggtcaaaaatggcattcatttgttgttcgtatgaaattattggcatttaaattgatcgtaagttccttgagggagaggaatagatcagatctaacattttttcccccttctcttctcaacaaagtttgttattatcatgaagtggttatttatttaataagccaggctttggactgtatgtttccagggcaggaaaatctgttttaaagttatatcttaggttttttttattagctccttttaactgtatgtgcatgataccagcaaaaggttgtattttcaggcatctcatattatggtttaaagttctcatagggatttcaggaccagtaagagtcatatcctgtttctatttaggatgtattaatatatatataaagccaggcggagaatcacaagaaaatttaaaaacaattgttttataagcttctttttcccctatgtgttattactgtggggctgcgagtgttacaacaagtccatatctagattaagcagtcaaggtcaggcacggtggctcatgcctgtaatcccagcactttgggaggccgaggcaggtgggtcacctgaggtcaggagttcgagaccagcctggccaacatggcaaaaccccatctctactaaaaatacaaaaattagctggtcatggtggcccgcgcctgtaatctcagctactcgggaggctgaggtaggagaatcgcttgaacctgggaggcagaggttgcagtgagccgagatcgtgccactgcaccccagcctgggtgacagagtgagactgtgtctcaaaaaaaaaaaaaaaagaaagcagtcaaatgcaagggaatgaaatccttatttactaaaacacattagtaggcactggggaatttaacttttgagtatggatatcctttccgaatatttttggtgcatttgtaataaatgtcattttctcctttttaaaggaattgtcttagaagaaagaaggcaagccaccattttacccacgtaaatatatgaatatatttctgacattgaggtgttccagaagatgataaagaaatgatagcagctccagaaataccaactgattttaatctactacagtaagtaaattatattctgataatttttaaatacttgtttattccacaaaatggggaatgcattaacttcagttaaatttccttctgctcgagaagatctaatatataaaatagcttttatgctttgcaagagtttatatcagcactcatcaaggctctgtaataataattattctgtacttttttgttgttgtgttttaaatttgtcttttagtttacatgctgcagtttattattttttgttgtgtagttctgagtccatacttggttttgcaatagcaactgttttgagagagcatcataaaattcctaaaaataaagttttctcattagtgaggtataccatgtggcactatttaggatgtaatgtcagatttctgttacaaaatcaaatgatgattgcagaaataagttacatgtatattggtccagaaagtgttttcaacataggtatcctctttacccccatctgaaaagctaactgtactccttagcttttattctaattactccttggttttgaaagattttgaactactctatgtaacagtgattttcatactaaggtacagtttcatgagttgcctcagtgaaaagtgaacttttaaattgcccgtgaatccctttatttacccacccccaccactgtattttttattaggatctttatgagacttgacttgaaaagagagtttagttgctaaaaattttgaaaacaacagactaatacctttgtacataatggcagccagcatttacttttgatcatatgtagattttcatatttttaataattttgttatcttcagtggagtttatgaatcttctgggaccaaatacattcaggttcccacaaaacagcatttttagtgaggattttatgtattctaagtctcatatctttgtaaaagttaattattacctttgttaatattaagtgtctgctgtatacaggatgttacattagatcctgtgaggaattaagttaggtacttcctgctgcctttatgagttcatattttaaagatataaagagaagattatgaagtttcttatatacttggttagagactataaaaagggtttatattatggactagactattgactgttagaatatctcaaataatgaggacctgaaataggataatgaataaaagggaattgatgttgttcgggtggaacaggcccagcatttgactgggtatgtggggtgcagggcacagtaaagaggaatggaagattcagtcgtgtgatagatgactcaggatgtttcaggtcactgaatggttaatacagtatgtttaataaacataactgttatttcacctagggtagtttttgttgttcttttgatcttaaaaacacaggaaagcattgaagaacggcttaggagagtatttcttctttggttgggagtattttagacttccattctgattactcacttaagctttctttagaaagtttttcagtaagttaccaaacctctagtgcttcactcttagttgggatagcttggagatgagtattaagaggataattgagcccttgattactctggccattggaacattgtgaagactatagtgattttcttcagacttaaagcagttacttagctctttaagagagctggtgtcctacgaaacgcttgggaagaaataaatattacttatacatcaagatattttaaattttcattttttttttgcaagaccatatagacatgtgagaagattattgatgacaacaatcttcttaagatgtaacacacatgagcttcagggttaatattatagtagtcattcagtttttggtgcattaactctagggaatggtatttattacaggccctttcctctcaacattgtaggatatagttaggattgccaccaccttccatacattgtttaaattactttatatgtaagtgctgtataaatagtattttttttcctgctagcatcttaatcattattttagatttatgaaatattcttacctcacagcctctgctacctcatagcctctgggcaactggttattgtagcaataaaatggaaatagaagaaatctagattgagaatactagttttataaagatagcctttcacttcgattccatttattttaagcagagctggtgctaggtttacacatttagggtggaaaaacctttatcttttatggatgtggctcaattctaaaatccagtgtgacccaaatactaatataagtatgccttgctttaagcatttaaatgagggtatgttactactatttagatagactcatgtttactcatttggaaagcatcacacatatttatttaaatcggtcggcttccatatgtttgtgagaaaatccagattatacaaactagccttaccccaacccagaacaagggacagttgtttaggactatagattcatatgttggagattgtagagactttagagatttcgttctttcctgcgtatatattatttatagatgagaagattgagattgtcacttgtataagatccacagttacttagtaccaaaactgttctcctgactatagctcatcacctctttacttcataaaggatattgatcacttagcataattccctagtgtatttcaaatgctttagtttataaaaaggttttataagtaccctttcagaaatacatgttttgtatattgactcacctagatttataaatacttttcgagtgaggtaggagagatcagaggatccataatcataaaactccctaataaagttcctccaatgcctagtattaaaatacagtttttccgcagcactgtgatctttgaagtaggaaatggaaccaacgattacatggaacaccacagttcctagggttaaattttgagacccactggattagttttcatactttgattaaaaattaacaaaaatgtttaggtatttgtattttagattattatttttgtagctgcttatgtaatcttgtgtgtttggtaacgtgctatagtatgatgttttggggaaacatcttaattacttataatgctaatatgaagttttgtaatgagttaaccaagcctttcttttagaaaatatggcaaaaattagaaactcaatataaatttctaaggaagggttttaattcttatctttctgtcacagggagtcagaaacacatttttcttctgacacagattttgaagatatcgaaggaaaaaaccaaaagcaaggcaaaggcaaagtatgtatcaaatatttgactttattttgtttcctaagatctcacacacacacagatttaagttatgtctcagatagttttatcttttaaaaatggctttttaagggggtgggagctgattggtatggtaagccttctgagtaaatgtggtccttttgtcttctagaccaggtagcctttgggatctatttacactgctgtaaagttgcaaataataataataataataataataataataataataataatacatttccagtagtttatttcgtaaagcacagtatgtgaagcagaatgcaatgttctgttggctttatttttgttttcccacaagtaataaaatgtaaaggaaagcaatatataaaatctttaaagcactctaaaaatgtaacatacaaccagtttaaggctaatgggttacaaatgacaatagttttactctttataagtaatatgaaagataaaaaattacaaagttaagttctgagtcaatataatgtaagtttaaagtgtgagtgggttagcctgagggctggatataacttggcgaatggctaaattattttgttgttttggaaagtatatttgactctgcatgtgtgtaaatacattatgcaaaagataacttgtttttgttgttcagcatttgtttttcaaaatgaattttggatttatattgtctcatgacatactttgaaaaagtcttaacaatacagaagtttacgatgaccaaagtgaaatttttccataatcctatcacctggaggtaatttattctttaaacattttgatgcacatacttctattcatacacctatgtataaacatgatgataacattttatttaagtggagtcatactatgcaaacagtttaatgtgcttttaaaactcaatggtatgttgtcaacagctttcccataagtgactgtaaaactctcttttattttttttctattttttaaattaaatttatttgtttttttggagatggggtctctctatgttgcctagactggagtgcagtggctattcactggcacagtcatggcacactacagcctcaaactcttgggctaaagcaattatcctgcctcagcctctcgactggactacaggcaccacaggcctgtgccacgatgcctggcttctctgtaattccttttattttttatttttgtagagatgagatttcactatgttccccaggctggtcctgtactactgggctcaagcagtcctcctgcctcagcctcccaaagtgctgggatttacaggtgtgagccaccacgcctggccattctcttgtgatttctaattgtggcaaaacatcacgtttaatgtatggaacataatttatttaactaatgcttggaatattttttgagtgctcataattcatgtgtttcataattttgtgtgctctcttatttctttaaaaagactcgagagagggatatgaatagaaatattaacttacggctatccaaagataaccttaattctattggacagtataatttattagaaaaccattttttttccattaacctattttgcctttgatttaatttacaagtttggacaagattcttggtggcacctgagtagatgactctgaagtttttgtgccacagtttggttaaggttatatagctactactgtgggtgaggtgttgggacaggtcaaggatttattacaataatagcaactgcattttgagactatactatgtatgttccatgtgttgtgctaacaatttcacatgttaatctaatatttgaacaactgcgtagatgagaaaacaccattattttataggtaggaaactgaagtccagagaatcccagtggttaaaggatttgagttcaggtctgtgcccttaaccctctatactataccacttcctaaagtctttatgtagaagttttttttctctccaaggttgtacacaggttagcgtatttgctttttgtataatgcttcctttgttattatcactccttgcacatttttttttctagcacagcatacccattctgccattttaattgtcccaattagtttttcatactgacagggactattgaggcatttgatagataaactgcaaatatacagctccatgttaattaacattttatattttactagtctattctgttgtagttgatcttttctttcaaccttatctctgaaaatgcttttactggggacaaaagcctttcattgtgcaatcaggaattaatgaattaggttcacaaagactgaatctcatttacagaatatagcagtctcccttattctcagggatacattctaagacccccagtggatgcctgaaattgcggatagtacagaaccttgcatattgaattttttcaatatggtaaccaaaatggctagtaagtgactaatgagctgcgtggatatgctggacaaagggatgattcacgtcctgggtgggatacagcaggatgatgagtgattctatcatgctactcagaatggtgtgcaatttaaaacttttgaattgtttatttctagaatttcctactgaatatttttggactgcagcagaccaagggtaactgaaactgaataaagtaaaacccaggggaggactactgtattgcaaattaacaagtaatatgtttcagatgtttcaggtgttccccttcagggaaggggtttaaagtaactgttaagagttgagtcgttttggactcttggaggaagaagggaccctctaaggaataaagtacataaataccacaggctttcagtggaaagaaatttgtaggcatcgctatagatcagagatccgcaatctgtggcttgtttttgtactgtccaggagctctaagaatagtttatatatatatatatatatatatatatatttttttttttatagagatggggtctcgctctgttgaccaggcttgtcttgaactcctggccttaagcaatcttcccatctcaacctccgaaagtattggaattacaggtgggagccactgctcccggtcgttttaatatttatttatttatttatttttatttatatatatatatatatatatatatatatttatttatttatttatttttgagacggagtcttgctctgtcgcccaggctggagtgcagtggcgcagtcttggctcactgcaagctccgccttctgggttcacgccattctcctgcctcagcctcctgagtagctgggactgcaggtgcctgccaccacgcccagctaatttttttgtaattttagtagagatggggtttcaccgtgttagccaggatggtctcgatctcctgacctcgtgatccgcccaccttggcctcccaaagtgctgggattacaggcttgagccactgcgcccggcctatttattgctcgagacagagtttcgctctgtcacccaggctggagtgcagtggtgtgatctcggctcactgcagcctccacctcctgggttcaagcaattttcctgcctcagcctcccgagtagctgggactataggcgtatgccgccatgcctggctaattttttgtattttagtagagacagggcttcaccgtgttggccaggctggtctcgaacttctgagctcaggcaatccgcccacctcggcctcccaaagtgctaggattacaggcgtgagccaccacgctgggctgtttttataattttaaatagttttaaaaataaagaatgtgctacagagactgtatgtggcccacaaagcctaacatatttactatccagttctttacagaaagttggccaacacttgctttctagatcgtagagatgtgttggtctaaaagagacctttaagaaatcatcaaatccaggggtcggaatacctttctgtaaagtattttaattcaaccctggcatttgagaaatgaggattccgagttagggaatggcttgttttcttaaagtataagagctatgggaggtatttttatagcttaggcatatagggaaccttttcactgatttttttgatgcccctacccgcgcgtccccaccccccaccaatactgacaacttttgttataatgggcttcatttccatagttttcattaattgaattttcatgatgactaaatgttggagggaggcctagaacaagaatgagattgataaacctactcctaatgttcagaattccttgttcagagcactgcaatgatttctaagactaacaatacaaataaaatgttgaactgagtataaggtacatatttgataatgagtttggttattcttgctgcccacttcagtctgcatccaaaagctgcataagggagtaatataaaacttggagatagctaccttgatttactacacccttgagaattctctgattatacttgagagatatttttgcagtgtttttcaaactttgttgatattttgagggcttttaagtctgtgattttatattacttttcaaaatagattcaaatcagtattttgtgtcattgtttctgttggtcttcctaccagattaagattcatgtaacatttactgaactccttttaacataattttttcattttacagtgataacaatagctgacattttttgactttattatatgctgggtatgttgctaagtactttgtgttttcattatcgcagcaaccctatggggtaggcacagttttatcctcactttacaaattagaaaaacatcactgaaacatagtgtggttaagtaatttgcctaaaatcactcagctaatagtagcagaaatttgcacccacagagtctgtctgtctgcagaggctatgctgctaactactatgtcatgtgaggcatggtagtatacttgaaaaaatggacaccacaaagaggctgtcacagttatatcattttgttataagtggatggaattctttagggcaagtttaagcatgttatgtaccctatcagctacttctactgtagctgtgttttgaactctcaaggatagtgatataacttaaccacctcgtattttttatgcagacttgtaaaaaaggcaaaaagggcccagcagaaaagggcaaaggtggaaatggaggaggaaaacctccttctggtccaaaccgaatgaatggtcatcaccaacagaatggagtggaaaacatgatgttgtttgaagttgttaaaatgggcaagagtgctatgcaggtaagatttatgttgttcttcccagttcatttgtacattttaaactttaatgagttatatagagtgtagctctgatttttctaattgcattttaaacatacactacttattagaaaaaagcaacaaaatcatcagaaaactcttgggatgtatttcttcatatataagacttttgtgctgtgttttgattcattttctgctgcatgcttttttcttttttcttatttattttattttattttatttttttttgagacagagtctcgctctgttgcccaggctggagtacagtggcatagtctcggctcaccacaacctccacctcctgggttcaagcgattctcctgcctcagcctcccaagtagctgggattacaggtacaaaccaccatgcctggctagtgttttttgtttgtttgtttgtttgttttttttgtttttttgtttttttgttttttttggtgggtattttcagtggagacggggtttcaccatgttggccaggcttgtctcaaactcctagcctcaagtaatctgccctccttggcctcccaaagtgctgggattacaggcggaagccaccatgcccagcccattatttattattattattattatttttttgagatggagtctcactctattgcccaggctggagtgcagtggcacgatctctgctcactgcaacctccgcctcctgggttcaggcgattctcctgcctcagcctcccgagtagctgggattacaggtgcccgccaccatggctggctaatttttggtttttagtagagatggggtttcaccatgttggccaggctggtctcaaactcctgaccttaagtaatccacctgcctcggcctcccaaagtgctgggattacaggcgtgagccaccacgcccagccccaacccattatttttttttaatggcctaaggtaaaaaataatttggtcaaaaatatgctgatgtaaaccatggctatgaggtctcaattttccctgaatttatatagatgccattaaaatacgaagtcttctacccatatggaattcctggttgagtgacctaatataattattatccactttagtggaatgaattattttagttactgttgtctattacaaattttattatttgtgcttgtttcttagaagaataaaaagttggaggcatattcatgtcgaatcattcgaattatgttttctctgcatacttttatgacaatagaagcatttaggctttctaatgttggctaaaccattagaaagtggaataaatacaatactcaaggagtatatatacttaataaagttttaatttaatttataaaagctacaggcaatagtttttttttttaatttcaacttttagatacagggattacatatacaggtttgtacatgagtatattgcacctaggaagtgagggtagtatccagtgggtagtttttcagtccccaccccctacccccagtagtccgcagtgtctatgttttccacatttgtgtccacatgtgctcaatatttagcttccacttacaagtgagaacatgtggtatttggttttctgttcctgcgttaattcacttaggattattgcctccaactctacccatgttgctgtgaaagacacaattgcattcttttttatgactgtggagaatagtatttcttcatagaaataactttaatcagtgatgggtgcacatgaatggttatctgagaactatccgttcaggctttttgttaataaaaactgacacaaataccttgtttagaaatatagaattagcttaatatgtgtggttttataaataaaatgtgtcaaatgaggctaataaagaacagttttacatgtaaaatgtgaaaatacttgttaattgtttgagctttcgccaattttacagagcaaagaacttaaaaggtgccagatttattcataccattctaatgcacctttttaaatccgtttattaatgtttgcttgtatatcatgattagagtgtggattctttttcttgtgtaatgttttaaattactgttttgaatatgtttggcttttaaaaaataaataatgtcttattatattgctgtactatggtttatttagtcattccccaattttaaaaattacttttctctctctagttctccttttgggttatttttatcaagaggataaattatttcagttacattgtattgcatttcattactttccttcttttttttgtattatacattttctctaatattttgttctaagtagttaaatgcactaatcttctttcttctgctatctttttaacatcagtgtcttagtccatttgggctgctattaaagaaactaacataggccaggtgtagcagctcacataatcccagcactttgggaggccaaggtaggtggatcgcctgaggtcaggagttggagaccagcctgcccaacatggtgaaacccagtctctactaaaaataaaaaagttagctgggcttggtggtgagcacctgtaatctcagctactcaggaggcttaggcaggagaatcacttgaaccctggaggcgtaggttgcagtgagctgagatcgcaccattgcactccagcctgggcaacaagagtgaaaccctgtctaaaaaaacaaacaaaaacaaaaaaccaacataaactagaaagcttataaaaaacagaaatttatttcttacagttttgcaggctgcgaagttcaatattaggtgcctacagattcattatctggtgaaggcctgttttctggttcatagatggcatcctcttactgtgtcctcacatggaaggggcaaggcagctctcaggggccttgtgatcttattgccatctataggctccacttcttaataccataacattgactacagttcaacatacagtttgaacacaaaacccttcagaccacagctatgagaaatcctgactcataaccacagctaattgggctattccatttttatctaaaaatgaatattttctttatttttgtgttgcttatggcttgtcatattaagattgtacctctatctgtgccatttttgttttcattttttattttaagatgaggtttcattatgttgctcaggctggacttgaactcctgggctcaagcaatcctcctgcctcagcctccccagtaagtgggactacaggcacatgccattgtgcctagcttgtttttctgttttgaaatgtgtttccctcttaagagagaatgtctgcactgtctttccattgatttcctggaatcttttcaacaattttattttgttatgtgtgttcccacttgtgttacccttttaagaccaaatttgatggaggaagtcctctgtttagaaacttccaagggttcttatctaaaatttctagctcagatttccttatgccatgttttctgtcctccagtcacagtatatactctgcccttagacttttctttttgtttttcttgttgtttgcaatagttttattttactccccccttgcatatcaaataggactgagcgaatcaaatgtcagtcttctgaaaagcattctcagacactactacttttcctttccaatgtgttttttactcttatcttttcattatatagcacttatactgtgcctgactttgactctagattgctaattctttgatcaaagatcatgtgttattcattatttttgcattgccaggatatacctatctcagtagttgttgttgttgttgttgttgttattattattattattattattattatcattattcgagacaagatctcactctgtcacccaggctggagtgcagtggcatgatctcggctcactgcaacctccgcctcccgggttcaagtgattctcatgcctcagcctcccaagtagctgggattacaggtgcatgccaccacgcccagctaatttttgtttgtaccttttggtagagacggagcttcatcatgttggccaggctgtctctctcagtaattataagtgatagtcaataaatgcaagaatggctgttggtttaaaactggttgttatgttttaagaatggagaaagtatgcgtgtgccccttaattttattatataacagatgttgaattttgttacataagttctcagcatactatttgattaaaaattttaagcatatttcagtagctcgcattatttttattatagcagacttattttcctagtgtaaactctacttgatcttaatgaattactttttaatgtgatgtagtggtctctttgtaagagttcattgaatattttgcatctttattgatgagagtagccattgttccagttatctattgatgcataacaaaccaccccaaacttagtgatgtgaaacaacaatcattttattatgcctaatgattctttgggtctggaattcagacagaactaagtggagatgacttgtgtctgctttatgatgtcaagggccttagcttggaccatttgagtgcctggcactaacacagttagggactataatcatttggaagcttctttactcatgtttagtgcctagtctgtagtgatatgaaggctggacttagccagaactgttagctgcataactacaaatggcctttctatgtggctacggcttcttacagtatggcgtctgggtttggagagaatgtcctgagagaagtgtccagtttgctagtgctccaagagaccagtgcagttgctgcctggcattctgtgacctaattttggaagcatcactgcattctattctagagaagatgacatagaccctcttactggggagcaatgtccaataatttggggccatgttttaaaactgtcacagtctctatgatatattcttttgctgtttattgcctatatcatatttgggaaaaatactgagcacatttcttttgtaaattatgttggttaatataaacaagctgttgtaaatacaacaaagtagaaattaagtaaagttttagaataattccagtcagtctatctgaaccaggtatttcttagatatttttccttgatttatctttattgtgtaatcatagtatcttttttgtacattagattctacatgttttagtcattgtttgtacctggatttcctatttattggtatataacttagaaacatttccctctcccaaccttttgttttttatactagctcttgtttatcatcttgattttatttaatttgctctatttaaaaagttttgttgttgttgtttttgtttgtttgtttgtttggagacagagtcttgctctcttgcccaggcgggagtgcagtggtgcgacctcagctcactgcagccttcatctcccgggttcaagtgattcttctgcctcagcctcccgagtagctgggattataggcatgcaccaccacacccagctaatttttgtatttttagtagagacggggtttcaccatgttggcctctcgaactcctgacctcaagtgatccgctggcttcagcctcccaaagtgctgggattacaggcgtgagctaccgcacccagcctaaaaattgaaaatcagttttgtcgttgcctctcttgccccgaaaggaataaagtattccttttatttttagttctagcctattttcttttttaagaaataaccatattgagatatatttaccatactataaaatttaccctttaaagtgcaaattcagagttgtacagccaccattacaatataattttagaatattttatttatttttattattttttttgagatggagtctcactcactctgttgtccaggttggggtacagtggcatgatcttggctcactgcaacctccatctcctggattcaagtgatactcctgcctcagcctcgcgagtagttgggattacaggcgtgcaccaccacgcctggctaatttttgtattggtagtagagacaaggttttaccatgtcagccaggctggtctcgaactcctaacttcaagtgatccactcacctcggcctcccaaagttctgggattatagacatgagccagcacacctgccctgtattgtcttaattatttgaaattctctcctttctttaatgtcactgagaaatcataagtaattatacttgatggaattgacttccatagtttccacattcttttcaatgcaaaataaatagaagattgataggtcattttgtgttatcagataattgttttactgaattcgattctattttattattgttaaaattgaactttaaatttcagtgtataagtatttatattaaagtaatgtgatactatataatcttgaattttatgactttatcagacttaattgattttgagaaaattagaagaagctaatgattttatttttttccctctgctgtagtcggtggtagatgattggatagaatcatacaagcatgaccgagatatagcacttcttgaccttatcaacttttttattcagtgttcaggctgtaaaggtaagatatatttattttgaaatcagcagctctcaaatagtcacttcgttgttccacctaaagagatgttgttagcactttacatggtaaataacgctaaggcattatttgcatcatatccatataaaatttgtaaggaaaaaagagcaaaggacaaagtaagagagaaagtctattgacaaagttttattcatatgtgaaagttatctaaaaacttagcagtttataattattatgttacttttattagatatatttcccactttcagcatctggttttaggaacaaagaaattgattaagaagggaggaggaagataatgaagagatacaggttcagatgacaggtaatcgtacagtgtagggagttaaaaagtgccatgaataacagtaagtaagcaagcaagcaagtaagtaagttacgttaagtaagttaaataaggtattgataaaatcgacatttcttctaaaaggtaaagaaattttgttgtgtgtagtggtgtctttaaagtgttttcactttattttaaaaatattttgaactgggaaagatgaaagtacaaaatacagaaatttcttccctaagacagaagtatttaggacaaacatttggcagggggacaaaattatgtaagttggggagtcatatatcctcatatggatcaataaatgagccagtcaagattacgggcaggttctgatgtatctggtgtctcccaatacttagctcatccttgaaatttcagatgatgcccgggcaaatacattttatggagatttctgggggtattttttttttttaatgaaagtggcatcaacaacattagagcattagaaattgggagaggaagttgcttaaaaatagatataaaacgttaagatggtaaagaatgatttatttaaacaaatgcagaaactgaattgtaagaagcaattcaattctgcagtattcctttaaagataccgtaatatctttgaaaaacaagtaacattggtagagtttgatcacaacattcagtgtagtatgtgtattaaatgttacctgtctgtgaggcctgaaagatagacaactatattaaattcttgagcctgtgatctttataatgtcactaaggtgttgagaaatttaaaaaattgtcttaatcatagcatatagaaagctgcctagtttacttcatttgcctaaaataaaagtagctttaattcaatattagaaaattcagctgacttctgctcagaggagatgttgtcatgatgttactatggtatccttaaggttctgaaccagattgactgtttaaagatgagctatactaaaattatttttccctatatccagtcatttttttctggggtaggatggatataagtacctgcttgttgtgtcatataatcaagggctatgtcctttctcattaggctctttgcaaatggaaggttgagtgcagacagctgaacagatgccagaaataacgtaatgagttgaaattttaaatcttaagtctccccttttatttattattattattattattattattattattttatgagagagagtcttgttctttcatccaggctggagtgtagtgtcgtgatcatggctcactgcggccttgacctcctgggctcaggtgatcctcccaccttaacctcctgaatagctgggactacaggctcacgacaacacgcccagctaattttttgtttctgtttttattttttgtggacatggggttttgccatgttgcccaggccgcaagtgatcctcttgcctcatcctccgaagtagctggggctacaggcgtgcaccaccatgcccagctagtttttatttttcgtagagacagatctggctgtgttgcccaggctgatcctcaatctcctaaactcaggcagttgtcccacctcagcctccaaagtgctgggattacaggcatgagccaccttcctggcatgagtgagtttgtttgtttgtttgtttgtttgtctgtttttggcatgagtttctttctttctttttttttttttttaatttaatttttttttgtagagacaggtctttctctgttgcccaggctggtctcaatctcctagcctgaagaagttgtcccaccttggcctcccaaagtgctggaattacaggtgtgagccacccctcccgcctgagtttcttaattaggcttctgagttgtagttttttttaaaacaaggccgcagagcatgttccctttgtcaaattcattccttttttggcatcagtttgtttacaaatcaggagcttgctaactcaacatttggaccttgtcacaagtgagtttgtcaagatttctaaaaacttaaggtgttgaaaacttaaattgtaaggttaatttaagcactgctgtaatatttatcttagaatcaggcaatctccatgaaggggaatttactatataatcaaagataaagccattaattacttatacacacaaaattattttaatataattcttttataaatgacttagaaacttctttaagtatacttattgtaatttaacatttcctgcagacccaaagttgttataagcatcagttattttttctacaatacattgatggcttctgtagctgttgaagcatggagggatatttaactccatgctgctcctgactgctccgttggtgattctgtggccagtgttttcttctttttttcctagtcagctgtcacttttctttttttctttctcttttcttttaaaatagagatagggtcttgctctatcacttttagatttaccggattttagcagtcttgctaaaaatgtcccccacatttttaaggcagcaggctctggccttatgtcctaatggtggcttcatacctgcctcaagagttaaatgaatggagtttgtgatagctactttcttttctgctctgaggtccttttctgcttgtttttgggtttctggatgtcttgtggtttatgagacggggaggagctttagaaatgagggattgttgaaaagtatgcagtatgtttgctttgagatatatttatatgtaaatgttaatttcacagaaatgttcaggtcattagttactttttgttctctagcattcccaggtatacagcacctgggtatgaagtatgggaagattttgaagagagatacgtgattctagattaaaaacaaaagcctttcaaaaggtttttgagagtgttttctcttctcctcttctctcttttttttttttttttttttgtgagacagagtctcactctgttgcccaggctctggagtgcagtggtgtgatctcggctcactgcaacctctgcctcccagattcaagcgtttctcctacctcagcctcccaagtagctgcgattacaggcatgcccagctaatttttgtatttttagtagtgacggggtttcaccatattggccaggctggtcttgaactccagacctcaagtgactcgcccgcctcagcctcccaaagtgctaggattacaggcatgagccaccgcacccggccaagagtgtgtttctttagccagagaaatggtgctttctcctgagttcatcaactttttaaaacaatcatttttttttttttttaagttgcggtaagtaaggattcttctagggtacgactagaaattaatctcacccagataagagggaggcagcatgatttaggtgaatagtctcagacaaattatttaatttcttttagccttagcctaagccttagtttcctcatctttgaagctgggattatggatttacagctatgtatatacacaggcgcgcgcacacacacagatgcatgcatatacaaaatattgctctggtcaattgaaaaaaatctatgttaattatatctagttcttatttataaatctcatcttcttgtaccaagacattcttcttttagatattactatatttatggtatttctagtgagaagactagtaagcaaataattcaacaataaaaacaggattttgaaaatctagtatttacgttgattacccctgcccccatctctctctttctcagtctgatgccccatcagtggaagttcatgtatctcttcttactgcacactagaaatttcctttctgatgtttggtctccacctgactaatgttttactacttctaatgtgtaccttttcttttttcctctcccatcctcctgtgtaagattctaaaggtccttatcaaattgtttctctttgacatagttctttattttctaacttataacatgtgtggtttttctggtgggtatggagtggaggtggagtcagagctatagcatttggcatttccacacatcagggctttgattatgtactacttttgacagcttctttttctttttggtattctttagttttaacttttaactagattacaggcgtctaggtgggcaggaactacaatttactacttagctcttttagaggatattaggatgtagttactttacatgcaatagtgcttaataaagagacttgactaaagtgaactctagctattactcttttccttatcttcagcttcatccccaaggttttaagtgttatactagatgctatctcactcttgataacatatggtttatgttaaagagacaaagccaatataaatattacagcatgagtaaagtgagtcaggtagaaatggccaaagttaattgtgttaggaaaaaagatatctgtcagaagtatggggctgttttcttgtgcatactgagaatagatagcatttgtttgtgctttatttatagattagagtatcatggtaaagattattagatgatggttgaagaagtatgccttttattgtgtgaccatagacttcttagtgttagagacttacttggaagttttctttatttttttatcacaccatatattaacttctgacatttgcaaatttcaggagttgtcacagcagaaatgtttagacatatgcagaactctgagataattcgaaaaatgactgaagaattcgatgaggtaacttactaccttaagtgttttgataacttatgcatgtttatcttgacttatttttgaaagtattattaaattgtaagcattaggctgggcatggtggctcatgcctgtaatcccacactttcagaggccgaggcaggcggatcacctgaggtcaggagttcgagaccagcttgaccaatatggtgaaaccctgtctctgctaaaaatacaaaaaaaattagccgggagtcgtggtgtgtgcctgtagtcccagctacttgggaggctgagataggagaattgcttgaacctgggaggcggaggttgcagtgagccgagctctcgccactgtactccagcctgggcaacagagtgagactccatcaaaaaaaaaggaaaaaaaaaattgtaagcattaatgttgtaaataagagctttggcattagatttaatcaaatgatgcctgtgcgacctttggcaggttgttgtcttagtgtcagttgtttttttttttcttttttcctgagacaaagtctcactctgtcgcccaggctggagtgcagtggcatgatctcactgcaacctctgcctcctgggttcaagcaattctcctgccacagccttccaagtagctgggattacaggcacccaccaccacacctgaataatttctgtatttttagtagagacatggtggggggtggtgggcggtgtgggtttaccatgttggccaggctggtctcgaactcattacctcaagtgacccgcccaccttggcctcccaaagtgcggggattacagcaggtaggcgccactgcatctggccagtatcaatttcattatctgtaaaatgggcctaatagtactttactcataaggctgttacgaagattgaattgagtaatgtttgaaaattgcttaacattttatggttcccagaacatagcaaggacttaataaatggtagttattattgacaaaaatgaaaatgtcaaggaaaagtataagaacatatcctggaatgttgtaaaaggaaggtttcagcaatatttagggaacctgatagctagggcaaaggagtatatagatacttttattgtttaaaaactcttaagaacaacaaagattacatattagtttagactgagttgtcccccccttacctccctagggctagattgagttgattatttcattgagctctttgaagtattgttaccaataaatacatacatagatttactataaattaagcttcttcaaggaagggatttgggtttgtttgggtcacggctgtatttcagcaccagtacttttactcttccaaaatttttcgctgtgggttttcaagtagaaaatgttgtctgatttgagttttatttggtcttttttttcttgcttactctgatgaaggagctttgaactattattctaaaagatagatgagttaaaatggctttgatgatcgctaagtgctattaatcactccccaagtagttgagaagtaattttgaatagtggcattttttacccttttaatattgaatgttttagtgagaactttctcactaaaagggaacaactatttgagataattgtcctgaaatatgatttgaaaatgtcagcaaaccaagttgctaacaattaagatgctatatttcaatatagtcactaaattagccaatcagaaaataccaaaaaaactttttttgtggaatatcaggaccttattctcagatgagacgcaactgcacttacatgtgacatgacttcagattttaaaaaatgttctgttgacaaaaattaatttttaaaatttactgaactgaattaccttacatctctaggatactcttgtcagagaccgttacttttagatgttctatatggtattggtctctgcttttatttctaagtacttcattgtttttaatgatttgtggagaatctcagtttaccctgagactagagaatgccctcttgttgtgcaaaggaaaaccagagtaccagtcttccaaggcaatactagctacatttccatttctttaaaaaattatgattgtttatatctgttgactgtgtgatgtatttgaagctaataacatatttctaatgttttgttgatttatacatcatacattttatttgagagtataatttccatcattttgaatccatttaaaaatataattttggtttggtttgggtttgcttttgctttatatctgtgcttatcacaaggatgttttgttttgatgagggaggcttttaaaatttttaacctgagtaattggtatatattttcattgattaaagtgaattcagaatatctatcttgatcttaaataaagagctgaagtgttcagaggtacccctacctttatatattgttctcttgcctactttgaggatttattggagaagaaaggtgagataaagataccttttcatgcttttgtctagggtatttcaaaagcaagtgatatgttaagtcatgcattctaaatgaaattgctgttttaaatttttgttttaggatagtggagattatccacttaccatggctggtcctcagtggaagaagttcaaatccagtttttgtgaattcattggcgtgttagtacggcaatgtcaatatagtatcatatatgatgagtatatgatggatacagtcatttcacttcttacaggattgtctgactcacaagtcagagcatttcgacatacaagcaccctggcaggtcggtatttagaaatattttctgcatattgtcttagatttgagatgaaaaagattctcatttaaagagaaaggaaataacagagatacaaattaattttatttataaagtgaccactaagaggacactcccccatccctcctgcgaattcctggaaatgggatgataatttcagttttgattttgtgaaggtatactataactagtatttggtaattttcttgtatactatgcatactgtgccacagcaggggagaattggacaataggtatgtgttgggttcttgaaaaatactatgccacagcaagggaaaattggactataggtatgcattggattattgaaaaataccatgccacaagaagggaaaattggatgataggtatgtattgggtttttgaaagatatgttaccagggaagatattgacagcagatttggagatatcatcacagtcattttggatatgtgatcctgatgccatttagtttgtctttggtgtgcgttgcctctccaggtaggatggcccctactagatgatgcctgttctttcagtcacactgcaaaaaattgatttttcttatgtttctgggtaactttaggctggggcaaattctttgatctttaaagtttaatgaaataaggtatatttttatacctcataacatctgttagttcctcttttgtgcttaaggtaaaattggtgatacactgctgttgaatttgttgcttttgagtttcaataaataaaataggcattaattgttatgatagtattctgaatcttctgaatcttaatgatattttgatttttaactaaaaaaactttatattctctgttggtttgttttttatttataagattttctcaaagaattaaatctatgattaaagatatgcttctacgtccttcattattaaagagaaaatgcagtttcccgtatgttgtttttgtttttagatttgaagtcagaaaatatgaatgtgatcttgctttatgcacttgtggtagcaatgtcaataacttgatggctaaagtaaattaaaacagggattatggtgcaagatggatacttttagatcagagtgacagactggtttgctgggagcatgaaattaacttagagcagaaaattgggaaatctttctttaagagagccaatagccacaaatttaagatgtagttttattgttgttgtatcatgcaatgcaccaagtctgagaagtagtctggagtaagctaaagaaagcaaaaagtgatcagatctttcagttaataaattttaaatcccaggcaataagaatcttgtatcaggagtaagagtttagtaacagaaggtagagatctggaggaagttttatgaaaaagcactttaattaagtcacattttgccctttgttcttttgactttccatggagatctgttcacagtttcatcagtcatgttatagagtaaaatgaaaggaaagcaaatactgataaaattcctcaacattttcataaaatataatttgatgtaaagccatcaagttccttttaattactgaatagctaaataacttctgtgtgaactaaaatttactttagaaggtgaatcatgatctatgaaaatgattattttagaggacatattatagaataatgggatttaaggatagactggagtcagattgccttggtttgaatcctggtttgactgcttatatgaactgaggcaaattttaaaatttccctgagcttcaattttgccgtgaatgaaatgggtataatacttacctttgagagggccattgtgaggattaggagataattcctgaaaagttattttattttatgttattttattgtcatttgtagcagctgcatctttcttttgttagaagcagattagctcatttctgcttaatatttctatttgatcttaaattgtaaatttttgtgtctgttagattagtttcaccatacttttactctttaaaaatagctatgaagttgatgacagctttggtgaatgtggcactaaatcttagcattaatatggataatacacaaagacaatatgaagcagaacggaataaaatgattggaaaacgagccaatgagaggctagaactcctgctacaaaagcggaaagaggtaaacttttatattgaatatttaggctattgtgtgaccaacttggtcaccattaattaggatataactttgctagtggctcagataattgtttttgaaatatttaaatgtaaataacatttcaaactatttgcccaacaaaattctgatgaatatccgtgccaacaatactgttttcttattttcaacctgcgtggactagtattaagagtggctttaagtaaggggactggggttagtctgacaagttgtcttaagctttagtattattcatctctacggtgaaaaaccttttgtcaggatgaaaagagatttcacaattaaaatcactttggaaaataaaatcactttgaaaaataacataagctgtttattggcatctaaatcagtgttttttatacagtagaaggcatttgtttaacattaatgactgaccaccaaattcaactctgaatgaggaaaataattttttcagccttatgcgaaataacagtaaataaaatcttttgatgctgcggctgtaatttaaattctttcttcattggtgataaaatattttgctatctcataatggagatgtttgttttcatatcaaataggcaaagtctgatttttcaaaaatattagtaatgcagttgaattcagtagttatcatggttatctacgaattattgacctgatcttgaatttttttggggaggggaattagtagctaattttaaattggttatttctgaaatagttaataactttaaaacatatccagactcaagaattgactaagaaaaatcctgatcatatttcacccatgtctaaattcctcatatttttcatataatttgaaataaagtgttgatactttttccctttaatttatgtatatgctatatagtaagtgatatgtagtagcaaactacattacagatttctttacagtgttttttttggaggcagaatctcactctgtctcccaggctggagtacagtggcactatctcagctgactgcaacctctgcctcccaggttcaagctcctgcctcagcctcctcagtagctggaattataggcttgtgccaccatgcctggctaatttttgtatttttagtagagtcggggttttgccatgttggccaggctggtctcgaactcctgacctcaagtgatccgtctgtcttggcctccccgagtgctgagattacaggcatgagccactgcacccggccttctttacagttctttagtggaaatttatgagcattagaaaaaaaatctactagctaaatattaaaatcccaatcaaatatttcaggtattaagggactttatctacctggtaatataactgttaatttttctatatggttactgttgtctagtataattcaaaattccccaaaatactggggaattctgctttttttgtgcttgtaacaacttacaggtgttcatttggttgtcttcctttacaattgaaaagaaatgatgtgtttttttacagcttcaggaaaatcaagatgaaatagaaaatatgatgaatgcaatatttaaaggagtgtttgtacatagataccggtaagttgtgacagtttttttcataaatagcattatgtaatttctactcagcaagtttgcatatttcgtggtgtagggaatctaaattagcaggaagaatgttatagtaaaatcaatgttagactccattagtgccactgagtcactctgggcaagttatttaactcatgtgagtttggtgtttcccatctgaaaaatgggataatgctgtgcttgacttgcagccagtagaagttactgctatttggagttgggctacacaatacttaattgcctttggatgcactatgttagtagagcctgcacgtgctgactcctgactctcttcccttccattgaatatcagtgggaacaattggataggttaaagtgagatattttcttttgctgttttgaatgaacagaggaaagaaatagtaatcttataaatttatgctgtaacctattcttaaattttggtagtatttttattcagcttccacatatcctcaacttggcagttactgaatcaggttaatgcttactttttgtaatgtctccatgtccattcttaccttttcacttctattgtcaccattaccttagtctgtttcctcattctcatgcctagagattattgcagttttgccaaaatatccttttattgtgttattcctctgccttcaatgactcaccagtacttacaagatgaatttaaaatcatttattctaacattcaaatcccagttgagcttgacctcagtgtaatgtataaataatacttacctggaaattacgctctagccagacaagtgtgcctgctgtcttctgaacacaccatgcccagcaggtgtgagcaaaggctgggatatggtatggtataaaaggtggggatgggattttgtttgtagttttatataattttaaatgtttatgtgttgataattatgctttgccacctaagcttttggcattcaggcccatgcttcatttctattttttaatccctagtaataagataatgtcatattcatagtagatctgaagtacttggcatctcttgaataaaccataagttttgtggtatattggcactaattatgcatcgtttttccttcccccattcagtgatgcgatagctgaaattcgagctatttgcattgaagagattggcatttggatgaagatgtatagtgatgcctttcttaatgacagttatttaaaatatgttggttggactatgcatgataaggtaagatgtgcccttcagactgcttctttctacacatcggcgtggctgtctgcacctctcattcatgagttatctcccagtatgtatacctggtgacacatttctggaagcctcccctttattcttttctatcttctctgtaaaaacttattttctatcacataaagtctgctagatatttttgaatcctggccactgatttaaccattaatggtgaatcatttttttgctgaaatattacagtcatgaaggtagtaggagtgaggcatttcttagggcacgaagaagaaccattacgctgttgttatctgagagctatatacttaaaaaaaaaattattcaattttgatcctctcttttgacaaacctgtatcttagccagattataccttactacttggtttctgacctttttaatatgttttcattaaactaccattctcttaggctgcctcttcacttgccttgaagaaattgattgtatataattctttccaaacattacttcccatagtggaaaatatactgtgacacatgcttctattgtttttcacaatagatttgttctgaacaaattttcaaaaattatcctttgaactacagaaatagtaaccccataggtatttagtcataaatgtatgtactgattactatttttgcattatcaaacatgatagtttctgaaggaatgctatggtatgaaacatttaaaattttaaagtagaaaatattgtgtacatcttgaatattgaagttgaaaatacatagagttttaatgcattgtctcatctttttttttttttttttttagcaaggtgaagtaagactcaaatgtcttactgctctacaagggctttattataacaaagagcttaattccaaactggaactttttaccagtcggttcaaggttagtattacttaagaatttacaaataacttgtcatttgcaaacacttttctcttgctttccttttaaaaatattttaatttttttgtccttaggatagaattgtgtctatgacccttgacaaagaatatgatgttgcagtacaagcaataaaattactcactcttgttttacagtaagtatgtatttgttgcatatttgcactaatgttcagatatctaaataatatattagagtatttggttcagactcatctaggtctaaattttagtagcttacgtcatggaggtttacagctagaagttgaatttcttcatgtatagttgagaaaacacaggaagaaggaaccatagaatatggaaattcttttttttttcttttttttttctgagacggagtctcactctgtcccccaggctggagtgcagtggtacgatctcagctcactgcaagctccacctcccaggttcacgccattctcctgcctcagcctcccgagtagctgggactacaggcgcccgccacgacgcctggcttattttttgtatttttagtagagacggggtttcactgtgttagccaggatggtctcgatctcctgacctcgtgatccgcccgccttggcctcccaaggtgctgggattacaggcgtgagccactgcgcctgaccgaatatggaaattctaactgagctaggaattcatgtgttcccattctcttggcagattgatttccttcctgtttttctgtttttgatgctcttgaaataagcacatcagtgtattaaaaaacatgcttattgtattttgttacacttttagagtatgagcatttataagaatgtctgttatacttctcatagcacctttaaacaatctgaatttaagacctattctgtgttaatatctgatagtgatgttattcatatttttcctttttaaaaaatggtagtaaaatatagattatgtaaaattcaccattttaaccattttaaagtatggtttactgtcattacctatatttacgttgttgtacaactgccaccactatccattgtcagaaccttttcatcactttattctggagctctgtacccattaaacactgattcttcattgtcccctttccccagatcctggtaaccactgttttattttctatctctatgaacttgcctattctagatatttcgtataagtggaatcatacaatatttgttttttgcatctggcttatttcacttggcataatttcttcaagtttcatacattattatagcacgtactcctgtttatagctgaatatttcactatatgtatattccacattttatttatccatttttgcattgatggacatttggactgtttccaaatgttattgtcagttattgtcagtaatgctgctatgaacatagatgtgtacaagtatctgtttgagtctctgctttcagttcttttatgtatacccagaagtggaattgctggatcatatggtaattctgtttaatttttttttgaggaactgccataatgctttttacaaaggttgcactgtttcacattcccaccagcaatgtacaagatttccaatttcttttttttttttttttcctgagatggagtctcactctgtcgcccaggctggagtgcagtggcatgatctcggctcaccgcaacctccacctcccgggttcaagcgattcccctgcctcagcttcccaaatagctgggattacaggtgcctgccaccacgcctgggtaatttttgtatttttagtagagacgaagtttcaccatgttggccaggctggtctcgaactcctgacctcaggtgatccacctgccttggcctcccaaagtgctgggattacaggcatgagctaccacacccagccaagatttccaatttctgtacgtcctcaccaacacttgttttctgcatttcaggataaatatttatcaagtgatgtctctataccaagcacttgggtggtatgttgagagagttaaaaatcagagccttctcatttcaaaataatatgacgttttataaaaatacctagaaataagaaatccaccagatatatgcaaagaaacattaataaaatgcaactaagggacataaaagaaggcttgaatttggaaagcttacctaggaaaactcagtatttaaaggcttgtaatcttcccattctgtatatttaccacaatgtaaatagtaaaggcaaaggaattttttttttttggccatagcaagcaaattgtgacatttcatatggaaaatttatcatgtaagagttgccagaagaatatgatacaaactaatgagtgaggactagcccaatgtatttttaagtcatgtattataaaatcatagtaatttaaaaattttggtcctggtacatgaatagacaaaaaagatcaatgaagcagaataaaaatagagatgaacacatatgcaccactaaaatgaccatgtaaggctttcatgagcatgacacaaaagctagatataaaaggatcaatgaattaactatataaaaacctaaaaatgtctgtatggcataaaataccataaactgagaaaacagatctcagattgggcaagatatttttgcatcaaaggagttaatttctgcaaatcaattaaagaaatctgtaataataggaaaacagtcaaatattataaatcagattattgacagaaaagtatgaatttaaacatatgaaaagatgttgggccacacttacaaacatatatattaaagtgagacttttaaatctgtttgcttggcaaagatagaaagtgtttggtaattacactatattgttgaggctatgacgtaacaggcccttttacattgttgatgggagtataaattggtctaagctccttggagaaaaacttgacagtatctgtcagaatttcaaatgctcatgttctctaacaaagcattgtttgtaatagcagaattttgaaaacaaccaagggtgcatatcactagaggaagaattaaattagtatgtaagataatagctaatataagcactttatatggataatttcatttaatactgcagctcagtgagatggtagtggctattcccatttctgtgaatcggacaacattgcagtaattaaaaagaaggcagttctacagatattgacaattcagggaactcacttaccttggaatttcttgagcagtctgttaactgttgcattctttaatttttaattatattttaaaatcataaatgttatacacacatgttgtatataaaaattttgaaagaattctgaaataaagtaacagtatgctacatatatttctatagcttctttcccaccatcctccacagtacactagaaacatcttctttctgatatttttatcaaaggtaatagacatacccattcatgttgattttcagccatctatatacctaataatttaaatttcttagaaacgttccttttcaaaaagttaaaatgagtgaacttctgtagagttacagtactttaacttgtttgattcagtgttttttttgttttgttttttagagacagggtcttgctttgtcacccaggtggtatgatcatggctcactccagcctcgccctcccaggctcaatccatcttcccacctcagcctcctaagtagctgggactatagctactgtagtcccaccatgtccggctaattttttttttctttccgttttttgtagagatgaggtctcatgttgcccagcctagtctcgaacacctgggctcaagtgatccacccacttcagcctcccaaagtgctgggattacaggtgtgagtgaccacacccagcctgattcagtgttattttgttaaaaacacacaagttatttttccaagaacaatctgatattatataaagagcaattgaaatcagtgtgcttttgaaacttgaattttaacaatttagttctttttctctcaaaaagaagtaatacttcttagacatcagacttctggaagctttcagcacaacagaaaaccaaaaagtaaagaggatctgtgtgcttcaactatccagtattcttaggcttttttcctctggcagtggtcctatgatttgaatttacatataatggtaaaaacctagattatatatatcacagtagactagaagcatattgggagagaaagagctgccaggggccaggactctgaatgcagttgcaagggaagaatgcaacagcgtttaccctggggtactgtggttgatgggccttaatgatgatgatttatcgaaaatattttgttaggcttattttgttctttaaagataagaaaaataaaatgagcattacattttagtaagatttttttccccagtgattgcagttaaagatctttggcacttagattttagttatttgggaaaaccacttgcattgccttacatggtgttcagtacatggtggatgaagcatttttgattgatgtgatataaatgggccattagtatattttgatgtaatgttgtgacttaatattactatgaaatataaggaaagtattatattatctgtgatttttaactctaagctcttagcttgctgcccctttactttctatatgggttttcattattttgtcttccttttctgttagcatccatgtgacataattcttttaaacgtttatttgtttaccttctgcattcacttttaattttacctgccatttatctttgatagattttggtagatggtaattaaataagcttgatttggttttttttttcctttaacacaaattcatgaaactttacaactttttaaaagtatgagcataagtttttgtactgttaatatgcttagaattaggacgttactaaaagcacctgttactgcttatttcttaggagtagtgaagaagttctcactgcagaagattgtgaaaatgtctatcatctggtttattcagctcaccggccagtagcagtagcagctggagaatttctctacaaaaagtaaatctatatatctgttactcattttctaaggcatactttcataacagtaatttgttatgttatacttgacattaagattatatatatataacttattttaaaaattactacagatcatatcgaagctttcacattttactttttcctttaaaagtttagatttctcctaagttctttgatttattttaagttagatctttaaagggaaatgtaggctgggcgcagtggctcatgcctgtaatctcagcactttgggaggccgaggcgggtggatcacgaggtcaggagatcgagaccatcctggctaacacggtgaaaccccgtctctactaaaaatacaaaaaatcagccgggcctggtggcgggcgcctgtagtcccagctactcgggaggctgaggcaggagaatggcgtgaactcgggaggcggagcttgcactgagccgagattgggccactgcactccagcctgggcgacagagcgagactccatctaaaaaaaaaaaaaaaaaaaaaaagggaaatgtacccatgtctttcagtaaacatgcttagaaagatacctaactatattataatattaagactgatctcttcctaattgtttacccttttattacctgcttcagcatctaaatattgcttatgctataattaggcttttttttttttgagacagagcctctctctgttgcccaggctggagtgtgcagtggtgcgatctcagctcactgtaaccaacctctgcctcctgggttcaggtgcttctcatggctcaccctcctgagtagctgggactacaggctgtatttagtcttcaacttatttttcctttcctttagaaaatattaaaaggttcttcaagtatttaataaagtttgacataagaatcccaagaattctacagtctctttacttttgtgatcctatttaactcagattaggtagtatgagtagaagtgtgaatatctgttcacagaaaacaaagattgttatataatggctttcaaagagactcttttgagccatatagattaaacttttcttgttcctatgatgttattaaaatgcctgttgggggtgcagcaattattaggaagagtaggtggtataaaacatttacactacagttttctattcattgctgtttagtgttaattctctttgttgtttatgaggaaaaatgctcatgctatccatagtaaaaggacagtaagttggggtaattttgccagaaggatggaaggaaagtatatgtttagttttcaagatgaatatgtatcatagattttttagcataaatggtgtagctttgtcaatgtactacttttatggaaggcaacagttatataaaatacagtaaggtttttaaaaacaaatagtttataactcagtacaattaacttgagaaattagtttaaaaggacttagaattaccatcaaacatgaaatgaaaaaggtttatagcaattatttgcgtggtgtgccatgttggatgatattgtacctacccagttctcctttactcctttgttagatccttagatatgaaattgaaacagttaatttttttattagaaaattttttgttgttgttgtcgtaaaataaatattttacttttttcacaggctcttcagtcgtagagatccagaggaggatggaatgatgaaaagaagaggaagacaaggtccaaatgccaaccttgttaagacattggtttttttctttctagaaagtgaggttagttgatagtatttattttatacttaggttcgaaaaattttggaaaaggggttaaaatgaggcacatttaaaaaaatattccttgtagcacagtaaattgtgaatagaatggagagccacccactcccccactcccccaatttttttttttaaatatgctttctacttttcttctttttttttttttttttttttgagacggagtcttgctctgtcacccaggctggaatacagtggcgccatcttggctcactgcagcctctgcctcccaggttcaagcagttctcctgcctcagcctcccgagtagctgggcttccaggcgtgtgccaccacgcccagctaatttttagtacagacggggtttcaccatgttgaccaggctggtcttaaactcctgacctcaggtgatccgcctgccttggcctcccaaagtgttgggatttacaggcatgagccactgcgcccggtcactttcttcttctagtaagatgttcaaacagtaggatttatgtatagtgctgagaatattaattttaaagttcaaaatcctaattgtcagttgggctactctgcttactatttgtgtgaccttggtttagctacttattctttcaaagcctcagtttcctagtaaaaagatgggtaataaattcttagttaacactgaaataatctgtataaaacttaacacagatctctagaacattgtaagatttcagatgttggtacctgccattgcaattgtagatgtagacttaaactagtctccctaaagttggaaacctacaatgttagccagattttgagagggctcaaaatttatttttggtgttcatattacatactattatttaattagtgatcaggccttttaattttctagttatttctatatatggatatataattggttttttattctttaggattttctacattacaccatcaggtcatttgtaaataaagataattttccttttcctctccaacattttttttttcatttgttttcttgccttattgaattgtctaagaccttcagtagaatgttgcgcttaggtgcggtggctgacgcctgtactctcaccacttgaggaggctgaggcgggtggatcacttgaggccaggagtttgagaccagcctggccaacatggcaaaaccccgtctctactaaaaatacaaaaattatccaggcatggtggtgcatgcctgtaatcccagctacttggaaggctgaggcacaagaatcgcttgaaccggggaggcagaggttgcagtgagtcaagatcatgctgctgcactccagcttgggtgacagagcaagactctgtctcaagtagacatctttggattgctcctgatcttatgggagaagtgtccaatatttcgacattaattacattgttagctataggtgttttgtagatatttataatccgattgagaatgttcccttttattcttttctttgctgaaagtttctaacatgaatggaaattgaattctgtaaaatgcttctgcattacttgagatgattgttttatttttatcctttattatgttaatgtgtcgagttatgttgaatgactttttaaatgttgaatcaacctacttgttcatgatgttattctttttctatattgttggattcagtttgcaaatattttattttattttatttattttatttttttaagcaacagtgtcttgctctgtcactcagcctgaagtgcagtggcgtaatcatagctcattgcagccttgaacttgtgggttcagttgatcctcttgcctcagcctccctagtagctccgactacaacttcgtgccaccacacccagctagtttattttagaattttgtagacagtaggggtgtcttgtgtcccaggctagtcttcaactcttgggcccaagcagtcctccctccttggcctcccaaagtgctgggattacaggcataaaccacagcacgtggcccggtttgccagtttttgagggcattccctctatgttcataaaggatttagatttagattttttattatttgtaattgctttgacagcttttttttgtataatgattatgatttgcacaccccctcctccccccgccaaaggagtcgggaaacagtagggtttgttttttgttgttgttgttttttgatacaaagtctcgctctattgcccaggctggagtgcagtggtgtgatctcggctcactgccaatctctgcctcccacgttcaagtgattctcccacctcagcctccagagtagctggaattacaggcacccatcaccacacctaatttttgtatttttgctaaagacagggttttgccacgttggccaggctggtctcgaactcctgacctcaggtgatctgcctgcctcggcctcccagagtgctgggattacaggcgtgagccaccatgcccagctaacagtagggtcatttaagcttcacataatgaagagaatgatttgcttatatattgaattgacaaacatgcattttgtgttttaattaaccattatcactccccttcagttaaaataaattcatagcatacctaagaattgagagtagctgactaatacattaggtccaaataagcagtaagtatgtatataatctttttataaaatacttttcaggacgggtgcagtggctcacacctgtaatcccagcactttttggaggctgaggtgggtggatcacctgaggtcaggagtttgagaccagcctggccaacatggtgaaacctcatctctactaaaaatacataaattagccgggcgtggtggtgcatgcctgtagtcctagctacatgggaggctgaggcaggtgaatcatttgaacctgggaggcagaggttgcagtgagccgagatagcaccacttcccaacagcctgggcgagagcgagactccatctccgccacccccccaaatatatataatttattataaatatatatattttatataaaaataataaaaaatttttttcatattaatgttttaatgataattgttaatgtgtaatgatgctacctaacacgtctttcttacagcaagcaaactaaggcagtttcttctctgtcctttcatctatttgacgtcaaaaaatagattgctgtttgagagtttgtagatgatgtcaataaagtttccattcttttgagttaaggctagtatgataattgtctaagaccacattgctctttttaaattttagttacatgagcatgcagcataccttgtggatagcatgtgggactgtgctactgagctgctgaaagactgggaatgtatgaatagcttgttactggaagagccacttagtggagaggaaggtaaggatgtttaattatgatatttttgtttagacagttttgtaagtagatttttactcattccatttatttgtccttttagttttaagacaatttgatagaaaaatcttacttcgtgcatagttttgttttcatataaatattatgctatgtaaaaagatgtaattgctgtcaacattctttatttttttgtatctgggttattttttttacccaaatgtatggatctgtggtggatagatttgggatgctgagggttttaggaaggtgatgttttctgtgataaagtaatgggattttctttagtaccttagggcagattctgtttacaggcagaagaaactgttatgtaataattacaagtggcatatagggagaagaaataagctaactctttctgactttttttttttttttttttttttttagcactaacagataggcaagagagtgctctgattgaaataatgctttgtaccattagacaagcggctgaatgtcatcctcccgtgggaagagggacaggaaaaagggtatgccaatcaatgtcttttcaatattctaaactccatttctcctttttcagtatctttttaaaaattccattttagccatgaaacaattttgttttatttttcagacaacctttgcttataaatttgttagaggtaaattttaaagcattagcaatttgagaaatttgagttctctgtaatatacttttttagttgctgcaggagatatgattgacagtccctgccttcatgactgaatgtagcatacaccatttggaatggtgcagttgtatgttttatttatggatttgctttctatttcttctaaaataaaatcagaaataaaaatggagataattttttattaaaatagggaaatttctatttcctggaatcagattttaatgcattattgtaaagtttacatgaacttgcattttataccaacaattccacaggctttcaaacttttgactgtaaagcataaaaattcattcttatattgtgacgtattacacatgaatatgtttgtgtgtgcataactgaaacaaaattttatcaaagacaatgtgatgctttctgtgttttctatttctgttttttaaaaatttctgtttcttttttgctaattgctgatagcaatttagtgttttgaatttgttacttatgtgtcatgtcccacagcctagagtaagcagaaatgctggtcaatcccagtattttatatataagctcttaaactatatttcctatttttaactgattctcctaccatctgaaggtagagttggttagtcttattggatattgattttccctataggactatccaaatttttttttgttatttcaggtggctttttgtttttataatgtgtagttttctctttcatgtcacttttagggttaatgttttatagtgaaatttttgtgtccatctcttaaaatatagttttagtaatcattttgtatgttttaactaaaacttgaacacttaacagtgctaatgggcttaataaatacagaagtctttctgttcctttaggtgcttacagcaaaggagaagaagacacagttggatgataggacaaaaatcactgagctttttgccgtggcccttcctcagttattagcaaaagtaagtttgtgtcaatatcatagtgttactaagaaatgagttttttttccctaaatgcctcacagaatattataatgctttcttattgtgatatttttaacgtgatctttatatttcacagtactctgtagatgcagaaaaggtgactaacttgttgcagttgcctcagtactttgatttggaaatatataccactggacgattagaaaaggtaagattattttgtgtaaaaaaaacctttaagaaaaattattcagttcattatatcatagcgtttgtttatatttcttaaaatgtttttttggaacgtattttaagaaaggaaacctatagcttaggtcttctgtactttagtttgacttacagaatggcggtaatgatgcttccctttgcttcatgcccacaactgtaccttcattcttagctattatatgactatgtcactgatcatttatagagactgggggtggataactagataataacaattagatgagattgggctcattcagggtggtatggccatagacgataataacaattataagacaaaatcaactaatatttattgaacacttttgctatgttctgtggattaatgtaagctcttagtatatgttagcattctcaccatagccctatgaggtaggtaatatctcccttaaagttgaggaaaaagtatggatggatcagtgtatttatttatcatgattagaaaagcaccttaaaatgtacgctctgtgttgtagacttactgtatttgaaaattttttccatggtggtatggtcatgtagtcactttatacctatcatatatgccttagttttgatgaaaaatattattattttgcagcatttggatgccttattgcgacagatccggaatattgtagagaagcacacagatacagatgttttggaagcatgttctaaaacttaccatgcactctgtaatgaagagttcacaatcttcaacagagtagatatttcaagaagtcaactgatagatgaattggcagataaatttaaccggcttcttgaagattttctgcaagaggtatatattataactattacaagtattttgtcagttgagcccctctactgcagtaagctaattagtcacccaagtgttaagtcttggtgatagtccctagcagtattttgaaaagatgttcaggcttttcattctatgactcatcaggctactcctccaccaaaataggaaagtggtaagaatctgtgactcagagaaggtgaaagcaaaactaacatcttttttgttttgagaaatgatctgaacagttacctggtttttattgaaccagggctgttaaggaatagggtgttaatggaacagaaaaggagagctagatttagactaggtagcctaaaaaaagtagagtatttctaagtgttttggcagtgtaggttagggaaggacattatgttttttttttttttttggagacggagtctttctctgttgcccaggctggagcgcagtggtacgatctcggctcactgcagcttctgcctcccaggttcaagcgattctccggcctcagtcttctgagtagctgggactataggcgtgtgccactgtaccaggctaatttttgtatttttagtagagatggggtttcaccacattggccaggctggtctcgaattcctgacctcaggtgatccactcacctcggccttgcaaagtgctgggattacaggcgtgagccacacatccagtctgggttttgatattataaaactttaataagttattattattatagccgctgctactgttggagtttcctgtgttttctcttgtatttccaaagaggcttagtgcatagtacttaaatacacttgtatttttgttgtgattgttattttttccagaaatatatatttacattcagtttttttgattaaaataaaaattcataattgtcaaattaatgccattagccttttccacatcacttttatcattaatgctgtaagatcatatggactttgtgatttctagttttcttgttttattaattactcatttaacttttatttggtgtatattgttattccgggcttattaagttttactaattggaggtttgtgcaaatatgttgatgtacgatgattacattcttagttaaaaattttaatagctctactcttggctgaatataattttgattaggacaaattaaaatcaagcaatggtttaattaaatttaattactttgtagaagagttatagtttaaaaacaagtgcttttttgagagaactagagttcaacacagtagattgagtaatgtgtaagcaattttatgtttcctgtagtaagactggtaaaatttttcgaaagttaagttaccctaagttgaaaagtatattaatagatgttgatatccaaatgggaccagcatatctagtcatttttcagagggtttttccctgtttatctgtgattagtgtcatatgtcttcatgatgatatatgtttaaggtacttagattttgtcctttaggtattgtccttctgatcttcttgtcatttaagtattttattgtcctagtgcatttattactgtgaaaaaatagatgcctttataattttgtgtcaagtttacttagaagaaaaagaagaatgtcattttcgttttttctctcagttgtgatgtttctatgataaacttgtgttgacttacttccccagccatattgccttaaatttggccagatctaggtattgaatgacaaagttcatttgtgggttttgttatgttatttttcatttttcaaggtaatagtgacattttgatagcctaggagttttcactttgatggttcttaatgtataattaatatttatagggtgaagaacctgatgaagatgatgcatatcaggtattgtcaacattgaagaggatcactgcttttcataagtaagttgaattttgaagttcctgttttcttaaatctgtagaaataaacttgcatgttttgtgggttatgttaatttctaagctaatttgttgttgtcgttgtgggggcattttaaagtttactgcatttactgcattctgttaacagtcaagtccaaaacaattgtcattaggcttagctttttaataaaacttaatttttttttttttttttttttttttttacagtgcccatgacctttcaaagtgggatttatttgcttgtaattacaaactcttgaaaactggaatcgaaaatggagacatgcctgagcaggtttttatttatttgctagttacacatttatctttgaaaagtgaagtcttgtgacttttaaattttaactgtatcctttgattctttttacagattgttattcacgcactgcagtgtactcactatgtaatcctttggcaacttgctaagataactgaaagcagctctacaaaggtttgtggtggttcagtagtgtttttattagactaaatatcattaactgttttcagcaaactcacacatttaatgagatcagttatttcagtgaaatgttgcttgtttctaatgtactgttatttgtagtttgatgtatattcagtggagaggatatcgatatggtttgtttcaaggtatgatttttaattaaaaattgttgttcacatttgaaggtggcataatctgtggttttctgtattctcaaagttggtgagcaagagcctttgaaacagatataagtattagattacataaattgaagataataaaccaactccccctagatcttcttatgctctggtattgttttgggataaccttattcatattcaagatctctctagtgatgttccaaattcatgatcaatcattttctgattgaatatataatgtgccagcgccagctattagtacatatagagcttttaaagctttacccataatgataatccttaatgtgtttagtaattgaactaaacaggactgccttttccatttgtaaactggaagcttaaacattgtacttgtagtgctggatattaccttaaatattgtttgggctcatttttagaaatatcacacagtttctaagagttctggagttaggtgtttgtaggcattttcttcaaaaagtaatcctcttgataataagtttgtgttgcctaaacccacagaataatgttaaatacttagaatttctctgggcttttaagatgttgttatatctacaaatggatttttcctcttgaaaaatcaatatagtattgttaacattgtgtgcttcccgcccccccacccccaccaccttctgaggcagtcttgctctgtcatccaggcgggagtgtagtggtacaatctcggctcactgcaacctctgacttgcgggttcaagcaatcctcgtgcctcagcctcctaagtagctgaaactgcagtcatgcatctccacgcccactaacttttgcatttttagtagacatggagtttcaccatgttgaccaggcttgtgaactcctggcctcaactgatccgcgcattttggccttccaaagtgctgggattacaagcctgagccactgtgccctgcccattgtgtgctttttatcaaacacttaggaaaaagttaatttaactaaatgttaagcttgtagtaggaacggtgactatattaccatgtataattgctcacctatgttggaagttaaaaactaaactggaaaaaaggcagtatttttagtagaggaaagggatgaatataaaattatttatggtaagccaggcacagtggctcacgcctgtactcccaatgctttgggaggctgaggaaggccactcacttgaagtcaggagttcgagaccagcctggccaacatggtgaaaccttgtctctattaaaaatacaaaaattagccaggtgtgatggtatgcacctgtaatctcagctactcaggatgctgaggcaggagaattaattgcctgaacccaggaggtagaagttgcagtgagctgagatcatgtcactgcacttcagcctgggcaatagagtgagctccatctcaaaaaaaaaaaacccaataaaaataaaaagtttgagatattttaaagtttatagtaataccacaaaatattttccattctgagtttttataaaatacagcagtatccttccaacaagaaatggaagatgctgtttcttttttattattttattccatttatgggttgaccacccttgaaataatgtgagcatggagcgtaaatctttattagcattctgtgctagtggctttattaaagattgccatatcaattatataagtcttctcatcctcttaatatcctaaagccttaggatattatctattaatgtacctcatatttttaaggctgcaatttggtgagatttgtaagacaaaccgtctctttgttttcatttcttataaattataaggaagaaatttaaatcaaatgcagaagtagagttaataaagctatgagataatgttttacataattgaaaacattttaaagaaatgctgaattgtttatacaatattttttaaaagttaatgttaaattttttcaaggaggacttgctgcgtttaaagaaacaaatgagagtattttgtcagatatgtcaacattacctgaccaacgtgaatactactgttaaggaacaggttagtaattactatagatggtaatctttttgtaagcaacctttataaaatctgaactaatgtagaaagtttaaataatactaagattgagcaaagcagaaatatcttgtatctgcctatgtatattatactaaaaaaataggttaatatattggatttgtgcataataaaattgattaatttcatatggggtttataattgcattatagattacccttattgtcattttatgttgttgtttctttatgacacatggtaaacagacttcatacaaattatagatgtatgaaattaacaaaagtcattcctgaaagcaactaatatgacaagtttgttccagggtagaaaagtccacagggttttgttatctctgagagtatcagatgttggcattctcgctcatcctgatcttcctgtggaccttctctgaaataaacatttataatcacttccctgtcttccaagtgttaccttcccaacgcgtatgccttcatgcttccattacttctaaccttttcagttctcgaaatagactgttacctggtttgatcctagaactaacatcatgttcaattctaattccctaattgagaggattaagcttcgttggaaacgtgcttttcaaatgcttttatgggaagatgttttcacaagcattccataagaactattaatatggtatagtcaaaatgattatggtgatttcaaggtttgcaaccatttcatacagcttaacctttgttttttcaggtagaatcccaatagtcaacctgactatgatttttggacactgtgatatgttaggtactatttattttagttcagtgttattcaaatataaccagccctttgtttggcacttgtctttatttaatttaaaaataccgaagctaattttaataaaacatatttggatttttatagtttaaaatgttcattcaatgcccagctggtagtctctttttttcttatttccagctctctcttgtccctaccatacatatatgcttggtcacacatgccaagatgcagttactgaattttgctatttttttccaaaaatatgaagtatattgccataactattgcattgcagaattctctccaattttacgtgtgtagttttgaactatagcaataaagggtgtggtactttaattttcatctctataattcagatgaaaggaacaagatttctgatggtagtaaattgaatttagatttaaactcttggaataggattttaatgacatgcacagatcgaaacctaatgcacgaaatattactttataattgcatgggacaccaagatattcagcataataatccctatttttatagcattaacacataatccttgtgggttatcctgtgtaacctcctatataatcccttgctcaggccatagagattaattatttagttattaaacagcttatgtgcccagtcttcccaacagcttcccagaatgtgtcctggtcagctcacttgatttgccagttcagctaattagtaaatatcatcatacttaatactttatatccttactctttatgttgcaagtttttgtagactgaaatatgctaataggtataaattactactatagtagttaggagaagagactgaaggaaggggtaaaaacataaagagaaaaagtaaatgtggttagttccaaagtggcaaaactcttaataagatctgctttgtgctctgtattatattgtctttccaggaatgatcttcctttaaatgtattttctggtttactttgtgaccctaaatttctattttcattaccccttcccaacaaataattaattagtctgtgactccatttaaaacccatggcagagtttttattaagctccttgagatacaacttcagccttatgtttattataatatgttcaggtttacctgataaatagtaagcagccctgtatctggttatgttttcgctacttaatcagtacacgtgtgaacaatgagagtgcttaataagtaccatagattttgtgatctctattctaatacttatctctttaatgttttttcttctgtagagtgaagagtggtaccaagtttatacattatttcatatttgagaatgaataccttggggcattgcaatatagagcaaagtaggggatttggagttagaaaacatgagtttgagtcctgaccctgcatatttttgtagtgtgtaacatattgtacaagtcacttaatgttgctgaaaattaaaaaaaatttgtgaaattactttgcagttagtaaagccttatacaaatataagcattcgttgttacataaattatacttcgcagctttagaatcttaggaaaatactaaacattgatttctcttaagatttttaaatatagaaagttggattctgtttctgtgttaaatatgtaaattatttgtggcagttagtgagaaaccttggattatagcatgctttcctcttttttttttttttaaataggccttcactattctgtgtgatattttgatgatcttcagccatcagattatgtcaggagggcgtgacatgttagagccattagtgtatacccctgattcttcattgcagtctgagttgctcagctttattttggatcatgtcttcattgaacaggatgatgataataatagtgcaggtaattttattgccatctttttattaaatctgtgtccaccataaaatcaaacttaagtaacaatgatgtacatcggtgcactaaaatatattttatccttaaaaacgtgaaacacaggtatatattccagcacaatttatgttcatttttttgtactattgtaaagaaaacgtgatgttgcagagtataggctttcaagtcagatcgctgcttctcactagcactgagtctgctttctaatttctaactacctcataaaactgttaaaaattgagtcaaatgactagtacagtgcctggacatatagcaggtactcaataaaatttattccctcttgcccttattcattggtaataccaatatgcagataatttggaaagaataaagtatttatgtgactttttgttgtgtacttgtataccgtaggttttttttgttttttaatttggggagtattaatttgatttctgaatgttagaaaaatgtttgaaactgctctgtaaaagtctggggcagtatataatgtttacaggaaaagaatcaaaccagcctttcctagtgttaagttactcttcacaccctaattgtttacacaccctaattgccttactttagcatgaggttatggaaaagaagtgatatttggcggcatctttctgggtttgtttttagtttgaaggtatattttttgtttatttttattttttagaaacagagtctcactctgttgcccagcctggagtacagtagcatgatattagctcactgcaccctcaaactctgaccaaagcagtcctccccctttagcctcctgagtagctaggactacaggtggtgtgccaccgtgcttggctaattttttgtagacatggggtcttgatatgttgcccaggctggtcttgaattcctggtctcaagtgatcttcttgcctcggcctcccaaactgtgaagttaaaacttaaaggaaaatacaacatcaacatgtatatatccatactgatgtatcactgcatatcagggtgtaagtatatatgtaattctgtatatggcatgtagcttacttttagcaatagagagctttgtgctcatgtactaaaaacttaacctcaacacaaatgagaaacccagagtagccaaaacagttgtcagaatccatgtagtgaagtttatatactttgagtttttcatctgtcactctaagctattggcttagttatgcttttgttcataacattgatttgacaaacatttattggtcagcaggcagtttactagatggtatggatatgaaaagatgagacaaggtctcatccttcaagaattaaattcaggatgaaaagaaccaagtaattatagtgttgttgttgttgtttgtttgtttgtttgtttgttttgagatggagtctcactctgctatccagggtggagtgcagtggcacaatcttggctcactgcaacctctgcctcccgggttcaaatggttttcctgccttagcctcctgagtagctgggattataggtgcccaccaccacgcccagctaatttttcttttttttttctttctttctttctttctttcttttttttttttttttttttagtagagacggggtttcaccatgttggccaggctggtcttgaactcttgacctcaggtcatctgcctgcctgggcctcccaaagtactgggattacaggcatgagccactgcgcccggcctatagtgcaatttttgataagtaatggaggcatgtacaaagtgttgtgggcatgtagagtaagttctcactgatctgcaggtattgaaacatcttttgagaagctaacaactgaagttaatccaaaaaatgaataggactttataaaacgtctttttttaaaacttctaaaacgtctatgagaaagtacagttggattctaaaacctgatacaaaataagttttagtacataaccgttttgttaatttggggctgccttagcttcatttagtccatggggagttgaattagagtaagcttgccaaaactcttgatttatctaggagcttcctagaattacccacacttcttatctccttagacttgtgtgtgtgtatgtgtgtgtttgtgtgtgacagggtctcactgtgtcacccaggctggagtgaagtggtgtggacttcatatagctcattgcagcctaaatctcccaggtacaaatgattctcccacctcagtctctggagtagctgggactcaagcgtgtgccactctgcctggctaatttatttaatttttagtagagacgaggtctcgctgtgtagcccagcgtggtttcaaactcctgggctcaagcagtcctctcatcttggcttctcaaggtgctgggattacagatgtgagccactacacctggcactattttcacttttaaaatgaagtgcattctagtccaatggaagagtataaaatataacagatttttacataaccattccatcagtctttgtcaaatttagctgtgtttgttttaggttttttaaagaaataaaagcacagttacaaaagaagccctcatttgtattcctcccttatcccattatcctcccattttccctagagataactgctaccccaaatttgttgtttatcacacctttgcatttcaattttattttactaagaatttgtatctgttaataatacatagttcatttattcttgctaacttccatgtaaatgatattaggttgaacattttgcaatttaccttttttcttctttttaaaatatgaaatgagatcttgctatattgctcaggctggcctcaacctcctgggctcaaacagtactcttgcctcagcctcctcagtatccgggattataggcacatgccactgcacccagtgcagttttcctttttgaatttacattcttgagatttttttcagtgttgacatgtggctacaattcatttattctaactgctgaatattatatgatacaagttaactacagtttatccattttcttatttttagacatttaggttatttctactttttcctcaattaaaatagcgttacaacaaatatttcaatgcttagctccttgagcacatatacatttgcttttctagtgtatacctgagtggaattgctagattatgtagtgtgtgtgcatcttaaacttgatcatattttgctaaagtggttgtattgttttaccctccttccagcagcatatgatagtttccattgttactcatcctcacctaacatctagtattgtagacccttggatattgtatttgttagcctacatcagattagaaagggagagtaaaatagggaatgctcctagaggcatttcattgacaatacataataataatggcagctgacacttatgaaaggcccagtgtgttaggtacttctctacattccttaacatccacaagagaaaaagttggctaattcttgacaagccattagtggagaaaaataaaaatcaggacttaaaaactctgaatatcataggatagtttagtctttagagggaaaatgtctgtatgcgattggaaacaatgtcatgtagaaattgtccattatagtgacagagctattaagaaaatgttactttatgtattcagtgtaatgatatgtcttaggtttctaagcaaatagtgttgcatcttgggacatacatttgagataaaactttctctgatggtctatcttaaattcttactctttaaatttggttttagtttactagaagttatcaaagattaccagagacaggatgaaaaattaattaaatgaaggaacattcttactatacataaaatagtttttgatattgggaaccttatattggagcttataggatatgcgcagactgttcaccagaggaattataaatggctaataaacataaacaattttaatttcatttaacaagggatagtggtttgtttgtttgtttagatggagtttcactcttgttgcccagtctggagtgcagtggcgtgatcttggctcactgcaacctccacctcccgggttcaagcaattctcctgcctcagcctcccaactaggtgggagtataggcgcgtgctaccacacccagctgatttttgtatttttagtagagatggggtttcaccatgttggccaagctggtctcaaactcctgacctcagatgatccgcctgctttggcctcccaaagtgctgggattataggtgtgagccaccacacccggcctgggatagtggtttttgttttgtttttttacaagtaatttcatttgtaaaatctgtccagagggaaaaatttttgtatgcagcttttttttttaatataaaaagcttcatctagttttatttacagtatccaataagtaaaacaattattttgcattacttggaggctgcagtggggcttccctgactgcgaatttggaaataagtttgtcttcttgagaattgaatgtcaagatttcacataatggatcagagtagaaatatgcaagattattttaaaaagacagaatggtttctggggcctgtctagctgaatatatgtacaaaggaggactgttatagccagattttggggtttgaggtaaggtgggatcatccttggaagggataggagaaattctgaggttggcagtgttcaggaacgtaggagccttaactaacagactttgagtgtgcagattttgttgacaaactatcctgctagggaagtagacaaatgttaggcaagtttagcctgacttcagtaggtgaacatggaatacgaacaaatggagtgattcagttccatttgttctgatcatcatttgatgtcacaaaaatttagtctattggaataaattatgaatggttataattttaattttaatgtttttcccttttcaaattctcttataaaagcatgtttcatagtgagaattaaaaaaaatacatggttgaaataaaatacaagatgcttaatgtttgggactttttctccagatggtcagcaagaggatgaagccagtaaaattgaagctctgcacaagagaagaaatttacttgcagcattttgtaagctaattgtatatactgtggtggagatgaatacagctgcagatatcttcaaacagtatatgaaggtaaagttgaaaaatggatagcaagatagttttaaaatgcaacgctagtttttatgcatggctgccattgaattctttaagggcaaattacatttctagtgtaaaagagttgtattttaaaatatttagtgttttcaatacatttccttatacctctactccagttaatggacattttgggtttattgtgttcgtttgcatttagaatattggagatggcccctctcaatttgtcactatcagaaatagcatgtatgattcagtttaagataataggatggcattcctcctctgcttgatgtagcattaaaaagagtttcaggagtcagaagacttgggtggtagttttggcttggttactatgcatcttgcgaccttgaataactccaagcattttgtgacctgagttcctttatctgttccactgtgattgttaaggttttcccctttggttctcaaagtctgatttgattaaccataggttattcataattttcataactatatgtgaggttttgttaagttgaaagtagtgataaacaggatattgttgattatactaacagaatgtgactaaatgtggtaagatagcttaaaaatccttcctcaactaaaatctaattataaatgtaaactttttaaagcctttgctttcaagaaataaaatatgtaatatatttaaacctagttaatcctctctggaatattttgctacttgaactctaatatcattgaaaattattttggaacttaaatcatttgggatgataattaccaggtttttttttttttaaactaaggttgtttatgaagttatttaacaaattttaaagttttagtcttaggtattctaaagtcacttactagtcatagggacgtggttattctgttatctctgataattgttattgtacgtgtttgaaacacaatcttaaattaggaaaaaatttcatgtgcaatgtgtaatgtaaatgtcatataaacaacttttaaaagttgtttatatgctttccttttaaaagttgtttataggctgttagattctataagccaaattaataaagttttaaactgctcgtggcctgtatacccggtatcaatgaattagttataagtgtaactgagattatatttattgttttacaaagagaattttgtttgtacattttgtgttacttctgaaaatctgcataacctaattgttgttttgactaaaactgaccagtataccgtctttattttaaccaagtctggagcttaatttgattagatcttaactgttttgtatatatgattttactgaagttagggattgtatgcttagaaatgatctttaggtttcagtaacattctttcctgcctttgaaggcataattttggctaaatacatactttgtgacgtgtttacatgactaacctaaaatttgtcttattgtcaagtagttttaagagataaagctctaatttgtacaaatttctttatagtattataatgactatggagatatcatcaaagaaacaatgagtaaaacaaggcagatagacaaaattcagtgtgctaagacccttattctcagtctgcaacaggtaagcattaagagtaccaactttagctaacacaattaacacctaatagttagcaaaataaggtagcagttgaaattgggcaaagtgtgcaataggcaatttataaaagtagaaatacaagaaagtataagtgagattatttttttgctttcaaactgtcaagattggcaaaacctatagctatctaaggtatggaggaaatatagatatggtaggcaatttggcaatttatgtaaaaatttataatgtgtatgccatttgaggcagcaattctactttttaaatctactcttttatccaaggtgataagacaagtttgcaaaagttgatatacaaagttgtatattgcaatgttgtttataggaagtaagacataatctaaaagtctattaggatattagataaatttactgtatagtacatttctgcgatgaccgttgtacaacacttaaaattagtgtagatctatattcattaatgtataaagagcttcataatcacaaaatatattaacagtggttaacttgttttggtagatttcatgttgaattctacttttttctctgtatatttccaaacttatttttgtgagcatatattaattttataactaaaacacaatagttttggccaggcacagtggctcattcctgtaatcccagtgctttgggaggctgaggtgggtggatcacctgagatcaggaattcgagaccagcctggccaacatggtgaaaccccgtctctactaaaaatacaaaaattagctgggcatgatgatgtgagcctataatcccagccacttgggaggctgaggcacgagaattgcttgaacctcgtaggtggaggttgcaatgagccaagatcatgccactgcactccagcctgggcgacagagtgagactctgtctcaaaacaaacaaacaaaaaaaccaatagttttcattttggcagtgttgaggcatttaattagataaaattactgacttagtatacttttgtctttggagacaaaatttgcatgcaaaacccaacccaacccattccaacttaatgaactttcttttaggaatgtccttttttttttttccttttcttttgagacggagtctcgccctgtcgcccaggctggagtgcagtggcgtgatcttggctcactgcaggctccacctcccaggttcacgccattctcctgcctcagcctcccaagtagctgggactacaggcacccgccaccacacccggctaatttttttgtatttttagtagagacggggtttcaccgtgttagctaggatggtctcaatctcctgacctcgtgatccacctgcctcggcctcccaaagtgctgggattacaggcgtgagccaccgtacccagccaggaatgttcttaattttatttgagaatttgaattttctctattaaaattaataaaatgtaggctgggtgtagtggctgatgcctgtaatcccagcactttgggaggccaaggttgagaattgcttgagcccaggagttggaggccagcctgggcaacatagcaagagcccatctctacagaaaatgaagaaagaaaaataaataaaatttaaaaggttgaaaagatggcatttaaaaaataacttttgctataaagtaatagctgctagctgtactgtttagaaaatataaaaaggaacaaatgcaaattatccttaatgttttcacttcacaataacctttttgttttttgatggccttgttactcttttttatgcgtacatgaaatctgattttttaacaaaattaaattgtgcattccattttgtaaggctgcattttaatattaataaacactgaacacatttatgccattaaataatttcctcagcatcttttttttttttggagcaggagaggttcatttatttttttttctagatttttgtgaaggtataattgaaaagtaagaattctgtgtacttaacggtatacagcatgatgttttgataggtatgcattgtgaaatgattaaatttagctaattaacataaacattacatcacatacttacttgtggtaagaacatttaagaccaactgttctagcagtttttagataaacagtacagtacattactcttaactatggtcaccatgctgtacaatagatcttcagaacttacttatcctgtcctactgaaacgttgttccctttgaccaaagtctcagcctcccccaacccccagtccctggcaaccaccattctgttctctgcttctatgagtgcagatatttcctcaacatgtggatttcattttctctgggtgtatacccagaagtcttcctccttttaaaaagttgacacacgaccgggcgcggtggctcacatctgtaatccaagcactttgggagactgaggcgggcagatcacgaggtcaggagttcgaaagcagcctggccaatatggtgaaaccccatctctactacaaatacaaaaattagctgggcttggtggcacacacctttaatcgcagctactcgggaggctgaggcaggagaatggcgtgaacccgggaggtggaggttgcagtgagccaagatcatgccactgcactccagcctgggtgatagaacgagactctgtctccaaaaaaaaaaagttgacacataattgtacatatttatggggtgtacatagtgatgttttgacacagtgtatagttaaccaaagcaggatgattagcatatccattttgacgactatataatattccattttatagatagaccacaatttaaccaaagtctccttgtttacgctgaggtttttttacaagttttgttattacaaatagcactaaaacttttttgtacatattattgtgcataaatattatttcttttggttcaagtcctataattagaattgctttgtcaaagaagattaaaattcttaagcttttgctatttcatgttaagagttcttgatgtaaagattcaccacttaaacgtaaataacagagcatggttgcctaataatttgctggggttttttttcccctttatatttttatatgctatgttaatatccaattaataccagcaggatagcattctgccaaaactaacctgaagggtttctaatgttaataaaaacctccagtttaaatatacgaagtactgcacttttggtcatttgcatcatgttttagtgttttgcaataaaatacagtgcctcatttattgaacacctgtattttaaatgaaaatgtaatattttaaaagatgttaatctccaggtattaagaactttaacatgctttctttctttccaaacagctttttaatgaaatgatacaagaaaatggctataattttgatagatcatcctctacatttagtggcataaaagaacttgctcgacgttttgctttaacttttggacttgatcagttgaaaacaagagaagccattgccatgctacacaagtaatctccagatattttattcagctctcatattttttagtcatgaaactttatttttaaatctagccctttcatttggaataactaaattaaatttatgctttattattagcttataaatctctaccctatctcctttcttaattttaaagaaccagttacagtgctatctcaattaacaaatgagttgggccaggcttggtgctcatgcctgtaatcccagcactttgggaggctgaggcaggaggatcacttgaggccagtagtttgagaacagcctggccaacatggtgaaacccgtctctactaaaaatagaaaaattagctgggagtgggggtgtgcacctctagtcccagcaactcaggtatgagaatggctcgaaccttggaggcagagggtgcagtgagctgagattgcgccactgcactccagcctgggggacagagcgaggctctgtctcaacaacaacaacaataaaatgagttaggattaaaactccgtttataagcctttgtttaaatttaaaccatacaaagtctataaattatgtgaatcaaagcagcataaattcaagcattacacatcttttttatcaacttttgtcatgatctcattgtcagatagagaaatctttgaggtttgattcctttgtctcaagttttttctttggttctgcactcttactttgtagtgaccttttcccatgttttgatccacacccttctttccatctgcatattttgttgcccttatcaaaattggaagtcgttttattttatactgggcatgtaatttagtgatcaattgcacttttaaagtatgggtacattttagacctttaacataaccaacatttgtgtattaaaaccctttatctgttacctgtgggttaaagaaccttgcttttagattctcggactctccttcatcctcttgctcatttagttataaaagtgctaactgtctctctgaggaaaatatgctgctcttgtttaagttttgcttctactccctcaacttaattattattattattttgttttttgtagagacagggtctcaccatgttgcccaggctggtcttgaacccctggcctcaagagatcctcccacttaggccaccaaaagcactaggattataggtgtgaaccaccacacccagcttcctccctcaactttaattaactctctcctttcactttcttctaaaactgaagtttatttttatgcatccattagatggtaattttacataatatttaaggactacctgtatattattttcagaaataatatctttttttcatgtaatatccttttttccttcttgattccatctggattgttttttactcagttacatatttgatagagttataatgttgggttgttattttgatgaatagaggtatttatcgtcacataaatatagttaaaatgggccttagatggggtttaattttactcttgaattgtttattacaaatgtttgtgaattattttttaacgttctatatgttagagtaggtctcctttatgtcttgaaaaatacagataatgtattgatcattatgtgagagaatttacattattttctatggaaaaaagtactgattaaagaatgtagatataccagaccatattcagactgaaagctaagtggcgtgtgtgtgtgtttgtgtgtgtgtgtgtgtattgttttaaagaaagtaacagtgacataaaatgtcagtatatctgcacattctcacactttacaacctgcttattttctattcctcaaattaaaagcttggcaaaggaagtagtgagtgaaatttcctaagttattgacttttttattatagtccctcaaatatttatttcaattattttttgttttcctttgcagagatggcatagaatttgcttttaaagagcctaatccgcaaggggagagccatccacctttaaatttggcatttcttgatattctgagtgaattttcttctaaactacttcgacaagacaaaagaacagtgtatgtatttgctggaaatgtcctatttaatttcattttgggattcttaagggcaatttttatacttggtttctctcctttctactcacacagaattgtaggattgcattaatacacaaaaaagtttatacttcagcaactttataatttaaggattataactgtgttttatgcataatactctattttaatattgtgagttttcctccagtataattttggcttttgacacgtaatttgaatactttatgtattatttaagagactggactcactatgttgcccagactggctttgaactcctgggctccagtgattttcctgccttaatctgagtagctgggactgtaggcaggaaccactgcctggctgctttttgtgttattatctgcatttgtgccttaacccaactaaggagggagcatttgaaaaagaataataaaggcaatccatcaggaacatcctttaattctcaaacagggcacttttctggtttagtctccaataatagtgacttataaaagagcccccaaaatggatttaaattctcaaaaatcttctacctttcgccatggctttgaggtgtaaaagggcagaagcgtatggatacctcatattgtaaataatcttgtctgaaaactcactagtattttgcatttaaagactatagattttatatgaaattctaaagcaggcaaaactaatgtatggtgataaaaattacagtaacggttacttctagtgttggagagtttgaatgggaacactagggtactagagttctgtatctttttttttttttgaaatgaagttaggtctgtccttcaggcaccatctcggcccactgcaaactctgcctcctgggttcaagtgattctcctgcctcagcctcctgcgtaggtgggattacaggcgtgcaccaccatgcccggctaattttgtatttttagtagagacagggtttcaccatgttggccaggctagtctcaaactcgtgacctcaggtgatctgtccaccttggcctcgcaaagtgctgggattacagacgtgaaccactgtgccctgccaagttctgtatcttgttaggtatgtgggtcacacaggtctatgttcagttataaaactgatacaactgtgctcttagttttgtgtgttctattgtatataaatttatcccagttaaaattgcataagcagtattaatcagagaaataaaaattaaaacaaataccatttctcacctagcacattaggaaaaattaagaagtctgatagtgtcaagtattgccaaggatgtgaggcagcagagccttttatacattgttggtgacagtacaagaccattttgtggagctctttggcaatgcctagtaaagtttaagattctctctacctcatgatccagtaatttcattcataagtagataccccacagaaactcctgaatacatgcacaaggagaccgataaaagaatgatggctgtttgattgtttgaaatagtggaaaaactcaaaataacctaaacatccatcaactgaaaatggatcaatagattgatatataatggaataccatacaacagtaaaaatagctggatttcattgagtacaaacagcaaagtacaaaactgtactatgatgtttacagacaactatgtattgaatgtacaaaatgtgcatgggggtgataagtagtggtaacctctgggcacgaggaggaagcaaaatggggatagctttagtgcgggctacttatctgtaatgtcctatttaggtatgtggtgggtacataattgtaaatctctctgccagtgagtatattttggctcaagttttgtatcttgttgcagacttaacagtttttggagtggtagccagttcacaggccacacttggaggagtactgtactactatatatgactgaagtgtattgtaatacagaaagacatactgggagtcgggtgccgcggctcacacctgtaatcccagcattttgggaggtcaaggcgggcagagagttcgagagcaatctggccaacatggtgaaaccctgtctctacaaaagatgcaaaaattagccaggcatggcagtgtgcacctgtaatcccagctactcaggaggccgaggcaggagaatcgcttgaacctgggagacggagttgcagtgagccgagatggcaccactgcactacagcctcgatgacagagtgagactgtgtctcaaaaaaaaaaaaaaaaaaaaaaagagaaaggcacactgaacagctaacaaagcagtatgctttgtgactgatttctcctattctctttaatgctgttcacactggtgaatctgaattgatagaaatcagtcattacaatgacagcaaatatttgaattgcactttacagttaattgacaaatagttgtctttatttgaagcataatttagccttatagaactcttggtgtcagagccttggacttgaatcatagttatgctgcctactcatttttattactgtgggattacttcttaatttcaattatcctttctttcgtcacctgtaaaattgggaaaacatttccctcatagaattgtaagaatagttaaggaacctgaggaaaaaaaaaatatctagcacatagtcgtcacatgaacgttagttgaattttgattgcaaaattacatataagccttgagatacttggatccaagggtagatttatgatttccatcaggctgaaacttttttgcaggtaggtatcatatcatatccatctttgtatctatccatagtgcctgggacataataggtactcagcaaatgttaaactgagtgctctgaattatttcatttgatgtgaaaatcttggcagagacaacattgttcattaatgtcctgtaaggctgagtttgagtagtgaagtaatatgcctatgctcgcacaactatgagttaatataacccacagatttctgtatcaaagctaacagtttcgatttcttttcaaggtatgtttacttggaaaagttcatgacctttcagatgtcactccgaagagaggatgtgtggcttccactgatgtcttaccgaaattctttgctagctggtggtgatgatgacaccatgtcagtcattagtggaatcagcagccgggggtcaacagtacggagtaaaaaatcaaaaccatctacaggaaaacggaaagtggttgagggcatgcagctttcactcagtaaggatataatttattctctttatatttatccctaatgtttaccaactgaattgtcattaaggttcaccttattttttatttgagatgtgttcaataatagcttacaaaatgtgttcattatgtgtaaacatgctgttgtaggcattttagatacataaactcagttctcacaactttttgggtacatcttcatttttcagatgacagtacttaacacagagaggttaagtaacatactcatgtcacagttattaagtaggagagccatgcagtttcactgtagagtgcctgctttttaaaatctgtgctacactgtatgcatagggaaatggactcagtattatagagctagttattacccaagagatcagatcatctagttaaagtggaacaacagattcagagaggttgcaacttctgaattcctatgaagaggccattaatcatgaagaacttcatagaaatagagtgctatcgtattagaggtaggaatgcattatgacgcttgaagctcttagactcctagcactccagagttggttcaaaatgggcctggggacttttttctttttcttaggaattattaaattagcatagttgtcaaaatttgtcccagttattattgttgaatagcaaattacctcaaaacttaggacatagccaggatcatggtgtctggtacctcagccaggaaggctcaaaggctggtggctgaaatcatacggaggcatcttcacttacatatctgatgctggctgtcatttgggacctcagctgtactgtctgccagaacaccaacgtgtgacttctccatgtcagcataacactaggctccaagagcaagtgtcccgaaagaccagaagtggaaggtgccaatttcttaaggcctgggcccaaaaactagcatagcgtaatttctgccatattctattggccaagcaatcacagagattctaggggagaggacataattcttaacctcttaatgtgaggaacgtcaaagaattttggggccatatttttaaattgccacataactcatcagctttcatttatgatcaagtgcttagtgtttaaaacttgattgtcctatgaattttagtatcttttgtccagtagtataaaggcataaccttatatttctaacttgtacaattttacactggttagttatatagtcccaacatcacagttgatggggaaatctcttttattaccctgggccagttaaagtagttagggctgatggtttataagttaaaagaaacttttctgttttttaaaaacaaaatgttatcaaattgaaagatgatgttttctcatatcactaaatttttgaaagtttttatcatctgaactagtagttaatagttataggtgtgtgctgggccatcaaatctctctctctctttttttttagacctcatggaaacacatgaatgggtatttatattacagaaatctctcttttttttttagacctcatggaaacacatatgaattggtatttatatcacattttacaaatagattattaaaccagatacgtcaatttttacaggaagaatcaatgctctcattcaggtttttggggagaatcatagaaattggggcattaataagttaacagaaggaagtatgaatactgataggttggccaagtcaatgcaattttgaagacagtattggagcctgaatgcagtagaacttaaaggctgatgtaattatattgcaaaatgtggagtttatgtttaatctattattagagtattagctattcatgcattttctttccactcttattccttaaaaccttacacacatttgcaaatatgtataatcttttttttttttttttttgatggagttttgctctttttgcccaggctggagtgcaatggtgtgatgttggctcaccgcaacctccccctcccttgttcaagcgattctcctgcctcagcctcccaagtagctgggattacaggcatgcgccaccacacctggctaattttgtatttttagtagagacagggtttctccatgttggtcaggctggtctcgaactcccaacctcaggtgatctgcccacctcggcctcccaaagtgctgggattacaggtgtgagccactgcgcctggcctttttttttttttttcttttgagatggagtcttgctctgttgctgaggctggagtgcagtggtgtgatctgagctcactgcaacctccacctcccaggttgaagcaattctcttgcctcagcctcccaagtagctgggattacaagcgcccgccaccgcacctggctaatttttgtatttttagtaaagatgggatttcaccatctttgccaggctcgaactcctgacctcgtgatccgcctgtctcagcctcccaaagtgctgggattataggcgtgagccactacgcctggcctcatatgtataatcttctaatgaaatagttttcttctaaattcacaatcaaaaagtgctatcaatttttttctcccaggtcagtgattttaaaaattactattaattcagtaacaattgtacacaaatttgacttattaattatggcaacatttacagacatttgaaaaaagtagcttttgcaggtgtgaaaccttttttctttttagtccaatgcttaattaatatttgtatagatttgtggcccccttgcagttgcctcttactacctgctcagtggtctgcatcccataggttgggaaccagtctcctattgcttccatccctgttgccatttctcactcacctaggccacacaattagccttttaactggtctgtttgctcaccggtattctgtttttaagttcactccccacactgccaccacattgactaaaacatgtaactcaccaaattgcttccctaccttaaaaccttcagcagcagttccctgttaccttagaagagctcacaagattttccacagtttgattcctgcttctttatccagccttgtcttttgctaccctttcaatctttatgccccaggagtagcaaactgttagttttgaaccatatgaaattgccctttttgtaggtcaaatatcagcagattaatagggttcagtcgactgggtgcgatgtctcacacttgtaatcccagcactataggaggccaaggcaggcagatcatttgaggccaggaattcaagaccagcctagccaacgtgctgaaaccctgtctctactaaaaatataaaaattagccagacatggtaatgcattcctgtaatctaagctacttgggaggctgaggcaggagaattgattgaacccaggaggtggaggttgcagtgagctgagattgcgccactatactccagcctgggtgacagagcgagactctgtctcaaaaaaaaaaaaaaaaaaaaaaaaaaggtttagtccttgtttcctgccttagtgttcttgctttatgttcttctccctgcctagaataaaaagcctttctagcccacctgatacctactctagttagaagttgcttctggatagctggctctgacccctttcactgcccccattccccttatacttccctctctccttgcatttaccacactgtattttaattgcctggttgttttgtgtcgcaactagactctaaggccaggtcagggactgccccttacataggtttgtgtcccccgttcctgtgacttgcatgtggaaatcaacagatgtttattgacctgaacaggttgtattagacatctgaatagtcaaaattagtgactaaacctcgtcgttaattttcttttccagctgaagaaagtagtagtagtgacagtatgtggttaagcagagaacaaacactgcacacccctgttatgatgcagacaccacaactcacctccactattatgagagagcccaaaagattacggcctgaggatagcttcatgagtgtttatccaatgcagactgaacatcatcaaacacctcttgattataagtaagtacatttgatcattttctgtactataactttattaattacatagaaaaagttaagttaaaagaggaataaaattctccttgaagcacgcaggtaacatggatgttagctcaaagacaacaagaggaagcaaggcaacagcaggagagagcagcaatgagctatgttaaactgcgaactaatcttcagcatgccatgtaagtgagagtgccttattgtctgagtctaggaagttcactaattcattttaacattttaatgtgtgccttatctaaaaatttcagcaaactctctagagtaacctaagctgaaataatcaaggaactaaaaattggtctttccaacagaaaagcaaaatattttaattaaaatactacctagttagccaaaggaccaatcttaggttgatctgttggaaaagtttaaatatcaatccttgtttattttggtacacagcattaaaaatacagttgtgttacatcctaattgattttcccaacttagttcaggccctcatctctcacctgaactattgtattagctttctaactggttttcttccctcaaatctcccatttattttctcaccaaacctctcccttcaccccccgctccatcattcacaccaccatcaagaattactattctagaataaaaatcttaccatgtaactcttacttaaaacctttctgtggctccccattgcctgctggataaactcccaacttccttagctcatggcatgcaagatgtttcaaaatatggcccctgccacgttttagtatcatttcctattccctggcagctggtaaaatcatcataaaagaacaagctcaggtgtcactttaactgaagctttggtcatctatgctcccataacactatgtatatccatatttcttatagcacttgccacattgtattgtaaatatttgtttatgagtttgtcccgtttgtctagactgtgagctcctcaagggcagggaccacattcattgcctatcagtgcttggcacgtaaaaggtgctaagtaaatgttcattgaatgaataaatgttcaatgctaaaaaaatgaagtttatcttttaaatactttgtttttactggattatgtatgataactttataaatctttctaaaatcttcattagctttggctctaaaaaacatggcagacaagcagtctttagataatttttttaaatgtcttgattggtatacagggaaaagtgtgatgattatgattaagtttttgagtttgaaagcattgtatttataatgtggtatatgttttactattgggagatagtagttgttaccctcttctttttttaatttatattttgttctgtcttgttggtttttagatgttaagaattttacctgtttttcttacaaaatgatcatttactatgagtggtggcctgcataaattcactttagttatctccatagtggtcttaacctctagagacacaaggtatactctattacacgtatagattctgatcctggttaatatggtcatcatctatattgtcacatagttctatccccttttgtctgtttctgtgaccacattccttttaatataagttcttattttatgctggatcctacaactgatttcttggcttccaagtagtcgccggtccatatattccagaattctgccatgcaatcatttggtctatatctctccccataaaacattacaccagttcctaagatcctatatagcatgtcactacttagtaccattttaattcccaattatagttaactcccccgcctcccggcaactacaagaaattatctcagttaaatgactattaccaaaggattctttggtggttgtaccataagtcatctattgcatgggactctaaagcattttcatcttacaatgatttttctataatggtatctgccctataactaaaaatacttccaaattttcttttttatttttcatagcttgtatcacatatatcttccttgtacttcaaacaaaatgcagaacggctttctgattttctgtcacatagttcatacagcacatatattcccttcacggttgcctctacaaaatatagtaaaattgtctttctacccagaactgttaggaagtaaggaccattataaacatatttgtccaggtaacatggatcagagatcgtatcttgttatctttatatcttttaagaaccagcatagtattgtgtaaattgtaagcattcggtaaataattgctggggttttggcaactttcttgactgtgggggtgtctttggatgagaaaagaaggtaatgttggccaaactagggaaaaacaagtcctactcagtttcactattatgttggctactttatgctgatctgggctaatttgtgaacttaatttattccccataattatgtaataacatatataacttttggtcttagtttttcattttaaatttctaaatatgtcttagttttgagtttcatagggcacacgaatctgaagtttcagcatgagtgttcctcatttcttcctgaggcagaattaattccttattttagtatgtccttataacacttgatgcatagttttcttgtaatatttatcacattttgtcataattaattgtttatctctgtttgccatggtagactgtaagctccttgagggcaggaatcatgtcttagtcttattcatcttttttttttttttttttttaacatccataggacacagtagaagcctgtcacgtagtaggcattgtgtgagtgagtgcgcgcatgcctggtacacattaggtactgaatgaatgagggagtgatgatgggtaaaattagcattatatattgatgaaaatatatgttttctgaaaatgtcatttttttggtctctgttttatgtttgtttattaatttgtaccctgcctactttcaaaaaggatttgaggtatcttgtatgttcccatgtgggaaattctcattgaaccttgtatatgggatatcagaactataaagctaaatgtactgaagtaatgtagaataaacataactccttagcatttttagacaagtaaacattgggttttgatatcattgatgacataatcaatgcctaatcattctccctgacctttaattccatcattttccattatacttgaatatagagagccacatactgctgcctagatattaatagtcacgacattagttcagatcttgactttgttttatatttctctagtcggcgtggcacaagcctaatggaagatgatgaagagccaattgtggaagatgttatgatgtcctcagaagggaggattgaggatcttaatgagggaatggattttgacaccatggatatagatttggtaagaaacttaatgatttctgtaagattttcagtttagatcttttgaaaattatgttggatatttattagagtagagaaatacttaccaagagaagtaagttttgcaaaaatattaaaatagttgccaggggtttagatatatgggaagggatttagaagagagtaaggttggtgaaggtggtagatcctagattaagatgataacaattgtctgtttgtttctgagattaatttaggaatatataggtttaaagggtatattttgattaatactaatttgactatgaaaatcaatttttatttaattatgcattttaaaaaatatgagttagtataaaagtataccattatcaaaacaatatattaatactacttgttgagacaaattccgtatcagataatgaagtaaaattacttaaacttggaaggaaattaaatacaggtaggagtgtattctttattaataattaaatatgtggttagggttgatcatatacaaaatggttttacatatttcatcttgctacatatctcattaaactttgtgaagtaggttgaaaggattgaggatattgaagcttactctctccaaagaggcaaaactagcaaacagtaaagttgatacttataagtccagtcttatgattctttttagtatattgtgtattcttcttaaataattaaatttttagaatggtataatttggtgcctcgaaaggaatatgatttttaaagtaaaatgaaaagtgagttttccggtttttgtctcttaggataattttccatgagttttttttttgagatggagtcttgctctgttgcccagacttcagtgcagtggcacaatctcagctcactgcaagctccacctcctgggttcacgccattctcctccctcagcctcccgagtagctgggactgcaggcgcccgcaaccacgcccggataattttttgtatttttagtagaggccgggtttcaccgtgttagccaggatggtctcgatctcctgacctcgtgatccacccgcctcggcctcccaaagtgctgggattacaggcgtgagccaccgcacccggctgataattttccatgagtttttaaaatattgtgtcaggtacacttggaatcacatagaccatgtgaagaacttggatattttcagttactatctggtttgtagatatagctaaactaatgtcaacttatttccttttttcctttagccaccatcaaagaacagacgagagagaacagaactgaagcctgatttctttgatccagcttcaattatggatgaatcagtaggtttaatttaaatgtaccctaggattgcaaaatcagaagtataggcagtctctcagtttgaggttgaagacctggggcagcatactgagaatagatgaaaacagctggatgtgagaaaaagaggcaggcaggcaggatttcagtgggaggggaagagagtgctgcaatagtgttgacagattagaaaagtacttttgaatcctggctgactgggacttgaatattaaggaatttggactgttcttccaggtttgtactgttcttcaatgggttgcccattgaaagattttaaataaggtaatggcatgatcagaattgtgtttcagaaagatttccttgacatttatggatgggacaggatgaatgaggggcgtcatataaaggcatggtgaaaaataatgagaacttgaacaaaggctttgataatgaagagaagggtatctagctatctaggatgagagtcagttaccactcccaccatccttaattggttattattgggttttgtcagttatttttcttaagtacctcttatatcagtcccctgtgccatattctccttgacagtgccttgattcgggtcctcctcagttttcacatgggctgttgcaaagcctttaagctgatattgcagtcccgctgctcctttatgcctcttgtggggtcatctttctaaaaatgcagatctgatattctcacttatcgttctaagtcttttattgatttttttcccccccattgccattaggaagaaaattctagctcctcagcctagcaaacaaagccttttatgatctggttcccttgccatcttaaccttggccttttccttacatgtattctatgctctagccatatcaaatcttgtagttccactcagatacactatgctctttcctgactccataactttgtataagcttttttctgccagaaattcccctttatttttcctcctagtaaagtctttctttgatactaattctgacattacctgtggaatttttgctgacttccacagatttttttttctctccttctttaactgtttgtacacactttattgtaataattaccagacttgtgtagtgagataggatattacatgccctggtccttcactagactgaactccctgaggcagtgatgatgttattcattcttagttctgcccagcacaatagatatttagttttgtcaaatgaataaatcatttaaatgccctgccatctccctttttagaatctacccattttatgttccttgttcctcacacctactgcctcaggtgacggttataccatcctcaaaggcctgccttctatgtacaatttctaccattcccaccttgccctctcctacctcataatctgctttcagatagcttttagaactattttgacaaactaattcacactaacatgtttactaataaggccaaggggccgggctcagtggctcatgcctgtaatcccaatactttggaaggccaaggtgggaggattgtttgagcccaagagcttgagaccagcttgggcaacacagtgagaccccatctttacaaaaactaaaaaaattagctgggcatgaagatgcatacctgcggtcccagctactcaggagggcgaggtgggaggattgcttgagcccaggaggttgaggctgcagtgagctgtgttcacaatactgcactccagcctgggtgacagagccgagaccctgtctcaaaaaaaaaaaaaaaaaaaaaaaaagtagaatctgcttcaattggtcttaagtgtggcctgagattctgcactgctaacaaatgctgtcagtgcttcaggtctgcaaaccatactttgagtagcaagactttatagtacctaatgacctgttgcactcataagtctatagtttaactgcacactgaagtttatggttttcttgataattaatctaacagtatgtatcatcttagtttgttaaataaaacatggaggtagtgattgtgatgaggggtaaaggaatattttcaagcaggtgcgatgaaatgcatttattcaacaatttattacatcagaagttggtgctaaagcgaataagacactccctgtccttaaggaattcatattctagtgcaccttgactatcactttgaaatgaaaagtatggaaggtagtagctgagagtttgggtgacagacactgtgctaggtatgatttattttgatcctctcagcaaccgtgtgagaaaggtaatgggaatttccactttcataccatagcaagctgagactgaagagatcatttagtgactttgctcagttatacagttagcaagtgtccgagtagtaatttgatgccagttccttttgatttaataatctcatgctgtcttctactgttgtgcttcccaaaactaaaatccccatttggatgagaacaccaacaaaagtaattaagaaatcgaaatggttaactgtgatcaaaattaatatgggcagttaggatcaccattttttaatgtatttgtctaatgtcaggagaacttttaacattcgttttcttagttacatactagatttgcaaaaaggtgttcttcagattactaaaataatgaaacagcaatattaactatgtgtatctatttttgacatttaacatttagagaaaaataggggcctaatagtcattttttatttatagtgattttatagcattctcatgtatattgaatgttacaactgaggggcttttatttattcttaatttgataatagtttagctgcttctgctacaaaaattaggaaaattagcacatgtacttataactgtagttttatagcattaccacatgatggcagcagtcacataactgaatgctcagtaatctttaaaggcttaggtgtctttagaagtctttgaccatgtaattttttttttaaagttaacagtttattttttaaatatacactaaactatactccatactgtcttaaccataacttaagaaatggaataatggaaaattttgaatgtcaaattctgtttgcctttatacaataccccacatctgttcttactgaagcccataataccggagtcatctaaacagtagcaaaattgggatttaaattctttaatgtccagttctgagattctccaattctaagggaagtaactcaaagcaccctaatgtagacacttcagtttgttactaaataaattgtaaaaatatctttttaaacacttaatttttaaacatgattttctaaataaatcataaaaaatatctttttaaacacttaatttttaaacaagattttctaaataaatcgtaaaaatatctttttaaacatgattttcacattatccaggagtggtaatataaaaactctgaacatattttgtgttgcatatacataaaattctagatttatggtgtagctggttttatatttggacacaaaattggtttataccattttgataacagttgttttctgccagaattgccaaaatacactgaagtttgatattaaatatgtttaagtatttattaatgttaacatcagaaacaggcagagtttgtgttggcacagaaaagaaagtgtcactactctcattctcttgtgttgagattctcttattagaattatttatagtataaaattggtaaagaagggctccatgtaatggagctaatttaatgttctagtaagagaatctacttataacctagtctgtacaaaacaaaaagaatctcaagtgtttgggtgctttctagtcaggcactctgtttggaaagaacttgagttcgtcttcatcccatactcaatactaaattgctaattaagattttgtactttcattcatcatcagaccttttctaccgagattcatagagtgttatggtaagaattggcctttaaacattatctcggtctttttggtggaaacgttctaaccacccaaactctgacttgaaccaaaaaaggagaaccctgaagcatgcgggaaggggagaggacaagggattagtagtgtggtagttactgtgaatggacaggtaagaaattgggtgcacgagtcctctttgttttcattacttgggattccaaacactacttgataattcattataaagaggctgcaatcagatacttgtttctggatctgcaaatacacagtttcttcagctcaaaacaatacatgagttctatgacttttgttcatagaacttataagagatttaacttacaagtaagagctctttgtaatatttcagctcattacatctggctttgatatcagttcttaatagcttattatagtattctaaaatattacttaatgggcataagtgctagaattttaattgaacaacctaacttttagtatatatactaagagtcacatgccattcttgtttagtgaacaagggagagttgctccattcatcatctgcttttacttttagacaagtaattattagattttacctaacattcctttctcagttggagtatatagaaagcatcaatgtaagtcattttgcccagattttaccttacccttttgatttcttaaaatttgtagttctgttccattcactttggccagattttctaaagaaagcttcttgctttctacatacttgaattgttcttagattttttttggtctgcatactcaaatgcctttttgaaaaaccatatccacttcccagcacaaatagccaagtttgcaagactttcttaacccctttccaaggaacctgtgccagaaatatatgtgaagaagcacattcatttattcatttaacaaatacctatgttgagtgcctatgtttagggtattatctagacattagtggtacatataagcataattaatccaaggttcctactttaattatatgtgaggtaagtagcatcttgattagtcctgatgttatttcattatatatcatggtcaatttaattttagaattatacatctgaagagaggggaagttttcaaagtggttttattagcatgttatttaacataataaagtattaatgtaatatttatggatatatttaaagaaatgaatgacttttaacgagattttctcccctctctctctctcattaggttcttggagtgtcaatgttttaataccagtacacaattaaatctgtggtgaagtcattttctaagtggaagaggaaattttaaagtgtggtagatacagtgaaattctgtacagatttttctctaaggagaatatgacatgcttatgcttaccaagatcaagtgcattgaggggcagttttgtttgcctgaataaacgtaaaggacaagtaaacaatttgatgataagctacagtttttcttagaaagtaaatattttatttatgcgctgttagttggcttttgaatcgattatttcatgcttttttttaaaaaaaaaaaaaaacaaaataacaatctgaagaggcatttggtacagatatgaattctcttacatttatttactggttgtactaaataatgatgacctctgctggatttctgtttacatccagaaaacaatgttaaggatgtatttattcccctaccctgaagaaagtgtaggatagaattgtttttagcattctaaatttaaatgcttaaaacgtcaatcaacaaaactttgttttaaatattgtaattgtggagaaaagtaaacttataagcagaacttttacaattttttcatctaaaagtattttaagatatttttaaaatccaagagcttctctatacttttcagaaatatccagatgcagtgaactgccagaaggtaaccagtctcaaacatgcttatcccattatcaaccctgaaagtttgcttgtcctttaagataaaaatgtaatgttgtgatattccttccagtaatgccactgtattttgtctccaaataaaagaagcttattgtagtatgtttgcagaaaaattctaaacaaaaattatacagcttattagagtgtgggaatagggatctaaattttaaataaaattatatatatatataaattggtgctgattttataattgcgcagtttgtttagttttttcttacttttaaattccaacttaaaattatgaggtttcagaaatatattgaaagtttaacaatgtttaaaaatagaaaagcatgagtgttcatgctttaaaatgatttttaaatttgtattttatattgttttatctatctgtctttgcaagcagtcttcaggttaaagatacttctaacaggttacagtacatttcctctgtatgtaaattagatgggataatagaattcataacccataatattctttgaaagctaagctttaaacttcattttatgtcctttcacaaataaattagtttaaaacagaaagtggctacttgccattttgacatcaactcattttgcgaggcttaggcagctagacatcgtttaaaacaaaatattaacttatattacatgtgtatctatctattgtcagtcgtctctcagttcttgaggtatattattttaatcattccatgccttaatatgcttgcaatacaagaatatcttcagatgggtgaataccaaaaggctttcagtttttagtcagaaatcaagcattgggctgtggtagccaaaaaccataggttagctaaaaagatcatgatacaattattttattaagtcatggttaataacaaatgaatccagacttgtctaacagattttccatcaacaaatattgttatgtgcaaaagtattgcctatgttgttttacacaccactgcattaactagaactgctgagaggactgtatatatgattttaaacctaagttgattttttttctcactcttgaaaggagtacttctttgtgaaagcagttcttacagctttgttttcaaccagctaaaaatgttttatatattactctaacctgttgtcctccacattctattgtcctaattgtactgttttctgatttgtatttatgtcttgagacagtaactttttgaataaaaataaacctacagtatgttgtatgttttctcttgtactcaaagggggagggtggctataaatggtttgcaaatttatatctattatcacatcttttaatgtgtttggggaataatttatagagaataccatcagtttatatttttaataaatcatatgtatttacaatgaaaccaaatccctaattggattattactttaaaataggaacctgtaaccattattgctttaattttcatctggtatgagttaaacacatttacaaatgtttacattgtttatacagggtacatttgagtgcctactgtgtgctagcatgtgttaagagatctctccttcatagatccattggggaaaacaaaataatgaaacttgtaataaatgccaggaaggaaacaagcaggatatgctgaggtagagaatgagagagagacagtaagagagaaacctgccttaaataaggggctcatggcatggaggtaaaaccatttgaaaaagaatttactaattgaattcttattgaaaactcatcaaagaaagtgttaagatttgcattgtactctttaagagattcatgtcagtgtaacactagcacattgttcatttgggctagtttgtatatcagaattgtcttctgtcattagtgattcagaactgaacatataaaatgatagctaaaacagctgcgtgctgttttaagtagtttacatgtaataactcattaagcctcatgacaagagttgataatgctgtcattcccccaccctctgccaccaatttttttttttttttttaacaaatcagaagaaggtgagaatgaggtacaaagaagtttaaataccttagaccaggggtaccagaacgtggcctgttagggactgggccgcacagcaggaggtgagtggcagcctagtgagcaagcattaaccacctgagctttcctactgtcagagcagccgtggcattagattctcataggagcgcgaaccctaaagtgaactgcacgtgcaaaggatctaggttgagcattccttatgagaatgcttgatgatctgaggtgcaacagtttcatcctgagccccccttcccaccctgcccccaaagtctatggaaaaaattatattccatgaaactggccgctggtgccaggaaggttggatactgataccttagacaaggttatatggctagtaaataatggagttggtattccagcccaggcagtctggctgcattaagtcctagaaagcattgaaactatttgatagataagggaaatattcataattgcatacacataaaatggtacattgttcattgtgccatagtgcatctatctacttagagttcagctggttatagagttggtaggtgtaaataaataattgtccttaatatgctacctaaccggctttcataaagaagatgtaagttgaatctgagtcctgagcttatcagtggtttagttaataaagctgagagactggggaagatgagtaggaaaattgaaatgtcttcaatattctgccacaaagggaactttaaggggtcacgtggttgaatacagatcagacagactattctggtggctgtaatgatccagcaaaagaaaatgattcgataaagcaccatgcctttggttatgaggaaactcggtgttgaagtccactaaataaatgtcacttcaggtcaacaaattattgattgatgtgtgcctggcctagtgctagctggtgagaaggcaaagaccaacaagacaggttttgtgcttacagttctgctgggggttaggatgcaggtgccaaaagaataaaatgaagtaagttcagtgtttttactgtgtgttaggggagcacagacgaggggcgcaaacagtggatgtgctcagggagccttcctataaggctgatgctagaattctcccctgcaacatttttatttatttattttttattatacttttaagttttagggtacatgtgcacaatgtgcaggtttgttacatatgtatacatgtgccatgttggcatgctgcacccattaactcgtcatttaacattaggtgtatctcctaatgctatcccaccccacaacaggccccggtgtgtgatgttccctttcctgtgtccacgtgttctcattgttccaattcccacctatgagtgagaacatgcagtgtttggttttttgtccttgcgatagtttgctgagaatgatggtttccagttttattcatgtccctacaaaggacatgaactcatcattttttatggctgcatagtattccatggtgtatatgtgccacattttcttagtccagtctatcattgttggacatttgggttgtttccaagtctttgcgattgtgaatagtgccgcaataaacatacgtgtgcatgtgtctttatagcagcatgatttataatcttttggtatatacccagtaatgggacggctgggtcaaatggtatttctagttctagatccctgaggaatcgccacactgacttccacaatggttgaactagtttacagtcccaccaacggtgtaaaagtgttcctatttctccacatcctctccagcacctgttgtttcctgactttttaatgattgccattctaactggtgtgagatggtatctcattgtggttttgatttgcatttctctggtggccagtgatgagcattttttcatgtgttttttggctgcaaaaatgtcttcttttgagaagtgtctgttcacatccttcgcccactttttgatggggttgtttgtttttttcttgtaaatttgagttctttgtagattctggatattagccctttgtcagatgagtagattgcaaaaattttctcccattttgtaggttgcctgtttactctgatggtagtttcttttgctgtgcagaagctcttgagtttaattagatcccatttgtcaattttggcttttgttgccattgcttttggtgttttagacatgaagtccttgcccatgcctatgtcctgaatagtattgcctaggttttctaatagggtttttatggttttaggtctaagatttaagtctttaatccctctcgaattaatttttgtataaggtataaggaagggatccagtttcagctttctacatatggctagccagttttcccaacaccatttattaaatagggaatcttttccccattgcttatttttgtcaggtttgtcaaagatcagatagttgtagatgtgtggtattatttctgagggctctgttctgttccattggtctatatttctgttttggtaccagtaccatgctgttttggttactgtatccttgtatagtttgaagtcaggtagcgtgatgcctccagctttgttcttttggcttaggattgacttgacaatgctggctcttttttggtcccatatgaactttaaagtagttttttccaattgtgtgaagaaagtcattggtagcttgatggggatggcattgaatctataaattaccttgggcagtgtggccattttcacgatattgattcttcctacccatgagcatggaatgttcttccatttgtttgtatcctcttttatttcattgagcagtggtttgtagttctccttgaagaggtccttcacatcccttgtaagttggattcctaggtattttattctctttgaagcaattgtgaatgggaattcactcatgatttgcctctctgtttgtctgttattggtgtataagaatgcttgtcatttttgtacattgattttgtatcctgagactttgctgaagttgcttatcagcttaaggagattttgggctgagactatggggttatctagatatacaatcatgtcatctgcaaacagggacaatttgacttcctcttttcctaattgaataccctttatttccttctcctgcctaattgccctggccagaacttccaacgctatgtggaataggagtggtgagagagggcatccctgtcttgtgccagttttcaaagggaatgcttccagtttttgcccattcagtatgatattggctgtgggtttgtcatatatggctcttattattttgagatacgtcccatcaatacctactttattgagagtttttagcatgaagagttgttgaattttgccaaaggcctttactgcatctattgagataatcatatggtttttgtctttggttctgtttatatgctggattacatttattgatttgcgtatgttgaaccagacttgcatcccaggggtgaagcccacttgatcatggtggataagctttttgatgtgctgctggattccgtttgccagtattttattgaggatctttgcattgatgttcatcagggatatgggtctaaaattctcttttttggttgtgtctctgccaggctttggtatcaggatgatgctggcctcataaaatgagttagggaggattccctctttttctattgattggaatagtttcagaaggaatggtaccagctcctccttgtacctctggtagaattcagctgtgaatccatctggtcctggactttttttggttggtaagctattaattattgcctcaatttcagagcctgttattggtctattcagagattcaacttcttcctggtttagtcttgggagggtgtatgtgtcaaggaatttatccatttcttctagattttctagtttatttgcacagaggtgtttgtagtattctctgatgatagtttctatttctgtgggatcggtggtgatatcccctttatcattttttattgtgtctatttgattcttctctcttttcttctttattagtcttgctagcggtctatcaattttgttgatcttttcaaaaaaccagctcctggattcattgattttttgaagggtttttttgtgtctctatttccttcagttctgctctgatcttagttatttcttgccttctgctagcttttgaatgtgtttgctgttgcttctctagttcttttaattgtgatgttagggtgtcaattttagatctttcctgctttctcttgtgggcatttagtgctataaatttccctctacacactgctttgaaagtgtcccagagattctggtatgttgtgtctttgttctcgttggtttcaaagaacatctttatttctgccttcattttgttatgtacccagtagtcattcaggagcaggtgttcagtttccatgtagttgagcagttttgagtgagtttcttaatcctgagatctagtttgattgcactgtggtctcagagacagtttgttgtgatttctgttttacatttgctgaggagtgctttactttcaactatgtggtcaattttggaatagatgtggtgtggtgccgaaaagaatgtatattctgttgatttggggtggagagttctgtagatgtctattaggtccgcttggtgcagagctgagttcaattcctggatatccttgttaactttctgtctcgttgatctgtccaatgttgacagtggggtgttaaagtctctcattataattgtgtgggagtctaagtctctttgtaagtctctaaggacttgctttgtgaatctgggtgttcctgtattgggtgcgtatatatttaggatagttagctcttcttgttgaattgatccctttaccattatgtaatggccttctttgtctcttttgatctttgttggtttaaagtctgttttatcagagactaggattgcaacccctgcctttttttgttttccatttgcttggtagatcttcctccatccctttattttgagcctatgtgtgtgtctgcatgtgagatgggtttcctgaatacagcacactgatgggtcttgactctttatccaatttgccagtctgtgtcttttaattggagcatttagcccatttacatttaaggttaatattgttatgtgtgaatttgatcctgtcattatgatgttagctggttattttgctcattagttgatgcagtttcttcctagcctcaatggtctttacaatttagcatgattttgcagtggctggtaccggttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaacgttgaatatcagcccctactctcttctggcttgtagagtttctgccaagagatcagctgttagtctgatgggcttccctttgtgggtaacccgacctttctctctggctgcccttaacattttttccttcatttcaactttggtgaatctgacaattatgtgtcttggagttgctcttctcgaggagtatctttgtggcattctctgtatttcctgaatttgaatattggcctgccttgctagattggggaagttctcctggataatatcctgcagagtgttttccaacttggttgcattctccccatcactttcaggtacaccaatcagacgtagatttggtcttttcacatagtcccatatttcctggaggctttgttcatttctttttattcttttttctctaaacttctcttctcgcttcatttcattcatttgatcttccatcactgataccctttcttccagttgatcgaatcggctactgaggcttgtgcattcgtcacatagttctcgtgctgtggttttcagctccagcaggtcctttaaggacttctctgcattgattattctagttagccattcgtctaatcttttctcaaggtttttaacttctttttgatgggttcgaacttcctcctttaccttggagtagtttgatcgtctgaagccttcttctctcaactcatcaaagtcattctccgtccagctttgttgcgttgctggcgaggagctgcattcctttggaggaggagaggtgctctgatttttagaatttctagtttttctgctctgttttttccccatctttgtggtttttatctacctttggtttttgatgatggtgacgtacagatggggttttgttgtggatgacatttctgtttgttagttttccttctaacagtcaggaccctcagctgcaggtctgttggagtttgctggaggtccactccagaccctgtttgcctgggtatcagcagcagaggctgcagaatggcggatattggtgaatttgcctgatcgttcctctggaagttttgtctcagaggaatacccggccgtgtgaggtgtcagtctacccctactagggggtgcctcccagttagggtacttggggggtcagggacccacttgaggaggcagtctgtccgttctccgatcccaagctgcgtgctgggagaaccactactctctttgaagctgtcagacagggacatttaagtctgcagaggtttctgctgccttttgtttggctatgccctgcccccagaggtggagtctacagaggcaggcaggcctccttgagctgtggtgggctccacccagttcaagcttcccagccactctgtttacctactcaaggggcaatggcgggcacccctcccccagcctcgctgccgccttgcagtttgatctcagactgctgtgctagcaatgagcgaggctctgtgggcataggaccctctgagccatgcgcgggatataatctcctggtgtgccgtttgctaagaccattggaaaagcacagtattagggtgggagtgacctgattttccaggtgccatctgtcacccctttctttgactaggaaaggtcattccctgaccccttgcgcttcccaggtgaggcgatgcctcgccctgcttcagctcactcttggtgcactgcacccactgtcctgcactcactgttcgacactccccagtgagatgaacccggtacctcagttggaaatacagaaatcacccgtcttctgtgtcgctcacgctgggagctgtagagtggagctgttcctatttggccatcttggttccaccccctacccctgcaacattttatgcaaattttcacacaacaaggttgaaagaattttactttgaatacactgttgtacttgcctttaccacatatccatctgtctctcatttatgtatttcaaagtaaattgcaaacaccggcacactacctcctaactacttcagtgtgcatatcattaaaagtttactgttttctattttggtgtataatttatatatagcgaatacacaaactatatatatttgctgttttgacaaatgcttacactgcttaacccaaatctgtatttgaacattaccatcaacctagaaagtttatttattctccttaaccaatctgttcatctatcctctagaaacaatagctattatgtttccatcatagactaaatttggctcttctagaacttcatataagtggaatcataacagtatttttgtgcaaggtttctttcagcatgtttttgagatgtatccatgtttcatatatcaacaattcattctttttaatgtgtttcattgtaaagatatactacaatttgttatgggttgtttctgcttttttggctattatgaataaagctgctacctgagttgcattttaaaagccaagaggtggaataggagaaaggaggactgggtgacgagggctgaaaatttcaggcaaaggagacaacataaatgaccatcttagatgtgagaactatttagtaattgcttaagggtggatggggcaagactggaaaggatagttgactatccaatacctcatcagctttaaaaatgaaaaaagacattcacaagtgatacctttggtaactgaagtgttttcgttttatgtgtgatgtgctcagaattggcgaagatccaaaatagtagcagggtgcctttaaatgacttgtgagaaattgatttaataatatgggtgttttcatcacatcaggccttattctaccattgaggaaaatgaaaggccagctactataagtttgtttttcattttttatttttacttgttttaattgactatatatatatgtgtgtgtgtgtacatattgacaagaactattcatgtgtatgtgttttaaaatatgtatacattgtggaatggctaaatcaagctaactaacatgcattacctcacattttttgtggagaggggtcttttgctcttactgtattgtgtattctcccttcaaatttattaatatttgccatatatatacttaggtgctccaatgttggatacatctatatttacaattgttatatcctcatgatgaatcgtcccctttatcattatataatgaccttctttgtgtctttttacagattttactcaaattctgttttatctaaagtatagctacccctgctctcttcaggttttcacttgtgtaaaatagatttttccatcccttcactatctgtgtgtgtccttaaaggtgaagtgagtttcttttaggcagtatatagttaggttttactttttaaaaatccattcaaccagttttttgattggagaatttattccatttatactcatagtaattattgataggtaaggacttattactgctattttgttcattgttttctggttgtttcatagatgctttgctcctttcttcctctcttgctaccttccttagtcattaggtgattttcttcagtgatatttttattccttactttatatcttttgtgtatcttctatagctttttgctttgtggttactatgaggtttacataaaacattttacaattacaacaggctatgttaagctgataacaagttaattttgattgcattaaaaaactatacttttactccccccattttatgtttttgaaggcagaatttacatctttttatattgtacattctttaacacattattgtagctattattactattattgttttttttttttttttgaggcagtgtttcactcttgttgc

SEQ ID NO: 557 - DNA, 126125 bp, Homo sapiens
atgtcctgaagcaaatagttttattaataaatataaaattacaaatgtgaatatgtttcccatattagtgaggtctccccaccctccctgctctgaatcaaatttttacaaatgttctggaacagaagcaaatgttgagttggaagctgccctgaaactgagtcttaacgaaacaatacccatttttgagcccagccacagagttaggagaagcaagtaagaaactttagcctcgttttacaaagagcaggggatttaatcttatcaaggaagtcctctcatatactttttcagaccgctatttcatgaggatgacgcagcacacttttcctttcattcttcacacactgatctcagtcgtctttatcagccacattctttttatgtatttgtgcctggaacgaatgagctgataatgcaccttttgatcatgttttccagtggatgaatgtgttccatgcacccaagccttcttccacgccgcccctaaaaaaaagtccatttctttagggtaacatcatcattttaaaaaagaagtgacacatgggtggggagggaggtgtgatggaaacacgtctttcaaaaatgtgtagtcgtagcctcggccacttcattaccacattgagaataatttctgcagtgtgactaagcatcaacccttcaagtttggagtggatttaaagcaggtcaaaggtttacactcagatccctctatactgactgctttaaccctcctgccttgattgtaccttttctagaagtacttgcacataattttcaaaatctgaagaagaaatagatttagtaacttgtccaaagtcacaaatctagtaagtggtaggagaagaatttaagcccagacagtctggctccagagcccatgttcttaaccactaatccattccacctcctcactctttgcctttttactcctgcaagctatcccttgccccagtaatctcccgtcttcagtccaccactccccaccccaaactcacaataaaacaatggactcaatgatacagtagagagaacggaagtcacaaaaatggcgtgagtcctggttctgcctcactcaaccgtgtcacctggggcatcttgagtcctagttttctaagtgcacattgggaatattaaccaaaaataaccagttcccccccaaaaactactctgcaaattaaattaggtcatgtacacaaagcctccagtacagtgcctggccctggaaagcaaaccagccaagacaagagaagacatagaacaaccacaatttaccgcacaatgaacacagtctaccaggagaaagtgagctgtttcagaaagtaacactttcaccttcctcaatggctttataatacagccaccatctggggaaagatggctggggacatggcagggtcccaccacaatgtcaccttgagtggaggctgcaatagtcagggaatcttccatgacttgcaccgaatacttgcaaagccctttttgggagacattttatacaaagtgattccaactacaggattgttgagggtagtccatgcatagaattatgttccaaaggatgtaggtccattattgctgcgtgtaaaaaaaaaaaaaaaaaaaaaaagggtgacaaccccatggcagggccatctgtctgtgaaggggccagggaagcaaattcacctctacatttaagaggtctcccaaaacaaacaggaaggaagtgcttctgaacagttaatttaacttgctcttgaggtcatttaaacccaattctttttgaccgtccttagaagagatggagaaaggctgtcattttctcccaagacagattcagtcactgtcagaccttgctcttctcctagatgaacagctctcaggttttttggtttcaggatccctttacactcctagaaatcattgaggaccccacagaatttctgtaatgtgcaatatatctacagacattgaacatattaaaagattgacccaagtatggtggcttacacctgtatcccagaacttcaagagctggaggcaggaggatggcttgaggccgggagcttaagaccagcttgggcaacatagtgagaccctcatctttacattttaagaaaaaattaagattaggaatttttttgagacggaatctcactctgtcgcccaggctggagtacagtggcgtgatctccgctcactgcaaactccgcctcccaggttcacaccattctcctgcctcagcctcccgagtagctgggactacaggcacccgccaccacgcccggctaattttttgtatttttagtagagacggggtttcaccgtgttagccaggatggtctcgatctcctgacctcgtgatccgcccacctcggcctcccaaagtgccgggattacaggcgtgagtcactgcgcccggcctaattttttaacataaaaatatacaagctcatattctgtgagccctcaggctacatatcatacagtctctagaaaactctactgtatactcttagataatttaaaaaacaaacaacatcttaatattattatgaaaatcagtttgactcacaggccccctgaaagggggctggaggtctctggggtctccagaccacacttggagaactgctgagctagataaaacctcctacaacaggttgtagtgagttctgtctgccacatcctgaacccttctacttggacatcatattgattttcatttgtttattttcatttttatgatttttagggacagggtatggctctgtcacccaggctggagtgcagcagtgtgatcatagcaaactcctgaggtcaagcaatcctgccacctcagtcttactcctgagttgctaggactataggactatgctaccatgcccagctaatttttctattttttgtagagatggggtctcactatgttgcctaggctgatcatgaactcctggcctcaagtgatcctcctgccttggcctcccaaagtgctaggattactggcataagccaccctgcccagcccccatcttgatttttaagtctggtaatttatgtagttagaattaaaatcctgaaccagtaatatcaaagaaggattaaataagaagtaagaatgtaaacaatgaggcagaactacccaaacaactattctctaaaactgaaatgcaaattagcactgaagacaccacagaaaaccttgaacaggcagatcaacacagtatgggccaacagactatcctcccttttcgtttttccttctttttaattattgttatgtccacaaatgacttttccattggtattaaacctgctagaggttctttgtgaggtggattcaagaagaaaatacccagagtttcacaatataggtagcgataaccaggtctcactttccccttccgtgagaacttcgtgggacagaccgaccgcgcaggatcaggtatttccaaattcaagtactaacacaagtttggggattaatcatgccagcttttttcttttttaatgtttgatatgggggtcaaggttaagcttttctatgcagtctctttgttctttcttactcttagcccattttgtcctcttctctgtggctgtaactccatggctgcccaggaccatctggtagtaccttcctgctcctttgcttctaatagtcatatttataacaggaacaagtacctaggaagcacttatcccagtatctgggaagcacttatccaagtactttgtgctaagcactttatttttgcattttctcatatctccccacaaccccacaaggtaggtattattattcccattttaccttagaggacattgcttgccttacagtggcacagttacgtatgtggtggtgcagggatatgatcccagacaatcttatcccaaggctctctacccacgatgctaaactgccttttaaagacagtgacgccggacacagtggctcacgcctgtaatcccagcattttgggatgctgaggcaagtggattgcttgagccctggagttcaagaccagcctaggcaacatggaaaaactccatctctacaaaataaaaaataaaaaaaactagctgggcatggtggcatgtgcctgtagtcccagatactcagaaggctgaggtgggggggatcacctgagcctaggaggtagaggctgtagtgagccatgattgcaccactgccctcgggcctggatgacagaggaagattctgtctcagaaaaataaaaataaaagacagtgattgaagagattaaaacgacatccttcccatgtcatttaaaggtaaataaataaaatcttatttggcaaaggtgtagagcagagaaaaattgtggactttgaaaatgcaaccaatggctcttcaccacaggcaccaaagtaaatgtaggtgaaccttttatcagtgccacctgacaaggaaagccttatctctgctcttctgatagtctgttagtggtttcacttttcccctaagtgttcattcacagcttctagcattaccctgttgaggtccaagctaatatgctagaaaagagttgctctgatcagtcttccattcccctcggcaaagaaaacaaggggtttgtcaaatatggcccagacccaagggcgggagagcaatcctatctgaccttcaattactctgaactggaatcgccttcttccctgacaactgtgactaattccaaaggcccaaccagccttctcataatgatgactctggggtcaattactttgggggcagattagaatctgatctgaagctgaaaaattccgcccccttggtactaatcccttgaactttccaatcctaaatagggcaagtttcaggaaagagcatttctcattttacagcctacctgaatattgtctgtaatgattttgcttaatcaaaaaattaattaaactcttgctctaatggtctaaacacaagtcagaggaaggaagttctggccacgtgccaaagctccatctgaggctctcggagttaataatttccatggtgttttaagcatttgaaacaacaaaggctagctttcactaatagcacaactgattctggaaaacctataaaaatgaggcctgctctagggtggtttgtatccagagaattaagttttaacaaataaaattaaatcaacagtcaataaattaaaattttgctattctctgatactaatctgcaaacttagccataagtgctcaagttaatgaaaatgggctgccagtggctctgctgagatcaccgatggctgttaaatggttttccgtggggacagcgtggggacagcgtggggacagaggacaggagtctcataaggcatttctaggcgagatgaggtccctgggcaagccacgaccctttcttacatttatacatttcttgctagtacattacttacttgatcagtcactcttcagaaataaatacatacaattttttttttttgctctgtgaaacgtatcaactcttcataatctaggctgcaaatgcaaactggcaccccgcagatgaaacggggctgcagaagcaatttattaggtcttcacagtgtttgctttttaaaaatattagttggttgccaacattaaaaactcagaaggcttcacacaaaaatgcaaacatccagccagtcctggaaactggataactgagcaactccaggctgacatttctgcagggcagccatggacgagaacagagcagtggcagcacgcttagaacaggcctcgctcatgcccagcctgcttcacctgttcacacgtcttgcctggctctgcacttcctaaatctagtgatttatttagtggcttcaagaactgctacactttccagtgtgttaagctctgaaaaactgagtgcagataaagatgctgcaaagacactgcccaccttaaagtcgactgatggagaaatctacatcccagatcagattttttacttcctttgttcctccatagccagcctgcaggttaactcccttatgagaaatactgctaatggaatgttaatatttgttggaaggaaggagggaaggagggagacagatatgctaaatatttaaaaaagaaaaaataagcccacactaatcccttgcataaaattcctgaagtttcagaacagaaagcactatgtttacggtgttccagaaagcactatgtttacggtggtttttttttttcaagatattcctgaatatggattttaccacatgcaaaaattctgtttgcagcttgaatactgaggacaaaaatgtgatctatttggaaaaggtgattagcaagagaattagaatactggattctcatggatgaaatttcagtcattattttttgtcaatagaattctcagtaaatatagtccctgaaaaatagaatttacccatgcactactttgaagccaccacccccaccacacccctgccccaaccaacttttatttatttatttatttatttatttatttatttatttatttattttgagacggagtttcgctcttgtcacccaagctggagtgcaatggcgcgatctcggctcactgcaacctctgcctcccgacttcaattgattctcctgcctcagcctccaagtagctgggattacaggcatgcaccaacaagcccagctaagttttgtatttttagtagagacggggtttcaccatgttggccaggttagtcatgaactcctgacctcagctgatccacccgcctcggcctcccaaagtgcagggattacaggcatgagccaccgtgcctggccccgaccaactcttactaaaataaatggtagcttccatttctttttttcctcaagggtcatatcgacaattgagatgctctgttcaaaaaaaagtaaaaggtgggggtgaaaagaaaatgcccatattgacacagatctgtactgcattttaagctgtaggttgaaccatgtagtttgaagcatctatgcagcccattttccatgaagaaaaggtccctcctgattaccacccgtatttcccccagcccctgccttcttctaatcacgtttacagctttaaaaaaaaagagatacaccttgcttctcactcaactgtcatgtacagtccaaaaataaagaccgtccaggattcaggactaaagcagacttgaaaacaaaccccaaattccttccatgcttcaatggggcaagaaatgagaattcgaaaccaactctagatgtaagagttcctaaaacaacaacaacaaaaaacaaaacagttttttaatactgcaactggcacatcgaccaaacggtctgctcggctccaactgtttatctaaagcagaaatagctcacaagtgattaataaacagagaatggaggacagtagaatgtggaagtcatgttggatcacatgtggtttaaaacatgttttgaaacaagcaggcacaaaccttctcataattttaaagaaaaccttagcaatatatgaagaccttcaggaaaaaaaaatttaataccatgaaagtgccttcttttagtgcatctagtgatttatttagtggcttcaagaactgctacactttccagtgtgttaagctctgaaaaactgacagtgcagataaagatgctgcaaagacactgcccaccttaaagtcgactgatggagaaatctacatcccagatcagattttttacttttgatggacgtgatctccattagaagcatatgtcctgaaggtcttacaccttggagaagaaagaaggtgcctcaaaacttaaggctgcaaaggatcaactggctgtaatgctggctgcaaatgccagtggagattgaattaggctactggttttgttaggatagttattttgttagtgctgtggtacaatgtacaaagttccttaagttttgagtaatctgcctctaccccaattttccccgtatgcctctatgttttgtgtacaatgtcacagaaagtgaggcttttcaggactacacctatggcattcaaaccgaacttttcttagtcccattttgctggtctgctcgtatgtcactatccaacattataaagtgtagtgactatagctatccatagtttagggtactctttagttggtaacccagacatgtagttcttaaataaacggcttgttaggatgtcattttattgtattcatttttagagacagggtcttgctctgttgcccaggctggagtacagtggcacaatcatagttcactgcagccttgagctcttgggcacaagcgaacctcccacctcagcctctcaagtagctgggactacaggtacacactgccatgcccaactaattttgatttttcattttttgtaaagatggggtctcgctttgttgctgttataactccgtgttcacactgctatgaaggaataccccagactgggtaatttataaagaaaagaggtttaattgactcacagttccacatggctggggaaacttacaatcatggtggaaggcacctcttcacagggtggcaggagagacagtgagtgctgagcaatgggggaaaagccccttgtaaaaccatcagaactagtgagaactcactcactatcacaagaagagcatgggggttactgcccccatgattcaattactcccaccaggtccctcacacaacacctggggattatgggaactacaattcaagatgagatttgggtggggacgcagtcaaaccatctcagttgcccaggctggtctcaagttcctggcctcaaacgatcctctcgcctcgacttcccaaagtgctgggattataggtatgagccaccgtccccaacttaggaattcattttaaatgccttccagtattatgctgctgctagaaatgcaattctaaaaagtacacccaaaacaccaaaaatacttacgcaatgtaacattaacaagacaagaattcaaaatagacacaccataaatataacaatgtaaaaaatatatgcaggcgggaggtaacaagtaaaaacaaactgtactggagtagggtgactttaaaaataaaatctcttatttcctacattaattatttgctaccaatgtttgttcttttttttttttttttttgcctgggattaatcatcagtaggtggaagtttgtagagaaacatttgatatctacaaaatgaaccacaaatgtggctaaacgtgccagctacatgacttttttttttttttctttttttcctgagacaaagtcttgttctcttatccaggctggaatgcaatggcgcgatctcggctcactgcaacctccgccttccaggttcaagcaattctcctggctcagtcctgagtagctgggactacaggcaagtgtcaccactcctggctaaattttattttttgtatttttagtagaaatagggttttggcatgttggccaagctaatctcgaactcctgaccttgagtgatctacccaccttggcctcccaaagtgctggggttacaggtgtgagccactgggcctggcctacatgactgcttttcaagggaattgttttaacatgttaagaggctaagcacaaaagtagcattcaagtgttggttagacacttttgaatattatttgatttaaacatttctttcaaatggcatgcaagaaatggcttaggggttctcaggactgaggaatcaggatgggaacttgataacagggaccttaggttgaaagctattgttctaaaacaaggtgctttcccggcatgggaagcaaatgctgggttttacaagaccacaagtgaggcagtgcctttgacttggcattatctactgtggcaacaagcagcaaggtcatgatagggttactggtggaatagccttgctttttggaacaaaaattcccacaaattacccacatatcaaagttatccattagctaacaaacatgaacgttttctagcaaataaaacacgcatatcacaaagtcctctctttaaaagaaaacataaagaagagaaagagaaaagaagctgatgacggtgaagcctgatttagcagatacgtttattcaacacagtgcatgattcaaagcatcggatattccacagccaacaaggtttcctattccctattacaaaataccggataccctgaatatagctcattcaaggtcctcgttcctttttccctatatctagaattaaacaggtttccccgtttagcgcacatttcacgttcgctgaaggctttggggagagggggaaacagagcttatgactgcccctctgaaccaaaggcacttaatgttaaaagataaagcacagtagagtcaccccacagacattcctatgtgttcaacggctgaacttcagcataccatcaccggccccatgtgggattcatcataacaacgtaaaagacactgatttccttggaaaaacaaagtgcagtacgaatataaaggagtcaccacacccctcttccgaaaataatacataagagaactcttactttacatgattagtatcactcaaggttcacacatggaaaaaatagctaaaaaataatctataataaattctcactatgaagtcacaatagaatctgataccctttttagaactggtgagttggagagacacccagaggtcatgctgtccatcccttcatttgataggggagggcacttgaggcccaggaaggtcaagcgtcggacctggggtctaacccctgtggcagagcctgcgtaggacgcgggcctcctgaagcctagctcagggttccctccactccccttcctctttaaagactctcaaaagtaaaatatggtgatgatctccaaagatgcaccacaccataaagcacatgcactgacccaggtcagcaatttggtctcacaaggcggttcctttggccattgggcaggtatgtaacccacctcagggtgggaattctttgcatgggatcgttcaaagttctgagaaaagcccaatgtaggtcagacacgactgctccttggactggggaagactttccttggttgtcagtccatagtgggcaggcggtcggctgcacagcggaatcccagattcgaagcagagctatcaggtgtgttctggctccgagcagcacagcgatacctgtaacaataagactgtgtagagagaaagagcaaggtaagtgctactgggactctcagctgaaggctctaacccatcagatgcatattgcaccggctgtagacagtgcttccccacaaccctgcctgtatggatacttaacatgtatgctttaaaaagggcagcacattcaagaactaaccacatattttccaacgtccttcaccttataaatgtaacacggatatagtacaaagatgttcagcattagatataacagcaaaaaagaaaaatgtaacaaccaatgattgcctaagtttaggcacatccatataatagaaaagtaagcagccattgaaagtcatgtctttacatagtatttaatgacacaggaagttttcatgataaaatgttaaatgaggccaggcgcactggctcacacctgtaatcccaacattttgggaggctgaaatgggagaactgtttgaggccaggagctcgaggccagcctgggcaacacagcaagatcccatctctacaaaaaattagctgagcatggtggtgtgcacttgtagtcacagctactctagaggttgaagtgggaagatctcttgagcctgggtgtttgaggctgcagtacaccatcactgagccactgtactaaagcctgggtgacagagcaagatcttgtgtccaaaaaaagaaaaaaaaacagttaaaatgaaaaaggcagaatataaaggtgtatatgtggtatgaccacagtgtagataactacatgtgccaagaagaaaagactggaagattccgaatgcaccacaatgtgcacagtagttatccctcaagcaatctgagtttcatgtttcctatatgaaacctattcagtattccaatacaataagaatatatattaatttttgaaattaaaccaagtaataagtgatagatggccactgaaaaaatactaagaacaacactaagacaccatttaatacctaaataatatttatgatattatttattatctaaatcatatttatgatatcatttaatgccagtagatcggcaaaaaattaaacaacaagtctaggaacatcaaacataggaaaggctgtgggacaacattgctttttaaaaatacattgctcttccatttctttgtatcctcttttatttcattgagcagtggtttgtagttctccttgaagaggtccttcacgtcccttgtaaggtggattcctaggtattttattctctttgaagtaattgtgaatgggagttcactcatgatttggctctctgtttgtctgttattggtgtataagattgcttgtgatttttgtacattgatttcgtatcctgagacgttgctgaagttgcttatcagcttaaggagactttgggctgacacaatggggttttctagatatacaatcatgtcatctgcaaacagggacaatttgacttcctcttttcctaattgaataccctttatttccttctcctgcctaatcgccctggccagaacttccaacactatgttgaataggagtggtgagagagggcatccctgtcttgtgccagttttcaaagggaatgcttccagtttttgcccattcagtgtgatattggctgtgggtctgtcatagatagctcttattattttgagatacatcccatcaatacctaatttattgagagtttttagcatgaagggttgttgaattgtgtcaaaggccttttctgcatctattgagataatcatgtggtttttgtctttggttctgtttatatgctggattacatttattcatttgcgtatattgaaccagacttgcatcccagggatgaagcccacttgatcatggtggataagctttttgatgtgctgctggattcggtttgccagtattttattgaggatttttgcatcaatgttcatcaaggatattggtctaaaattctctttcttggttgagtctctgcccggctttggtatcaggatgatgctggcctcatcaaatgagttagggaggattccctctttttctattgattggaatagtttcagaaggaatggtaccagttcctccttgtacctgtggtagaattcggctgtgaatccatctggtcctggactctttttggttggtaagctattgattattgccacaatttcagagcctgttattggtctattcagagattcaacttcttcctggtttagtcttgggagagtgtatgtgtcgaggaatttatccatttcttctagattttctagtttatttgtgtagaggtgtttgtagtattctctgatggtagtttgtatttctgtgggatcggtggtgatatcccctttatcattttttattgggtctatttgattcttctctcttttcttctttattagtcttgctagcggtctatcaattttgttgatcctttcaaaaaaccagctcctggattcattaattttttgaagggttttttgtgtctctatttccttcagttctgctctgattttagttatttcttgccttctgctagcttttgaatgtgtttgctcttgcttttctggttcttttaattgtgatgttagggtatcaattttggatctttcctgctttctcttgtgggcatttagtgctataaatttccctctacacactgctttgaatgtgtcccagagattctggtatgttgtgtctttgttcttgttggtttcaaagaacatctttatttctgccttcatttcattatgtacccagtagtcatttttgttcagtttccatgtagttgagcggttttgagtgagtttcttaatcctgagttctagtttgattgcactgtggtctgagagacagtttgttataatttctgttcttttacatttgctgaggagagctttacttccaactatgtggtcaattttggaataggtgtggtgtggtgctgaaaaaaatgtatattctgttgatttggggtggagagttctgtagatgtctattaggtctgcttggtgcagagctgagttcaattcctggatatccttgttaactttctgtctcgttgatctgtctaatgttgacagtggggtgttaaagtctcccattattattgtgtgggagtctaagtctctttgtaggtcactcaggatttgctttatgaatctgggtgcttctgtattgggtgcatatatatttaggatagttagctcttgttgttgaattgatccctttatcattatgtaatggccttctttgtctcttttgatctttgttggtttaaagtctgttttatcagagactaggattgcaacccctgcctttttttgttttccgtttgcttggtagatcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgatcctgtcattatgatgttagctggtgattttgctcgttagttgatgcagtttcttcctagtctcgatggtctttacaatttggcatgattttgcagtggctggtaccggttgttcctttccatatttagtgtttccttcaggagctcttttagggcaggcctggtagcaacaaaatctctcagcatttgcttgtctgtaaagtatcttatttctccttcacttatgaagcttagtttggctggatatgaaattctgggttgaaaattcttttctttaagaatgttgaatattggcccccactctcttctggcttgtagagtttctgccgagagatccgctgttagtctgatgggcttcccttcgtgggtaacccgacctttctctctggctgcccttagcattttttccttcatttcaactttggtgaatctgataattatgtgtcttggagttgctcttctcgaggagtatctttgtggtgttctctgtatttcctgaatctgaatgttggcctgccttgttagattggggaagttctcctggataataacctgcagagtgtttccaacttggttccattctccccgtcactttcaggtacacccatcagacgtagatttggtcttttcacatagtcccatatttcttggaggctttgttcatttctttttattcttttttctctaaacttcccttctcgcttcatttcattcatttcatcttccatcactgataccctttcttccagttgattgcatcgactcctgaggcttttgtattcttcacgtagttctcgagccttggctttcagctccatcagctcctttatgcacttctctgtattggttattctagttatacattcgtctaaatttttttcaaagtttttaacttctttgcctttggtttgaatttcctcctgtagctcggagtagttcaatcgtctgaagccttcttctctcaactcgtcaaagtcattctccatccagctttgttccattgctggtgaggaactgcgttcctttggaggaggagaggcgctctgctttttaagagtttccagtttttctgctctgttttttccccatctttggggttttatctacttttggtgtttgatgatggtgatgtacagatgggtttttggtgtggacgtcctttctgtttgttagttttccttctaacagacaggaccctcagctgcaggtctgttggagtttgctagaggtccactccagaccctgtttgcctgggtgtcagcggcggtggctgcagaacagcagatttttgtgaaccgcgaatgctgctgtctgattgttcctctggaagttttgtctcagaggagtacccggccgtgtgaggtgtcagtctgcccctactgggggggtgcctcacagttaggctgctcgggggtcaggggtcagggacccacttgaggaggcagtctgcccattctcagatctccagctgcgtgctgggagaaccactgctctcttcaaagctgtcagacagggacatttaagtctgcagaggttactgctatctttttgtttgtctgtgccctgcccccagaggtggagcctacagaggcagccaggcctccttgagctgtggtgggctccacccatttcgagcttcccagctgcttaggttatactgcccaaggtaatttatagattcaatgccatccccatcaagctaccaatgactttcttcacagaattggaaaaaactactttaaagttcatatggaactaaaaaagagcccgcatcaccaagtcaatcctaagccaaaagaacaaagctggaggcatcacactacctgacttcaaactatactacaaggctacagtaaccaaaacaacatggtactggtaccaaaacagagatatagatcaatggaacagaacagagccctcagaaataacgccgcatgtctacaactgtctgatctttgacaaacctgacaaaaacaagcaatggggaaaggattccctatttaataaatggtgctgggaaacctggctagccatatgtagaaagctgaaactggatcccttccttacaccttatacaaaaattaattcaagatggattaaagacttaaacgttagacctaaagccataaaaactctagaagaaaacctaggcattaccattcaggacataggcatgggcaaggacttcatgtctaaaacaccaaaagtaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatttagaatctacaatgaagtctaacaaatttacaagaaaaaaacaaacaaccccatgaaaaagtgggcgaaggacatgaacagacacttctcagaagaagacatttgtgcagccaaaagacacatgaaaaaatgctcaccatcactggccatcagagaaatgcaaatcaaaaccacaatgagatatcatctcacaccagttagaatggcaatcattaaaaagtcaggaaacaacaggtgctggagaggatgtggagaaatagagacacttttgcactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcactactcacaatagcaaagacttggaaccaacccaaatgtccaaccatgacagactggattaagaaaatgtggcacatatacaccatggaagagtatcacgactcatgtcttctttcccactgcccaatacacaagccctgcatgcacttgtacacttgcataaacataagagagcctaacgcacatatccctgactacctagcaggtattcagtgattaaccacagattacttcaaaagcctccacatgccaaaaataaccacgcttgaaactcttgtgccctaggattgttctccgatccaaaaaaacggagaataaaaataaactagtcatcctgtgtgccatgagcataaactctgagttggcccagtacagctcaagtccctgcaaactggttaaagaagtttcacaaagcaacatgtggaataactttagaatctgtgcagaagcgataatttggactcagggggaagataagttggcatgcaaaaggtttttttttttttttaaattattctcttttctctcagaaaagtaaaatgcttcttgtctttgtgaaaagtatctcaagttgacacagaaattctttagagcacttctactgtaaaaataaagacagtgctttgtcttctatagatagtgaaatgatagcaaccaattttctcattttccttgtggtcagtgaataatataacattagcaattctcaggtagacaaaaggaagatgaatttaaagtgtgcttgaaataattgataaattgatggcatctcctactatgtgtgatctgcatgcaatggaagctctcaaatgactagaggtgaccatgcaggaagacatagcaaaagcctcattccatgcagggcctactcgtcgggctgctgtgaaacaacagtgctttggtatttctagaatcaagttcctgtggataatccagggccccatgcagccaagcatgtgtagcaaactccacactgcaacaaagatcaggttcagggggagctacacagatgacatgtcattcttgtcccataaacgtacacgcttttttagaaggcaaaaattgatgtggatgagatttccatgatcatggcagtggtcctcggacctcagcatacataagaatggccaatacaggttgcttaaatccatgttcctaggccatacatccagaaactctgattcaggaagtctagtatggggcccaagaacctacttctaacaagcttctaggtgctgctgatgctacaggcccatgggccacactttgagtaacactagtttataggatttagaggggaagttgagaggatagcaaggccagagcctgatcatatcagggcatggtttaattattcactgaatatatgagagcttacaatatgccagatgctattttaggtatgacggatacaatcagaacaagacaaacaagatagctgttatcagggagctgacattcaaaagggaattgtcagacaataaataaaccgatacattcaagatggtttccaggagcagtcacctctgcaggaaggaaaatagggaaagaggactgagagtgactgggtggctactttcgatagggtggtggtctggaaaggcctctctgagaagatcacatgtgggctgagttgcccaaagatctggagcatgagaattccaggcaagagtaatgactggcacaaaggtggttaatgatgtctttggggtaactggcttcctcactaaaacaacaaaggtattagccagcttctaagcaggtcttagaaaccttgtgttcaactgcaggaagatggtaatagccctgccagcatctgaatgtggatatacatttgctacataaatgggaaagttaagaaatctctctggtgatagggcataggacttaggtttttgttgaatggcatatttctacctgtcacttatctcttaaattatatcagaaactattttaaaataagatgatattcatatgccacaaaacctagcatataaccactcaaatgaactgttgggatctgcccaaagcactgggttgaggattctacagctgcgacacaggatagtgaaaagacatatacaagagattattcccagggccatatctgaagaccccggtatatacagaataattccattcttgaaagacaaaaattaagtacacaaaaagtttgctggaatactatcaattgttttctttagaaagcatgatgatcttattttcattttgatctttactatgtattttctaaattttatgctatgaaaatgttttctttgaataatgaaaagtttaaaatcagtgcctctcccttccccaccaccaaaatttagttctttattagatcacagcaatccctgagactgtccattaaccaaaatgacaataaagaattaaaccctaaaaagcaagactcactacaaaagttagtgttgcgaggtcagggccatcacttgagaaaacagtcaattcacacatcattccatttcaaatgcactcattcactcagcaaacatttattaataagtcgtttattttaaattccaactaataaagcacataattaaagaggtaaatggcctcattataaatgtcctcattgctctttcttttttaccaactttatttttagcagcaaaagtggttcttaaggatgtgaggtctttaggtggctgaaaaatgggtcattctattaattaagaacagggaaagtgggaaggacctgttttagtcctatttcattaagatggctaattactgtgtgaaattgatctccatgtctgtgctaagaatgagatcctggacttgggaacaatccatttaagataatgacttaccagccttggggcttcaaagtaaaggggagcagcaatatggtttttatgagagggagactttttggtacaaagggcattttaaagataattgtaactcatgttaaacgaaatcattatagagaatgccacaacagaacagaggtctcaatttcccgtccgttgctcttgccactaacactagaccaactccttttgctcttcatcttggtaggatggtgaggatttccttaatgttgtaggctgagctaaagacccagagggattaatctaacaacatcaacaacaatgagtatttcttgagtacttactatgtgaactgtattactacgtattaattcacttaatcctctcagcaatcctatgagataggcatcattagtatctgcactgtatacatgaggaaaaattgaggcacacagatgttaatagtgtgcctaaggtcacatggtttataaatggtggatccaaggttctagcctattcaatctgattccaaagtctgcacccttaaccagatgacatgttgcctcatagtttttctttctgtgcccccatctccttattgaagctatactttggatagattttcaaaaaattatgaatgatcatcagaatttactttagccaggcaggccgggcatggtggctcatgtctgttatctcagcactttgggaggccaaggcgggaggatcacttaaggtcaggagttcgagaccagcctggccaatttggtgaaaccccatctctacacaaaaattagctgggcgtggtggcacaagcctgtaatcccggctactcaggaagctgaggcaggagaaatgcttgaacctgggaggcggacattgcagtgagcctagatcatgtcactgcactccagcctgggtcacagagtaagattctgtctcaaaaaaaagaatttactttagccaggcaaactggtgttggcccatgatcaaaaataagtcatcatctaaaaaagaaaattttttaaaaaatgaattataacattattctttctttttattgatttttttccttttattgattttcacctatgccatgaacattgcttttgcctgtctagttgggagtttattagttggttccttcttcaaaagagaagaggggaaataatctaattataataaagatgatgctgataggagcaactaacttttactgagcctttaccataagctaagcactgtaccaagaacttatatatgttggttcatttactcctcatcagaaccttataatgggtacaattatattatgttacaaatgtaaaaactgaggcttagaaagattaagtaatttgcccaaggtcacatacctggcaagaaacagatatagaactccaatccagatgtaattccctaatccacatctcaataatttagtaaaagctgttactcttcatctactggaaaggctaagcactctgaaaataattcacaaccgacactatgctattttcctaaccttacagatataaccagactgatgataaagaccaacctaataaacaattcatttgaccaagatcctggaagtgccatttttctatggaaaatcctgtggatcccactcagttctgtcaatctgctattctcctcttctaaaatgttatccccatcacatggaacctgactaaattaaaacaaatccttcaagtaagctaagaaaagataaaaatgcataatatagactttaaatcaaccactaagattataaaacatagagttacaactaataagcataaggagagaaaatggggtgataaaaagtatgtaatcgaaaagaagacaaacagagaacaacaacaggtgagacaaagagaaaaaaaatcaagatggcacatttcaacccaaccatattaaaaaccacattaaaaataaatggtctaaacacccaatgaaaggcagagattatgccaataaatacaataactcaaatgaaatggacaaattccttaaaagatacaaactactagaatgtactcaagaagaagcagataagctgtatagtcctacatctatttaaaaaattaggcctacagtaaaagaaaaaaaaaatgggcatactggctcacacctgtagtcccagccactcaggaggctgaggcaggacaattgcttgagttcagaaattcgaccctgtctctaaattaattaattaatagttaaaactctcggcccaaatgcattcaccaaggaatcctatcaaacatttcaataataacactaattctacataaactcttgcaaaaaaatttaaaataagttaatatttaacaactcaatctatgaagtcagcaataccctgaaaccaaaatcagataaagacattacaagaaaacacagaataaactagattcaaaaatactcataatttttgcaaatcaaatccaaaaatgtataaaaaagataatacatcatgactaagtggaatgatacatatcccaggaatgcaaggatagcttaatatttgaaaatcaatgtaattcaccatatgaacagatagaaaaagcaaaatcatattatcatctcaatagatgcagaaaaagctcccagcaaaatctacatccattgctgataaaaaactctaaaaaattagcaatggaaaaaaactttctcaagctgtaaagggcatgcatctatgaaaaagctattgctaatacatatccaattttgaaaaactgaatgtttattccctaagatcaagaatgaggtatgaaggtctactcttaccattcctattcaaccctatactgaaggttctagccaatgacatacagcaagaaaaagttataaaagggatctagattaaaaaggaagaactgtcgatattcacagatcatatgatcagctatgtagaaaatatgatacaatttacaaaaacattactagaactaataaatgagttttgcaaggttgcaagactcaagatgaacataaaaaatcagtaccatgtaagtgtacttaataaagtatgtaggagtttaaaagatatttttaaagaatctactgggaagcttataaaaatgtagattacaaataagctaaaagttataaaacatgaaagtagatacattcatacgcatggaattaggacagttaatgtcctttacttgcttaaaatgttttttacaagcttctgttaccccatttattcttgatgaaaaatcttctggtcctcaattacttagaaagtaaatggattctgaatttagaaaagtgccatatgccagagacataactggtgacaattaggattttgagatactactgtacaaagagagattcacctgttttccatggaagtctggtttcctggcaagaagatccaggtacatttgtagcaataacttcaaatagagaagcaatctgggattaaagactctgatgtatacgtgaacatgtaaatatattgggaagacctgggacaatgcttttaatttaaaattaaaactaggattttaggccgggcacagtggctgatgcctgtaatcccaacactttgggaagcaaaggcaggaagaatttcctgagcccaaatgttcaagaccagcctaggcaacatggcaagaccccatctctaaaaaaaatttaaaaattagccaagttacttaggaggctgagatgggaggatcgcttgagcccaggaggtcggggctgtagtgagctgtgattgtgccactgcacctcagtctgggtgaagagtgagactctgtctcaaaaaaaaaaaaaaaaaaaaaaaaagatttcatgaaaataaattggtctacatcttattaccaatgtaggtctaaagcatcaattgagctctgctctatgaacttcaacctgaatcactggattaaaaattctaagaaatacagaagatacacatacatacaaactcacatatatacataaaatctagagagatttgctttaggctagtgattcccgaacttggctgtatgttttcatcacctggagagctttaaaaaatgcaatgcccagctcacactgaagaaaaatcaaatcagaatgggggtgagtgaggagccagacatcagtattttatatagatcccagatgattacaatgtggaataaagtttgagaaccactgtttaagacaaaatttgataatgccatcattatcaaattagtaacttaatttggagccattataggtggttttaagtctctaaccacctggactgaataaattcctaggggaagctttgaggcaataacaatctgcaaaatgccatctctgcacagggatagaaagctggagttcaggagacgtgaaaaatatatgactcaaagaaaaaagggaagggatggtattctatttccaaattccttataaaggttatttaggaaacaccaagtcactctaactgatgaagaaagccagctcagacactaaaatcatagcccaaagagaagaaacactctctgggaatgatgcttatttcacaaggcacactttgtacctagaacacgggatgcttccatttcagtatatcacaatctgccctccatacataactctcacctgaatctcaacagaaaatccagaaatgtacaggattctcaaataaattaagggtgtgctttcagacttacatgctggaaaagttatatacacccacccctgtgcagttcgtgggacaacaaaggtctctcaaaggggcaagattcaatagatgaaatttggttgacaataggtcattcacaacctttgttacttgtgttacttttctccatgcttgtaaccaaatttgagatgactgtcctcctttttttctggtttcagtggggttaggtaggcatttgcagaagtgaatgagacatttggggctatcatttacaatggatccataaaactgctatcagaacaagaacggcaaaacagtttagtgacatgacttaccctatggcacatgtaggatccacctttcttcactcggtctttcccagaagggggacctttctacagatgaagaaaaaaggctatgttagaccagaaggcaaagctgccccttacacagtgggagagaatccactttgatccaaccagctctctcatggttgcctaaactctccacatgcatttccacccctaggctttgtatctgtattcgtgggctctcccaaatgctcacctccccaaatcctacccatcttctaaggcccacctcaagtttccactctttggtgaagtcttcgtaactacaggaagcaatcctgtctctaagtccctacagcatttcttgcctagatgactaataagctgcttggctgcacctcttaccatgtcatgatgcaaatttatcctgtgttataactggtttactcatctacactggcaagcctctttgaattgcatggtattttttgaaacaaaaatttttcttgagacagggtctccttctgtcacccaggctggagtgcagtgctgtgatcatagctcactacagccttgaccacctgggctcaagcaatcctccctcctcagcctcccaagtagctagaaccacaggcatgaaccaccatgcccagctaatttttaaaaattattatttgtagagacagggtctcgctatattgcccaggctggtcttgaactactgagctcaagtgaccctcctacctcagcctcccaaagtgctgggattacaggcatgcaacaccatgccaagccagaattatatgtttttataatcccgctgtgtaatacttaataaatagtttgctgattgaatgaaagagtttgcttgttagccttaaaaaaatttaggtgtgctttattaagatataattaatatacagtaaaattcatcctttttaagtgcacagttccagtgagttttgacaaacatatatagtcatgtaaccgctaccacaatcaagacatacaacatggtttatcttgaagaaaaaaaaaaagacacatatacgtactatgaaccaggcacagtttgagcactttacaaatattaactcaggtattctccatccaaccttggaggtaggttaagttactggtaaaataagtggcacagtcaggcagccttgctccagagtccatgctctgaggcactccactgcgctcccacttagagacaagaagtgtaggaaattaggcaatgcttaaaaggaggcaaggaagagcagcgtctaccactgtaataagaattaacatctacacagagccagtataatggcaagacttttttctaggaagggcttcagataaaagttcaaaggaaatgaaaatcctaaagcatcagttgccaagataaaagcctcaacatcaggtaaggcatacacagcatctgagaggtaccaataaataggctctaataagccagaaccgtatcaggggagtctatggggaaagggatttatctcctttttttgttcaaaaagacaattaatcacacacctgtctactatttgctccaaaaacgcaagaggccgggacaaccccactcctatcttagtttttccttctcctgtgacccaaaagcacccttacttaagtggcagaaattaaaagaatcacgttttctccaagcatggctaatgtactttcttgcaaatgtaaaccatgtgggcagaagtgcacattaccttctaagcatttccaggtacagatgctccttagcatgggattaggtcctgtcctgataaatccatcataagttgaaaatattattaagtcaaaaatgcatttaatactcctaacctacccaacatcacagcttagcctagcctaccttaaacatgttcagaacactcatgttagtctgtagttgggcaaatcatctaagaacacaaagcctattttataataaattgtggaatatatcatgtaaattgctgaatactgaactgaaagtggaaaacagaatggttgtatggatacttaaaccacagtttctaccaaaggcatatcacttttgcacaattgtaaactcaaaaaaaatcttaagtcaaaccattgtaagtaggggactgtctgtgcttagaaactatcacagacaaagccattggctattcctccttcaactgcagggctacaatatttccaaggccttaaatgcttaatgtcacattaataaacttttgttaattacaaacaggcacactgcaaacgtgaaaagctacgtgtcaaaataatggctggcagcagttttcttcccaggaatatctagaatctgacaaacactctgagtcagtttattactctataagacaattaccaagaattcactgtagcagcaatgaaagcatttataattgtggaactctcccatgtaatggccacactctcctacactgtttctcgcttaacaattcttgcattacactgctttaggtggttctctgcatgctctgttacaatgtatcaaattgtgattcaagtctctcccagtatctgctagcgtgcaatttagactcctcaagtagatctaggaacaagaaggagttgatttgccaatgggaaggcatgggaacaaaatagttgcctttcatcatcaacttcaatgaactaagtctgcaatcaataactacgacacttatcacagtgacgcaagtagtaatgacagtcatcccaggctgacacaactgtggcacctaacacagtcctcaatttaggtgactgctcagctgcttcttataaataaaactatttttgctagcaaacaacatgataattaactaaaactgtttgaaatgcttgccactttgccaaaaaacagaaaaattactaggagggtgtagtgggttgaagagtgttcccaaaattaatgctcattcacagccctagtgtctgacctgattcggaaataggaactttgcagacttgtaatttttgtaattaatataagatcatattggattagggcgggccctaaatccaatgactggtgtccttataagatgaggagaggatgcacagaggaacacagagaagtctatgtggtgatggaggcagggactggagtgaggcggctacaagccaaggaatgagaaggattcctggaagtcaccaggaaggatcttcccttagagactccagatggggtgtggcacagccagcaccttgatttcagactgctagcctccagaactgtgagaggataaatttctgttgtttcaagacactaagagtgggaggctgaggccaagagatggtcaagagatggaggtcaagagatcaaggtcaagagatggagcccaccctggccaatatggtgaaaccccatctcagctaaaaatacaaaaattaactggtcgtggtggcacacacctatagtcccagctacttgggaggctgaggcaggagaatcacttgaatccgcgaggcggaggttgcagtgagccgagatcgtgccaccgcactccagcctggcaacagagcgagcctccatctcaaaaaaaaaaaaaaaaaaaaaaaaagatactaagtgtggtaatttgctatgcagccctagcagattaatccagagagttggggaagaggggtatctccattcccatttgtgaaagaaaacattaataaatcaaaattaacagtgtctctcatgatcaagtttatgactgcaggctaaaacaacttaagtggctattggtggtggtgtttaaacacctcatctgtttgcctgtataccacagcaggaagagcggctgcagggccctaccacctccacctcctgtgctcaagagtcttggggatgcataagaatccacttggaattaacctagatatccatcagcagtggactggataaagaaaacgtggtacatatacaccatggaatactacacagccataaaaaagaatgactcatgtcctttgcagcaacatgaatggtgctgcaggccattattatcctatgtgaattaacgcaggaacagaaaaccaaataccgcatgttctcacttataaatgggagctaaacattggatatacatggagacaaagaagagaacaatagacactgggacctatttgggcaaggtggagggtgagagaaggatgcggactgaaaaactacatactgaatattatgctgattacctgggtgacaaaattatctacaccaaacccccacggcccacaatttacccatgtaacaaacctgcacatccatcctttgcacttaaaatgaaagttggaaagaaaaacaaagtctcagtggaaaaacatatggaacatagggactccgcctacaaccaggcaggaaccatcgtgaatcctgtctccaaaggtactactgcccgtaactgctctagtcccatagacacgaaaatatcaacatgtctccaatgcttgcatggtcgcaagaacagcaaaacacacaggtttctacataacagtcccaataatctcaaaaggccaaggtacagctaaagttctcgggaaaagtgatgaagaagcaacactcagcattagtgcagagaaatctacccctgtttaaaacacctgggagggcatgtaagtctttaaggatgagttgaatccactggagatgccacagaaccacgtatcagtgagactggcttgtttggaggaggaatgagtctgtaaggaagaggggtagccagcctgctcacggctaccaggacatttttcacagcacaacgactgcactctgtgtagtcaagagacatttccctttccctcgtcatgcccaatacattgacaaggaaagcaacagaagggatggagagtgtgacaaatttccatcactcagcaaacagtcaaaaggcaccactagcgacctggatgggactagagactattattctaagtgtagtaactcaggaatggaaaaccaaacatcatatgttctcactcataagtgggagctaagctacgaggatgcaaaggcataagaatgacacaatggactttggggactcggggaaagggtgggaagggggtgacggataaaaggctacaaatcgggtgcagtgtgcactgctcgggtgggggtgcaccaaaatctcacagatcaccactaaagaacttacccatgtaaccaaacaccacctgttccccaataaccaacggaaattaaaaaaattaaaacaaataataaacatgtcatttgacacaatccatagtaatgaaatgctaagcacccactacaaagaatgaggcacttctgtatgtgtacactttactatcactttttactaagaaaataacagcatcaagcatttattctgacttcctcacacaaactatgcctcaggaaaatagaagagttatgagtgaatgttctttatagaggaattccagataattaatgcagaaagagtaatagaatatcactatgtcaaaaatcttggccaggtgcaatggctcatgcctgtaatcccagcactttgggaggccagtatgggaagattgcttgagcccaggagttcaagaccggccttgggcaacatggtgaaacctcatctctacaaaaaatacaaaaattagccgggcgtggtggggcacgcctgtagtctcagctactcaagaggccgaggcaggagaaccatttgagcttgggaggcaaaggttgcagtgagcagtgactgcgccacagcactacagcctagacaacaggaatgagaaactctgtctcaggaaaacaaacaaacaaacaaaaaaaccttcctcaagaactgaatctaggcaatgagtatcaatggctgctaaaatcagtgagtgaaaggctaatgaagatcctcgtaacggatggttcagactgacaatgcctacttaaatactgatcaatcttattaacaaaaataatcttatcggtgtcacgataaaagccatgcatactatgcctcctgatatgatataaagaatatacacagccctatgaagtatttttaattactcttatacatacacacacacatacatgcacacacacacacacacacatcctacctaaagcctaaatataatcaagactttaaatctaaacaaagattgtaggaaatacaaggggtagaagaatatactaaaatgattccacgaagatgcaatgaacaaaacccaggccatgggaaattcttttaaaaatagatcatttgtggtgattcctcaatgatctagaaccagaaataccatttgacccagcaatcccattattgggtatgtacccaaaggattataaatcattctgctataaagacacatgcacacatatgtttattgtggcactgctcatgatagcaaagacttggaaccaacccaaacgcccaccaatgatggactggataaagaaaatgtggcacatatacaccatgggatactacgtagccataaaaaaggatgagctcatgtcctttgcagggacatggatgaagctggaaaccatcattctcaacaaactaacaatagaacagaaaaccaaacaccgcatgttctcactcacaggagggagttgaacaatgagaacacatggacacagggaggggaacatcacacactggggcctgtcagggggtcagagactaggggagggatagcattaggagaaatacctaatgtaggtgacgggttgatgggtgcagcacaccaccatggcacgtgtatacctaagtaacaaacctgcacattctgcacgtgtaccccagaacttaaaaagtataataaaaagaaaaaaaaaaagagatcagggccgggcgcagtggctcatgcctataatcccagcactttgggaggccaaggcagacggatcactggaggtcaggagctcaagaccatcctggccaacatggtgaaaccttgtctctattaaaaatacaaaaattagccagtcgtggtggtacacacctataattccagcttttagggatgctgaggcaggagaattgcttgaacccgggaggcggaggctgcagtgagccaagattgtgccactgcactccagcctgggcgacagagcaagattccaactcaaaaataaataaataaataaaaataaaaagagatcagacatcttttcaacaaataaatagcaagggaggaaaaagagagaagttataaattgagaggcttaaaatatcctctggtcgtggtggtggcacggggcaattctatatgccttgtggcagtttttgtcctggattatcttttgaaggatgtttgtgtaaccaacagtctcagaagatgacagaaggcaggtttgtttcctggccagaacaataatgtcaaaggttgggtatgtttattataaacctctttataagactggagtctcctaagctcaggattctccggctgtgacaaagacctactgtgtcatccttatgggatttgggagacaaggggaagcgatgtgaacatgaagtgcatgttgcctgctgtgctgtgactagaaaaatctgtaactctgacacagaaacttcatgtcttctgccagcatccatgacactgtagtggcctaactcatgagcttgcaaacagaataaaatttcagactcttcatagtcttgacaaagacatatcaacaaacaaaatgcatagtattactgtcatacatattacagttatatatgtgaaaaacttaacaacacagtgtgaccattattgctttaaacaatcttacgtttttaaaaggaatgaagtgaaaaaataaatgcagtcttttctacttacctatttaccatatttcctgcttgtcagttctgcctgtgtatctatctgaggtatcagctagttccagtccctttcagtctagaaaaactgcttagtatttcttagtatggcagatctgctagcagattcactgtctttgttaatctacaatgactttatttctccttcattttaaaatattaaacctttattatgggtaaccgttgattcacatgaagctgtaaaaggtaacagaggaattggtgtactctatatccagttttccccaatggcaacatcttccaaaactctgtactgtatctcaaccaggatgttgacactgacacagtcaagacacagaacatttccatcacaaggatcccttacgttgcccttttatagttacgaccacttccttcccaaccccaaccccttcttaacccctggaaaacactaaccccttcccactcctataattttgtcatttcaagaatgttatattaatataagtggaatcatacagtatgtaaacttttggaactggctttttttccactcagcataattctccggagattcatccaggttgctctgcataccaacaatctatcccttattactattgagtagtattccatggtgtggatgtatcggtttgtttaaatattcacccactgaaggacatttcggctgtttctagtttttttggctattacgaataaagatgctatgtacaggtttttgtatgaacataagttttcatccctttggaatcaatgccaaaggagggaatatagtggtcgaatgtttacttcattttcttttttcttttttctttttttttttgagagggtctctcgctctgtcgcccaggctggagcgcagtggagtaagcttgggtcattccaacctccacctcccaggttcaagcgattctcctgcctcagccacccgagtagctgggattacaggcacgcaccaccaggcccagctaatttctgtatttttagcacagacagggtttcaccatgttagccaggctggtctcgaactcctgacctcatgagatcagcctgcctttgcctcccaaagtgctaggattacaggagtgagccgctgtgcccagctgaatgtttaggttttaaagaaaacgtcaaattgttttccagaatggctgtactctgtcacacaaccaccagcaatggataaatgatccagtttctctgtatcctagccagtcactactttttaattttagccattctgatacgtgtgtagttgtatctccttatggttttaatttgtatttctccagtgctaatgacgttgagcatcttttcatgtgcttccatgccatctgtgtatcttcttctgtggtgtctcttcatgtcttctgcacgtgttctaattggattgttcggttttttactgctgagtgttgagttttttatgtattgtaaatatatgtggcttttgtcagatatatgggttgcgaatattttctcccactctgtagcctgcctttatatcctcttaacaggctctttcacagaaaagaagttctagtttttataaagtccagtttatttatttttccatatgtgggtgatcatgctttttggtgtcaagtctctacactctttgcctaggcctagatctcagattttctcctgtgtttttttctaaaggttttagagttttgcagtttaaattttaactctgtgattcatttggagtcaatttttatgtaaggtgtgagactaaggtagaggttcattttctgcccacggatgtccaattgttccagcaccatatgttgaaaagcctttctttccttcattaaattgctttggcaactttgtcaaaaatcagttgggcatcatatatgtgtgggcctatttctggattctctattttgttccactgatctataagcatatccctccaccaatatcaaacagtcttgattactgtagctaagtagtaagtcttcaaattgggtagattggttcctctcacattattatttttcaaaattgttttagcaattctagttcctttgcctttccatatatatttcagaataatcatgtcaatatctacaaaaaatcttgctgggattttgataggaattacattaaacaattgggggaagaactgatatctctactaggctgaattttccaattcatgagcattgtctcttcatttattcagatatttctttcattagtgttgcatagcttttagcacacatgtactaaacacattttattagatttacacataaacatttcatttggttttggtgactgtaaatgtattgtattttaaatttcaatgtccatgtgtttgttgttagtcttacaaaaataaacatgttcatcttgtgtcttataaactttataaactgaaatattagttttaagaagattttggtagattccttgggactttctctatgtaaacaaacactcatatatctgcaaatagggactgttttatttcttccttgctgatctgtatacctcttatttccatttcttaccttattctactggctagaaatcccagcactatgttgaataagagttctggaaacagacatagttacctttttcccaatattagtgggaaagcacttggtcttttaccattaagtataatggtaggtatacagtttctttgtagatgctctttactaagtttgagaaaatctttgtattcctattttcctgagaatttttgttataaatgagtgttgaagtttgttaaatgcttcttctgcactgatataatcatgtggtttttttttttcttcttttgcttcttattatggtagattacactgactgatttttaaatatttaaccagactgcactcctggaataaacctcaattatcatgttttaaaaaatacactgatgaattctatttgctaacattttgttaaggatttttgtgtctctatttatgagggatgttcacctgtagtaaccttctatttttttactgcttttggtttggggatcaaggcaatactagcttcgtaaaatgattagaaagtgttcccttcttttcattttctaaaacaaattgtgtagaattggtgttgattcttctttaaatgtctagtaaaattcttcaatgaatccatttgggcctggagatttgttttttgagaagttttaaaatttctaattctacttccttaatagttataggactattcaaattatctatttcatattgggtaaactgtggtatttggagttttttgaggaagtgttgtttctcgcctaagttgtcacatttatgggtatacagatgttcacagtattccctcattatccttttgatgtctacagagtttgcactgatatcttgtttcatttctcatattagtaatctgggtattctctttttgctttgtcagacttgctagaggtttgtcaattttataaatcttttcaaagacccagttcttcatttaactgatttttctctgtttttctgttgtctatttcattgatttctgtttttattatttccttacttttgcttgctttgggtttagttttctcctttttcttctgggtcaagctgaaacatattgattttagactttttctcttttctaatgcacacatgcagttctgcaaatttccctcttagcactgttttcactctatcccacaaattttgatatgtttcattttcattcagttcagtgcactgtttgattcaccttgggacttcccctgtgacctaaggattatttagaagcgtgtttcatagtttccatgtgtttggagattttcctattatatttctgttactgatttctagtttgattctattgtggttggagaacacattctgtatgtcttcaatttttaaaaatttgttgaggttcatctgatggcacaggatatggtctaacttggtatatgttccatgcataactgaaaaggggtattctgcagttatagggtagacagtgctagaaatctctatcagatcctttggttgatggtattgttgagttcttctatatccttgctgaacttctgtctaattgtactatcaattattgagaaaggagtggtaaggtccccaactaaaattgtggattagtctacttctcctttcaattttattactttttgcttcacatgtttcagctccattctctggggcatacacagtattactatgtcctcttgaaggattaaccattttatcattatatacgttcttcctcaactctggtaaatttctttgctttgaagtctgctttacatgatatgaatatagccactctgactttcctttgattaatgtttacataatatatattttcccatcattttgttgtcaacttgcttatatatcataatatttgaagtttcttgtacacagcatataattaggttgtttttttaatctactatgccaatctgtctttttaactgatatatttaagcaatgtacttttaatataattattggtatgtcaaagacttaagtctgtcattttattttttgttttctgtctgttctctatttttttgtctctgttttcctttttctgacttcctgtgggttacccaaacttttaaaaaagaattccatttttatgtaactattgtgcttttgagcatacctctttgtgtagcttttttagtggctgctaaaaggtgtatgcatattcataaacatatcactctacttgtgtgtgtacatatagtcataaatgtatcagtctactcatgtcattttaacagttccagtgaagcatcaaaaccgtaactctctttaaatccctttagcttctcttgtgtataatataatcatattaaatatttcctttaaatacatttagaaccatatcagacaatgttataatttgtttcaactgtcaaataaaatttagaaaactccacagaggaaggaaagcctattgtatatactcatatttgggcttaccatgttcttccttccagtccgatattcaaaagttccttctttaatcattttctttctgtttaagaacattcctttagccatccttttaggataggctggctagcaacaaattctctcagtctgcctttatctgagaatatcttgatttctccttattccaaaaagatacttcactggataaggattctgggttaacaatacttttctttcagcacttaaaaaacatcatgccatttcctctggccttcatggtcaccaatgggaaatccattgtcattcaaattgttttttttttttttccctataggtaaggtgtcattttttctggctgcttttaaaagttttgtctttagtgttcagaagtttaattataacggtgtcttcttgtagatttcttcagaattaccctcattggggtttgcttagctccttgaatctgtgggtttaagtctcttaccaaactggaggtgctttcagccattattttgtgaaggactcttctcatgctgtcttctttgttttctcctctgggattctcaatacgtaaatgtgagaacttttgttataatcacgtagatccttgtggctctcaacatttcttcatttactgttttctttccactgctcagactgggtaatttcttttgttctagttgacagttcactgatttttcccccctctgtgccctccattctgctgttgagcccatacactgagctttttagtttgatttttcaattttcagttctaaaatttgcatttggttcttcttatattttctatttctttgctgaagctttcaattttttcatttgtttcaagtgcgatcatagttgctcactgatttcttttttctcccatggtttctttaaaatctttgctgggtaagtctaacatctctgtcatctcagtgtgggcatctgctatctacttaaattcactttgatatcttcctggttcttgggatggcaagtgacttttcaacttaaacgtggacatgttcttattatgttaaaagactctggatcttattaacaccctgttttagctgtctttctctgataccaccctggcaggggaagagagaaggtgtgatcctgttactgccaggcagaatcagaagttcaggttccttgctcagcctctattaacgattcagaagggacccctcattactactagatgtgggtaggagttttggctccccacctggttgtatacagcaaggtaggggtaaccactttactaatagacaataagaaagacctggctaggccttctctggcacctaaatacagctgcatgagggtacaagcctagactccccactcagcctttgctggacagttttttctttggtgtttagaaagagtagagtggttactgtctaaaagctttctgtattgttagactgcccatttcctacttgctcctttggctagagagaacaggcttttgttgagacttcctttgtctacacctgttagcatttctgggttgcttgcttccctagctccaagtcagggatatatgcagcaaaaaggaaataaaagagacagggtctcactctgtcacccaggctggagtacagtggcacgatcttggctcactgcagcctcaacttcctgggcccaggggatctttccacctaagcctcctgagtatctgggactacaagcacataccatgatacctggctaatttttgtattttttatagagaccaggttttgtcatgttgcctaggctggtcttgaactcctgggctcaccataatgtcatttctaggactctgaggtcttcagccactctgctttaactttccatggtctgcttataattcttttatgtgcagtgtccagagttttagttgtatttagtaagaggaatagaaaaatgtacatctactccatctctccatctttctagaaccaggagtcaaacctccttcaccttcatttttgaaggattgttctcctggatatagaattcttagttgacaggtttgtttgttttcctttctactctttgattatgtcacaccatcatcctctggtctccactgtttctgatcagaaatcagctattaatcacattattgttgccctgtatgtgatgaactgttttcctcttgttattttcaagattttgtctttcaacagtgtcaatatgatttgtccaggtgtggttttttgtttttgtttttgtttttgtttttgcagtttatcctaattgaggttcactgagcttcttggatttatagataatcttcatcaaatttgggaaattttcagatttttctttcaaatttttgtcccttttgctcctctccatttgagattccctttacacatgtgttaaaattatgttggaacacatgatgttgttgcacagggctgtcttgatttttctctgaaattttttctgctttttaaatttttatgtatttattttgagacagggtctcactctgtcacccaggctggagtgtattgccatgatctggctcactgcagccttgacttcgtgggcccaggagatctttccacctaagcttcctgagtagctgggattacaggtgcataccatgatacctgactaatttttgtaatttttgtggatatagggttttgccatgttgcccaggctggtctcgaactcctgggctccagtgatctacctgccacagcctccaaaagtattgggattacaggcatgggccaccatgcccagccctctctgctcattggtttggataattcctttttcttttcttttcttttcttttttttttttttgagatagagtcttgctctgtcacacaggctggagtgcattggtgcaatcttggttcaccacagcctcaacctccctaggttcaggtgatcctgccacctcagcgtcccaagtagttaggactacagatgtgcaccaccatacctggctaattttttatttcttgtagagacatggtttctccatgttaccagggttggtctcaaactcccaggctcaagcgatccactcgcctcagcctcccaaagtgctaggattataggtgtgagccactgcacctgtcctggatactttctcttgatctaccttcaggatcactgaatctttcttctaccatttcttatctgctcttgtgttcaactagggaatttttcatttcagttagtagtatacttttcaattctagaaattctacttggttctttttttaaaatttctatttgattctctatttgttgactcacagttggcgtattttatagcaactattcaaatatactttagttctttaaatataatcataatagctatttttaagtctttgttaaatctagcatctgggcctacttgggagttagttttaacttaaatactcatcttctttagtatgggtcacactttcttgttagtctgcatgtttattacattttagctgaaaactagacatttaagattatacataatatgcataatttaagattacatatataatcttaaataatcttaaatgtttatatgttcagatatatatgtgtgtgtgtgtgtgtgtgtgtatatatatatatatatatatatatctacctatatatataaagagagaaagagagcgagagagagagcacatgtatatgtaacagcaactcttgattaccctattttcctgaaggtttttgttctgttttgttttgttttgttttggtaacttacctgaatataaactgtagaatctcattccccatggtctgtacccactgatgtctctgttcagattttttttttcaattccattgaggtcatatttgtgttgcatacttgaacagctgaccaataatttagacagaggctatctcagatactttgaacccactgggctttcacctttcatgaaccaaggtgtatggattgagaaatggcattcaaagtggcagtcatctcaagtctccctggctttcactttttgctgggctctcttgggtcttccctgcttatgtttagtttcccagaaagcctagaaaagcttatttcacacctttaatgtctctgttacttgcgcgatctccctgttaaatttctggctggtctaccacccatcacaactgctaccgtgggctagtcatgctgcaggatttcccaaaatattctaacgtgagtctgcttttttagctgacaaagccacaggctttcagtgcccccatcctccaccctgaatcaagtcaatctttggctgtaaggctttggttttcgccaccagtcctgaactgacagttacatttttattttagttttagagacagggtctccctgtgtcacccaggccacaatgcagtggtgcaatcatagctcaccatagcctcgacctcctggggtcaagtgatcctcccatctcagcctcctgaatagctgggactacaggcatatgccaccacactcgcctaatattttatttttttatagagacaacatctcactatattgaccaggctggtcttgaaatcctggcctcaagagatcatcccacctcagtctcccaaagcactggtattacagaagtgagccaccatgactggccttttatttatttatttatttattattattattatttttaataatagagtgtggcagaaagaggatatggaatcagttccaagcaagaacgccacatattctcacccattcttggccaaagctatagaagtttctcaagaatcaacacttctcaatttatcacctccctttggtggattttcagtttccagtggttgggtgtgtgttttttctttacaattttgttcagttttgtacttgttttctgtattagtgaatcacttgacctcttacattgcaattaccaaaataagaactcaaccaaatgtaattaggatcacaacaagaatggaatttcttaggatcctgattctcaacaagccaattacagaaaaatgttcatgagataattaaggacatgtaaatgctgactgagtatttgataatattaaggaattatttttaggttttttttgagatttgataataccattatagttttgtttttattattatttttttaaaagagtgtttagcttttacagtcacatactgaagtgctttttttgtgtgttttgagacagggtcttactctgttacccagggtagagtgcagtggcgtgatcatgactcactgcagcctcaatttcctggactcaagcaatcctaccacctcagcttcctgagtagctgggaccacagacacatgcaccattttaaatttttgggtaaagacggtgtttcactatgttgcccaggctggtctcaaagtcctgggctcaagtgatctgcccatctcgctctcccaaagtgttgggattataggcatgagccacagcacccagccacatactgaagttttctagggaaaaaagtacatagtatttggggttggttttaaagtaattcaaaggtgttagattaaactagattggataactgttaatgtcccagctttgtaatgtgtcaccttggctagactgaacctcatttcccagaattctcttccctttatgtttctcgttaggatgtgctacagaagacatttactaagcaacctagaagacagaagagtagcaatagccatagtgtttttattctcagaagactgatacaagggatccaggcaaggctgcagctgtttctcactgaccctatatcctcctttagtttctctgggtcctgggcaggtctgtatttagctctgtgatgaagagcactagcttctcctgtatgaaatccacatcatcaaagtatttttatcatcagagacacagcctctgcacatcttcctcctaaaagaagcctctttcaatcacctcaaccatctttcgagaaaggaactctttgttttcaaatattctagaatttaaaatgactgacgtctctgttaattaccataccatccatttgttgagagtatactaatccttatcatcgtatttcatcctcataatcaccctgtaaagcaggaagtatcattcttttcattttaaggatgaaaatactgaagctcagagagatgaaataaatggcatccccaagatcacacaggtagcaagcgagagaaccaggagtcaaagtccatcacactgtggcacctgcaggcttatctcacccccgtgcctaaccagatagagtatcttctaggttcagcagcatctctacccaaagtacatatttgtgaaaaatacagtcaaaataccaataatttgtatttttttttacctaatgtccaacgtgaaaaaatattttaagagtgagcagatgaaaccattacttcaaataaagctttttgaattatgtttaattttatttatctctggggacaaggaccaatgaagaagggactgcaattagcattagcctctcctgcatgagaggaaaaggtgacgcccaaagaaaggtcaaagaaagaaaactagagatcaaattggaaagaagagcgcagtaaaacacacgaatcaaattaacaacctccactgtattttctctgtaaaaccagcatgccattgtggtgattaccattttagtgaaatgaatgaaaacagtcatttcctccatgctacttgtttcacccacaccagattagaaacgaagagaatttttgaaattgtattacacttgcttataccacggtggctcctgattttccaataatataagtcactttcagaccccaaagtctatggtaaccgttcttgctcctggagtaatacatgaaatcaggtatttaaaataccagtctacttgtaaaataaatagcacataaataaacaatagcagctaatatttaccaagcacattacagttggatattgttttctatatttttagtcttccaaacaaatttttgatacagattctcttattggtatggcagacatataattgaccatccaaataaggatactttagagattgaaaggtggaactattaacacttgtgctaggcacagatataaaccaggaatgtttggacacccactcattggccttattttacagctaaagaactaaggaacagaaaagttgaatagtgtgcccaaggtcacgcagctagaaagcagaggagctgggctgaaggccaggatgtctggcttcagcatcatagtcggccattctgccatgtgccccttctgaactaactcatagactgtaacatttttcgaataaatcattcgactattctagtttcagacacacaaacctctctatagttcacgagttccacaaggccataaaagcacacaataaaaagtcttacaagagattgcaaatagaaagtgtctgcaaaataacctgcagagactccacaggatgagcccaggcaggaggcatcaccacgggacctaccgcacaggccaggtagttgggagaaccagtatctagtctgggctctatcctttcccttctggcctgagttccctcacttgtgctcctctagagaccttatagggtccttccccaccaaccatttgatgtgagctggtggacacatgtccaaatccttttatcttggagcttctccatcccaaattgtttcacttccttcaaggaacttcccatggtttcttgctgaggtgtgagataagcaactacaatcttctttgaggtgcctcattcgagggcctcaagttttacagcctctctccccactgagagacaggaaggagagagagtagaaaaaagagtgaggccccaggagaatgattaattctctgacctatataacagtagatacatatgctctgtttaagaagcatgaattattatagctgtgaaacacaaggctataaagcatctatgtgctgaaaaccagtcaacctaaacacagaagaagcaactattaagagaaaacacatatcacattagatttctgcaacaaagaagaaactttctcatcatctactggtagtggtagactgccagatggaatgcagtagactgctagatggaattagcctcctaataatgcaggtggttctttaacttcagaaagtgtaacacactaatatgcaacacaaaggaacatgcctgctctatccaatttcagatggattagatctaaattatagagaaatccgtttgttttatcctaagcaatgcatgttatacagcagcatcatcctaaatgcaaaggcaacttctaggtcaactaaaaccaaaccaccaccaacacagggtacagactacattcactgaaagatttgctccagaatcaatcacttatattgcttagaataactgtataaaactgtcagtcctgagtgcagggccgcatatggttctaagtattacttgaagtgagaaaagtagacacggtttagtctcactagggatctatcacattcttttattctcacaatcttctgtgttcttcagtgacaattcattagcaagttatgagagaataaagcaattagcttataccaaatggcattttcacttaaccattattttcagagaaccacttgaagacttccatgattttatttggacgttttgaaagtggataagtgctaagtgcccaattctgtatgttctgctgcttgattagatgccatgtttacttcctttactgagtataaagtggagactgtccatggaaagaagtgttatttataattgcatgctaccagatggcctatctcctttccacatccctaaaaaggtccaaaaaaatgtcttccatggattagatttcagagtaaggtataatttcatagcttgctagcttatttcatttgaattttcattacacgtaaaacataatactcataattaacatatatcaaatgtttactacatgacagcctctaccctagacattttctctgtagcatctccttgaaacctccaataatcccataaagggtattactatttcctcacttacagatgaggaagctgggtgaaaggttaactaacttgctccaggttattcagctagtaggtggctgagctatgacttaaatccaggtcccactccaaaactgcatgcttttaaccatcatgctatacttcctccttaattttatacttttatagcaataaatgtatatgtatgtaaacccaccgaggtgggtttgcttgctcttttaacatctgcaagctccttaagaaaagaggattgtgtctgttagattcccagaacccagcatacaaatctggcattcagtagcttgccagtaaattttgctgaatggacagaagtatacccttacataaaacttctacgtgtggatatgcatattcctatattaaaaaggcatccacacatccacatgaaaaaaatcacagcataatttggtaacaaaaaaagataacttaactatatattttctcttcttaataacctggttttatttccagatccttagagaaagaacaaatgagtcatactatgacatggggaagtcactaaaagtaagctataggaatgggaaatggcactatattactttacagctcattaacaagtcagacgtcagatacaaaaactagcttgccaaatcaataatttttaaaaataatttaatggaaataagaggttaggaaggtaagaaggacaagaaactgatttaaaatctcaagagatcaaaaaccataggaaaaattcactgcctcccacttgcttttggaagaagccactgtatgacatagcgattcccatctcttaaattatctttatatttataacaagtcttgagatgcctgatttaacatatgtggcttgtgacaaaatactactacaaggaaataagtagcttttcatgttttgtatttgaaataacatctggaatccagtaaacattaacaagtctggggatcagaagatctgggatttaatcttgactgcaaatcaagttcaaaatccgggccaaagtcaaaacctctagagctccacaccataaaaaatgagtccaagaccacatcttcttttttgcataatcaggaatattttgaggatatgagaacgagagggggcggagggatggggaaaacgcatgcgtgaacacttcgagctcttcaggggagaaaagtcccatacaaatgcaaagctttaagacattgactttactcctcactcctcgttttgttcaccccagaagcacagcagtctggagtaaagtcaggactatattatacagggatgcagggtctgaggcatatatcttcttttaacccgaaacacatttcaccctaaaaatctataaagctacagtggggaagggcttgggggccatctttaagttgacggagaccactcttcccccccaaaccatttgtgatgactcaggagtactgtgggaaaactctttatgaacatggactactctatgtgagaaaatgtaaagaagagaattattgagttggaatatatatgtttattaatctttgcttacagccaagagtgatgagacagagccctatctgaaaatattaagcagcaatcacaggctgagacagtgcgggaacatttagggttaactgtaattcactgccaagaaaaaacaatctgtccagggagagcccaggtcatgaaaaagatggaaaggaaggcccacggaagtggaagacaggatgccaactctggcagagtctggccctcaaaacagtgcgtaaatttcctttcttttcttttcttgtttttctttttttgagacagagtctcgctctgccatctagcctgaagtgcagtagcgcgatctcggctcactgtaacctctgcctcctaggttcaagtgattcttgtgccttagcctcccaagtagctgggactacaggcccgtgccaccacacccagctaatttttgtatgttttagtagggatggagtttcaccatgttagccaggctacgtgatccgcccacttcaccttcccaagatgctgggattacaggcgtgagccactgcacccagccgagagcctaaatttctgttctcgattcatacctcaaaccacaccaagacaagagataaaattcctcaagcaaccgacccaaactgggggccgaattctacctgaattcccagagtacccctcctctgcccagaaaagctgctcagacatggcctgccagctgtggatgcaactaagggagccaagaaagacaggctttcaagccctcaccctgaaatttccccatggcctttccaggtgaagaaaagtataggaaaggaataaacaatcttttgattgaaagaaatccaaaaaacccgggctttggttctggcttcctaagcatcagtggagcaaaagtgcctattaccatggaaatgataagaaaccaccattaggaattctgagattcaaattctctggaggcaaggactgcgtgatgtttatgtttgccactatcacacagcaggtgctcaaaaatgctattaaacaaatgaaagaaaaataacataatctggtctactaaacaacaagaggcaatgctgaaggggaaaggattttccaaagggagatgttccaaccaagaggcgcttagaaaccgtaatctgctctcatttaccaagtgcttgctgtgtggtgggcacagtgagttaacctctctttttaatcctcagaacagttcaatattgttgaatcttactattactccattttatagacaaggaaacagaagcaaaggatttcaccccctggccccaagatagcagagctgggatgtggacctagatggaaatcattttattttatttttattatactttaagttctagggtacatgtgcacaacgtgcagttttgttacatatgtatacatgtgccatgttggtgtgctgcatccattaacttgtcatttacattaggtatttctcctaatgctatccctcccccctccccccaccccacaacaggccctggtgtgtgatgttcctcacccggtgtccaagtgttctcattgttcaactcccacccatgagtgagaacatgaggtgtctggttttctgtccttgtgatagtttgctaagaatgatggtttccagcttcatccatgtccctacaaaggacatgaactcatcatttttcatggctgcacagtattccatggtgtatatgtgccacattttcttaatctagtttatcactgatggacatttgggttggttccaagtctttgctcttgtgaatagtgccacaataaacatacgtgtgcatatgtctttatagtagcatgatttataagcctttgggtatatacccagtaatgggatcgctgggtcaaatggtatttctagttctagatccttgaggaattgccacactgtcttccacaatggttgaactagtttacactcggtggaaatcattttaaaaacaccctcttaaccatgttactgtcagctgcagcctccatcactgcctactttccaagcaagcagcagacccaagggcagttccccggatttactgtacccgtgggaatggcttgctacatcctcagcacaacttacagatgaagcactaagcctacaagggtgacatgactcacctagggccccacgacattttaaagctaaatctcagatggaaacccaggcgactgacctcactttcatcacttaaccatggctctgttattcagcacagcagaaagaactttactgagaatgacaaataaccacactagcaaactctctgctcttttcttttaatggttctgtgataagcccaacccatcctgctgaactgctgccatcccaatcttatagcatatggctctcccttcccaggagcgtgatacactgtgaaaaggtaaccaataaaagcccctttcttgagcacactgaagtaaggaagacagtttacaagtcactctccaaagcccctagctggtaagcttaaggaaattcttgaaacagctctactgctccataagaagtaggaaaatatgttgcagaaaaacaagaagaaagaagtgcgcacacacacatgctcccctcactgcatttactttgggtatggaaaagtcatcacacttcagggctaagggcaagtggagggcagctatggctcagggcaccgattaggcatttacttaagaaactaaaagaagtggggaaagaaagaagaaaatcctttcaccacttaccctgaattcctcaaaaggctggaccctgtcttcttcatctttggatcccatggacctatcatagttacctcaccaattgctgccatcctttctaaaggtacctcctccaagaagccttcacagctccaactggtagagaacagaggtcaccaaggctctacctcaatcatatccataacaaatcttagcatagtgcatcttgattcatctgattggcactcaatctttcctcaacaaactaggagcttcttaacagcaagactggtgtttcacatacctgtatcccaagagtagatatagcccgatactacagtggatactcaggaaatgtaggctgactccagtgctacagggctttgccttgggccctgtcccattcatactatatcaatgactttaaaacaaccaaatctgttggtgataataaattggaagggaaagcgaccaccatcaaagacagcactgatagccagaatgatttctataagctgtctctcaaggttgaaacccataaacaaaataaaatctcatggagagttgagataggcattgcatgaagtttcaaaatgcacatacaaaacagaaaagattccaaatttttaaaatcattttgtaaaaaataactgcatgtaaaaaatagctacataaaaaaaatcgctgtgtaacaacatttggggagacctagcctgagatcaacacgggagaaaaatgcaagttttatttggctacaagcttaacgggaaccatcagtgagatactgttcttcattactactgcagctgctactcacagtaacagtaggcgtgcctgtagtaccagtaggatagcactgacagcaattaggatggaagctaccatgtatcccatgctatctgccaaacatggtgctaagtcccatactacactctctcacttccttacaactctatgaagtagaaatcttcatccccatttaagaagaaagtaaactgagtctctgagcagttaagtgacttgcacagggtcacacatctgggaagccacagttacagtgacaagattcaaacccagcctgattggcatccactaaccaaactcttaactgcggatgtaatctgagacctgatgagaaagaacgaataaaaaaaggatagctccactattatttgcatctatcagacaacatctagaatgctgtgtataattctgggtgtccatttataaaaaaggacattttcccccaattcatgttattcagaggaatgtaactgggttgccctgaattgcaaacccagttatcccaggtgcagcagaagaatgggaatgcttatctagaaacagaaagatgggtggggcaggggagacgcgacaactgttcttaggtatctgaagagcttgtctgtacaaggcagaaggaagatacattcttattctcagcaacagcagaatgagggccactgagttgacacttcaaggaggatttgagttggacagaggaaacttcagtgagaacatctgacaatgcagtaagttgccccaagtgttggagagttactgttcaccaagaagcttttagcaagaggctgcaggaccacagctgtcaggggtatcaaagaaggaattcccacagggggagaggttagaggaggtttccatttcccacctttcagatccactgaccctccaaactaaggaggccatggtacattttggtgttctgctctctttgctcaggaagaatcagtagttgtaacatgaggctctgagggtcattttgtcctgaagtggaaacaaacggtatttctaacattgtccaaatggtaactggaattagaattcgctcttttcaagcaagaagcatatgtctggataacgtgtttgaaatgtgtctgcaggatctaaatatctgaaccatacatttgagtttatttctatttctcaatagttctattttactggatgaagaaccttgcaactgatccacagtgaaaaattacaatgagtaaacattagtacttcctccagaagacattcatcttccactagggagaaggagataaaattattttcccaagcatagtcccaaaaggctgatattttgatcaccttgctttccccttggcacttactctgtataacttgtagctgtattaaatttattatcaggtgaacttcattatcactttcgtgctttttttcattttgaacattaggttagttctctatcaaactgatttattcatgtcctcagaatgtcctgattaaaaacatgtgagtgggccaggtgcagtggctcatgcctgtaatcctagtactttggaaggctgaggcgggtgaatcacctgatgtcaggagttcgagaccaacctgaccaacatggcgaaaccccgtctcgactgaaaatacaaaattagccaggcgtggtgacacatggcacatgcccgtaatcccagctacttgcgaggctgaggcaggagaatcgcttgaacccaggaggtggaggttgcagtgagctgagatagtgccattgcactccagtctgggcaacaagaacgaaactccgtctcaaaaactcaaaacaaaacaaaacaaaaaacacatgagtgaaggtcttatagcagcgaaaaattctcaatcaacttcctcccccagcccccagcacatactaggtactcaatgaatgcttgcttgaaatgatgaggctgttgatgggaccatcaatgggtatgaaagtcttaactaaggagaaagatgatatgatatttaccggtttttgccagactgagaaaatggcagtctcatcgcctgggcagaggaggatcaggaggcaagctaagtaacagtctcatgtttctgttgcacactgagacacagtggtgggaggccagaggatcacagggaaggggaacaatcaagtgtggagtttagaggatctaaaaaactactgtgagtccatgccctaagtcctatcatgcaatggcaaagaagtatctgagtggggtcaacaagtgtggcatctgcaagcatgagtatacatgctaatctctggccagagaactggtatgtgccccaaatgtacttaatgtgctatgtgtggataggcaagagctcagaggggtggcctctgcacaccacaggagacagacaaggagggcttatcccaggtcaattctattttttgtgtgtattttgtttgttttattttttgagactgggtctggctctgtcaccaaggctagagggcagtggtgtgatctcagctcactgcaacctctgcctcccaggctcaagccattctcccacctcaatctgccgggtagctgggactacaggcatgtgccaccatgcccagctaactttttgtgttttttgtaaagatgagattttgccatgttgcccaggctggtctcaaactcctgagctcaagcgatcctcccacctcagcctcccagagtgctgggattacaggcatgagccactgcacccagcatatccgaggtcaattccatacatcaaacaaccctgagaaacagaggacactttccaaaatgtgtctagagctatacaatctattagacaatcaaattccacattaacagaagcaaaacaaactgaatctctggctaaaatgtggtaagtagcagagattcattcagaggaggaatacattttggaaactttgatctgactgggctttgatgatccaggaagcataagcaaagttttcatggagagaatgagtatgtgataagccaacaaaaggtaagggtaagaggaatatcagcaatcactatttataaatattgttttctttccctctgcttctttttttcttttttccctgcctcgccccacaccgcccgccccatgcttctaaaggccagcgtttctcattaactcggctgatggaagtaagcaatattataattagatagccaaaacataatataaacaaaaacagtaaaataacaacattcctctgaaagtgatataaagtttgcacatacaatgacaaattaaatgtcacacaatttcatccagtataattatttctaatttgtagacaaggaaactgaagatatattctacatttagcagtagtcctttaatattaagtggcagagctgtaatccaagttactttggtttattccaaaattagagttcttttcctgacagccaagtgtgatggctcacacctgtaatcccagcacttcgggaggcggaggcaggtggatcaccagaggtcaggagttcaagaccagcctagccaacatggtaaagccccgtctctactaaaaatacaaaaaaattagctgggtgtggtagcacgggcacctgtaatcccagctattcgggaggctgaggctgaagaattgcctgtacctgggaggcggaggttgcagtgagccaagactgtgccactgcactccatcctgggtgacagagcaagcctccatctcaaataaaacaaaataaaacaaaaacaaaaggagagttctttctctgagaaaaagaagccacctaaatgcaattgtgtccctcacagagagggaaagatatcacagatcaccccatcctgtcacatcatcaactgaacaagtcagcatggtaccttggtactgaaagtgagtatgcagatgtgggaaattagaatgttatataacctctacatatttctttaactgaaagcactacatagcaccacagattaatatccgtctcagacttaggcaactgaaaagcaaataaccacaaactacattttcaaaaaccacattatgattgggttaagatacatcacagcactggccatttactaggttgtatctgtgaggaggggaatgaggccatctaaatgtggcacctccacaggacacacacatgggacacacacacacacacacacacacacacgttaacaccaagctgacctttttttcccatggccaaatacctcatcttctctcagatgtgtacaaagcacacatggctgtttccacaacctgcttttgccataaatgactgcccaataaaataaaaactaatgattaacttttgctccctggaaatcactgaaaaagaaaaatatatttcctgaatagcctttgcatacagggcactgactattcccaagctctctgaagaagctttaaaattatttgccattatgagttagtcacagaactaacataaatacataacacagaagaggtcagttcctgaattgaaatatttactaaccacgtggatattttggttgtaaacgttccctgaaaatgtctcttctaaccagcctctgcttatggaacacatggagtctggacagtcaccaaactcccccaattccatatatctggaattggtattattgtagggtcaataattatatacaggttctttgctaagcactagagatacacagtccattagggaagaaaagcaaataaattaagatctcaaagagaaataggacttaaccagaccagatgagaactaccacagctgtgaagaattgcagggctcaaatcctagagaggtgaaactgttttccttagagatctattgcctcaaatggcagatgtaaggctgagaagctgagcagaactttcaatagactcatggcctgaggatataaaaaattggagtttaaggccctccaaggtggaggatctatggtaaaacccctagacttttggttggcaccctgaagaactatacccagggggaactggaaatagactggccattacagggactgaagctctgcttcaaatcatctcaattcctgactagattaaagctaatctgaaatagaagtttctagaagcaaaggtaaatcctttccagagacacatcacactatctagatctcaacctccacaatttttcacataaaatgtctgctagtcagccaaaactaaccaggcatgtgagaaaacaagacatgactgaaagccaagaacaacagaaacagatcaacatggtggccagatattagagttatcagacaaacgtttaaaaatgatgactgaaaaacacagtgaaacagccctgcacactgaccagagcaccttaaataaaacatattgacgatatcaagcattgatgagaagaacagtttttgttctttttctttggctaaaagagaaagtaaacacagtaaactgttaacattatgtagtaggtacacagttatctattacactattttctgtactattctgaatttttgtaacacttcataattaactgtttaaaaaagaaaaaaaagatgtggctagagggatcagcaagggttaaattatgttagccttcagaagtcatgtgcaagaatttatacttaatcagccaggtgcagtgtcccacatctgtactcccagcactttaggaggccaaggtgtgaggattgcttgaggcgaggagttcgagaccagcctgtgtaacagagcaagaccccatctccacaaaaattaaaaataaaagtaacaagacctggcgtggtggctcacacctgtaatcccagaactttggggggacaaggcgggtagatcacctgaggtcaggtgtttgagaccagtctggccaaaatggcgaaaccccgtttctactaaaaatacaaaaattagctggggggcacctgtaatcccagctacttgggaggctgaggcatgagaatcgattgaacacgggaggcagaggctgcagtgagctgagatcacgccactgcactccagcctgagggatagagcgagactctctcaaaaaataaaaattaaaaaaaaagataaaagtaattaagtttttaaaaaatattttacactttattctttggataataagaaggcattaaaggattttaaacaggggagtgacctcatgtgacttgctctctatatagatcagtctagtcacaatgtggcaaagagagggaaggcagggagccctctgggaggctgctgcagtaacccagatgagggatgatcatggcttttctgctggcaatgaagaaaagctataaagacctgaattatggagtatgaattgtctaaggatttggggtttagttctcaaaactgttaaattatatcccagtcaaatgaggaagcaaaggaggccactgggacaaagagaaacctaaaatgagaacaatttcattagagcaagggcaacatccaggataaagcctgggattggtgaaaagaaaaatgtgaatttttctgtaaatccttagaagaaacacaagtagctctaaaactgaaagctaacaagcgctcagctccacaccagatggtcagatagatacattcacaacttgccagcattctaaggccttgtgcacccccttccaagcatgcagatgcttttatctgagatgaaaaaaattctatttctgattctgacagcaaatgccaagtcacatcttgccggtagagaatgacatctcccaaccacaaacccacctagaattttacaaccttattctcattttgaccactacttccaccagccccgctggaaagtaaaagaaactgaggagggatgacggcttctaaagaactcagcttttttatctgcagccctcaaaaagtagatctgttttctctagattattcatgagcagcccatgtgttattctgtgaagaaaaattaagcatatccaacaactttattcccgtattctgaaaaatgagcctcaggcagagtctatttcttcaattgctctgtaatcctatattgagaagatattgaagaattaattttctttatcattaccctttgagccttttcaaaaagttcaggtttaaaattaagcacatcaagtaaccagtctagctagtttggttataaatatacattcttggaactgacttatgaatgactactttgctagagatgggattttgcatgatattctcccccccaatctgttcacaccataaaaaatattcagagatgttctttttaaaggaagcactttccacacacatgtccatgtagtgtctcaatttgtatacattctgctggggtagcttggttttagaggcagggtagtatactatttgcattcaacatttttcacatgccagaataagtaaaacttggacaaacatggttgccttctgttcctaagttataaggtgcatcggtctgacatactaagaggttcaggaattaatcactaaatgacacaacttcctgcttcaacatttaaccagaaaacaccctttctctttctctccaaacaatgctgctgaatcaaaatttcaacccatcagaactcaggcaactagaggcatgataaataccacctagcagatcttaatagttcataataaaacagtaataaactttatagttatttatatatcatgcatgctttgatcaaatttacgagactgaatacaatttctaaagttataggcagatttcctcaaatagttatcaccatcacaatccaggaaaagataacatgctcacagacatttttacaaaatgctctgaggttgaaataagaaacatgcgcttaatgtgcctttagggaaatcccaagattaatttccagagtatgtaaatacccctcggaaacacatgacagcctggctgcagactgcccagaggacagatgccaccattccaagacacatgctctgtgaataatactcactgggttaagcgtttcttcaacagaatgatgaacagtccaccagtctgaagtccattcccatgcgttccccactatgttgtataagccataaccattgggagggaaggcatcaacctaaaaacaaagacaggaaaaatgctgtcaaactattcacctggtttaaaaaacatcttcagtgcagaaatgcagcaagagctttaatttcagagtatgaatgttgggttttattccaacagtcaaagtacaatttgaccaacataaagacaaagaaaggggcattttttttttggctttgagctcttagaggaattcagaaacctaaagagagttcatattaaatggtatgaaagtcagagaaattattcctaatagagttactaatattatcatcaatcaaaaatttgtgtcaaacattgggtgagtagggagaggatagatgatacttagactttcaaaatcattcacaggaaaatcccattggacccaatatgagtcttgtcatcacagctcagctttcctggccacacaatgtctttcagcactgagcgaccccaagtcagttagctctgtcctctccacaagtttctgccaactcatcatcttaccttaagcctcaaaacttaaggggatttctttttataaagaaaatgtgaatccattatcaagtgtattggtaatacagggttttcagtctctgaaacctgagtctgaggcaaacagtatgcattcttcagcagaaaattatacatttcaaaggcaggtcagacagtctgccacataatactgtcacaaacacaggaccaaagtgcagagtttttataaaaggggggagagcaggaggaaaaaaaaaaaaaaaaaactttaactgaacaataataaatgcagaatagttttgctggcttaatggcttaacatttttcccaacattttaaaatggaaattctcaaacataaagaaaaatttcatttttaaaatgaaaaaaatatatatgtatatcaagtaatccttgggggtttaaaaatctttttgtaaatccatgctttttccagactaaatgaagtagaatggaaggaatgaataaactaaaattcattccctgtggcttcagatggtttcacatctacccatgaatatggaagcatctgatgcttgggcaattcagagcactccaatcaaagtcacgaagctagtgtgaaaagaacttaatctggatgagttggaaagctgaaaattctcaccacactgcttccaaaatcagcaatcattatggaaacagcagtatttattcattgattcattcagtaattccatgcacagtgactaaagacagtgagggcttcaataacaaataatgaatgacctcaactagtttaatgagggagaaaaaaagaatatacccaaaactcaaaatccaactctgaaatgcagaatgggatgagtagggtaagagagggaaataaaatgtcagagaaactcgcaagagagagaagcttctggctgaaggcattctcctttacaaaagtagagttgtctgggcagatttcaaatagggctcagagttcaaaagagaacgaagaggccacaggcataaacaactttttcaacaatttggagatgatcaaaaagagcatggtagagtaatagctgggagaggtaggaaggaaaagaagaaattcagttatttcaggaatacaaggaaaggagccagaggagcaagtgcggttaaaagatgaaacaggccaggtgccgtggctcatgcctgtaatcctagcactttgggaggccaaggtgagcagatcacctggggtcaagagttcaagactagcctggccaacatggtcaaaccctgtctctactaaaaataccaaaaaaattagccaggcaggtgcatggtgcacgcctgtaatcccagctactcaggaggctgaggtaggagaattgctaaacccaggaggcagaggttgcagtgagccaagatggcaccactgcactccaggctgggtgacacagcgagattacgtctcaaacaaacaaacaaaaacagatgaaacaaacactggaggaaggaatcattttccagacttatagagcacaggtggaggtgctctcaaatcagtctgcctgaggtcctatgtgtgcatcaatactattttttttttagacagggtcttgctctgtcacccagactggagtacagtgatgcaatcacagctcactgcaacctcaacgtcccaggctcaagcgatcctctcagctcagcctcccgagtagctgggaccacaggtgtgcaccaccacaaccgactaatttttggaattttttgtagacatggggtctcctcatgttgcccaggctggtcttgaactcttaggctcaaacaaacctcttgtctcagccttccgaagtgctgggattataagcatgaggcaccagacccagtgacaccaacagttaacagctaacactaggcaagcaacttaacctatatgggtgctattttgtctgtaaaatgggaaaaataatagtacctactcaagggtttgggtatttttttctttacccaccttaaataatttgatgtttaagtgaagtagaatgtggaggtcaccacccctaaaattaccataggtgagtatgccactaaggaaaataaaaatgttaactgcctgctattaaaccaatctactaactaaagcttcctctcaggaacctcaaaagcaaacaaatgtatatgagaatactcctggcacattttcagatgaataagctgatatgcgttaaagccaaaattaatcattgtgtaacaagcagaatggcaaaatgtaaattctttagtctcactgtggtcaaaatagtttgctcagtataaaatcaggtctagctgggtgtggtggttcatgccagtaatcccagcactttgggaggctgaggaaaaaggatagcttgaggacaggagttcaagaccaatctgggaaacacaatgagacctcacctccacaaaaaaaaaatttttttttaagatagagtctcactctgtcacccaggctggagtgcagtggcctgatcttggctcactgcaatctctgcctcctgggttcaagcaattctcctgcctcagcctcctgagtagctgggattacaggtgcatgctgccacgcccggctaatttttctgtattttagtagagacggggtttcactgtgtttcccagtctggtctcaaaatcctgagctcaggcaatccacctgcctcagactcccaaagtgctgggattacaggcatgagccaccgcacctggccccaaacaaatttttaaattagctgggcatgatggtgtgcacctgtagtcccagctacttggaaggctggggtggaaaaatcacttgagcccaggaggctgaggttgcagtaagctgtgatcatgccactgcactccagcctgggcaacagagcaggaccctgtctcaaataaataaaatgagacctgaaataataaatacatgaaatatcaggtcagggagctatttccctgtagtccatctcattatcaaagttaaattcctgctccagttgaccagagcatgtggacacaaaagagcagcttaggtggacttgagatactacgtgtaaacgattgccataagatagagatctcattaagactcattctaaacacagatggcagctgtctctctctggctggcttgcttgctttctcctctagtcctgtttgtcaaattggttcctttaggactcccagtaaatgttctaatctgttttagtaacttccatggcaacttcttcaggtcaatttcccacacatatgctgaactttcagtcaaatattccaattctaaacatctgtagagtgtccttatttcatattgaacattgtattttttgaaaaggtacactgattttagaagagtaaatggctctatattccttggtagctcatgtaattaaatagaaaagaaactgtagctgcaagtgctgtcaaatatgcataactgtccaagaaaaccctgtcatggccttttgttaaaatgaacaggcacttatatcattcgtttggttcatcaaaaatgcttatcacaggccaggcgcagtggctcatgcctgtaatcccagcattttgggaggtcaaggcgggaggatcacctaccagcctggccaacatggcgaaatcctgtctctactaaaaatacaaaagttagtcagatattgtggtgcacagctataatcctagctactaaggaggctgaggcaggagaatcacttgaacccaggaggcggaggttggagtgagccacgatcacgccactgcactccagcctcggcaacagagtaagactccatctcaaaaaaaaaaaaaaaaaaacagacagaaaaataaaagaaatgattatcacggtcttgtccaaatgagggccacaaaagccatcacctgtgtctttggaatggagctcatttcaaatgagcatatgattatgccaacaaaagaatggtgagaaaggaactcttgtacacccataaaggaaaacatgccccaagtgttctggaaaataattcaaccatatatctgaaactcttaccaagaaaagttttctaacctttgactcaatcatttcactgctgggaatctatctttaaaaaatcatcaaagggccaggtgcggtggctcatgcctataatcccaacactttgggaggctgaggcgggaggatcgcctgaagtcaggagttcaagaccagcctggccaacatggtaaaaccctgtctctactaaaaatacaaaaattagccaggtgtggtggtgtgcacctgtagtcccagctactcgggaggttgaaatgggagaattggttgaacccaggagacagaggttgcagtgagccaagattacaccactgcactacagcctgagtgacagagtgagactccatctcaaaaataaataaataaataagtaaataaaatggctcaaggttgaagtgagtgctcttttgcccgccttctgccttctgccaggggaggacacagcattagtcccttctggtggatgcagccgacatcaatcatgctgctgccttggtcttagacttcccagcctccagaattgcaagaaataaatttctgttgtttacaaattatccagtctgtagtattttcttacagtagcacaaagggactaagactaagacatggctttatgagtatatgattatgccagcaaaagaacggtgagaaaagatttcttatacaccaatagaggaaaacatgccccaagcattctggaaaacagtttggccatatatctgaaactcttacccagaaagttttctagactttgaattatttcactgctgggaatctaatctatctttcaaaaatcatcaaagacgtaggttaatatttatgtacaagatgttcactgtagaaaaaaaaaacagaaataacctgtttccagtaaatacattggggtttatttatgacaggttatccagctgctgaaagacaatgtatttgtggcatactgctaatgacagatgaaacgtttctgatataggcaggaaaaaatagtaggattttaaatactgtatccagtcttacctaaatgcaatatgtaaaaaaatatgatacatatacaccagaaacacatatgctggcaaatacggtagttaagagcatgggctttggaaataaaccgacctggttcaaattccagctgtgccgctttccagctgtgtaaccttgagcaagttagttaacctctctgtgcctcagaatgctcacctggaaaatggggataatagtacctaccttacagagttgaatggacagtaaatgagacaattcatgcaaatgccttggcgcacaatgcccagcacattgcaagcactcaataactacacgccattattagcatcatcaacacagagaacaaatggggaagaaatgcaccaatatgctaacaggtattatttctgggtggtagaattccaggacagtttagctttctcctttatagtcttctcatttttccaaataatctacagtaagtattatggaatcagaaagggaaatccattatacaaaaagaaaatctgtttaattattagtatttgctacgtgcaacagtgaatgcatacacgaagggaacaccgtgtgagtcacaaagtgagcaatgcctttcaccccatgtctactgggagcctcagttctcagcagctgccaccctcctgcagaggtctcattactcacaggcgcagttccttggaagccatcctcaccagtgttggtcaccggaaactcgccctgccaaatgttggcataatgctggcctttgggctgcagtttgttgccccaggggaaaagtctgtcagaagagacacaggcatcagcctgtcaaacaggcacaggttttggatgaaagtcaagagaagggatgcaatgaaaaagagaacattgcttgcttgttctgagtgagccagttaaaatatatatataaataaataaagcttttaatcaggatttattttcaatttccttataacttctcatgtcacgtccacaacagcctcagtcttgcccaggtactcaggaggcctgaaataaatcacaaaactaaaagaaggacttatagaaagctgggagagtagacctcattttggacttatatggtagtgtgatcaggcaccaccacaccacacttttttataaagcctgggctattttaaggagcctttcctagaagatgtgaacccaacatgagttttctgtctcatggctctagaagcagagacataccgctgcttcaggagatgcctaaaataagaaaatgctaaaagcagggcagtctgccaagaagttctaagcagtgatatgtaactcaagggggttgaattgctaagacttgctttggggctggagggagcccacttggccagacacttggtttaggggtgataaaagatttgtgacccattctccagtgtcttctaagtaatttcgtggaaaaataagaaaaagaattattgtcgttattaactttctaaccaaagtaagttccatggagttttttgttgttgtttgtttgttcaaatgaccaacatattgtcaggcaaaatgagatcctctaaatacctattatgcaggcctcctcgacagctgtattcccactcagcttccgtgggcagccgcttccctgcccaagtgcagtaggcaaccgcatcattccaggacacatggagaactggatgatccggcctggggaagagcaaaagtagaatgaaaagtgacaccaatcagaacaagaagcaggagctggcttcagcaaagcgcccataatccccctcagttcaatctgtgacactgaggtcatcctggtccttaagtcaaaccccagccatgctacatctgtcatgctccaccaacggtttctgacaacccaggctcccaaatgggttacagttccactgggaactagactcaaaacatttcttcactttgtaggctcggattcccacagaatgtcattggtatggcagatgcggagatactccagctgctaggagggccagcaggagctttcagctcctttggggttcagcagagctgacagccatctcagagaaaccagtgactaaccaaccacagcaggggcatacagagccagccatttcagcctacagtggctcaacctatgggccatatacaccctagaggcccctgtgttgggtggagcttggttggacctgcattgtggctttgacttctccctctgcccagtcctgctctggcccctgctttctacaggtgtggggccctaacattctgcatcctaaactctgtttcagcctctgtttccagagaacccaacctgtgacccttggctttcaattctgtgtctttctacttttcctctacaagaggccggtctttttttcctgagggtataaagggtgtggaagtttggggaaaaaaaactgagaaaaaggggatagactcattcacccagcactagatggctttggctgaattccctgctcacttttttaaaagtgggctacaaattcctagtccattccttatacacctttgaattccccacagtaattacaccaggcctttcatttattctttcaacaaacatctactgagtacctatcatgtgccagtcactgtttccagcacagacaacagaggtactcttctcagaagatccatcggtgttgactgcatggataacatacattccccttttgggttttccttcctcccttagcattttcctctgttactaaattcaggaaagcagatattaactgggagctaagaagccaagtccacctgagaaacccaggaatcctatgactttccacctcgaagcctaattgcagcacagcggcttccaattgaggctttgaaagatgtttgacatttgtcaaggggctatatccctaaagctgaacttcctatactcgcagctccccgacaataagggcaataaccaggaatgttgttaaaaatagagacttaaaaactgcatctgaaaaattaggttaggagagcaggtttcttgggctgctgagatgctgagtcctaacccaaaccttgctcaatctccagggtttaaagtgttactctatttttgcttgagataattatttccttgccaccctggagacttgctgaccgacttggctctctgtggttttccagttagatggtggcttcaaagaattccaatctggaactcaagatcatgtgaatcctatacccaaggcctgggcttccacagtggcaacctgggaggacacaattacttatccataagacagacgtcttcttcctcatagacccgctaataatggaaacagaatgtaaagattaaacatgtcatgaggtttggaataggcctctcaaaaggagcagggaaactgggaagaggcaactctttgacaagccaaatgaggagagaaagaggccactaattaagagctttcttatgagcaaggtgcagtgtttgggtctttacatacgttatttcccaccatcttattttcctaccaatcaattacagtttgtcattcttatcattttatagatgaagatgcccactgagttcttttgcaagagcaaagggtacctattttgcaatggaacttgtcaactggggaaagagggaccagcctcacctgtgcagaatagtagagtcaggcccttctgggtgtctccagttagcgcctttcacaggtaaccaccagggagcagctgcaacctcaaagcaacccagaacaggctgatgttagctactaacatcaactctagaaaaatatcaactcagtacatgcagcaaaaatctcaatgtcttcaacttccatttggattaccaaacaaatacatttgccagaataccaaaataaagacttatatgtaaataaatctttaacaaaaaaagtattacttcatatcataaagcctcacagcaaacaaatacatatgtatttaaatggtgtatatctataagaattttttttttttttttgagatggagtctcgctctgtcgcccaggctggagtgcaggggttgcaatcttggctcactgcaacctccgcctcccaggttcaaccgattctcctgcctcagcttcccgagtagctgggactacaggcacgtgccagcaagcccagcgaattttttgtatttttactagagacagggtttcactctgttagccaggatggtctcgatctcctgaccttgtgatccgcccgcctcggcctcccaaagtgctgggattacaggagtgagccaccacacccggcctctgtaagaatttttaaaaagtgcatggctagccaatcctctataatctctaacaagtgagacaggtagtgctgctcctatttaaaagatgaggaaacagagttaaccctacaattaaatgtgaggctaaaggtcaaccatggtggtcagagatcaagctgaagcacagaagaaaaaatggggtgtattttcaaaagaccccgattcaacttccaacccaacattagctgggtgaccctgggcaagttcactacttgtctggaccctcctagtccttgtctgtgaaatgggagcacacccacctgcctcacctaactcagaatacagaggtcaagtgaggtaagattggaaaatgctcagcaaacagtaactagaaccttaactcctactttatggttctgttaaccaaaataacaacagtcaggagtcctcatttagtgagtggtttagttaggaacacaggctttggagccagtcaaaatgagatttgaatcatggctctgctgttcacggtgtgaccctaggcaacttatttaacctctttccccaagcctgttttctcatgtggggatacagatagtaacagcacctatatcttgggttattacaaggaggaaatataatacgcatacaggacttatgactatgcccttagcaactgaggttaatgactcagcaagcactcagtaaagggaaccagtctcactatggccccatgacactcagtcacaaggagagccacaaaaactaatcattgttgctaatactagctaaagaacagatgttgcaaatgattctttttgagacagggtctcaccctgtcccctaggctggagaacagtggcacggtcatggctcactgcagccttgacctcctcagctcaagtgatcctcccgcctcaccatcccaagtacctgggaccacaggtgtgcgccacaatgcccagctaaattttttgtatttttttgtagagatggggttttgccatgttgcccaggctggtcttgaactactgggctccagtgatccctgcccaacttggcctcccaaggtgctgggattacaggtgtaagctactgcacctggcctgcaaatgattcttctaatacaaatacaaatacaaaagaaagtgactcaaggttatccccacaacaatgttactctttgattgttttcatccttttgagcttgtctgagtagaagttaagggagaatatgtccctgctaacaattacagcaatcactgaaaacaccaagccccattcttgttcattctcttttcacatcaacacaatcagaacattcatgatatctcaatcacaatttgatgggaaaacccaatttttaaaatatttcaacaaaagaaggcattaggtccttaaatgacactatagcaaggtgttttattttacagagaacaggggagtgaagaggcatggcttctttctatttcatttgtggcgctgtagaagttcctctgggggctgttctcactgactgggctgtgcaggtttaggtgcccatgacaggtaattcattcagtgtcaagggaggagctgcagtgaaagctcaggtcagcccacacttgtgtttcaggaggatcctcagatcattcttccaactctaccctgtccccaacactaagcaccaccaccagaaggttctagttcttaaattaaaaaataaaaataaaaaagcttaaaagaatgacaaaatatagcaatatgttaacctccatgaatgacttttcttctcatacccttttgtgtcttaaaatatttcatcattagtgatttaaaaaaaaaaaaaaacatgatttgtttgtccattctactactaatgggtatttgggtagtttccagtttggggctattatgaatagtactgcttctatcaatattcttaaaagagtttgtggcttttggcaaatatatgtacgcatttctgccgacagtacatggtggagtggaacagctgagtcctagaatacacatgtgcacagctttagtagaggcaaacacaagccttaaacaggagaaggcccctgccatttcctaccctcttttcttcctttttttttttaaaaaaaattatgtatttattttttaactttttatttccataggtttctgaggaacaggtggtatttggttacatgtgtaagtgctttggtggtgatttgtgagattttggtgcacccatctcctaagcagtatacactgaacccaatttgtagtcttttatcacttcccctgagtccccaaagtccgttgtgccattcttatgcctttgcatcctcatagcttagctcccacttataagtgagaacatatgttgtttggttttccattcctgagttacttcacttagaataatggaaagagcgtggagattccctaaggaactaaaagtagaactaccacttgatccagcaatcccactactgggtatctacccagaggaagtcattacatgaaaaagatacttgcacacacatgtttatagcagcataattcacaattgcaaaaatgtggaaccaacccaaatgcccaccaatcaacaagtgaataaagaaactgtgatacacacacacacacacacacacacacacacacacacaatggaatactactcagccataaaagaatgaattaacggcattcacagcaacctggatgggattggagcctacccctttttcaaaggggagctttccctcaagtcagtttatgtatagaagtccctagggcttctctctagtgacctctcagcccatactcttctactctccttttcctctcaattcaatctggttacaaatgtttattgagcaccgactgtatggctagcactgaacctgattcttggaggggatctacaagtcccaggaatcctcagagtatgactgaagacaattggtatattaaatagttttaaaagtatttattttacatataataattgatatagtttatatatttatccccactcaaatctcatgttgaaatattaatataatccccaatattggaggtggcgcctggtgggaggtctttggatcactggggcagaacccttatgaattgcttgggccgtccccttggtgatgagtgagctctcactgtgtcacaggagatctggtcaaaagtgtatggcgcctccctccacctcactctcttgctcctgctttcaccatgtgaagcgcctgctcccacttcgtcttctgccatgatcgaaaggcctgaggcctccccaaaagctgataccagagctacgtttcctgtatagcctgcaaaaccatgagccaaacagacctctttctttatgaactacccagcctcaggtatttctttatagcaattgcaggaacagcttaatacaaaaattaattcctcagttgcaataattggcatagaaaatgtgcaattagtcatctcattttccttgataaatgtctctaaaattcaaattgatgggtccagatatcaccctacacatattagtactatagtttttttatctccttccacccgctaccccaccctctgctatacacacacctactcactcacactttctctcattctagacacccgcttttcttttttcccagcaactattctttctgaaatctttcatgctaccctagcaacccaaaacacactacttacttaacgtcatggagctatatgatgatcaccaatctcaatgaggtgcacggtaagatggaaaaaacacgtgaacacactgtggccaaagcatgagaaagaggacaccacgacaacactatccttgaccaaaggccgcaacctagtgttttggtccaaaatagtaagacctgaagcaagtatgcaaagatatatgtatagtaaatctagacataatatagtttctaacttaaaattacaaaataacccaactgtccttggtgtccatgaaaaaaggaatactatacggctagttatcaaaatacactctgacatggaaatatgaaaataatatactgtcataaaggtaacctatagaatacacatttgattccgtttctataaaatgtatgcataacaatgtttgttagtatcatcaggaaaaaaatgtctggaagaatatacataaacttaacataagcgaaggatcaggagagtactattagacatttttagaatgagtgtatgtcactatcacaggttttctcaacctcagcactgctgctattttaggccaaataccttgttatgggagactgtcttatgtattgcaggatgtttagcagtgtctctgacctctacccaccagatgccagttgcatccttcttctcccatgccaactgcggcagacaaaaatgtctccagacattgctaaatgtcctctgaggagagcaaattatctactgtattatgataattagggaaaaaaagattactcttcttaaatattaatacacagtttatagtagcatagtggtaagagtatctgaccctggagtcaagctgcctaagcttgaacaacagtatcaccttttacaagctacaagatcttcagctgcttatttaaccccttcaggcctcagcttactcatctgcaaagtggggataaaataatactatctacttcctggggatgttataaggattaaatttaaaaatacatgtaaagtgcttagaaaagtacctggtacagagtattagctgtcattattactactattcatttatgttattacatgttacaatattctcttagagctttcagagaacatatattctaattagtgaaaatctacccccatatctgttcagcttgagccccctccacccaccagttcacccttttcagagtactgatcaactgagaaaagtgaccaagagctaaggggtgaaggaagtattggaacatgtgtcacttccaaagacttctcaagaagatgtaccatcttccatcacagtcatgatgtgagaaccatctacacataaactaacccactctctaaagcaagcagcaccatgagggtagggcaaggggagtgtattagtccattctcatgctgctaataaagacatacctgaaactgggtaatttataaaggaaagaagtttaattgtctcacattccacatgactgtggaggtctcacaatcatggcgtggtggaaggtaaaggggcagcaaaggcacgccttacatggcagcaggcaagagggcaagagagcatgtgcaggggaactcccttttataaaaccatcaccatgtgatctcagagatcacatcagatctcatgagacttcactctcacaagaacagtgtgggaaaaacccagccccatgattcaatcacctaccaccgggtccctcccatgacacgtaaagattatgggagctacaattcattcaagatgagatttagttggggacacagccaaaccatatcagggagggtgtgaggggtaaacagaatacaggaggtatccacattcctcaacctccaaacttcagaaagcttgggcccctgtaagggaaccaaactacacacttgtctgtctgtaagacagatcataagtcaccactgtgatggtcagatgcagagtcagaaaccattttcccatttcacacatgaagaaggagagacaagtaatcaaagtcaccccacaactgaggactgacgaaatcagaggtagggccttattcatcctgcgcaagtttcccttggaatgtcaaatattttctggtcaaatttagggcaaatcccatccaaactcactagacgttttccttttccaagtgtcactgtttctaaacatttcaaataacttgttcttgaactcctgattctgtcttgaaaataagtgctattctactaggtttaggaacttaacaaaacaaacaacttttaagagtcatatattaggcatttcatcaaggctatactgcagattgtgacatctataattccttttaacaggaatagtgttcaggtgtgttgtttacagagcagaagcagcagcatgagtggactggcatctatgataaacctcaacctaaaaagagacaattttttttggatgtggttgtccacctacacattctctgctcaactgagacaatttccagagttacagcactcccttatatccagaggaaaaaggactttaacatgacctatttctagtcaaccatctccatagcaactgtctagggtttaagttgaaacagctgtatgagccagccagtgaccaattacaatgtaaataggacccacgtgagttttgaggtccccttgagaaatggacttcagagagcaaagacatgtttcccacctctccctggggacataaccagacttgtagtagcagcttaaagaaaaggaaacaagacagcaaaggtgcctttattcttgccagaggtggcaaattatgcttcttatacacacacagcccagaataaaatcagcacaggaaaaagaaagctctgtataattatgcatactcaagtgtaaagatgtcaagtgcacaactttacaactgctctcttaaaaattaaatgcatttagacaagcaaatttaaaagatggacgtttcttgaaacgtagtataaacatgacagctacccctataaaaacaacccgggagaatttttcaactggcatcagtgaacaatgagaaattacagatctgctcaaattcatgaagtataaataaaaccagaggagaatttagcaactgaaggaattaaatggagtaaagagcacacagtaaaaatatttcctcagtacccaacacaagtatggaaagctaagaatgaggcttgaataaaggctaaaaacaaattcatcatgaaagtaggtagtcaagtctgacagcttacttcaaattaaatcctaaatcaggtaccctgatgacttaatagactgcatgggagagaaaaatgcctgctttttcaaacagggtaaaaatatttatgaaacttcaggcagacttgaacttttcaatactttttggttcagttcttagtgaaatccctcatgctataatacattgcattcccaaggcacacaatcagtaatcagtacactcaaaacatttcatgtccttaagaaaggagtggaaattctaggcagaatttctaggcactattgagaatgtgcaaaaaatggcccaaggaatctatggactcaaagaagccttaaaagtgatctagtttactcattttcagttaagatctgcataattatcagggcagggggaactgatttggggcttgtaaaaaaaattaacaaaaatgagagaaatatttcttattatttaaaaacaatttttactcattttcatcaaataagtaactgtaaattggtataacctatcttgaaagcaatgtgacaatattcagaatcatttatttcataccatttgaacgaatacatcatagtcattaaaaattatatgctgaaaaaataaaatttgaataaatgtctgccctttactgaaagtgaaaaaagccagttacaaaaatgtttgtacaaattcaattaaaaatacatcaatatatagagacacccacccacatacccacatatcccaagaaaatattagcagaacatatatttaaatgtttgtgatgattatttctgggtggtgagattatgggtatatctaatgttcttcttgtgcctttttttttctggagagagggtcttgctctgtcacccaggttggagtgcagtggcactatcatagctcactgtaaccttgaactcctgagctcaagcaatcctcccacctcagccttacaagtagttaagactacaggcacatgccaccacacttggctaattttttcaatttttgtacagatggagtctcgctacattgcctaggctggtcttgaactcctgtcctcaagcaatcctcccaactcagcctcccaaagtgctgggattacaggcatgagccacctctctaggccctgttccatttttaatgtctgaaacgtctacagcgaacatattttttattcatattttcattttagttttagttttttcttttaatggagctaagacttaattttacattgaaaaaacaaaagcaatatcaaattaatgttcattaaaaattacttatattcatcattccattacaaattttatttttatattcatcttccagcttcatcagtaagcatacacatttttacagtttttccaaattttatattgaatgttttcattgattttattgaatatttttctatgttttatctgaacttcataacgatcactttcagtggctaccaatatttttgtcttgtcaatacactataatttccggtctcctaacattgaaccattcaggttatgttcaagtttgtctgttgttgtttttttgctattatagataacactacagtgaacatgttcaaacaccttcatgtacattttttgcttctgctaaatttccacaagtagcatcactgtaacctgagagcgtgtctttatagcccttgctaaaaatcatttacaaaaatcctcaatattattagatggtacggttagtttccctctggaaagacatctgcgtgtacacccaagatgaaggtatttatttcaactctgtaagaaggctccacttaggttccttacattgctagtagcttacttatagatctttacaggtcttttccagtgtctaaaacagggaaattacagaaagttggaatgccatctgattgcttctatgttattttttcacgccttacaagctctcaagcttctgagaagagaggtcaaagagaagacagaacatagaaaaggcattttaagaacaggaaattctcccacacacgttgtcttggaggtaaacaacaatataaataatctcatttattatttgtaaaagacaggaaaaagagcatcctcaagggacaggggctcttgttgcaaaggcagcacagggtcacagcctgagatgatctacttcctacttatattaacagtaagagacatacacatgcagatgaccatataacatcatggctctgttgctggcccttcaaacgacaggctggtactgtaccagccaatctcagcccacagccacaagaacacagaacaaattctgaacattctgcagagctaattcctcaggctgccagcctggcacatctcatctcaccgggcagcagaacactgcaccagtggcaaggtggtgactgctgattctcctgctggtggaggcaaactatgcagggaacatttgcatacttttaaaggattttaaaagtatgcttttaaaggactttaaaggtgggaaggatctgagaagatatctactgaaattccctcattttataaatgggaaaataggccctgaaaagcggcagatagtggcagagccaggaaaataacccacggctgcagggttacaattcagaactttttccactattcaagcacttcccaacagctgtttcctgacagttttccataagatggtagtaggtacggagaataaaaggttcccaccatcaaaggagtcacagtagttaggaaagcactgggttactcaaagttaaactaatttttaattgcaggacttctgagaatcttatcaagtgtatggtaagtcttgagtaacgggacagatagtaggcacttgagccaagtggctaattctgggtgccaattttggctctcctattacatcactagccatgtaatgttggttggacaagtgactttcctctctgagcctcagtttcctcaatcagtaaaattagtatactatgaaaatttctcatataggctcgctaggaggatataccataacaagcactcaacatgtagttaggtatatgtgggtaatggcacatgactacgaatctatagaataggttcatgatgctatctacgcattccgcaaatacttggtgagcatcttctctatgccactcctgtgctagcccccggggatacagaaccaaagtacatcattgagaagggaagacaaacaagcagatgatttcaagcctgttctaagtactgtggccaagagaagctcaatgagctatgggagccaaaggtggggcacccaatcaaagtcaggggggtgatgccctgacagtgcttcctgcgggaggtaagaaggaggagcaagtaaggcagggcaggagtgggaagggcattccacacaggaggccacctgtattacaggtgtacttgaactaatccagaaaacttgggcatcaacattttttgttaaataaaatgtaccaaagatcttcagaaccttagatctggaaggatgccaaaaagttacttgattttaacctgtacctaaaagcatcccctctatagtgtctctaggatgaacagaaataaggtaggatgaataccattccctatttgacaagggaagtccagatttatacctgttgatagtgggaggaggcagacaaatgcctaggcaaatagagatgggtcaatggtgaaaccccacctccaagtggaagacagtttaaagcctgaaagccaagctttaagtcaaagccacagaccggattgagaacctgccttcccatttggcacactttcctctgattgatccccatccttcactaattttacatatacctaccctttcctaattggttttctacactgccatgcccacctttgagtggtgtctttgctttagcctttctttgcatacacacaaaccaatcagcatgcattcccctattctgagcccataaaagccctgcactcagccacactgagagagaaaccacccaactgtgggaatgggggaccacccccatgtcccctctccactgagagctgttgcgtcgctcaataaaatttttctccgccctcctcactctttgattgtcagcatatcctcattcttcttggatgtgagacaagagcttgggacccactgaatattggagcagaaaaggctgtaacatcatggccctctgcccttcaccggcacagagcagccaccccacatgacagaaatggtggtgaggccaagctagccctgaagtcacagaccaaggtggggcaagggcattgctagcaaggtatctccggctggcaaaagtgattgagaaaagtcctaagtcagtattatccaagcataattaagagcatcccatttcgctgtcaaaagtgtcttgatttggacaataaattatgaagtcagtctatgaatagatggtcccacagtctcagcttgaacaatttgggtgacagatatcacttcctggtaggcagtccctgtcatgttcagatcattctaacagagttcccaatctatagctaaactgaaatctgtctcctggagaccttccctctgctgtccctttctaggttcccagggatcagatggaatagatcaagttctttttccatcatctttcagacatttgtagaataatcataactcattcacctcttagtctttaggttcagtaatttattcaacctttcccaggaactccaatctcaaattaagggcatcaccatctccccaaaacccaggagtcatactagattcctgtcttttcttttctctctatgctttcagaggtacttccaaatatcagatcacttcttagcttctctcttcctaccacctggttcctcagacccatcatctctcaccaggactatcacaaaaccccatacagaaccagagtggtctctttaaaatgttaattagatccaatggcttctaactgtgtttcagatgaaaaccaaacacctttgaggcctacaaagctctatgtaatccaaccctgcctacttctccaacctaaccctgaccctacatcacagtcccccttgttcctcaatccctccctactggtcatgctagccttgctcattgtttagatttcagctcagatgtcatcacctcagagagaccatcaccaatcctataaataaaagacccaagagcacaactgcattatactctaatcattttctatccattattctgttttatttgaatcgcagtccgtcatcacagtcagttataaatttacctgtttagagtctgttccttattagaattataacctccatgagaataaggatttagatctagttatctgttgtatctatggcacttaaaacacaacctagcccctagtacatactggataaacattatttttcatgaaaaaagtcctctgttccttaggtttgcatgatttccaaaccccaccccacccctgggtgaccctcttccgcataaacatcaattttaaatagtctttcagtgggatatccttttgtgccacttcgtgggccattgttgcctcatctataagattttttgccagataattctgaaagtttcatccattccaaattcttatttttgcataagtttctcttaaagctagacatccctcagcatgactctctactcaacagtttacctttgttttcccacagaggccgacgatacagagtccaatattcgaggggcagggaacatcagaatcattgttacctcttaatctaagttaggcctcaaaagaaccaagacatgaaaagaaatttaaggtcacattaaacaggtatttcaaatctgcacctctgggaccccagcatgcctcacacacactcattcagatcaggtgtcttggagcaggttagaaaaaaatattgtgtgccctgttatcctattatattaggttctcaccttccagggttatcatgttttgcttcctgagcttatgccacacactggctcctaagtcaagtgaacaactactcttttcaaaaaaagacacaaaagacagtgttaccttcttatctcatctagtcagccagccctggcctgcccttcccgaataactcagttaccgtgaacccaccttcaccctgttgacggggccagtgttctctccccaaggaaaagctgactttacaacatgaaatgggtcataccaggtctgagccctgctgctttcaaaaactaaatgctcccatagatgatattcaaatggcattctttcacattttggcatagtacctggaagacagtgggacatctagagttgtatgctgaacacacagaccacatcttaagccagaaagcaaattgtcacagaaggaattagactcacttccatcactagaagtcaaagaacacaccccactgatggataacagacctcaagaaggcatgaatacaaatgacaggtcaagagatatgtcaccatacatatccagaacaagtgaaagcaggggttcgaaggaaggacattctgatacatactacaacatggatgaaccttgaggacgtgatgctgagtgaagtaagtcaggcacaaaaggacaaggattccacttacgtgaggtacttagaataggagaattcacagaggctcaaagtacaatggaggtcaccagaggctgaagagttattgtttaatgagcatacagcttctgtttataatgatgaaaaagttctggaaatgcataatgttgatggttgtataacactgttaatgtacttagtgccactgaattttatgcttaaaaatggttaaaatggtaaattttatgttatgtatagtgtaccatacacacacatacaaagtatgttattagtatattcctccagccaaggcttctaagataatctaagaggatttatttcatagtaaatttcacaatttggtattccacaatagtaaatcttttcaaaacatcattgtagcttggcagaatgctatatgaggcattaccaaatcttataaatgcgcaacagtaaaggaaatttaacttaattttcaattatatcaagcaaagagatagtccactggaagaaactagaacaatgtcatttactaaaaggccttctatgtgctaggtactgtaccaggtggtactgtatacattacttgatttggtctttgtaacagctctatggggtagcattattataagagattgattaaaacaagtaaaatactagtgaataaaaaactacaatgttgtgctggcatgaaaaaaatgaatgaacagagttgcagaatgatcacgagctttaggtgagacaaaacttacagtctgttcctaaccaggttgattttgctggaaaaaaaaattccctagagaattgtaacaagccccagagacccgatactggagggaaaagaatatgaacagatgccaaccccaagatgacccagaagttggaattatcaaagactttattttttaaattttcttgagacacactttcactctgttgcccaggttggagtgcagtggcgtgatctcagctcactgcaacctccgccacccaggttcaagtgattcttatgtctcagcctcccaagtagctgggattacaggctgcaccaccacacccggctgatttttgtatttttagtagagatggggtttcaccacgttagccaggctggtcttgaactcctaacctcaggtgatccgcccacctcggccgcccaaagtgctgggactacaggcttgagccaccgggcccagacaaagactttaaaggagctattacaatcatcggctatgaagcaaaggtgaatggtctcgaatggaaagataagagctctcagagaaaatagggaacctgaagacatatcaacagaaggtacacaatctgaagaacacagagaaaagactactttaaaataatgaacaagcctaaggaacctctgggatactatcaaaaggtctaacatttatgcactggagtcccaaaaagagaggagagattggtgtttaaaaaaagtgaaataatatctgaaaaaatcccaaatatgattaaaaacataaatggacacatacaagaatctcaagaaaccccaaataggataatccctaagaaaacatgtccaaatgcatcatcatcaaactgttgaagataaaaaattttttaaacttgaaggaagacataaaataatgccacaatacatgtaagagaagtgtttgaaatgactgtcatcagcaatcatgtagaccagaaaagattgtgaatcaacatttgtaaagtgatgaaagaaaggacctgccagctcagaaaattcccttcaggaatgaaggtgaaataaaaacatcagatgaagaaaaactaagagaattcattaccataaggcttactctaaaaaaagtactacaggaagttttattttaggctgaagagaaatgataccagaaggaaacatggaactttaggaatgaaggaagagcaacagaaatggtttggataaatataacagactatttttcttctttaaaatatgtacgaggcggggtgcagtgatgcacatcgataatcccagcagtttgggaggccaaggtgggaggatcacttgaggccaggagtttgagaccagcctgggcaacatggcgaaaccccatctctatttttaaaaagtaaataaataaattaaattaaatatgtatgagtattgcaagaaaaacagcagaacatagtctaggttttttccaatgtatgtacatgtaatatatgacaactctaacacaggggatggggtagtagagtctatatggttataggacacatttacttaaagtgttaaaatgttaacactataatgtcagttgttatgtacgtatattatattgtaatccttagagctaccactaaaaataatactaaagatatagcccaatagacaacagaattacaatggaatactgaatacatatagacatagatatagatataaacaaaaacattcaaaagtgaggttaagagacattggaagatggagtgaggaggtctagccaacatctaattggagtttcagaggaaaataagtgagaatagagaaagggcaatattcaaaaaaataatggttaagagtagagcagagttgttaattaaaaaaaaaaaaacttcccaatgtatgggttaaagaagaaattataatggacattagaaaatatttagcaataagcaattgcaaaactattaactgtagctccacaaacacttgcagaactcatgaaggagattaacatgctacagatcctggaaacccagtgaaactcaagcaggataaatacaagaaatcaacacctagaataataaagacaggagataaccttaaaatcagccagagctgcatcacctaaaaaaaaaaaaatacaaaaaacaaaaaacaaaaaaaacccaactgactaatgactgacttcttaaaggcaataataaataccagaagacagtgaaataatgcctttagtgtgccaaagaaaataacttccaacctaaaatttttacttagtgaaagtatctttcaaaaatgaggtacttaaagatatttcaaataacaagaaagtttactaccaacggatatcctttaggcagaagagaaattgatctcagacagaatccctgagacgcagaaaggaatggagagtacagatattagtaattataggagtaaagaaatactgactacataaaaaagtattaaccatgtctaattagtggaggaagaaaacaaattagaatgaaagagtggacaccagtaatacgtaagttggataacgatgactagagtaaggtcatgggattattcaacagaaaagttaatggaataataaatgttaaactttatactcaagtattaaaattgattaactactaaatgaggagatataaagtatatgacttctaagaagacaagcacagttggaataagaaaaataaaacacaggccagaaattgaggaaaaagaagagacaaaaacagaataagcagaaggcaaagaataagatggtagaattaaatccaaaaatgtcaatagccacaataaatataaaagaactaaagtcttaactgaaagacaaagaatgcattactttcaaatgcagctatatattatttacaatgatatacccaaaaacataaagatacaaattaaaagtgaaaagaaggctgggcacggtggctcacacctgtaatctcagcactttgggaggctgaggtagggggatcacttgagttcaggagttcgagatcagcctggccatcatggtgaaaccccatttctactaaaaatacaaaaattagctgggcgtggtggtgcactcctgtaattctagctacttgggagactgaggcaggagaatctcttaaaccctggaggcagagattgcagtgagctgagatcgtgccactgcgctccagcctgggcaacagggcaagactgtctcaaaacacaaaaataaaataaaaaaataaaatgaaagtgaaaaaaagaaaaagtatatattagacaaatactaaccaaaagaaagcttgtacacctatatagtagataccagacaaaatagactttaagataaaaatcattatcaaagtaaaagagaatctctatataataaaatgttcaattcaatggtaagacatgcttttcttactattttaattatttcattttataaatagcataaaaacttttttctcataaaaatatttcaatattaatttcaatagctataagagcaaaaaaaaaaaaagatctcatagaaatacatagattaaaaagaaagatgcacctcattaatgacaaagattctctccttgactaaactctaatgaggctcctctgaactctcctttcaactaggccctgagttttgggcttccaagctcatctctgcattgtccagctgcaccaagaatcctgctaagtcagtttgcctaccctcaaatgtgtgatcacccttgatatctgatcaaactcctcatccttcccagtcccccaggtgatgtctgatcacactgacctgccttcagcaagaatcctgttaggccagttgagccagaacccctacttacctctgatgtttcctcttagtaatttttcatctgaggaagacatacttccaaacttacatacgcttagtaacatagctttaatatatataaagcaaaacttgacagaatcactaagagaaattatcaaatctatcatcttaaatggagattttaacaacactctcagcaattactaagatcaagcagaagggaaaaattagtaaggatatagaaaatttgcacagcaaaattaacaacttcctataatggatatgtatagaatattgcacccaattaatataaaaaattatttgcaaatacacgatttatttatgaaagttgacccctggtaggtgctaaagacagccccaacacatttcagggaccaatatcataagggccacattctctgattacagcctcattgagttagatctcaggaccaaatgatagcaaaatagctgcacgctaaaaagtaaaaatcttataaactatgtgttaaagaagaaatgataatggacattagaaaacatttagaaataaacaattacaaaactactataacacttgtggaactaaagtggtcacttagacatatgcagactaaaatgtttacattagcaaagaagactcaacaattttaaactatgtattaaacttaagaagtcaaaaaaagaatagcaaagaagttaagtgaggccgggtgtggtggctcaacgcctgtaatgccagcactttaggaggctgaggcaggcggatcgcttgaactcaggagtttgggaacagcctgggcaacacagcaaaactccatctctacaaaaaaatacaaaaattagccgggtgtggtgggcgcactcctatagtcccagctactcgagaggcagaggtgggaggatggcttgagcccaggaggtcaaggatgctgtgagcagagattacaccactgaactccagcctgggtgacagagccaaaccctgtctcaaaaaaaaaaagttaagtggcttttcccaaaatcatttgataaatggcagagctgagattcaaaaccaaatctctctcactcaaaggctatcttttccttatgacttttccaaataaacaagtgggtttgggcaagaaaagtcttagtggtctcataagagaaaaaaaaatctttcttaaatttctttttattttttaatttttattttttttttaatattagagatgagctttcagtatgtctcaaactggtctcaaactcctggcctcaagcaatcctccgacgtcaacctcccaaagggctggcagaagccactgcacccagccaagaaaaaaaactcttaaagcagaattgaagttttcaagatggtgttgcttaaactactagaaaactaaaagttcaaacattcaaaatgatgctgagcaggctgggcatggtggctcatgcttgtaatcccagcactttgggaggccgaggcgggtggatcacgtgaggtcagaaattcgagaccagcctagccaacatggtgaaaccccgtctctactaaaaatacaaaaaaattagctgggcttggtggcgggagcctataatcccagctacttgggaggctgaggcaggagaatcacttgaacccaggaggcagaggttggttgcagtgagctgagatcatcacaccactgcactccagcctgggcaacaagagcgagactctgtctcaaaaaaaaaaaaaaaaaaaaagatactgagctatttatctgacttacatgtgttttgagttattttaatttacttttcctatgtactgaaacttgcccttctgaatactttctggcttagtttacattgaagttaacttagtaaagcttttctaaaaattattttggggagtgtgaccttagaattccgctggacctcaaggcatttctcattacaacccacacacattcaggtaactggatcgcatccttattaacagttctctttctagtttagagttgtcgtgcagttgtgattaaataacagcgggtcagactgcattattctttgccttctgtcccagtccagtgtcatccaaataacaaagcacccagcaccacttgggcaggatatgactgcctagaaattagtttttactgcagggggaaaaaagatgcttggtaattctcatccttcaatgaaagtgactttcagttgaaagaacttaaaatagcctactcctctcatttgtcaaggatacttagtcaggaatttgtttccttaaactgttgatccagaaagtgccaagctacaaatgaagagagaatccttgttcctcaagctcccaccaacagcaactgttttctacccagcctatggctatcccttgtgtcaaagttttacgagtcatattaataacacaattatgaaatcaaaacagtctttatcttaaatactggaagtatatcttaaatactatcctttttttcaagaaaggagggttatctatagcaagggtccccaacccctggaccacaaaccagtactggtctgtggcctattgggaaccgggccaaacagcaggaggtgagtggcaggcgagcaagcaaagcttcatctgtatttacagcccgctcctcgttgtttgcgttaccacctgagctctgcctcctgtcagatcagtagcggcattagatcctcataggagtgtgaatcctgttgtgaagagctcatgtgagggatctgggttgctggctccttgtaagaatctaatgcctgatgatctctcactgtctcccatcacccccagatgggactgcatagttgcaagaaaacaagctctgggctcccactgattctacattatggtgagttgtatcattatttcattatatattgcaatgtaataataatataaataaagtacacaataaatataatttgcttcaaacatcccaaaaccatcccctcccctgccccacatccgaggaaaaactgtcttccacaaaaccagtcccttgtgccaaaaaggttggggactgctgatctgtagtataatatccccccaaaaaacaaacactgctacaatagcaaaacttgccttaatcccttctgggacttaatatctataccttttaagattcttgtctcaaattaaacgtccaaataataatcatgagtaattcatgattaattcatgattattacttcgataataatactctgttttaaaccattaaattcaccagtttaagatatttttacacacaaactctgaaagctagctcaatgttttacctcaaaactacataaaaagaaaactagctgagatggcaacagcatcagcaaagcttttgaatctcgcctctctacgtataaaaccagacagaacaactagagagcaatacccaaaacccaggaacaatgtgcacagcaaatccatgtgacaaagtatcctcaccaaacccagaacgcaaacaggtgaagaaaaaccgccaacggccatacaacctgcatggtgtctgtggctgggcagtggttgggcaggagaaagaaaagaaagcaacaggaaatcagacctgtgaaaaggaaaatcccaaaagagccaacaggcattactggaaagcatggagggacagtttgacaacagtagctcacactggaaggaattttgcccactccaataaggagtaggtttaaggggcccatggtaagaacgtgtgaaggcactcaaacagttgtgcaccatgaactcttttttttttttttttgagacggagtctcgctctgtcgcccaggctggagtgcggtggcgcgatctcggctcactgcaagctccgcctcccgggttcacgccattctcctgcctcagcctcccgagtagctgggactacaggcgcccaacaccacgcccggctaattttttttttgtatttttagtagagacggggtttcaccgttttagccgggatggtctcgatctcctgacctcgtgatccgcccgcctcggcctccccaccatgaactcttgaaactgacctgccagggttcccttccagaatagagcctcacaccaaggagaaatctcaagagacaaaaccaaactcctgaaatagagggacaagagagaaaaaggaaaaaaaaaaaaaagagagagaaaaaggaaagagaagtagtggaggaggggaagaaatccaggacatctcagaagacaggaggccatcgtttaaacactatgttgagaacaactaagagggagttcagtgaagttacaaagctaccctgaaccatgtctctttctaaaagttcagaaaaactgagttcaaatgcaaatgagcaacagaaaagactcaagctcaaatgcaatccaaatttctataagaagtaagagaagaagcagcagaacaacatccttatgaataacaaatgcagtcaggaagaaatgctcaaaaaaaaaaaaaaatcacaacatggtgttttaaaatgaggtaggccgggcatggtggctcatgtctgtaatcctagcactttgggaggccaaggcagatggatcacctgaactcaggagatcgagaccagtctgagcaacatgacaaaaccctgtctctgttaaaaaatacaaaacattagccgggcgtggtggcgggcccctgtaatcccagctactcaggaggatggggcaggagaattgcttgagcccagtaggtggagggtacagtgagccaagattgcacaccgcactctagccttggtgacagagccagactctgtctcaaaaaataaaaatttaaaaaatgaggtaaatggcatgaagaaaatgatgcaagagagaacaaaataaatcagaatccacaaactcagatgaggtagagaagtcaagtagcaactagaaataaaataaaaagtcatttcagaaataaacagataattaaaagacacagaagacaaaagagaagaaaaaattaaaataaaaagaagaggccaggcatggtggctgatgcacgtaatatcagcactttgggaggctgaggtggaaggattgcttgagcccaggagtttgagaccagcctgggcaaaatagtgagacatcatctctactaaaaatcaaaacaattagccaggtgtggtggcatgtgcctgttgtccccactacttgggtggctgaggtgggagcatcacttcagcccaggaagtcaaggctgcagtgagccaagatcgtgccactgcactccagccagtgtgacacagcaagaccccttctcaaaaaaagaaaaagaaaaaagagagagaaaaaaatgattaaaaagaaagtgataaacactgaaaatgggtaaaaagaattatgtaaagaaagatataagaagttcctaaagaataaaacaaaaggacacacaaaatagtaaaaagtataacagaaaaatttcctgaagtttaaaaaaaaattgtgaaactagatattgaaagcttctaccccatacctgagaatactgacccaatgacaaacaccaacacacagtctagtgaaatcactggatactaaagaacaagaaaaaggaaaatcgttgggtattcaggcaaaaacaactaattttcaagggaaaaaaatcagattaccatcaggcttttcaatagcaatgctttattccaaaagaaaaaaaataaagtatgtgagctactcaagaaaaataaatgtgaaccaaagatttcatatccagaaaagttgactttaaagtataaagagcactaacaaactgttatcaacgggcaaaaactcagggcatattgttcccatggccacttcctgaagaatctagttgagaatgagcttgatcaattcaaatgactagagagacatgatcacagagagtattaaacatgtatagtcacttgtagaactgagattagttgagagctaaaatggaaagagtactctctataatggacatatgtttcaataatacagaaatagtacagtattttaaaactaggggagaaacaggaaaagcatatataaatgtttgggagttttaaaaacctattctcagtaattacactggggatggtagcattagtattattgagaccactgtgtatgtaacctgggataaaataaatgcgtgattatagactagtctatcatcccctgtgtccttgaaaaccagtattcctgctgtggaagaaaggagatagatgtaatacagaacaggttaaactaaaaatcacaaaatggaagtatcagtgtatactcattttggcattttatctcagtctgtccactgcagaggcctagaaacaatgaccaacctaatagcaatgagcatacccagggcctagacagggtcctcgaaatactgttttctactacaagatactagagcttcttaaagaaatggctttaaggatgaggggtaggggagggagcagatcttggcctcacaaaaagcaaagctatgaagccatgaagccatgaaggactactaggactgaagcactgctaggactcaggacagttgcttaaagctggggatgggaatcggtaatgaccacaaatgggcatgtggtttcttttagggctgatagatatgttctaaaattagattgtaatgatatagataaatttttgatacaaccccaaaataagtgagttgtatcaatggtcagctttctagttgtgaaactggactatataaaaaatatggaattatacacttagtatggtaaaacctatggtatgtaaattacatctcaataaagctgttggaaaaaaagatatgcccaaaccttcaaaagggatcatggtttcagtgtaaaataaaatatggcttgtttttgttttgttttgttttctccccagagacagggtctcactctgtcacccagcctggagtacaatggtgccatcacagctcactgaaacctcgaactcctgggctcaagtgatcctcccacctcagtctcctaagtagctaggactatgaacacatgctaccatacctggctaattttttgtattttttgtagagatggggtctctctctctctctcttgcccaggctggtcttgaactcctggcctcaggtgaacatcctgcttcggcttcccaaagtgctgggattgtgggcatgagccaccatgcctggccataaaatatatttaaatccatgagttcatgaagacttttttaaatccagtgattacacaaatctacatttgtggcaaaattgtacagaactaaatatatacacagacacacaaatgaataatataaaactggtgaaatcagacaaaaacaagtgggtcatatgaatgctcaattttccagctgtgaaaccgtactatagttatataagatggtaccattggaggaaactgggtgaaaggtacaccagatctctctgtattatttcttacactgcatgagaacatataattatcttaagatgaaatatttaatcaaaaaatactctaattggtcacctttgaagaacagtagggaaccaattcattatcttaaaagctagtaaagaatcaagcatttatcctatctgtcctgtatgacctgcaacaatggttaagaaatagtagatgatggaactatctctttatgaaagtatctccattaataaatgaaaaagattagattatcaccatctaatatggtttggctgagtccccatccaaatctcatcttgaattatagctccaataatcccacctgtcatgggagggactcagtgggaggtaactgaatcatgggagcaggttttcctgtgctgttgccatgatagtaaataagtctcacgagatctgatggttttataaagggcagctcccctgcacaaactctcttccctgccaccacgtaaaacgtgcatttgttcctccttcaccttcagccatgattatgaggcctctccagtcatgtggaactgtgagtccattaaacctctttttctttataaattacccaatcttgggcatgtctttattagcagcacgagaagagactaatacaccatcttatgatagcccccaatggattaatggattaggtactaagcatcaacagccgctaacattataaaaagaagaagcaccagacatcaggtgcctcatggggaaagaacccaccaattatctgatgtcttactgtagggttcaaacctgagtctgatcacacctggggatccagctaccaacttgcaggaaatacagaggacagagagaacagatgaactgcaccatgacagggcattcagcaaaatccagactgcaggaaagtctccaggctaaatgtcctagattcttcaatagataaatcattgtaggaaaaactagggggtaaggggaagcaacacaatgaaagggaaacctgtagaagagtcttaaaagacacaaatttcctttaaattagcaagattaaactttgcatgtacacctgggtaataatattataaagaaatgcaaagaagtgtctactttgagaagcagggtactggctactttagggacagagaggggtgatgattaggatgtggcacctggatggggctgctggggtaggcagaaaaattctaattctggacctgggtaatgcttacaggtacgttcaccttaggataactcagtaagctgtacatttgtgttgtgtgattttctgtatttgtcttattttaccaaaaaaagatttttttaaaaaaaaaggagaatttatctcgcttttataacctgtcataaatagaatgcaacacttaaaataattacatgaaaataaaccatattattaactagctgtggtagcctgaggacacttccaaggcctcttctatgttaaaaggagagtaaaagtgtagtcaagtactaaggatatgctagcactcaaacttgcaagattcaggtctttctttctaacttaatcaagtcttgaaagacacctaaaaggaaagtgctttctcactatgtgattcagtgagattggaggcttgccaatctaccacccaaaatcatctcccctactgctcaaatttacctcgtaggccaactcacatcttactcttctggagacactgggttacaaaaaaaaaaaggtctggtgcagtgaatgaaggtaagtcagaccttatgaggaggatgaaaaaacaaaaacttagctctccctgatcattgacacatttatgttacttgttcagccctttctaaataagcttaaaaggtttgcttttccattatcagcagttaagcaagtgaccaacactacaacccagtgagagctgcctgtcctcatcctagtcacaagcacacacactttactatgtactcaacaggcaccttcacagcctagcaatgacccacctctgtcttcatacctaatgtgtttggaggttctcaagtgacaagaggccctgtatctgaaaaggcaaattacaaaaataagcgcaaacgcccaccctcacctgaactcagtatcttaaaataaggcacatgtcccaagctgctggctaatcaacaccagcctcaactgacctcaaagccctttaaaaaaaaaagtagggcggaggggaatatcagattacatattagacttataaacttgtaaggagcaaagaaagctgtgaaattcgaatggagctcaatcacatttttcaaacatttatctaaaacacatattaaaaagtggctcaattcacctatatatgatctgaaagcaagtcttgttttacctcaccgtttcccccacatttttctatattaaagagaaagcaaacataagccaggacagtttcgtttttcttgcactgcactgctgctcacgagaggacagagtgaggcccacccacagagatgaagcgcagacaggagctaaaaggtaacttgcattaaaaaggaagatgagggctggattccttcgtcttcaatgcctctagcttcatcagcctccctggagtgggcagacccccgtttccttccctctctcaccatctcctatcccttctgcattctctaccctctttgttttgtgaaccctcaacttcccagcttaccctcactccttcccttgttcttatattttcaagagacatgtaagcaagcaaatactccaacatacacaaacctgctaaaatgtctggaacaagaatcccaagttccactcatcacaaagctgcttgtgaaaatctactccaccgtttgtttccatgtctgagaaaaacacacctcatctgcattccctggatcctccatatgggagggtacacccctgcatgtaaagaaccagttcaccacctccatttttcatgaacattcagaacaaagggctcctttcttgagtgctactctgatcccatgaattcaaaaatgtttaaggaagctctatctccacaccagcacctgaggagatggagacttttagaatagaattttaaaatgttctcattgagccctccattctagaaatggctataagtaaatgaaactcggaagtgtctggagcctactgagctctacctagcaacactgtgtgttccttggcacacaagacagaaactcaaggcagacccatcacttcctcagataccatcttgtcccattttccttaagataaggtgtcctggtccatgggcctattatttggggtcaatcctcagcaggagaatggttaggtgttacagggagaggaaggtgacacatgtggtttggatttttcacccaaacccttttcaatgagccttagagaaatacaggagcctgttgaaacattacttactgcctgttgaatattggtcttcacttgctcactcaacatgccttcaaagacaaaggagtcgccaaacttctcagcctataaggaaggtaggaaataaaaatccagaaaaggttgtagtaatgtgttgcatgtgtgcccttttctctccacactattaaagtgattcctcttgtccaattgaacttgagtctttcttatgacttcccagaggactcagaaatgacctaaaagtctctggcttcctcttaaattaatgtcacttacagagaccattttcgtttaagactcacttagctgataagaatgcagactgaacaagattagcttttgagaacgtgactgttcttgaaggaaatacatttccccaagtatcacaaatgactctgggaaatagtattctgtacgtgtgagattacataatcaatctttgtcctttgtcctgaatctagctaaacgaattaaatagcactgtttgctcacattctgacacattctagttccactaaggggtcaaatgtgcttataaatctcaactggccaattcaagcatcaaatggaaatctgtattttaatgattttatttaacattagtgtctcaattcttcatccacctgattatttttgttgcatgtaaccctattctgaaaattaggtcgtttgtcccttggtaaccatgactctcctcctacatttgtcagtgttcttattcatctcctaaaatatgtgggctcttgtttcagccactgaaacactgctgctccccagagctctgcccttggctctctgcaattctactacaccagtggctctcaggctttgtgcagttgagattatgtaatcagctggttaaaactacatattgctgctccccaacaccagagattctcattctgggggtctagggtgaggtcaaggagtctgtgtgtgtaaatagcacacagctagttgttctaatacaagtagttcaagagatgcactttgagatacactgatcgattcttgttgatggacaactttcaatctcatcaaattaactatagccagtactccaaatgactctcaaatctctacctctagtgctgtcctgttcttactagatgaaattaactgagtactggatccttatattgcagatcttacaagcatctccaactccttttccggagtggaggctgccatcttttcttcacccctaatcttcttcctgcattcccttgtgacactgccatgactaactacctaagccatttagttattcaacaaacatgtatcaaacacctaccatgtgctcagtttggggctaaattaggggatataaggtcaatatcagatagccatggcccctatccttattgtgcttaagtgtgggagcacagaaaaaaatcaagccaaacaacgaatggaagacaataattataactttactacaccttgtaaggtagagtgtcatgaaaaactttcttgagaaagtgacatttaagctgagatgactcaagaatgagaaggagccaaccatgcagaagggggataagcaagaggactgcgaattccaagcagagagaaaatacgggccaagttcttgaggtgggaaagaatgttgagttttcaaggaatagaaacaaaaccagcagggctagaacatagtatacaagaggagcatgatataaagtaaagctggagagatgggaaaagagtgccattaaaaaaacagagcattttgtccaaggcagttcttggtcctttttgagctccttggcagtatggtgaagcttaagaacccccttctcagaataaaatgtttaaatgcataaaataaaatcaataaaaaaataaaataaaataaatagtattatgaagaaaagtcattatatcaaaatattaataaacaaaccagtgctatagtattaaatatgctcttcattaatatattaaataagatctagtggcaggtctcataattatcatatttcaaagtggggatgaatgcaaacaatatttcaagatctctgcaacaacaaaaatatgattaaaaatgtctgtgatttctactggtaacaaagttagaggtactgctactactgctgtggtttgctgtttgcatcataattgaagaaaatactacattgtggctcgagggtagtaaataaccagatatattaggttgctgcaaaagtaatcgcggtctttgccattaaaagtaatgacaaaaaccgtaattacttttgtaccaacttataacttttccctatccatgtttttagatgccccaaattctgcttattctatctaatcttcatggagaaccctggttctgtagaagtcttctaacttaagtaaactattgaggaacctgagctgagagtatctctgtgaaaccaaaaggaaaaggacttctgcttattacgaatgtgtacaaaaacggtttttttgtttttgtttttgagacagagtcttgctcttcttcctggagggcagtggccggatctcggctcactgcaagctccgcctcccgggttcatgctattctcctgcctcagcctcccaagtagctgggactacgggtgcccgccaccatgcccggctaattttttgtacttttagtagagacggggtttcaccgtgttagccaggatggtctcgatcgcctgacctcgtgatccacccacctcagcctcccaacgtgctgagattacaggcgtgagccaccgcgcctggcccaaaaaaggtttctaaccactttatatatttgagaaaattccaaagaaatgtgacaatgcaaaaccaaatctgaaagttgttttactttaaacattcactctcaaattattcatttaataataatttacaaaaagacatttggggtcttaaaaaaaaaaaagaatagggaccccacgaactgaagacaagagtaaaggtttttcgtgagagaaaactggaaagcatataaaataagtatatttcagaaactgacataaacattcatagactagaaagctttcctcttcctattcccatttaggaaagcatccactatcagaaccttgctttgtgattcagtgaccaccagatgatgtctggaactgctatagcacagcatgtgtgagttgtcaaggtgttggaataaagacacgaaaatgaaaagctgcacttctgcatttatcacttaaaaaatatgaaatgcttctggaaaaaaacaaactgcaacttactgagaagaaaagtggtcttactttacatgccatctgttatctcaaaaagccttagtggacagtggtattctctgacacattaagcattaacacaatatagcataatagttatagcacatgttctgaggtcaaactggccaggctggaatcccagctctaccaccaactagctgtgtgatgtggggcaaataacttttcttatcctcagtatgccacctgaaaaataacctgcctcatggggttgctgtgagaaattaagatgaaatatatacaataaaatgcttcacacagttctgccacagaatgcagtaaaaatggtcagtcaatcttagctgctattaaagcattcttaaaagttctggaaaagaacaagttctccctcctttccccaatcccattacctctgtcaaatagccagttgagttcacaaacttctcaaattcagtattactgacttcataggcatccatgtaaaaggcatcaatagtaactctcctcgcaggtgcttccccatcctgctttatctgaggatcatctgtgcccattgtaaatactccagcagggatggggaccatctacaatgaaaggtgaaacacaggaagtcatgcatcacagccaaggtgtacctgtgtaggggtaaagttcctagcacccaggaagcacgcaagtttgtaaatcttcaccacagtaataactgtaaaattcggaaaaatctctctataccccaaagaaggtgaatcacgagtctcaaaaagaagtgaaaattctttaagaaggtaatctccttaatcaaaccactacttgatacaaatctgtacctgcactggaaacaggtctggaataacagtcaccaagccgctaacggctagaatgcagaggtagcgagaatatcccacttttcttttttttttgagacaggttctcactcttttgcccaggctggggtgcagtggcatgatcagggctcactacagcattgacttcccagactcaagcgattcccccaactcagtctctcaaacagctggagtacagacatgtgccaccatgcccaactaatttttttttttttttttgagacggagtcttgctctgtcgccccaggctggagtacagtggcacaatcacggctcactgcaacctccacctcccgggtccaagtgattctcctgcctcagcctcctgagtagctgggattacaggcgcccaccaccatgcccggctaatttttgtatttttagcagagacaggttttcaccaagttggccaggctggtcttgaactcctgacctcaggtgatccacccgcctcggcctcccaaagtgctaggattacaggtgtgagccactgcgcccggccaagctgattttttttttaagtgatgaggtctcactatgttgccaaggttggtctgcaactcctgcgctcaagtgatcctcccacctcggccttccaaactgctgggattatgagccattgtgcccagccccacttttttctttatacattttttattcgcatatgcttttgtttcttttgaattatttttaaaagcacatgtaaaaatgcaatctataatatctttaaataaccactgcatgaattttggcctccaacaatcatgaaaaaggcttacctcactaaaatagaaagttttaaagtttactaaggggctgtttgtataattccttataaaaaccctaattgcaactactttgttcctatctaccttcccacatgaactctaaactccaagaagacagcaattggggctgccttattcacagctctattcccaacactgagcacaggatctgaggatgacactgaaaattttcagttaaaaaatgcaggtccatgctcaacatcatgagtcattagggaaatgcaaatcaaaactataatgaggttccacttcatgatcactagcatggctataacaaaaaagacacaacaacaagtgctgatgaggatgtgaagaaattggaaccctcacatattgctggtaggaatgtaaaatagttcagctgctttggaaaacagtctggcagtttctcaaaaagctaaacgaagagttatatgaccctgcagttctcctaggtatatacccaagagaaataaaaacatatgtccatgtaaaaacttgtacaaaaacattcatagcagcattattcataatagccaaaaagcagaaacaatccaaatgtatatcagctgatgaataagtaaacaaaatttggtatatctataaaatggaataatattcagacataaataagtattggttcatgctacaacatgcgtgaaccttgaaaatactatattaagtgaaagaatccaatcacaaagggccacatattgtatgaatctattcatatgaaatgtccagaataggcaaatccaaagagacacaaagtagattagtggttgccagaggctagggggaggcaggaatggggaatgattgctaatgggcatagagtttcttcttgagatgatgaagtattctggaattaggcagtgatagttgtaacacctcataactatattaaaaaccactgaattgtacatgttgaaagagtgtattgcattctatatgaattctatctcaacttttttcaaaaaccacaggccttcaaccataccatctgtcagaaatacactctttacagacacaatgtcttattttcaaatcatttgagtgagccaattaatagactcctcagcagcttaggaattgtcaagttcctcatctataaacaagggttcaatatcacagaataaaacggatcataagaaactacttataaacaattatatatctacaaatttgataaccttgaaaaaaatgaataaattcctagaaacatacagcctacccagactgaatcaagaaaaagtagaaaatctgaacagactgataacaaataaggaaactgaataaataattttaaaaattggccaggtgcagtggctcacacctgtaatcctagcactttgggaggccgaggcaggtggatcacctgaggtcaagaatttcaggccagcctggccaacacggtgaaaccccgtctctactaaaaatacaaaaaattagccgggtgttgtggcacacgcctgtaatcccagccacttgggaggctgaggcaggagaatcactggaacccaggaggtggaggttgcagtgagctgagattgcaccactgtactccagcctgggcgacacagcaagactccgtttcaaataataataataataataataattttccatcaagaaaagcccagaaccagatggcttcatggcagaattctaatttaaagaagaactaataccaatccttctcaaattcttccataaaattgaagaagaggaaacacttccaaactcattttatgataccagcattacactgacaccaaagccagacaagaatactactagaagaaaaaaaaatacaggccaatatccctaatgaacatagatgcaaacattctaacaaaatactagcaaagtgaattcaacagcacattaaagggatcatataccaaaattaagtggggtttatccctaggatcaaaggatgattcaacatatgcaaactacaaatgtgatataccatgttagcagaatgaaggacaaaaccaaatgttcacctcaatatatgcaaaggcattgataaaattcaacatcttttcatgagaaaaactcttgacaagttaggcattgaaggaatgtaccttaacatgagtcatatatgaaaagcccacagctaacattatactcaatggggaaaaatggaaacctttgcctgttagattcagaacaagccaaggatgcatactcttgccacttctattccatgtaataccggacatactagacagagcaattaggcaagagaaagaaagaaacagcatccaagctggaaacaaagacgttatgttgtccctgactgtagatgccatgtttttctttgtttttttttttttttgagacggagtcttactctgttgcccaggctggagtgcagtagcacgatctcggctcactgcaaactctgcctcctgggctcatgccattctcctgcctcagcctcctgagtagctgggagtacaggcacccgccaccacaccaggctaatatatatatatatatacgtgtatatatatatatgtgtgtgtatatatatatatacgtgtatatatatatgtgtgtatatatatatacgtatatatatacatatatatacgtgtgtatatatacacacatatatacgtgtgtgtgtatatatacacatatatacgtgtgtgtgtatatatacgtgtatatatatacgtgtgtgtgtatatatacgtgtatatatatacgtgtgtgtatatatatgtgtgtgtatatctatatgtgtgtgtatatatatgtgtgtgtatatctatatacgtgtgtgtgtatatatatacgtgtgtgtacatatatacgtgtgtgtatatatatacgtgtgtgtatatatatatacgtgtgtgtatatatatacgtgtgtgtacatatatatacgtgtgtgtgtatatatatatacgtgtgtgtatatatatatatatacgtgtgtgtatatatatatattttttttgttttgttttgttttttttagtagagacagggtttcaccatgttagccaggatggtctcaatctcctgacctcaggtgatccacccacctcagcctcccaaagtgctgggattacaggcatgagttaccacacccagccagcatttctttatactaatgacaaactatctgaaaaagatattaagaaattaatcccaggccaggattcaatgtaatttctatcaaatgtaattcctatcaaatgtaattcctatcaaaattctaatgtcatttttcaaggaaatagaaaaaaaaatcctaaaatttgtacagcacaacaaaagaccccaaagagcgaaagcaattttgagcaaaaagaacaaaggtggagtaccacactatctgacttcaaaatatactacaaacctaatcaaatggcatggtactggcataaaagctaacacaaaaaccaatggaacaggatagagagtccagaaataaactcatgcatttaccatcatctgattttcaacaaaggcaccaagaacacacaatggagaaaggacaatctttcaataaacggtattaggaaaactgaatatccacatgtagaagaatgaaattagacccttatctcacagcatatacaaaaatcaactcaaactgtattaaagacttaaatgtacagtctgaaactgtaaaactactagaagaaaacattgggaaaagaagctccatgacacaggcctggcaaagatttcttggacttgaccccaaaagcacaggcaacaaaagcaaaaataaacaaataggattgtatcaaaccaaaaggcttctgtatggcaaaggaaacaacagagtgaagagatatcccagaatgagtgaaaatctttgcaaaccatgcatcttatatggagttaatattcaaaatatataaggaattcaaatcaatagcaagaaaacaaagaactcaatttaaaaatgggcaaaggacccgaatagacattgctcaaaagacatacaaatggccaacagatataagaaaaaatgctcttcacaactaattaccaggaaaatgcaaattaaaaccacaatgggctatctcctcacacctgttagaatagctatcatcaaaaagatgaaagataacaagtgttggagaagatgtagagaaaaaggaactctactgcagttggtgagaatgtaaattaatacagtgattatggaaaacaatatggaggttcctcagaaatctgcaaacagaattaccatatgatccagctatcccacttctgggtatatggccaaaggaaataaaaccagtatgctgaaaaaatatctacactcccaaattcatggcagcattattcacaatagctaagatacagaagcaacctagatgtcccttatcatataaatggataaagaaaatgtttatatatacatatatatataaatgtcagaatactttttagccttaaaaagaaaactcggccaggtgcggaggctcacgcctgtaatcccagcactttgggaggccgaggcaaggggatcatgaggtcaggagatcaagaccatcctggctaacacggtgaaatcccgtctccactaaaaatacaaaaacttagccaggcgttggtggcgggcgcctgtagtcccagctactccggaggctgaggcaggagaatggcgtgaacctgggaggcggagcttgcagcgagccgagatggagccactgcactccagcctgggcaacagagctagattccgtctcaagagaaaaaaaaagaagaaaactctgtcatttatgacagcatggatgaacctagtggacagtatgctatgtgaaatgagccaagcacaaaatgacaaatgccttgatgatctcactcatatgtgaaatctaaaaaagttgaactaattgaagtagaatggtggttatcagaggctgggggagaggggaagatggggaaaggaaagatgttgatcagacggtacaaaatttcagttagatagaagaaattagctttagtgatgtattgcacagagtggtgactataataagtaatgcattatatatttcgcaattattaaaaaatagattttaaatgtttccaccacacaaaaaatataagtatgtgagctgatggatttgttaattagcttgatttactcattccacaatgtaaacatatatcaaaacatcacgttgtaccccacaaattattataaaattatttgtcaattaaaaataaaattttaaaaaacaagggctcaaattagaaaggggaaaaaaaagaagtcaaggagagatggactagttggaaaaaaagagagtcacttagcaatacgggcagaagcattagaaaaataacatcagaagaaacagaaattaggaatccacagtcattgattctactttccatttctactggctttccttgctggtggctgctttgattctatgcgtgtacttcccaataaaaatggtgctgttttcatttatgataaattagtaataaatgtgtttttatttgtctaatgtattactactatcccaagaaatcaaccttgactactcacatcccctactcccaatattacacaggccacctagtctcactagatttcctaaatatgtatctctctaatctctccctcttttctacccccagataactgcagaacccttgtaattggtgttcctgtcttcagtctcctttcacatccccacctgcttccaagtcatctatcttccattcaataattcattcaacaaatatttaagcccctactaatccttctgaaaatgttagtctactgtacccaatgcaattttccaactgaaaagggctggaaacaatctaaatgtccatcaatagcaggctcattttaagtaaattgtgggccttcaataaaatggaaaattaagcagccataggaaagaaaaaagaagagggggataaaaaaggatgcttttgatatattgatatggaaagatctcaccatgatgagctacaagaacaaagcaaggtgcacaaatgctaagtatggtatgctgtcattagcgtgaaagtaggttgagggatacaggtacactatttttgtatttacttatatttgcagaacatagctctgaggaaatatataagaaatgcatgcagtggttgtctgaggggaaagttactgggtaaatgagaaattgttcactatatactcttctatatgtttttaaatttttaaaccacgtaaatatactacctgttttaaaaaataaagtgtcaatctgaccatactactttcctacttaaaactgtcaggaattcctatcgcctttcagaataacatatataaacatcagagctcatctctcacactctctcttgccctgtctttcacccgcatttccataaaccactttgtctcttggtaaatattgtcatggttcaaggatcagctcctccaggaggcctttcctgcctgcatatccctctagctcatgtgccctcacacacacagtgtgtgtgtgtgtgtgtgtgtgtgagagtgtgtgtgtgtatatatatacatatatatatatatatattttttaagagatggagtcccactctgtcaccccacgctggagtgcagaggcgtgatcacagctcacagcacccttgatcgtctggtctcaagcaactctcccacctcagcctctacgcagctggcactacaggtgaacaccaacacaccctgctaatttttttttttagtagacacgaggtcttgttatgttgcccaggctagtctccaacttctgagttcaagtgatactcctgcttcagcctcccaaagtgctgggcttacaggcatgagccaccgcatcccacccaaagtatcttaattctgtgttttcatcttccctagaacctaggctctttgaggaccagaaatgaatcttttatttctatatccccactgcctagcatggtgcatggtccacagcagacacaaaaatctttaccaattgaatgaggtcatgactgtaatgaggaatttatcatttgaattatgcataattataaaaatgctatttaatttataacagttctagacatgcataacatgtcaacatcacagtgaaacctgtctaacagatgtaggtcaaggaccgaactaggttgtccattattctcactatactctaagtgctgggacacaagataacccagtcctaaaaggagaaatcaacattttaagcagctctacaaagaagtagaaaaattgaagacatcagacaaaagtttcaagagcagtcttaaaatgattaagaggctctaataagagatttcataaaagacttaaagaaaaagctttcctgtggcaaatacttcctgttaggagaacagttgctcatccctcagctcaaaggaccacaggaagctgtgcccattgtacctaatgaacttttacaattatctaacttttctcatcttcttctccctcaaggtgagtaccaacaatgctaatgcaatcatgacttccatgtgaacttccggccgagttttttttttttccttctttcattaaccatcagagatagccagtgctgaataagccaagtttccattctggagactatagataaaaatagcctggatcactctgagtggatcataatttctcatttatactaatgaaataaagttttctgtcctacaaatgtcaaatgtcattcaagtgaaaaccagagaaccaagtgtctcactctgtaggatccaaagccacataaaaaggaccattttagtcaactcttcactgaaggttcaaattcaaacaatccatatctcctccaatctgaaggtgagataaccccttccctgccacaccacagcttctgccactgccactcaagccagaagcataagtgaagtaaagaatgactctattattcattggaataacagaaccatatgtgggctacacacttaggccatgtgcagtgggcactgctattttggtccatccggcacccaatccctctacttcttgtaaaatactgaagttcctttccaaaaccatttcttaagctttctaagtggcccaggggtactggatgactctatcctacttcccaacccccaccaagcctggccaaccatagcattcttttgaccacggagatgtaattagggataggcccaagacccaatcaaagttcatctttgaacttttgctggagctaccaggaaagaactttttctcttctagttatcttatcagtaggagaagggacattacctgacaatggagccgactatgcagaagagccaagagatagccaaagagaaaggccttggagatgctgcctgaggccctgtatccaggtgtgtctggggccatatttactcttgaacttcccaactaggggagctataaatgtcccttccagttttttcctgcttaagccagtcttgtctttttttcacttgctaccgtaagatttttgtcttgtacacaaaaatagaatcagctcatacgtaacttttttgtgtaacttctccttttccttctttcctctcctcaaccttaacattaaaagctaaaggctcttgttctgagtcccctctaataaaaaataaaataaaataagctaaaggttcatgagaaagctgggtgaataagagaagcatgctctctggatctgtccacaaactcctgccttatctatctatacagggcttatttatctataccattctgtcaccctcctgcctctacagacagacactaatcatagatgaaatgacattcaaagtttcttgcagttctgagctatatgattcctttaagcctcagttgcctcatctgtaaagtgggagatgatctctctcacaggattcttaggaggatgaatacagcaaaagaatactttacaaatgtttcttgaaaaagtatgtgaccttctctattcccaaggcagtttctcaatactgtatccaccaaaaaaggaaacacaggtcattcaagaaattattacagaatgcctaaaatgtataaggcacgtgggggatatagagattaaaacatctaaaaatgcttccaatgtagaatatcagacaactacaaaactagcactacattagggctgggcgcggtggctcacgcctgtaatcccagcactttgggaggcagaggcaggtggatcacgaagtcaaaagatcgagacaatcctggccaacgtggtaaaaccccgtctctactaaaaatacaaaaattggccaggcgtggtggcaggtgcctgtagtcccagctacttgggaggctgaggcaggagaatcatttgaacccagtaggcagaggttgcaatgagccgagattgcaccactgcactccagcctgggtgacagagcgagactccgtctcaaaaacaaaacaaaacaaaacaaaaaaacactagcaccatattgaagaaaatatacaagttgtcatcaaacaacaacaaaataagctatgggaactgagaggatagaaaaactacttctttgtaggaggtggaaaggtttcatggaagagacggcattcgattgtgcctcattgcccagggaagcattaccagtcagaaacctcctcagacaggaaatcaagactgactttatccatatgtacagacatgccacctacaatcttagcatcccatgatcctaaatgcctttcaaataactcttctaaaagataaaagcagactaaaacattttgcttccttgttacaaaatcataacccacgcagaaaactattaggataattttctcaatgagaatcatatttttataaccagagggaatacacattaaatttttaaacatctatattgtttcccagacaattctaatcgccataactttctagtgaaactgaaaatttcttgagggcaaagcccagtgttatttctctgtgcccctcaccttgccacacacactcattgtatgaatacacaaaaacaaaaaaagactcatctaaaaagtgttacattaaaaagtgtgaacatgtcactcccagatcttaaatcacttatgtttcccagcacacaccacgcatttccacaatgtgccatgtgttgatactattctccttcttggaatgtccttgaatctggaattccattcccagctccgaaaaatatttcctccaaggcctagctcaaatgtggcctttttttttttgaggcactactcgacttgtccatgaagaattaattctttcttcctctccaggtactctggacatatccctcctatagtattctcactatagaaaaatgatacttatgtgtgtgtctgtgtgtgtttgtgtgtgtgtgtgtgtgtgagagagagagaaacacctaccagagtgtaaatgccatgtgggtagtgtatgggtctttttctgtatgcccagcacataggatgaatcttacataacaagtgttatatagtaatgtgccaaataaacatttgtttaattaaaccaaataaacagaaaacaaagaggggaaaaaaggcagaaacaccactatgctcatttacttctcctgaaatattggagttcctgaatttagaataaatggtaaagtgtcagaattagaccaaagtcatctgcacatgaactaaaacatttgaaaccaaggaaaatagagagattaagaacagcctcctatgacgtcattgtcttgataacaagactgcttcagtttcagtcattaagttcagcccttgaaggcttgaaggtatattctcatcaaccactaatttgttaataaattgagatgcccctaagcattgtagaaagcagactataagaactggccaaagatggcccatatagcatccagtcaagacacaaaaccactctatagggatgaaaaatgtacatcttgtaaatgtaatccaaaagattctaacatccacatcccattctggaacccagaggaaaatagaatgtttaaaaatgaaaaatgttcaatgcttgccagaggaatctagataaaattttgagacagaccaatgtatatatgcaaatgagatggctgccctattaaaaaatagataaacagatgtaaggatttctccttagaaagagggacagactggcttggcgcggtggctcacgtttgtaatcccagcacgctgggaggccaaggcaagcggatcacaaggtcaggagattgagaccatccgggccaacatggtgaaaccccatctctattaaaaatacaaaaattagctgggtatggtggcgtgtgcctgtaatcccagctacttgggaggctgaggcaggaaggagaatcattcgaacccaggaggtggagattgcagtgagcggagatcgcgccactgcactccagcctggtgacagagcgagactccgtctaaaaaaaaaaaaaagaaaagaaaaaagaaagagagattgattatcaattaccaggcaagttagagaggaattaatatcaagtatggccaatacacactaaaacagtaatcaggagtcttcaacacacaaaagataaacagtactgcaggacatgctctaagggtaacaggaaaaaaagtaaaggccaaaaattatacaggatggaaaaacaatgagaagcccaggtatcaacctcctacactctacacctgagagactaaatcatggtcctgaccccatcaccctcacagtccagttggggagagacatcagcagaaaaacatctttaataattgttatgtcagaataaacacataactactgaggcaggatacggaaatattgaaggggagagaaagaggagatcaggtaaaacctactgtggatgttacctctcacctaagtcctaaatattggtcaggattaacccaaaggaaagaaaaatggaatgggaaaaggatagtgtctgctaagtaaacaagaaggagcactagtttaggagtcagaagacctgacctttagacccataagttgtttcgacaacacatcaatatgcaaaataccgggcagacagattgaagtaacagttatttctttctttctttttttttttcgagacggagtctcgccctgtcgcccaggctggagtgcagtggcaagatctcggctcactgcaacctccgcctcccgggttccagcaattctcctgcctcagcctcccgagtagctgggattacaggcgcccgccaccacgcccggctaatttttgtatttttagtagagacggggtttcgccatgttggccaggctggtctcgaactcctgacctcgtgatccgcgcgcttcggcctcccaaagtgctgggattacaggcatgtgagccaccgcgcccggccagtaagttatttatatatcccggcacctaacacatacaggcgctaagcaagacagataaataatagcaataaaacaactacagtttgcttagcccttcctaagtgctaaagtgctaagaatagcaggataaacaattcaagcccttgtcctcaagcagagtgtactcgaggagactacagataagtatacaacaaccctggtgaagatactgagacccaggatcctaatttattccgttaataagagaggaaatggtgatttaaaccataatttgattgccttaaaattatgagatcctcattaagagaacaggttggagggagaaagaaatagggggtaaagaagtaacaataaccctcaaaccaaactccctaatggtcaattaaatggagtcttccggtgaggcacggagaaggaactcctcatacgggaacagcaggtgctcgatttggggtgtggttataacctttacttcccttcctactagtgccttgctttgcctactccaaccccgtccaggaaccgagcagcccccacccgcctcggaggaatcgatggagcacctttgagtgcgcgagttgccgctctccgggtacggggcccggagcgttagcctcccgcgagtatcggtgagcggctgccgaactgccatgggcgccaggccgctggggcgtgccgcagccgcaagaacccgcaagggaccccgcgcccgcaccggtcccggcctcctggctccctgccgctccacacagcagcgagagcagcagcagcaagaggacgagacccagctcagggcaacgtccacacaccagccctagtgcgggcgcagccatgttgtcccgcgggccatgtgacccggttggtcacgtggctgagccctccttaaaggggcagaattttgagctgacttacgaagtgaccaggagagttgctcttcacctttcttcaggtacttctttggcgctgctgcttgcctgtgctaacgtcaaaacgcagcaaaacacaaaactccacaaaactcaaggccttccacagaccgtgcacccctttatgatttcttggttgaaaaataacagtcaaatttgctgggcatttggtaagtgccagagtactatgctaagcacttcactttttaaaatctcatttaatcctcacaaagacccagtaatggcgcgcttgtagtcccagctagtcgggaggccaaggcaggagaatcgtttgaacctgggaggcggaggtttcagtgagcccagatcccgccactgcactccagcctcggcgacagagcaagactccgtctcaaaaaaaaaagagaaatacaatacggaatcagaatccgtggggactggacacagcaatccagggtttcacaagctctccagatgattctaatccacacttaagtttaagaaccactgttctacagttccgtaatcgaacaaaatgcaaaaccaaaacaaaaagaagatgaaggagaaacttacagattaaaaaacaacatagcaggccgggcgcggtggctcaagcctgtaatcccagcactttgggaggccgaggcgggtggatcacgaggtcaggagatcgagaccatcctggctaacacggtgaaaccccatctctactaaaaaatacaaaaaattagcccggcgtggtggcacgcgcctgtagtcccagctactcgggaggctgaggcaggagaatggcatgaatccgggaggtggagcttgcagtgagccgagatggcgccaccgcactccagcctggggacagagcaagactccatctgaaaaaaaaaaaaaaaaaaaaaacatagcagccagctgcaatatgtgaaccttatctaaatactaattcaaacctactgagttcaaaatttttgagataatcagggaaatttaaccactaagtcaaattataatatttgataaaattaaggaattgctgtaaattttgtttttaggcttttaggagtaataatggtatttgtggctatattttttaaaagaatcccctcactgaggtacacacacactcactgaggtatacacacacacacacacacacacacacatatatatatatggataaaaatataggcagtcaaagatttgcttcccaaaaaatgggtaatcagggtctggctaaagatgaagcatgattggccatgagttgataactgtcatagctggttgatgggcatctgggtgtttattgcactattctaatgtagcatctgtttgaatttttttagcataaagaaaagaccagccaggcaccgtgtctcaagcctgtaatcccagcactttaggaggccgaggcaggagaatcgctagaggccaggagcttgagaccagcctgggcaacacagcaagaccttgtctctacaaaaaattaagaaaattaactggccatggtgacgcacaccggtggtcctggctacttcggaggctgaggcaggaggatcacttgagcctggtaggcagaggctgcagtgagccatgattgtgccactgcactccagcctgggtgacaaagtgagaccatctctcaaaaaaaaaaaaaaggccttttctccttgttgactattttacagtttgccaaggcctttcacacattttctcatttgagattacaaccacttggcaagaaatgtattattactatactcatttcaaaattgatgaagctaaaaggtcaatgccttaaccaaggttgtatgtatttactgtgcataatatatagtcaaggtctaggtcaacggtaatctttgttcgcctccttcaaatatcagtctcagcacatgctgtgtcagctgcgcttcagagacctgaacttctttgattcctggtccagctataccattaggctataacctccatgaaggtaaggcaggagcctattcgtttgccactgtatcagcaaaatcaggccaagcctgcacatgatcactcagtgaacatttattaaattatggataagtgaatgaacaaatgaagtaacgattatctctttctcttaaggggaatcaaattgtggagaaaataatataggtcttagactcacaaagagctgtggttaaagctggccactttacatgaagtatgacctaggcaaattatttcagctttctgagcctctatttcttcgtgtgtgaaatgggaataataattcctttttcttatagattttatggggattaaataacacaaagtatataaaaggtgtagcctggtacctgacatttaacatatctcaaaaataactttgctattactaatcattatgaaagatggaactttgttggttctccaggacgatcattcttttgtctcaggctaactttttagtcaataatcaatgagtatgagatcgatgagagatttctcatcaatattttccactctaatattttgctcctgtcagtgaggaggcttgttctaaaaattaagaggtaaaaagtccaactcagccatcagctcgtacgaattagtgtaattatataaaatatctctcaccctccgtctcacgtgtgagctccttctgcattttgtagcctttcttgctccttctatctcatgaagctgggaggatgaaagaccccagtcctgaaagcagcttgtctgctcactgaacatcaaagagttcagcatggctacagtggagtgagcaagggggagagaagaaaggaaaggagatgagaaaggtaacattgggccaagtcatggatgaaaggagaacagaaaggtaacattgggccaagtcatggatgttctggtaagcttttactgtgaaagttggtgccactgcagttttgagaagacatctgacactcttcctgctgagcagcatcaattttccctccaggttagaggcttctcttgctttctggttcctgaacacagggaatgcaaagtgccctgatggtagccatggcttgtagttcaatgggaccctggttgtgtccacagaaagacagcatccctttgtggatcaggacctgcagctctgcagagctcagagttgcagggatgggagaacaaaatcccagtaagtcagtaggagtaatagtaagtggggctacttctacttccacctcttggtggaacctatatattcttcctacgtgggaacaagtctgacatctctaattgagggcgtatactgcatccttatagatggccccatctttgcaggaaattgcatccaagctggcgtttcagctgtgctttcagtaagccattttcaccctttatgaggccagctgctttgggttcgtattgtaagggataaaaccactggattctgtgatcatggcctacccctgcacctccttcactgtgaagtgggtccccggtcagatgtcatgtggtgtaggaatatatgcctatgcataaggcattctgaaagccctcagacagtgatgctgcctgaggctcttggagtaggaaaggcacaagtcaaaatgttatctacttcacacgtgcaggacacttggctccactttttgggtttgatgaataatgttgatatgaacatccatgtacaagtttttgtttgcacatgttttcatttgtcttcatatatactagaagtgggattgctgggtcatatggaaattctaaccttttgggtttgggtttaaaaaaaaaaaaaaaacaggatcttgccctgctacccaggctggattgctggagtgcagtggcatgatcacagctcactgcagcctcaacctcctgggcttgagaaatcctcctacctcagcctgcaggatcacaagctgctaccacgtccaggtcattttattatttttttgtaaagatgaagtctcactatgttgcccaggctggtcccgaactcctggcctcaagtgatcctcctgacttggcctcccaaagtgctgggattataggtgtgagccaccactcctggtcttgtttaaccttctgaggaattgccagacttttccaaagtggctgtaccattttacattcccactaacaatgtatgagccgtccaatttctccatgacgtagttcattcttccacctccttcagagtaaaatctctttgtcctttatcaggcccagcctaccctcagccaggttatactgaaacttgaccctggctataacctggcagccacaagaggatgtagaggcactttcttgggggtgggaggctgttgtttttaagcaggaaaaaaaaaaagttctggtatatgcagtattttccacatgtggaaactactggttctcagtagggaggctacctctgcgagctccctctggggtcccaaaggagtctgcagagccacatttcacagggccatccacctagatgtccctgcctcacttttcaggttccaggccccatgtttttccaaccagattcctgaatttagcataggagatctactttggctgagcatccaaacatctgtggtggaactctgggttctgccgctcagctgggtctgctcttgcacggcaggagaagacttctttgcaaactaccaaagagaccctctggctctcacacttggttctcagctgtttattaactgctctcagtttctcattatcccttgtagagagggtcagtgcagcttggtaataaccagccaattccattatccttgcattcattgttcctctacacttttcaaactcctgagtcagcatgctggcacaggcgttccttttcacctggacattttcccaggtcactgccagtaacatttttagcagctgggccttgtgcccaaaaataatcaaaccccactcaagatgggatccttatcaccaggcaggcagtgagtgacccagtccccaaactccactttaccacctgctttctcagactactcacactaccaattgtgtcagtgtggttcctcttaaaaagagatgccaagatgtcattaaaaatgcaagagaaagccaggcatggtggtgcacctgtagttgcagttgagcccaggagttcaaagccaacctgggtaaccgcgagatctcacctctaaaaagaaaaagaaaagaaaaaaaaacattaaaaaggaaaaaaaggaaaaaaaaagagagaaaaaaggagaaaaagagaaaaaaggaaaagaaaaaaaaagaataaaaaaaaagaaaaagaaatgcaagaaatcctatggggttggggggagggtcacacctgtgaaaccccaaggagagagggaataggaaggaatcagaagggaaagcctccaaactgaatacaagtcctacctgtggaaggagggaggcaggaaggaacatggaggaggaaaagcctctgagtctggtactgcactgagaaagtctagtccaggtcaaccagaagtccagagcaaaggcttcttattagaggagttatgcattgagccaaaatggtgaaccctattcttcccaccaggttcaatcatttgttggagctgcccaggaagagcgtggcctcagttggaacactggccaatcctacaagagctctgctgtgggctctccattgactgtacaccttgaggcaggttctgtcttgaagagcaatctcagcacatactcccgggctgccacactgtggccaagaaggtcctccatgatctagcccctgccttcctttctgatctcttcttccatcaaattgtcctttgctcaccatgctctggccatggtatccttcttactgctcctggaacacatcaagcacagccctacctcagggtctttgtacttgctgttccttctacctgcaatatcctacttttttcaaagctggctctttcttgtcatgcaggtctcagtacaaaccttatctcctcagaggaaccttccctgattctcaaatgcaaaataaccctttcccattctgctcttttacctcacctcctttattgtctttatagctcttgtcactatctgaaatgatttcttttgttcctctgtctccccatgggggcagctatagcatcttcaggattcaatgctgtaacctcaatggctagaacaacacttggtatgtataagtgctaagtaaatatttactgaatgaatgaatatatcatccaatgaataaaaaccttcatggtcttggtccaagtagaaacttgctgcctgacagtgttatactcacatagacatttgaaatgtggctttccatttttacatccaggagggttatactcacatagacatttgaaatgtggctttccatttttacatccaggagggcctgcaagatggatataatagtacccaaggattgtatgaagattctcattaattcattagacaagtgtttattgagtgtcaactagtagccaagcactattccaggcactgagaatacatcagtgaaaaaaaaacagaaaagaattcttgcccttgtgaaaatgacattaaataacttaaaccatgtgacatacaacattgcttggtgcataagaatagctcaagagtttttagttatgattatttctattgtcaacccatttaatatctaaactgagcatttcaaagtattttaaaaaaaaaaaaaaaggacaccttcctctatacttagagagtaaaagagagaagtccaaataattagaggtagaaaaaaatttttcatatggttctttctttggactgtctttggagccctttattggtgaaattatctgattggaaagcctattaatttaggctttttagttttactagtttgcactgtagtttgtgctgtggagaaagttatgtacagagaatgtttcgttttggtttgttcatttcctcttttctttttctttttttcttttttttttttttttgagacggagtctcgctctgtcgcccaggctggagtgcagtggcgtgatctctgctcactgcaagctccgcctcccgggttcacgccattctcctgcctcagcctcccgagtagctgggactacaggcgcccgccaccacgcccggctaatttttgtatttttagtagagatggggtttcaccgtgttagccaggatggtctcgatttcctgacctcgtggtccacctgcctcggcctcccagagcgctgggattacaggcgtgagccaccgcgccccgcccccttttctttttcaaatgcttctggtcttactttccccactccttgaaagcactggggtgggggtggagggcatggggaaagacttccttaaagaaaatgcaaagaaaagatacattttaagaatacacaggacagaagctgcagacaacagaaagattagtttcagaaggcactggcacattgtgaaaaacagaaccaggagttggcttagaggctgcagcagctctgggacctcagcagcggactttcttgaacttcactctgctgctctcctggttcactccccagctctccaaggtctgcttttccctgcacacttattttttctcttccagttggcttgccttcctcccccctcctcgttgtctttttgtcattgttgtttttggcttcacagcttctgcttagtcacagttcccgttcccagcatgttcctgacccttcatggcctcaatgctactgcacagcctcattcagcatcactgtttccccattcacctgccacaaaggggaagcctggtttgcccagctcctctttctctcaccacaagacaccatagaccaataggaagcctatgctttagctgcatttgagtcacgtagctatttctggtccaatcagttgcaattgggtcaggcaaacctgtagcttgcatcagactcacttaggggccttcttaaagcaatgattgctggggatgccaccatattcagtacgtcttgggtgggacccaaaaattcacatttctgacaagctccaagatgatgctaatccatacattttgcaaactactgcgttcacaaaataagccactagttctaccccttactacctgtgctgggtggggcacttttctcttagcaatgctagcagcattacaggcattgtgatggacaactccagtacagcctgtaattattctcctccaaacttaccgtttgtcttcctgatgttcctgggcagtggtgtttggagagaagggtgagaagtagccagaacggcaccaaaagaaatttagagcaagtgaaagatgctttatgtgcctttggaaagagagaggaagaaataatagaagaaatcacagtcatgagtctcttttagagcctagatatcacaatgtttgaagtcagataaaatgagggagaaaaatggttcccaactttttcacaaatgagagctcaattgtagagaggagatatatatgtctttgtatatatatatatttcagatgttcattcaatagcagttttacgtttagggttcttttttttagaaaatggaatgtcaagatgctgctgtgaggcagtccattagcaaaggaaactgcatattaaatcacatcagaagcacctgtatatatttgaaggtacaaatatacatcaccttttcagacctcagctagtgcttaacataggagtgaactctcaatccttgtaattactctgtggtttcccagggatgtgtgactaaggggatcccctaaggtggcttaggggttcagtgaggaagtaacttctttccaggaagacttacttctacttagagcagtcttgactagtgtaatacaaagagtcctagagttagagtcaaagactggactttgggtcctggaatttatttaggggactttaggtttagtcacaaagcttctgtaagcctgagtttcttcttcttgcctacttcataacagtgctccattgaaatcaagtaggcagttataagaaggaaaataaacactagatgagattattatggtattactttgcttataagacaaatttccatcctagtttatggttctgaaatctagacgtattttttgagctatggatgcctataatgtggtagtacttcctcttccctaaaaaaaaaaatgtttttaaagcagaggtttatattttagcaaatggtcttggaacaaaggaaaaatggctttatatattcctctaattgataaataatatatgaattcattatctctttttttcctgtctcacctgtaaatatgccaccttacatggtaaaaaggactttgcagatatgattcagttaaggtccttgagatggggagataacctggattatcctgaaggtctcaacgtcatcacaagagtccttataagcaggagaacccctcctggctgtggtcagcaagatgcaacaatgtggtcagaaagcatggaacaatggtcagaaacatgcaacattgttggttttgcacatggaggaaggaagccaagggccaaggaatgtgggtggctgtcacaagctgggcaaggcaaaggaacattttcctctagagcccccagaaaggaacacaaccctgataacactttgattttggcctaatgagcctcagattggacttctgacctatgaaactgtaagataatacatttgtattgtttaagcaactaagtttgtgatcatttgtaatggcagcaaggggaaactaatccaaatatttcagttccaccatcatcactaggtgcaggctggaattcagaggcaaaagggtcaatagatgtgtgccctccatcctcttggcatcctttggggagtcaggtaatgtgctttggctatgacacagctggaccacagtgggactgtgaccagaggagggactctgcccctcaacctctcaccatgctccctttttgccaggaaagtgggagagtggtcttgcatggggtagaggtggtgataaccatttggggctcaggcacagatagtctgagttcagatgtcagcgttaatgggaa

SEQ ID NO: 558 - DNA, 58263 bp, Homo sapiens
atcagagaactagcccatctatactgagacctgcagggaaatgtgcacccctctgagccactgacaccaggctctccagcctgcattccacggcagatcctcagggggcccaggctcagctctggcccctcctgctatagttggtgagccatctcattgatgcgggaacttgctaggcaacatgcatcactctaaaccaagatcaggctctccaacctctgtgccacaacagattccaaaggggcccattcccagctccagccccttctgctgcagttatggaatgattttatctgtgcaagaactgcttgggagatacatacccacctgagccaatgtgaaagacccataagccttcttccaacagcagatttctaggggacccagtctcaatttcagccactcttgctgcacttgggaacccagcccaactgtgcagagacctgttgggtggcacatccatctgggccattgacacagccttctggactcagcttcctggccagcattcccacacagcccaagtacattccctgggtcttccccaaggaagacatggggaaagtcatgtcaacctcagagtctttacaagacttgtagcaagcctagacttagagtgtcttctagtgcaaatatggctgcagtggtcacaggctcagggaactcaacagtcaatctacttagaatatactttttctatttagaagaaggacaggcacaaacaaagccagactgtgaagactaaaataaatacgtaatctttcaatgtgctgacattaccacatatccataagcatcaaggacattcaaaaaaatgtgacttcaccaaactgacagattaaggtgccagagatcaaccctaaaatgatggagatatgtaatctctcagacaattaagtcaaaatagtagttttaagaaagtttgatgaacttcaagaaaatacaaagtatcaattcagaaatttatcagagaaatttaacagagagattgaaataaattttgggaaaaatcaaacagaaatcctgtgcagaaaataacaatgaataatatgagaaatgaaataaacagtatcaataacagaaattgaccaaagagaagaaagaatcagtgagcttgaagaataacagtttgagggaaaaaaaggaaagaaaagagaaggaaaaggtgaaatggaatgaagaaagctttataggttctatggaatgacatgcaaaaatcaaatattcaggttattgaagataaagagaaaactgaaaaataaaaaagggtagaaaccttatgcaaaaacataaggctgggtgcagtcactcatgcctataatcccaagagtttgcaaggccgaggcaggaaaatcacttaagcccaggagtttgaggccaccttagacaacacaagtgagttcttgtgtctccagtaatttttttaaaaattagccaggcatcacggtttatgcctgtacttccagctattcgggaagctgaggtagaaagatcccttgaacctgggagagtaaggctgcagtaagccaggatctctccactgtactccagcctaggcaacagtgagatcctgtcttaaaataataattatcattattaattattaataataatagaaaactttcaaaatctggagaaagatatgaatatccaggtataggaaggtcaaagtcaccagtcaggttccaccaaattaaaaatactccaaaacatgctacaagtacactccaaggtcaaaaacaaagataagctcttgaaagtgacagaagtgtgagagaagtgtaggaaatggcatataaggaagatccaatatgcctagcagcaaacttttcagcagaaacttcacaggtaggaagggaatgggacaatatattcagagtgctgaagaaaaaatactgtcaaccaggaatactacacccagcaaatatgctctttaaaaatgaaggggagataaaaaaacttgaccagaaaaacaaaagctgagaaaatttattgctaccaaacatgttctacaggaaatgctagaaagggtttttaaaactgaaagaaaataatgctaatgtgattgctacactaatatggtaatcatggtgtgtaaactatttgtgtatttactaagaagactaaaaggaaaagcaattgaagtaaaaatgaatacaacaatatttgagaaattgacaatattaaaaatatgaattgtgacatcaagatttaaaatgtagtgggagaagggagttaatgcatacaggttttcctggttatttctttcttttcatttgtcatcaaagttaagttggtatcaattttaaataactacttataattatagaatgctttttgtaagaatcatggtaaccacaaagccaaagtctataataggtacactaaaaataaaattcaatgagttaaaacatacaaccagaagaaaccacttaaccacaaaggaaggcagaaaaaaaaagaagaaaggaaaagaagagttacaaaacaactagaaaacaagtaagaaaatggtagttgaaagtccttacctatgaataataacattgaatgtaaatggaataattattcaattcaaagacatagagtggctgaatgacttttcttcaaaagaaaaatcagctatgtgctgccttcaagaaactcattatgtctataaagtcacacatagactgagagtgaaagaataaaaaagatatttcatgcaaatgcaagccaaaaaaagggcaggagtaactgtactcatatcagataaaatagatcttaagtcaaaaactgtagaaagagacaaagaaaattatgataaaggaaatttatcaattcagcaagaggaaataaataagcactcaacaccacagcgtgcaaatatataaagcaaataccaatagaactaaagggagacatagattgcaatacaataatagtaggatagttcaacacccactttcaacaggggacaaatcatccaggcagaaaaccagcgaagaaacattggagttaaattacactctagatcaaatggacctaacagactattacagaatatcttatccaactgctgcagaacttatattcttctcctcagcatatggaacattcttcaggatagaccacatgttaggcaataaaacaagtctcaggaaatttaaaacaattgaaatcatatcaagtatcttttctgaccacaaggaataaagctagaaatcaataataagaggaactttcaaaactgtacaaatatgtggaaattaaacaacatgctcatgaatgactaatggatcaataaagaaattaagaaagaaattacaaaatttattaaaacaaacaaaaatggaaatacaccacatcaaaagctatgggatacttttaagagggaacttcatagcaataaatatctatatcagaaaagtagaaagacttaaaataaacaacttaacaatgcactgcaggaactagagaagtaagaataaaccaaaagcaaaattaatagaaagaaagatataatgaagtacagaaaagaaataaataaaattgaaactaaaaaatacaaaatatcaacaaaacaaaatgttagttttttgaaaagatatacaaaatcaacacccttagccagacccagtgaaaaagagagaaaacccaaataaataaaagcagagataaaaaaggaaacatcacaatttattccacagaaattctaaagctaattagaaactaaacaactacatgccaacaaattggaaaacaatgataagaagtgaataaatttctgcacacacacaacccacaaatattgaaccatgaagaaatcaccaataataagtaacaacattaaagcactaatgaaaaatctcccatcaaaaaaaaaaacctcaagacttgatggattcactgctcaattcatcaaacacttaagtaggaagtaataccaattctactgaaactatttcaaaaaactgaagaggaggaaatgctttcaaactcattctataaggccagcgttaccctgatgccagaatcagacaaggacacacacacacacacacacaaactataggccaataaccctaatacacatggatgcaaaaattctcaacaaaatactagcaaactgaatttaacaacacattaaaaagatcattcactgtaataaagtgggattcattccagggatgtaaggatggttcaacatgtgcaaatcaatatgcatgacatagcaatcaacagaattaaggataaaaaccatatgatcatttcaatagatgttgaaaggtatttaataaaattcaacatccattctgatttttaaaaaactctcaataaataaggtatagaaggaatgtacttcaacacaaggaagtccatatatgatacacccacatttaatatcatactaaacaaggaaaaatggaaaggcttttcactaagattggaacaaggcaaggatgtctgttttcaccacttgtattcaatataatactcaaagtcctggccagagcaattagacaagagaaagaaagtaagggtatccacattggaaaaggaagacatcacattatccttgtttgcagatgacacaatcttatagttagaaaaacctaaagactacacacacacacacacacacacacacacacacacacacaaatcagaaccaataaattaataaagtttcagaataaaaaatgatcatataaaaatcagtagcatttatatacattaacagagatcaatctaaaaaggaaatcaagaaagcaatctcatttacagtaggtacaaaaaacatacctaggaatatgtttaaccaaggaagtaaaagatctctacaaggaaaactataaaacactgatgaaagagaagaagagggtacacagacacaaatggaaagatatcccatgctcatggattagaagaatgaatactgtaaatcacccaaagtgatcaatagattcaatgtaatctctagcaaaataccaatgatgttattcacagaaacagaaaaaagcattcctacaagcgtaggaaaccacaaaagactccaaatagctaaagccatcctgagaaaaaagaacaaagctgaagacatcacactgcctgatttcaaattttgctacaaatgtatagtaaccagaacagcacagtaccaacactaaaacagacatgtggaccaatggaataaaacgatgaattcagaaataaatccacgtacttacagccaactcatttttggcaaagacatcaagaacatacattggggaatggacagtctctttgataaatactgccaggaaagttagacatgcagaaaaaaatgaatcgagacccccctcttttaccatatacatacatcaaatcaaaatggattaaagacttcaatgcaagacccaaaacgatagaactactactaaaaaataatacggagaaacattccaggacattgatctgggtaaagattttttggtaagacctcaacattacagacaactataacaaaaatagaaaaatagtattatatcaagccagaaagcttctacacagcaaaggaaaaaatcaacgaagtgaagagacaacccacagaatgggagaaaatatttgcaaactacccatccaacaagggattagtaatcagaatatataagaaactcaaacaacccaattaaaaactgggcaaaagacctaatagacatttctcaaaagaaatggccaacacgtacatgaaaaaaggctcaacatcactagtcattatagaaatgcaattcaaaaccacaagaagatattatctgaccccatttagaattatcacaaagacaaaaaatagcaaatgctgatgagaaggtggaaaaaaaggaacactcatacactgttggtagggatgtaaagtagtacacccactagggaaaacagtatgggggttcctcaaaaaactaaactagaactacgtttggtatagtccagcaatcttactgctgggtatgcatctgacagaaaggaaatcagtatatcaaagagacatcggccctctcatgtttattacaacactactcacaatagccaagacatcgaatcaacctaagtgttcatcaataggcgaaaggacaaagaaaatattgtatatgcacacaatggaatactagtcagccataaaaaggaattaaatcctgtcatttgcagcaggatggatagatctgaagatcattctgttatgtaaaataagcatgacacagaaagacaaatattgcatgttctcattcatatgtgggagctaaaacagtgggtcttgtggatgttgagagcaggatggcggatgccagatgctggggtggaatggtggagaggaagatgaaggggagctggttaaggagtacaaaaatacagtcagaaggaatgagctatcacatgcagtatagtaggaaaattatgcttaatagtttattgtacatatcaaaatagctagaagaattgtaatgttctcaatacagagaataaaaatgtatgaggtcatgggtatcccaattaccctaactttatcattacacattttaaacagatatcaaaatatcacatataacccaagaatactacagatattataatgaattagaattaaatcttccaaactatacacgagggtgtctttccatttatataggttttaatttattttggcattgtttttctgttttcatagtacaagtcttctgcctcccaagttacatttattacgaggtattttattgttttgtatgttattgcaaatggtattgtacttttaacttccgttttaaattgtttctgtctggtatacagacgcacaactgatttccatgtgttgatcttgttctctgacactttgccaacttttccacttctttaaaatccagaataagtatggcctgagacaagggaggtttgtgtattcatgatgcatatgtatagtcacgtgtatgttgcttgcgtatataccattcaataatcaatacataaatataaataatatgtatctccattttaacaactgtaatttattcctaaagccatatttaaaaataattacatttttaaatgggaaaagtcgtatgaagaattctgtcccacctcaagataactaaacaatttttcagtagaaaaataaatctaaaaacagaaaaaatattttaaaagtaaataaatcgtacataaaacgaagcgcaatcgagttttgttgcactaatgctttcttcctctttctacaccattttgtttgcagaatcggccttttgaaggttccgggttaccctgcagtgaagctgtcattcaagcacagtcagggcccaggagagggcgcagggagggcgcaggcgcgcagggagggctgggcatgcgctcggcggggcctccggctctcggggacgcgcgcgggcggggctcgccggggctgaaccggctgagcttcccagggacgccccgacccaagccctgcagtccgcgcgcgtcaggggtgtgcgctggaggccggaaagtcgaatatcacttcccatcctgcatttgatgtgctttggggttgaaaaagcccttatgtggtaaaaaaaaaaaaaaaaaaaaagtcagaaaagtggcaaaagtcttcaacggcctgaaaaaggccgagacaggaactgagaagctggcagtaggtcctgctactgctgcaggggcggcgggcgccctgggtgggccacgaggcagggacagccgaggctccgcgctcaccccacccgcaaggggccaagcgcagactcaggggagccagaggggccggaccgctgagcaagggctggggaagggtgagtcaggggcccctgtgggactgcacggggtggggggcacgggcccggacctctctcacaaatgcccacgtggtccccaaggctaacgccggctgcgtgggccgcaagctgctctgggcccgcagctcactcccctgggcacagggctgacacccgggcgaagcaggagtgtcccagcttgcttcagcccctcccctgggcccccaggctggtggctccagaaggactttactaagagggtgggaagcatcagtgcaggtacctgccctgggctaagggcctcgtgtgggtgatagccctcagcagggccctcccatttgggcattggcagcccacagggctgtggccgtggagctggagtggcagctcctggatcaccccacacctgcgttcctcaaggcctaggcaccacttgctccatggtcaaaagcatcactttgtgaaacgcagactgagcaaagctggcctaagattttggtcctccaggaatgacggaaggagccctctgcccccatgtagcctatagctgggacacgcagcagccagtgagttggtcacggtatgaaggcttctctcctcccggcaatcacagatcccacgcttggatacttgggagtgaagatgtgttatttcacccaccgactcgttccacacgaccaaggcctgtgcctgccctgagggcgagttggttgagccttgtacagacaactctcagagcgtgggcctgggccgaacctttccctgtgagcagcagcatcagcgtctagaacgacggccctcccggtccacggtggaaggtgcggagctcccgtggtgtgctggcagcgattcgcagaagggagatggagggccacagggcaggtgctcgcacggagtcatcgaggtccagggacaccttcctcccaggtgagctcacaaaggcaccacacattaatcctgggagacaaccattctgatgtggctaaggccatcgacagggaacatgattgtcaggaaacctcaacttttcgataaatgacagcaaaacctgaatgcaggagaaatgtatctcattttaatgcctgacttctaagcatccttattcaacatattatatgtattttttgtttcatgagtaaaatgtacattgagcttcctccagtagctgtccatagaccagccactatcactgccatcattattttgtttctaaacttttctttttacacatgtaggtctagctttttcctccatattgatgaactaaaactcactcatttcacaactcaaagccagggccttcagttcacagcccgttgcctcagacggcctttcctatatcttattgcttcactgtctgactcactccagcgtgtttcagccaagtatacttgtttttattcatcttgctctcttttcctccctcccccaactccccctctttccctctgtctctttgtctctttctctctcccccatccctccctctcttcccctttctctctggatgccctctctccctctctccctccctctcttcccctttctctctggatgccctctctccctctctccctccctctcttcccctttctctctggatgccctctctccctctctccctgtttttcttctctgtgtctgcctgcataatattcagaaatcccaacaagagcagctggagctgctaaagaaaccccagcgttctgtgctgctgccattgcctcctccaactggtgagcccgatcggcccatttttaggcagtgctgtggttggaaatgggcccttcctctggggtccgctacttccctccacctgactcagaagaatgagtcaagagggaagaacagctcgtattagggagagggtcccgtgtgctgttgcctttttcggaatcatttcaatcatgtttgccaaattccctacgaagttctgttccctcgtttgacaatgagcagaggcaggagagatgaattgctaaatggttgtatcccacaccgtgctgggaggctcagcagaacagagacctgtgtcaagcagggcttccttctccaccaggcccttcagcctgcattttaacctgtgacttgcgaggagatagcccgtgatcacaccacaggcctacttacatgacaggaagcaaaatgccaattccttctacccctttcccccaccccggtagaaaccctgctagttctttttaaaaaagggagagagatcatgtatagaaaaccttttttacaatttatttcctgttgttaatctttaaaaatgaggttctagctaagtgcagggtttcagtggtgaaattttgaccatgtgaacacataaataaatatttacagtctttggcaaaacacatgacgtttcatcaacctatacgataaatttgtttagaaaaacataaataatttacaaaaaatatggtacattctaaatactcacatcatcgtcactcccacaccattgtacggttgaccccacaacacagaaacagaaaacctgcacgctgttgacagtcgctacatttaatgaagtatcccaacgcttcgttggtctcgggaatacagctccacacgcaaaaaagtaaaaagtgcagcaaaacaacaacacaacgatcaacctcaaaggaaacaacaaaattaattttatcaaaatgcaatgtgtacattaagactaaagttatggattgttcctgtttggcatagaaatgtgatgactattaacagaaaggggaaaaagatttgccccctatccatcatcagacagacagacttctcttactaaaccccttatgtggagtgggatgagtgactatttcctgcagaaagatcatgcaacttaaagcaaaaaaacaaaccaaccaacaaaaaaaacaaaaacaaaaacaaacttgtgcatattacacatgactgattattgggtgtgcctggcaagactaaatgctgattcttttcagcgtttgaattaaaagaattccatatacagcagatagataacagtaacaaatattgaactaaaatcgctggcaacattatatatttaaggttccatcataaactcctcattattctctatgtattctgttacagcttctagcatgcttcatcgtgacaacctaatattatcaagcctcatattttcacaggattatatacttattagatgtttgtttctagaaattatactacatatgtgttactaggcatatttaaaataagttactggtaaatggagttgcattctatagtcacttaataaatattaacaaaatatttataactggaaccttaatgaaatgtatcatcaaatcaggtaaaagcaacttgtccgcagttaccaaagcctagatacgcgttagatgcgccttttccggcctgtgcgtctgctctggttcctctcaggcagcaaagctggggaaggaagctcaggcaggagcctccccgacgccacagcggcacaagcagcagctaaagcaccgcactttgctctgctaaccttttacttaaatgaggttttgccaaatccacatctggaaccgcgtcacacccatttgcaaggatgtttgttctttgatgaaactgcatctctactgcacatgagggctttcattgtaggacaagaggagagttcgtttatttttgtaactgttttacatgttccgattagttaatcggtagcttatgtcatttgctatgcctgttgtcttctaatctctccttactaaaacattacttcaaatttgaattgacccttgtttataatttatttaatgggatttgtgtgtcattgtagagcaactctaattcaagaatagtgacaactttaagcaccaaaagtagttcagcaatatttttcatgcttaatttatcataatggcttatgcacagtattcccttcaactccatatacacataaatacaataagtaattacattttatatgtaaacgtcattctttttaaacaaacaagaaaaagcaatgtaatggcatgcccaattttcactccacataaagtctcatatatcaccaaactggtttcctctagtgggttagatgttcatctctgagttccattgatatttatcctctgaaggcacttgggtttggggttgctggcaggaggtgaagaaccatcagagttaaggtcaagggacaggaggtgctgctagagagagaagccacaaggaccacaatgaactgaggtgtctagggaccatggcatgcacagggcattgccggaaatgcagcaaatcttgtttaaatatctacaaaaagaaaaaaaaaagcaataaacaattagcataactgggccatgggtagtgatttattttgttttacctagaaccagaaatataattactttaattaaagatgagatctatcatatggatggatggatggatggatgaaatggatgggtggatggatgagatgggtgggtggatggatgagatgggtcggtgggtgggtggatgagatggatggatggatggatggatgaaatggatgggtgggtggatgaaatgggtgggtggatggatgggtggatggatggggtgggtgggtggatgagatggatggatggatggatgaaatgagtgggtggatggatggatgagtgggttggtggatgagatgaatgggtggatggatgatgagatggttgggtggctggatgagatggatggatgggtggatggatggatgaaatggattggtggatggatgaaatgggtgggtggatggatggatgagtgggttggtagatgagatgaatgggtggatgagatgaattgatggatggatggatgaatgagataggtgggttggtggagatggatgggtgggtggatggatgagatggatgagtgggtgggtgggtggctgagatggatggatgggatagatgagtgggggtggatgaaatggatgggtggatggatggatggatgagatggatgggtgggtgggtggatggactagatggataggtggatggggctgggtggatggatggatgagatgggtgggtgtgtgggtgggtggatggatgaatggatggatggatgagatggatggttgggtgaatggatgagatggatgggcggatgagtagatggatggatgggatggatggatggatgagacaggtggatggatggatgagataggtgggtggatgagatggatggatgggtgggtgggtggatggagggatgagtgggttggtggatgagatggatgagtgcatgggtgggtggctgagatggatggatggatggataagatggatggataagtgctgggtggatggatggatgatgagtgggtgggtaagtggatgagatgagtggatggatggatgagtaggtgggtggatgagatgagtggatggatggatgagtaggtgggtggatgagtggatggatggatgagtaggtgggtggatgagatgagtggatggatggatgagtaggtgggtggatgagatggatggatggatggatgagatggatgtattgataggtggatggatggatggatgagtaggtaggtgagtggatgagatgaatggatggatgggatagatgagtgagtgggggtgaatgaaatggttgggtggatgtgtgggtggatggatggatgaaatggatgagtgggtgggtgggtggatggattagatggataggtggatgggtgggtggatggatggatggatgagatagttgggtggatgggtggttggatggatgagatgggtgggtgtgtgggtgggtggatggatggatggttgggtgaatggatgagatgggtggatgaatggatggatggatgggtggatggatgagatatatgggtgggtggatgaatgatatggatggatgggaggaaatgagatgccttgaaagacatcctaacataaggagaagaaaacctccacagaagcaagcagataaatcaaccccaacagggttttgccctgttggccaggctggtctcgaactcctgacctcaggggatccacccgccttggcctcccaaagggctaggattacaggcatgagccactgcccccagccaaacacatgattttcaatgtgtgattcttgagaagcatcctgagccttatttactgcatctgtggaagggtaatgcgcatttgaaggcatggaattagagcagatggaattcaagttatcttccaggtctataatattttgattcaaatatacctgtagcgagataactatagagaaactccttccttccttctttccttcctgcctgcctgccattgctaatgcaagggtaccaatctaaaatggcgtcaggagcctggaagtggaggaaatctaggaaactctaggctatggcacaatgaggatgggtgggacctgtaaataattggaaagtgttctaccagaggcatccaaatgcaattaaaaacaaaacaatccaagctgaccaaatgaaatggctgcttggaatgtgcagggggctcatgtgtggtattgtgcattaggtttattgccctgatgtacagcttttgtaagtggaagagcgcactgtgtacccctttccctttctgggtgccacatgccttccccactaacctgaagtgctcacactcacctctgcattcgtacttgaggtctgagaaatagaccatttcttgagagaagacaaatagacccagccgcccgccagcgtaggtttggtcatagataggtcctgagtctgccatgacctgttttccttcatgcactaagactctaaaaatggtgtttaaaaagaagaagaggaaagaaagacaacatgaactctgtgaagcattcaccagtgatggaaggttggctccggacacaagctgtggatactccgcccagggcttcagtgccccagggggcattgctggctttctcctttggagctccagccacccctggtgcagcactgatccagggcacgccttccttcttgcaaccacactattgtcacaatctgtgagttcacttacagtcacccaggcaagggctttagaggagactctacctttggtggggtgaggaggaagcttcccacttcctgggaagatgcaccggactctccctacttcaccttgtgctaaaaccatgagctcaccggctctcctccccactgtggaagctgcgtgggagcaggactggatacaccaagcccccgacaggaggatggggcatcaatatgaataaacaggaggccccctagggaaacgttccagcgaggccacgagcctgcacttcacccacacagatctgccctctattgccagggactcacacactcctggcatctgtgcagagtccagcctgatcttggtgcttattaactttgaaaaaacaaaaacaccttgattttaaattgaccacattttgtttgaataaaaatcaattataaatactgttaagccaagggaaaagattctgttgggctaactgtgtcaaaacttcatacaaccgtgttttaaattcagccatttatatcaggtacaaatctagtctccaataaagcacatgctaattctgcaaagatgcagttattttaattgcaggtgttctcccctgcctggggtattcattaggagaaaatatggttatcatcccaaaacaaagcagattgtatattctccttttcaaccattttttaaaaatacttaatatttagtagagatgcaggatagaaaagagaaagcagttaatgacgaagaatccagagtaaaacaaaaagttagaattcacttgagcttatttgtctattaatgttcaaatgtgccgtccgatgggaagccccttggaagaaatgcagctgtgctgacctgccctcacctgatgtagccagtcttgggcctgtgagtcaggtgccacctataggccgtgtagtccttccagccaatgttcctggggtcgtgccataaggttcgcacctgagagagaacatagcactcttgagtgccatgggcacccggagccttaaccacagctctgtaacaccaagcaggaagcaaaaacatgactttgcaagttcatgcttaaggctcatggtgctccatatctctctgatgtgtttatcatccaaatctctactgtggattgaagcccatggacagagtgtggctcagggctgagagccaaggcacctgaccctcagattcctggattgaagagcccaggcacctgatcctcagattcctgggttcatgtctggatcttctctttccttgatatgggatgttgggcaaaattcttgaagttttgatattcaattctccctagcttcaatttttaaaatatttttttcatattatatctttgatcattatgtcctatgctcactccctatctccagaagagggtaaaagaggtttaatttgtaaaaggattagcaactgtatttaactggtaattatcaactgtgttgagttgtaaccccaggcacagtgtctataataaagtaagattattaaaataactgtgcctggagttaaaattaataaagacaaaagtggggtctctggactgggctagtcctgctgaaacactctgcagccacagtggtgcagaggagatgtgtgggcctggccagccaacctcacctgccccggcgtgttccccgtgtgccacagcgcgttcctcaggtgctcgcccgtccccgtggtggagttcaccaccttgagggacacgccggagtagccataggcccgcgtgggctggtcctcccagtaggtctgcgtcacctgcttccacatcaccacatagaagcggctgcttgactggtaaccaaagacgaagccggcatagtcgtcgtcccggtcagtgtttacgtagaatgtgccactgaagtccacagacccaaactcgtcaaaacctggatgcaacgccataaggtttcgttagaaacacctttcaggtggccgggagtagtgactcatgcctgtaatcccagcactttgagaggccgaggtgggcagatcacctgaggtcaagagttcgagactggtctgaccaatatggtgaaaccttgtctctactaaaaatgcaaaaattagccgggcatggtggtgggtacctgtaatcccagctactcaggaggctgaggcaggagaatcacttgaaccggggaaaaaaggttgcagtgaactgagattgtaccactatactccagcctgggggacaagagcaagactccatctcaaaaaaaaaaaaagaaaaaaaagaaaaaaaaaagaaacaggtttcaggcaatccccagcttggccctgtgaccatctgacagtggatgcccagcaggcagggcgggctcccctcatcatcccgatgggctcttttaccatgagattagtggaattgaaggtatttcttttagatccaacttacaagagttctgagaggattatgaggtcccatttcatagaccaagtctataaaataaaatggtttactgaaatttcagagacttcagagcggcaggtgcatgtacctgtcaaggttatttaggcagacagtttcacagaccatggaaggatgggggcttccagaaagaccacatggcatcccacctgcatgatcttaaagtgcagtctgcatcttctgtgggcgcctcccccggagaaatgctggcaccaccgccgtgtctcagagactcacctacagcgatgccggggtccgagttggctgtctgaaccagctccttgccttgatggcgaatgacccagttgggatcaatttgggtggtccctttgggatccaaggggaccatctggaagttcctgaagtctgtctcactgatggcattgttttcaggacacacatcatcaatatctgggatgttgtcattgtcaaaatcatctttacaaatatcaccccgtccatcacctatgcacaaagaacaagcaaaaacaaaaacaaaaacaaagaagcaaagtcggtggtcggtggtttgccatttgcttttccgtgtctgagaaacatgagtgcatctttcccagaacatctaagactgagtgctttgcagtgttttgtggattcgtgctcaacaatctccaaaacatttgacttcacaggaacctcaactcttttcacaaaatttttgtgataaatacacagcaaaggccagcacagcaaattcacataaagccatttctcaccgtgttccaaactcaatgctgcaggtataaaacctgaatggctgtcaagtaatatcaacctgcatttccagctttgtgtttggatagttttctgaatgtctgttattacttttcttagtcatccttgccttttatagtctatttggcattaaagcggaactcacactaaaatggtttttcctagggagacatggacttccgctgtttagtgggtccttgtcaagttttcagcggggttgtggcatggtggggagtggggatgaggtgggcctggtgcaaacagggggaccacgaatttgccacatgtgtccagtctatcagtctacggcgatgacgataacctgacaggcagattgcaatgtactgaattagctatcacgtggcctgccgttttggaggaaaggcaagttggattgaatatctcatcatattcttcaactagtttccgttctgttcaagaacatactccagctaccacgtggcaggcacatagttggtatcagggcattctgaaatgctgaaatgctgctctgcctatcagcttctctctgtcccagtccctccctggggaaaggctgcatggggagcaagcccctgcatgcccgaacacggagtccagatgaggcttgctgtgctcactccatcccttcatgctgctcggggagaacacaggagctgcccttctgatcccagcatctcccacgtacttctgagtcatgctgtctcagatgcccctcaagtccttatctccctctgtcaaggacgtggcttccaaagagagcctgtgtcagccaggccccactccaagtgagggccactttctcacagcctccccggaagccccagagcacagctgtgcccttgtttattactcagggacgctgacttagaggactgcagcccatccagctccttccttgggcccccgtggctatgggccacctattcatgctcactgctgagcaaagcagctcttcctctcatgcttcacactcgtgccacttttgttggctttgctttcaaaaaaatcctccttgtcccctgcctggccccatacaccaaattcccaattcatcctacgttcgtaacccgcattctttctaggagatcgtcaacaatctggaagttatatggaggcagggatttctcctcctcccgacgtgcacacacacttgaggcagcacacctgttgaagggcacacacacagccaagaatgtgttgagtgtcaggggagaagaaactcatattgcatggacccacagctttaagaggcccaaagtcattgccctttttccagcagcagatttaagatgatctccgtgcatacatatctctgccctggcgggttgctcagaagccattttcctccacgcccatgagctgagagagcacccaccgtccaagtcctcctggtctgggttgaacacaagccggcagttgtccctgtcatcggggacgccatcgttgtcatcatcagggtcacaggcgtcgccctggccgtctctgtcatggtcagcctggttggcgttggagatgtaggggcagttgtcctggttgttctggtggccgtcgtcatctatgtcctcgttgttgtcacactggtccccaacaaggtcattgtccacgtcggtctaggggatggggcgtgagagaaacagcagaggactgccagtttgaggaggtggagaggaaccagcaggacgcaagcctgagagccggcctcctcgtcctgcagcacaagccccagggccacgcaggggcggctggcccgaggtcacactgaccctgacgtcaggacaagcactggggccaggcctctcggtccaggaatctctccaccctctgccacctctccacagtaattcacttcactaaaggaagatgtgcttcttcgctggaaaagcatgaactaccaggtaattatgtctcttttttacaccatttgcgccatttacaccatttacatcataggataatatatcctatgagctgcatcaagataactgtcctcccttgtctctttcaaacgcaaacctggaaatgaagccaattcctatgttggcatcaggaaaatggggagagaattctgtgaagacacaacctcgctccagctgatgaggtgaaggcgtctattcatttggcctgtggccactgagatacaagaatagtgctgagatttgagttgaataaatgttttcaattgaaatcattgaaaactccatgttatcctgtctttgtggagctcatggaaaactcccaaggccccatggaggggactgatgaggacctgagacccgcctgcccatggctgccctcatctggtcagggttgtgcaccaggggcagttgtcacagtgatcccccacaccgccaccgtccccgcgtccctctgatgaggacctccaaccccgcctgtctgcggctgccctcacctggtcagggttgtgcaccagggggcagttgtcacagtgatcccccacaccgtcaccatccgtgtccctctggtcagtgttgtagacgtagggacaattgtctcgttcattgaagacatctgtaagtgtttaaagggggaagaaaacaaaaacaaaccagaaggacaggtgagtttagaaaaagcacattgtttttcctatcacacgaaattgcttacagccacacttctatttaattataataaaaagacgcctaagaatatagtaaaatataaagactattagattttagaagaacatatgacatatttcattacagttcaaatacctttcatttgaaatagaaccaacttttggagatttctgggtaatgttgcaggaggggtagttgaatgtgctgtcgccgtgtaaatctgagcttgctaaattgcttatttctccctaatacccacttggaaagtatgtgttgagttcccaggagtttatcatccatgcacatgagtaggaaaaaaacaatggcagagagtggcagggtttttagatgtcatatcttatcttaagaaatctgaaagtgatgagttgcattgatactgaagttacaaaaatataaactagcactgaactaaacaataccatcagtgacagtgtcacaaatgacagagcaaaatgttacacggcagcgagtccacaggaagagccagaactgagctgagacgctcgccttgctttggtcaggtgaggtctggagaagggaagtaaggaacacctaaaaaataaaaatggaagggactggagcttgagatctgcatccagcacatcacagacgccatcctggatggggagccgaggagccccctggccaccacgagccctcagacagcaacccaccacattcccagagaacgagaggagggtggaggcagaaatcagtggaaaagatcagactgagaaacccgctgtgagacagaacagcaggttggggtggctcagaaagggggtggctggcgccgggctgggaagaggaccccacgaggcgaagtgtggaggagctggggccgagctccagcgtggaggcgagcctgcccccagctcttgctggttctacagaagcactcgcctggtctccaggcaccccaagagaagggatgaccatgcggtgacagtggcactgggttgcagagctcgcttaccaaggccagcgaactctccggataaagcagcaaccgggatcagtggcagaggtaaccacaatacacccacgttattctaactcctagaagctcagtttgatgaaaacatgaaatggcttcttggaatttttgaatgaagggtgaacattagaaaagatgccatgaagaagcacgaggcccaggactgcaaggctggggtcagagagaggaggataccaaatgcatagctttctctagggcggtcctgtggctggtgtcccctgaccttcaggaaaaggcaaggcagaataagcatgggtccctatgggaataactgaatgaatcatttaatcttatagtagtgtaaaaatgaaaggagcttatcaaaattcagaataaaacatgaaacttgccaatgcctccaattgcgacccttaaaatgcatgcattgggccgggcgcggtggctcacgcctgtaatcccagcactttgggaggccaaggcaggcggatcatttgaggtcaggagcttgagaccagcctggccaacatggtgaaacctcgtctctacttaaaatacaaaattagctaggcgtggtggtgtgcacctgtgatcccagctactcaggaggctgaagcaggagactcacttgaacccaaaaggtggagatcgcagtgagccaagatggtgctactgccctgggcaacaatagtgaaactccatctcaaaaaaaaaaaaaaagtgcacgcatgggaaggagcagaagcacccaccgtccccatcaatgtccacggagcaggcgtcaccctctccattgttgtctgtgtcgatctgggcagggttgtgcacgtaagggcagttgtcacagcggtccccaacctcatccttgtcatagtcagcctggcggggattgaagaggagctggcagttgtcctggaaaaccaagaaagggaagactttaacgaagatcataggaatgtgtgtcgggccgtttagcacttataagttatgtactcaaggttgatgaaaatcaatatagaaatcaaacaaacacaaaagccagttagggctggacggtggctcacacctttaatcacagctgggcactgtggctcacacctgtaatcccagcacttcaaaaagccagtcagggcagggcacggaggctcacacctttaatcccagcactatgggaggctgaggcgggcggatcacctgaggtcaggagttcaagaccagggccgggcgcagtggctcacacctttaatcccagtgctttaaaaagccagttaggcccgggcacagtggctcacaccattaatcccagcactttgggaggccaaggcaggcgggtcacctgaggtcaggagttcgagaccagcctggccaacatggtgaaaccccatctctcctaaaaatacaaaaatgagccgggcgtggtggtgtgcgcctgtaatgccagttactcaggagactgaggcaagagaatcgcttgaacccagaagatggagattgcagtgagccaagatcatgccattgcactcaagcctgagcgaccaaaaaaaaaaaaaaaaagagttagccctcgccaaacactttttccatatcaaatcattttatcattatttatgcatctgtcttttgttgaaaatttgtagattgctaaggcaaaaatggtatatcatacacttcatggtgaggagagatatgtaaatatcaaataaatgaatggattagtgagtcaatgtctcccatcaaagtcagatgtaaaaaagcagtgagtaaaatcttgatctattcttgctagagctgttttgtgtacaaatacattaaaccatttgtgtttgcagcaattttcttagaaaaatggtaatattttaaatgttgccataaaggcaagtctatcactcatggtggtgtcagccttgcccatcactggctcctcagcagaaggagaggaggtcttctatttttttgcagttaaaatagaaaaaattattcaaaacatttccggcagcacaccctgggcagccccatgcactgaggtaaaatccgcttttgcaaaggactgtctttatagtgacctttgggaactgcctatgcacaaacgcttgcaggacaatggcagttacgttgacaagggctgtttggtataaagtggcctcctgtggacctcgctgctcctggaacccagggcaggtgcgcggcacaagctgctcctaccttctcatcggtcacaccgtcattgtcatcgtcatcatcacaggcatcgccaatcccgtccttgtcaaagtcttcctgcccagaatttggcagatgggggcagttatcctgcaattggagaaggaagaatacttggaaaaacatttaggaaagcgcctctttcaggaatgcaggtgaaatgaaaccagcatggcgccgaggaaggaagcgtgccccatcagtcctcgatctcaagcgggagctgagagaggagccaggaggccagaagcgcatgaatttcttctcaactcctgccctggaaattatgtcaccactactcacgagggagacaaaagaaacttgtgttcggagcccagaatcccagtgaggttgccaaacaactgcagaaacaagaagagaatgacaaggtattgctctgagagaacatgggagagaaaagaggctttagtggtgctttccttcccacagacttcagctcataaatcaaaatgccaaagcttataaacgtttaaccctcaccagtcaaaaaatctcaaagaaaagagtctttcaaatatgtatgtgatatgttcagaaaccagggctgagaacttgaaattatctgctaactcagcttttcacggtgagtgggtaatgcatgtaattgggcaaaaactcctttcatttcagtccagttataccataatttaaagctgagctgtgcagacactaacaacttgagggaattggaaatccaggaaaaggtagagagtagcgtgtccgtttcagtttcagtacaagagccccaagggtgtgtcatccccgtggctcaaagcacatcactcgttgaatcagaagacagaacctggggtcttgtgctggagcccagagtttcagcacttacagattaagaaaggagagcatgttgcttgtcatggaggacacggatcccagacgggggcccctggcaatggggaggatccagcacctgtgtgtcgggttaatatgggaacgggcacaggggtcccttgtcaagtctcacttttaaatccttttgtgtatgtgtatatatacatataactttgcaaattatataccattttcgaagttattaaatttccatctaaaattccacaatgatggaaagaataatcgggatatcttctagcagcacggactcagctgcagctgaccttctgaaatcaggggcttcaagaagggtaggctgggtagccaaggggtgtaacataggttgggatcagtgcctcgttgattttaaaacatactcatattttgtttcagtgagtatttggcatctttaatcaagcgggactgacagagaaaattaacacaaaatttgcaagaatgattaaatattaaataaatgaatatatttatattttcaaatgatattttgtgtcagtttgtggcatttccatgtctgaccttcttaaggcataaaactgcactaaaacattttggggcaccctgtgcggtggactgagtggcagtccccacgatggatgtccgcgtcctagtgtcttggcgcccggggatgtcacctgatatggctgaagtgaatttcatcttgtatggtaacaagtggaattaggtcaaggacattgaacagtgaggctcatcctggattatctgggtgggccctaaatacaaccacaggtgttcttatcaaagagaggcagaggaagtttccggagagaaaggcactggagaaagtggtgtgaagccgaccagaggtcagggccatgcagccaccagcgccagaagcccagcgacgcctgagccagagaagctgggagaagcagagggagcacggccccgctagcaccttgacgttgtgtttcaggcctccagagctgtgagataacagattcctgttgttgtgagcctcccgggccgtggtgttcgttccagcggccacaggaaagcagtccagcctgggatgggccccgaaggagctccttcttccagctgagcagctccttatactgcaacacgcttgggctttgggaagaaaaccatgtcctaactctttccaagtgacatagcctggccagacctgcctgagacacaatggcctctgcacagcctggagccgagcgtggagccggcgtcctccctctgctcagtttcaggcgttaacgatgcgcgcaattgcaaatatgggccgacgtgcccgaggttctctgtgcccagcagtgggcggcgccagagtgtgcctgtgtctactaaggacctccagagaggggaccagggggatgcattcaacctggtgatcaggcaagaggcctgagagaccctccttccaaattccctgtgctgcccccgccccccgtccgcgtagcgtccccggcgccaggaggagggctgaccgccgtggccccgtgtgccctgcgagccccgcgcctcaccttgatgcagtggtaggtggcgttggtggcgcagaccagattgaggttgggccagccgtccaggtccgagtcctccccgcagatgagcccgtcgcccgcgtagcctgtctggcactcgcacttgtacatggggtcgctgaagtggcccaggtagatgcactccgcgtgcttgtggcagttgtgtgtcttgtccttgcatgggttttcgggctcacacacctacggggagaagggctgcggggttagcgacaggcaggacgatggctccggaggcgtcgaggcggggcgtcgggcaccgcaggccccagcaggtccggtcccaagcggacccaagtcctgaagtgggaagggctttctggacacgcacttgaggtgctgttcgttcctgaggctccgtttgtgactcagccatcgtttctgagcctcggctgcagctcaccaagggctgcgctaacagcggagaggtggcggcctgaccctcacaggcccggctgagcacgccccgcaccccgcgcggagagcagcggcccagccgagcaggtgctcagcttccccgggccagcccctcccatgcctctcccgggccacgccaccccttcctctccttcctcctgctgcttttctgagctcatctgatttttccaaagccgctcgcaacacacaaggaaggccggccttgcgtacttgcttttccgtcttggctgcttccaggccgaccccgacgggctggttccctctgtatcggggcgggcagggcaggcagtggaagccaggctgagtgttgacacagcgaggcaccttgctggtggagaagcagatgtcggggaccagggcacactgcggggacaagcagacatgagaggccgctcccgacctcagggcgcccacagcccagggcggggtcacccacctcgtccaggtcctcacagtgggtgccattgcccaagaagcccacagggcaggagccgcatgaccaggacccatcggggaagctgctgcactgggctcccgggaagcaggggttggataaacagccatctgggtgggagaaggcggagcagagttcaccacgcgccctgcgcagcacagaaggaagcccgccctgtgggccgtcaaacactctgggatgtctttgtcatcgaattgtgtagtcaggaacactctggtgtgattctggatgatcatcaagaggcatcatctccaagaccgcattgctcaggtggacacagtgcagcgggttgcagaagcacgtgtacattatgactacacgccacgggccacaccacacaactacccacacgccaccttccacaacacacaactgcctacgcaccaggttccacaacacacaactacatgtcaggtgccacaccacaaacctacctacgcgccacgttccggatcacacaactacccacgtgccaccttccacactacacaactacccacacaccatgttccagaccatacaactaccacgtgccaccttccagaccacacaactgcccatgcaccaccttccacaacacacaactacaccccaggtgccacactgcacaactacctatgcaccacattccagaccacacaactacccatgcgtcactttccacaccacacaaatacctacgtgccatgttccagaccacacagctgcccacgcaccaccttccacaacacacaactacaccccaggtgccacaccacacaactacctatgtgccacgttccagaccacacaactacccacacgccaccttccacactacacaactacctacacaccatgttccagaccacacaactaccatgtgccacattccagaccacacaactgcccacacaccaccttccacaacacacaactgcccacacgtcaggtgctataccacacaactacctacatgccacattctagaccacacaactacccatgtaccatgttccagaccatacaactgcccacgcaccaccttctacaacacataactacatgcaaggtgacacaccacactactacctacatgccacgttccagaccacacaactaccatgtgtcacatttcacaccacaccgctgcccatgcaccatgttccacaccgcacaactacctacacaccatgtttcacaacacacagctactcacatgccacgtttcacactacacaactacatattccagaccacacaaccacccagatgccacagtccacaccacacaaccacccagatgccacagtccacaccatgcaactacccacacaccatgttccataccacacaactatctacatgctatgttcccagccacacaactacccacatgccacaggccacaccacacaactacccacacaccacattccacaccacacaactacccacactccacattccatgccacacaactacccacacaccacataccatgccacacaactgcccacattccacaggccacgccacacaactacccacattccacaggccacaccacacaattacccacacaccacattccacgccacacaactacccacattccacaggccacgccacctggcatcttttttgtttttacattagaaatacaggaggactgaaacacagatgttaaaagtagttatctttgcgtgtgcaactaaaattgatttttcttttctgtgtttttcatctagtttcccaaagcgtttgtgcttttcatcagaatggaagcccgggtttcagtgcccccgcttctacccctcactcacccacggggcagctcctcttgttgcacatctgacgctcctgcacatcccccacgcaggccttccctccgtactgaggctcagggctgttgcagacccgggtgcgctcccggatcccaccggcacaggtgacagtgcaggccgaccacggggaccaggggctccagcggccatcgactgcggggaaagccaaccagggggagctcagagcaagacccggggtggagaacgtgagttggctgagtgagagggaagagcaggtgggacatggtgttccctacacagccccacaaactggtttctccccaggttggctgactacaggtcagagcgtgatcgcaccactacgcctgctgcaatggtggattccgggagtgactcagaagccagtgtttccaatggctttgctgcgatctcttggcctccagaagacaaatcataccacctcttctttttaataaaagaatttttttaatagagagggtctcgctatgttgcccaggctgctctcaaactcctggcctcaagcaatcctcctgccccagcctcccacagtgctgggattacaggcatgagccaccgtgcccggccccacaccaccatttacaccgagaagctcagagctcctcgccaagctgtccctctgccatggagggtggcctcaactcagaagcctggtatgacaccgaatgtcctcacaggcagttcccatgaggcgtgagcacagctgaaggcaatccctgcacaccctctttttctcagcacatccatgcacttcccgagccaggcctccctggggaagcccttgatgctttgggccaagcgctctgtaactcacaccctagtctgcacagacgcagggaaaggctatttcagagagacacagttctgtgcatctgcggcatcctctgtccacactcactactcagtccaaactcactccccgtccacactcactgcccatccacactcactcagtccacactcactcacttccatccacactcactgcccatccacactcactgcccatacaactcactcccccattcacactccctccccatccacactcactccatccacactcacttccatccacacttactccccatccacactcactcccctatccacactcactcccccatccacattctccctcccccatccacactctccctctgtccacactcactactcagtccaaactcactccccatccacactcactcccccatccacactcactcccccatccacactctccctccaccatccacactctccctcccccatccacactccctccccatccacactcactccccatccacactcaccatccacactcactcccatccacactcactccccatccacactcattcccccttaaacaccatccacactcactccccatccacactcactccccatccacactcattccccatccacactcattgccccataaacaccatccacactcactccccatccacactcactccccatccacattcactcccatctatactcactccccatccacactcattcccatccacagtcactccccatccacactcactcccccatccacactcactccccatccacactccccatccacactcactcccatccacactccccatccacactcattcccccataaacaccatccacactcactccccatccacactcattgccccgtaaacaccatccacactcactccccatccacactcactctccacattcactcccatctacactcactccccatccacactcattccccatccacactcactctatccacactcacttcccatccacactcactccccatccacactcattcccatccacactcgccatccacactcactcccatccacactcgccatccacactcactcccatccacacttactccccatccacactcattcccccataaacaccatccacactcactccccatccacactcattccccatccacactcactccatccacactcactccccgtccacactcactcccgtccgcactcactcccatccacactcactccccgtccacactcactccccatccacactcactcccccatccacactcactcccatgacagagctgcggtgctggatcattcttcctttaattacagtctgtcctgaactggaatgaaacggggctatctcagaggaggtttgcgctgagcacaggtgagcagaattaatcacaaaggatgggttcattaccgagccaggcccgggatggcagccccctttgctgctcggctggggctgggctgggctggaacaggccctgacaccccggatcccggctccagctgtggctgctcactgtgagctgcctgcaagcccgcccacccagggccccgccttcaccgtacttacttgggcatggggcgccctggcaggctttggtctcccggccactccctttgcaattcttgccccccatctggggcactggggagttgcagagacggatgcgtgtgatattgccaactccacaggtcacagagcatgaagaccaaggtgaccagtggctccagccgccgtcctgccggactaacacaagaagcggagagagatcaggctgtgccgcctagaggggtatttgcctgtaagcggtgtgccttattaaccgaggagcatctcacagctgctgaggagagggaaggagaacccctcccatcagctgggagaaagagcctcacctggctagaatccttgcaaaggcccagcacctcgtgagggcagctctgtcccttgcaaaggtcccgatgactgagagaaacgcggccccacccccacaggcacgcgggtgtcacctgcccgacactcactgcgggtgtcacacttgctcagactgcaagcccgtgtctggatggagggccccaagcaggtgttgctggtgacgtcacaggaccggcctctctgctgggtcccagagccacacgtcacggagcactgggtccactctgcccacggagaccagccctcctcaccgtccaccgctgccagaggaagcaaacacggtggcatcaggccctgcctcacagacgtgccacagaacagaacgggcacagggcagctggcgtggggccacagttcatgcatccaggaatctgaggggccactgcctggctggggcaggtggacatcccagtggctgggccgtggctccgtgggacccaagtttgtgacctgcacgggagttcagggactgcctttcaagagaagagcaaaaacgcctttctgggtctactattagggtgctgaggggagctaaatccatgtgtgtccaggaaagtctcttaatcgattttataaaatagcttgccaaagacagtgttgaatcttttctacatgaggtttcattaaagttacaaaaatgtaacgtatttccatttaacctctgttcgctgatttacataatgtagtgaaacatttcaattattggtgaaaattacaggtcacttatttccaagtaaactgaaacaagctaataaaaaggagattccctgtaaagaaattcttcataggtaatcacagccgctaaatggggggaaagagcaacctgacgccagaaatcattcccgtgaggagagaagcccagtgaatgcgccatgactcagtgttctagaaagcagggaaatgaaagaaaagaaaaatggtcaaggaggtcttttcctggtcatgatgctcctgataacataaaatgtctccttctagtctaatgtgggccctttgattatcaagattatatttttatgctttgccaggagcattctgactttgtgaatacctaacaggcacttttacgcatattgaattgttggttttaattataagactaactgtataggggatacattttctgcatgttacaggcaataaatttgaaactcagaaaaatcccattttattcaaaatcacagagtggcagagcgtgagctctgagtcccttcattctctgtccacatcagaggtaaggtgccctgaggatgacacagctctggggccacagggacattctgggaatgtttgggggatggtgactagtttagtttgggagaagcgttgcctgatcttagtgcagcagcaacttggggtgtagacctgaagcaccttgccaacggcacggcactggggagccacggatggctcaggagctctgggtggggtcagcagagctaacttgggaagggaactcggggcaggggtgggaggcagcacagagacctgagggcagcgttggggccaactcagtctctgaacgtgcactgagtttccagggtggcccaggaacccccagggtgcccacacgtggttcctctccatctcaggttctgttccttagaatgtatttctatcccttagaacatattcttcggataacagtctttggtttttgtttgtctgattttctattgttttttccaggagtgtgtgtacagtgatcacttgctgccataacacagtcacagatctacgtgtgttctctgactctcagctggggctccatcggggcctgctctgggctcacctgcgtgaccactgggctcagcttcctcgtctgagaagcatcaggactggccttcccacccccgcgttcccagggcttccacactcctttctagccatgagtcagtcctcagtggatgaccagtggcctggggtggccctctgattctctcacctgtactcagggggctgaacctcactcttctctgccaaaaccaaccaatgaataaataaacaaacaagcatggaattcctaaaaatgcaggatgcgcttgccggctggcgatactcacagtggaggcaggaagggcagcattcgccttccacaaaggatggactggcgcaggttgcaggcgggcaggtgatttggtggcaaatggttttaaatttctacaagtgaagaaaggcatgcatggaacactcatttaaaaggaggggacgctggtacaagggctgagactagaaggggtcgacagaatggctgaatgttttccatcctacggaccatacattacagagatgtgaaaataagggcatctttttctcccattagtgctgacagcctaacaagaacagggcccccagatggctctttgcatccattccattcctttctcccttcactgagcagcaaggatgcaacagagagctccaagcttcctggaaggagggaagaaaagacgggcagcaggaactcctgttatctaaggtaatgctgaggccattgtcagcagaaatagagtaacattaaaagctaaattgtctgtctgtaagacttcaggcagtggcttgtatttcccccaaacgtttctgctgagcctcaggctctgttggaaccggatggaattaaatgcagagtctagggccatgtctggcttctctgttcctcctgtttctaaccaactggggacgctggccaggttgctccccctctctgggctctggttctttatgtgcaaacaaagaggttgattcaagtcctaaatacggttcctggcccttctgtgtttcttacactgaaatttcctcacatagctgaaccggtttcacacatcagcactgaacgctggcatttccaggcagtcaggttctgccaagtgtccgatggtggcctcttcccccaagagccgtgttctggggcctcaccttgcaggtacacgtggtgcagctgtccaccacccacgtttcattttccgcaaagaaccggccatcctgccagcaagctgacatgttccttgtcttaggagggccaccaatgagctcccagagaaactggttatcattcgactggaaaatcaagtgaaacatttaagtgtagacaataatactacatatttagtcatcatgcttgtggatgaaaaacaaagttcctccttcattaaaaagctctaaagtcaagtaagacttgactcatccctgggtggaagttccggaagttgtcctccatcctcacggggctttctgagccacagcttcgtcactgcctgggcttctggggctccccatccacctgccttcctggagagcggaaatcgcgtggctcacatcacacctggaccagtgcagagcaacgctggggctccttcgactggggacgccaggtgggactggggtgggaactaggtccccaggcagcagccataacgacaggcagggatacagccaagctcctgccctcgccaccctccctgccccggtctcctgccatcgaccccctccctgccccaggctcctgccctcgccgccctccctgccccggactcctgcccctgccgccctccctgccctgggctccatctcctggcatcatttacttcatgccctctgggtacgagtgacagtcagcatcactgcaccctggttagccatgtgtatgttgtggggcaccgtggcccggagcacctcattatgttcagtccctttctctaaactgcgagctgcccgtcctgagccccgcaggcatcgctctctcttcctggccgcgctgtgccgctcaaacccatttcactcctgccagcctcacaggaacttcccgtcctgcctcttcagctatgccaacatgcagtccttgaaataaaattattttcctctgcaggtgtgtgtgtgtgtgtatgtgtgtgtatgtgtgtgtgtatgtgtgtgtgtgtgtgtacactcatacctacagatttaccaaggaggtaaatttcccaaaattaagaatttattttggagactgtgcccaggactgttttccttgggaatacttcccaagatctacccaacttccctctaacaatgctgaatattgagcaaggatcctgaggagcccggcagacacctcccctgtgaactgtgggtttttacatcgagcatgaggcactgccaagccagggaatgttgatacctgctgagatgggccagcggcggagctgcccatgccctatgacccccgcggcccctgcgtgagtacccaccactctcttgaggttctcgctgagctggttcacgaggacgtggagccccgagagctcctggaccatgtttcccagctcctcgcacgagcgttcgcacacctcgggcctcctctccgagctggggcccacgtactcggtggtgacatgcggacccaggcgcagcgtctctgtgttctcactgatggcgttgatctcagctgagggcaagcgtagaagggccgtgagcatcacagaggacggggccagcagcaggggctgggaacagagggaggatgacccgccctggctcccggagcggcctggtgctgggagacacaaggcggaggactgggccagcagcagaggccaggaccacagggaggaccatctgccctggctcccagagtggcctggtgctgggtgacaccaggaacagcagggacaggggacagtggctatttcccacgctgccacatgtcacagaaggagcagagcagaaattagctcaggagtggggagacgcatcagcataggagaggcctgcacagtccaaacgcaggagcaccagtggccacgcatgtcactcagacccaggtcccctctttgcaaagcttccgaccacaaatctgcttcttgaacacatcccccatatgttctgacggctcctctcgactcttcatcctttttttttcatccccaaacaccctttcttatggctccttgctctgctttaaagaaaattcactatcctcttgctcaaacagccagtccccttgagactgtgccttgctcctcctggccttcccaccttcccactgctcctaacttcccaccttcccccaaattcccaccttcccacattcccaccttcccaccgctcccaccttcccaccactcccaccttcccaccactcccaccttcccaccactcccaccttcccaccttcccatcttcccaccttcccaccactcccaccttcccaccttcccaccttcccaccgctcccaccttcccaccttcccatcttcccatcttcccaccttcccaccactcccaccttcccaccttcccaccactcccaccttcccaccttcccaccttcccactgctcccaccttcccaccttcccaccttcccaccactcccaccttcccagtgctcccatcttcccaccttcccaccactcccaccttcccaccttcccaccttcccaccttcccactgctcccaccttcccaccttcccacattcgcaccttcccaccttcccacattcccaccttcccaccttcccaccgctcccaccttcccaccttcccaccactcccaccttcccaccttcccactgctcccaccttcccaccttcccaccactcctaccttcccaccttcccaccgctcccaccttcccaccttcccacattcccacctctcccaccttcccacctctcccaccttcccaccactcccacctttccacattcccaccactccctctgaagccctagatcgtgggacctgggtgggtatggcatgtaatttacaaattgacctgaggcgagtcagggacggaggcggggtccagtcctcaggtcagcggggcctgcgcagttgcagtcagggcccaggctctaggccggagctcacctcacccccatgtaggaccctgctccctctcaggggtgaagatcccatctttgaaatgcctgacttctctcggacagtccattattgaggaaagacttagacattttacagcgctgtcaggcattccgtgattgagtttttaatcacttggttataaactgtgctgcaattcatactaagctcagaagcttcccctcggattcatgttgcccataaccatgtacaatcaggtcaatatcaacacattaatagagacaaagaaaccaccctgagtggattttacccagcacactaatctttaactaacctagggtatttgtttttcattcctctaaaagttaaacaaaagaccgcatatatctttgcttctgctctggctctgacaggaatgtagttttacctggtagtaaaaccttccagctaacttgcatttctccaggcttctgccagtattctcagttgtaaaataataatggctcagcctcttcacaaggttactctcacttttaacaaacagtggaaaaggggatgtcattaccaagaaccaatccatgaactagctgtttgtataagaccaattttccttaagtctgacataaccagtgaagaagaagtctttgttgtgttggcaaagatctccaaatgggacattggcatccacctggctttgagtagactaactcatgggtgattgccacatatggtccggtagatatatgtatatagatccatacttattctacacatctggagataacagatctagatttctctgtgtttttttttttttttttttggaagatctaagagtttcccataagttttaaaggtttgcttttgatagttccagggattattgacttgtacctgtgagcctaggaaatacctgctgaaggaggctgcacctactagggtgtatgctggtaacacacacacacacacacacacacacacaaggtgtttgctcacatagaggtgtaagtcacgtttgtcatagtaggttagttttactcactgaccattatgacaactgactcaacatgccatggacaaccttagctctagtttaactgaacccacgtgaaattatagtacaaacatgtgattaggaacaccgcgaagggtatattttctttcatacaaagaatatttgcatatatgttttgtttataaaaacaatatttttctatattagtgaaaatacacacgcacgcacacacacacacacacacgtatacatataaatatatcagactgaaaaaacattattgcaacaaaaagtacccaaaagccccacagccaactgcaccccaggaacccccagaagagcactgcctcatgaagctgaggccctggcacgcagagtgctggagccaagataactctgcctgtgctgcaaatcacccctcaggtaacaggcacagtgagggtcgtggtgggggtgacagttggagctggaatgagggttggtcttagaacacccttctccctgcattgatgatcaaatgtctccttgttctccttcctcacaggacgtgcacaaggacccggacctgcaaagtgtaactgaagagtgggctacgcaccccggttctgaagtaggcggtgggatcacagagtcattgtgcaccaaagataccaaatctcacatattcctgatgtatagattcatgacataacagtttacgcttgtcataatttggaattgaaatggcctggccttcgtgtgcacacggccacaccgtgtggcagacgtgagctccgctttgaggctgtcagacagacccaggcagcagccctgctccctgctcactggggagctcaacatggcagccacacagcactcccttgggtgccagccttcatctttgtaaaatgaagaaagtgaaagtgcccatctcacgtagtcattctgaagattagatgatgtacggcatttaatgaacctgtcatagtgaccttcagaattaaatgctcaagaaaatattggaaagtgtgcttggaaatatgattcacaattgtaactaacagaaaagatgagatcatctgtcaatgatttaagtagcatagatttccatcatatgatggagtcaacaactatgaacagtataagaaaacttctaggccgggcgtggtggctcacacctgtaatcccagcactttgggaggccaaggtgggcagatcacgaggtcaggagatcgagaccatcttggctaacacgctgaaaccccatctctactaaaaatacaaaaaattagctgggtgtggtggcgggtgcctgtagtcccagctactcaggaggctgaggcagaagagtggcgtgaacccaggaggcagagcttgcagtgagcccagatcgcaccactgcactccagcctgggtgacagagtgagactctggctcaaaaaaaaaaaaaaaaaagaaaacttctgtaagtcaagttcgacaaatatctatgactttccttaggcagacaagcatcacacattaatatactggaaaagttgtctatatttcaactcatattaaagcaccagctatttatattttgtcttctataataaaattatttggatgattaaaatctacttaaaattaactgtttaatcaatttattattttcagatatcaacatgtctaagttgaccagctaagtcactcaaagacaatagtggtagttacccaaatatttttacttaaatttttacaagcatgaatgcacacacatacacacacacacatacaccatgtcacaatagaaatccatccaagccagtatataaaatgcatttttcacaacacacctacctccctggccttgctggcaacccttcttgcttagaatatcttccacagagttttcaaacactaggtggacgttctgaagcaaaccctgtaagtatacacaagcagaaaaatagagcaacagataaacatccaatgtttgatgccaagctaactgacattctaaaaatacaagttggaatcttcaagtagtgagagtatttccttctacgtagcaggtttgcaatctctttataatcagtttttctgtatatagtacttttgaaattttgtttttaagcatgacacaagaaatggaagtgtaatgtaagaaatctacctagaagaaggaaatgtttcataaataagagtgagatggcccttggagaggtgtggcctgctgtgtgttctgggcatgttcccatggacgttcaaggccattcgttccttgcaagtcactcatgattagcgagtttctgcatttggcaaagaggctcacagagtcccactggtcctctcagagacacagaccctgggcctgcaggagcgccttccgcagctgagttatgacggggctgggccagtcctatatggtatggaactcctggacacccatgagaaattgactcaacaacaagctatgcatctctagaccttttactcaaattactgagtttaaccatgtacttatttccaaggccctacacgtccgggagggagcaatgtaccatacaccattgtgattctaaagacctgcagtttaagattcatttccaaacatattttaaccaaaatggacatgaaaccattccctcataaatcactagccctttcccttggaaaagggcacctgctactttgctctcccatcatttcgctactaaagcaaacatttaggagtggttttggttgtgatcaaaaaagtctgggattgctagaaacatttgaatagggttgattccttgatcatcaaaccagcctcaatctcaactgacgataattagtgcagttagggaagcacacctggggcagccctctctgattaatcgtggtttagaaaggcgtgcgttgtgtgtgtgtgcgcttgtatgtggtgtttgcatgtgaaagggtgagtgcctgtgtgaaagtacgtatgtgctgacaactgcctgtggctctgcatgcattgtgtgtgcacgtgtgcctgtttgtatacacatgtgtgatggatgtatgtgcatgcatgagtttgcatgaggtgtttgtgtgtatgtatacgtgtgtatgagtatgtgtgcatttgtgcatgtgtatgtgtgtgtacatgtgtggttctgtgtatgcatctatatgatgttcatgtgtttatgtgtgggggatgtgtgagtgtatgtatggtgtttgtgtaggtatgtaaatgtgatgtgtgtgactgtgtatggtacttttgtgcacgtgtgtatgtgtgtgttcacatgtgtgtggtgtgcgtgcattgcatggctgtgggtggtgtgtgcacacctgttttgtgcacacatgtataagtgcttacatatggttgtgtgcacatgtgcatgcatgagtgtgttcacatgtatgtgtgtggtgtgtgtgcatgtgtggtatgtgcacacgtctgtgaatgtgagtgcatgcatggtgtttatttgtgtatgtgcatgggtgcccacgtagggtgtgtgcacgtgtgtgcatgtgtgtgttcacatgtatgtctgtgtggtgtgcatgtgtgcacatgagtgtatgaatggtgtttatgtgcgtctgcatgtgcgtgcccatgtatggtgtttgtgtgcacatgggcatgcatatgtgagggtgtgttcacatgcatgtgtatgtggtgaggtgtgtgtgtgcgtgtctgtgtgtgtgtgttgcgtggtgtgtgtacatgtgtgatgtatatacatatgcgagtgtgagtgcatatgcagtgtttgtgtatatgtctttggatgtgtgttcatgtgtttgtgagcatgtgtgtttgtgtgtgtgtgtggtgtgtgtgcatgtgtgcacatgcctgtggctgcgtgtggtgggcagtgtgtgcatgtgcatgtggtgtgtgcacgcatgtgtgtgagcacatgccgggatgtgcagtgtgcttctctaaggccaggctctgcctgctcaagcatcgcatcaccagacgcattagcagatcagttcccagctaagctctttcctccctcacggcggccacctccctgcagagcgtaccctgaagtgactctctctggcagagcctttggccacgtacatccggctcttttccgcctgcaggtgctcgtagaagggctcgtccagagcgaagctgtctatgaggtcgcagcccacgtgcaagctgtaggtctcgccagccacctgcacggtgacgttcttccactgcgagtcagccaggccgacgtcctccagggagaccacatgccgggtgccgtcaatccagtaggtgagatccagcgtgtccgcggggccgttggagacgatctcgaactgcctctgggagagaccggggccctccagagccaacagcgtgcccctggacttgccgtcctgcttgagctgggccgtgaggaagaagccctccttctgccgcatgatcttggtgatcttgctgaggtcatctgcgttcaccggtgggatgtagtcaaagcgcacgaagcggtaagccggcacgccggggtcgggcccgcggaactgcttggcgccaatggtcttgcggttgatgttgctgatactgaaaaggtcgaaggtcgtgtctttgtcctggtgaccagctgcaaagggaaccgcagtggagaagggtgacgtaggggaagagggcgaggttggcctgacccagggtgacaaaccagaacctcgcgtgtaaggaaattaacgaggcctcccaatatcccgcagcttctctcccttttttatgggaatcctggagccacctctgatgaaaagccactatcctccgtgccagtgccgctactcagagtgtgggcccaacgcagctgcgggtctgtggggtcagtttctgcccctggctggtcgaggagcgtgtgccagaaggtaaatcggtggagacaggcagcgccctgtccgttcagctggccctttgcatagcccgaccttcttggtgagggaatcccggcctcgcttgacatcctggcacatgtcccaggtcactctgtctggctcttccatctcagatctgaggctgaaaagcagccatcctgtctaccagttgattgctcaggaaaaaaccaaataaatgaataaactgggaaagacatggatctttagccttgctattgatagagtgtcagaaagcggctaaatcgtatgttgctttcttgttgagatcaactgcctaaaaccagttatgtcagcaggttgttattttgtaaaaatgtattctccaactcttaatgcaccctgtgggtaaggatctgaaagagtggtcagtatcaagtacagaaacaaatggttttaagtcaccacctaagctattggcaagaaaagtgatcagatctcacgaaaatcataatagtttaaataattcaaagccaggcgcggtggctcacacctgtaatcccagcactttgggaggccgaggtgggtggatcatgaggtcaggagacggagaccatcatggctaacgtggtgaaaccccgtctctactaaaaatacaaaaaattagccaggcatggttgtgggcgcttgtagtcccagctactcgggaggctgaggcaggagaatggcgtgaacccgggaggcagagcttgcagtgagcccagatcacgccactgcactccagcctgggtgacagagcaggactccgtcccagaaaaaaaaaaaaaagtaatacactgaacagaaagtttagccaaagccttccttttcatctaatatttagcaaattagaacaggataatacacagggttgctgacagaagtgggcaatggaccactttccatagagttacttggcaagaattaaaagctttgattcagcaattctaattttgtaacctatccaaaggatataatcacaaatgctacttaagatttatccacgtcaatattttttgtgtcatcatttatgctaatgaaaataaaccaatctaagtgggaattgattgaaaaagatcaggctttatctgtgatgaaatattatgtggtcattaaaaatcatactgtagaaaagtaaacacatgggaaaatatttaaaggaggaagaaagtggagcaaaaagaattcaacaaacaccaaatacttgcagtgttgtgaacatcctctatagaaaaaaggataaactgtgcaactctaggtggaattgcatttttctctaacacctgaattttccaaagataaattatctcatgtcatattggctcagaagtaagttactatttgatttataaaggagctagaaggtcctcacgggtaagattgtccaaccacacactttattttgtcatctctccccttgcagctaagccatatctcacaagccagagagagaccacaggctctgaggacactcaccttgcgtgctgggccacacccacagagccagcaggaccagcctccagaccatcctgcctcctgcagctgagctcctgggaatacaggaaacccttgttagtgatgagtccacagctgcaaccctgcctgtgagcgagactggcccagtgactcacatgaccattgaataacagtttgcatataaaactcagcaccaactggatttgtggcaaactgagagcgaaggaggaaatttactcttcaagcaggattcttctaactataagatttgttgagctagcatttgccggcaagcactgcacatcacgttctaaatattcctattatttcatcttcataatagcctgggaggtatgtgctgctctaattgtcctcattttacagatgagcaaatggaagatgggcaagttcagcgcttgcctggagtaattctgttcatacgactcgtagacaggacttagatgtagaaagtttgaatttagaaaaatatccagcctgacaaaaataatctgtgaacgcattttgtgtaaatatccagcaaaaaacagttatgcataacctaattaaatagaatgaatatcaactgtaaaaaaaagttacaaataaacttaatttggtgaattatacttacaaaacaacagaacacttgacttagccatcattttgaccctgcctctttattttcctgcaggcctgtttttccattcttggggattttaagttggcacagctcagtggaggctggccccgaagtcaggagatgtggtccaaagcccggctgggcgattaaccctgtggatctcagcttctcctcttccgggcgagcatgagcctgagggtcccagggctccccaggtcccttccagcaattggtcacaccctgctctaggttgaagggaagactgagaccccaattcttcccatatttagaatatcaaaggccgttaacttctcattgttaatccaaggactctccctctccagaaacaacatttggtaacctggaaatcctcaccttccaggaatagagaaacattcctcagaagaagagaaatgcttggcagcacctgcagaccccccacccatctgctgctgggaccccccccccaaaccatctgctccccccagtgccgccccaggggtccttggtgattgtttcatctgtcctggctccggaagcagcacggcctgcggccggagtcagcaccaggctgagcaatgctgagcaccagctgtgcaacctagggaaacttacttaacttctctgtctcagtttcctcatccgtagaatgaaacgtagcgtcatgtaaaatgcccacctcatcgggttgtcatgagagatgaattcggcaaatgaaacttcaccaggggctgacttagcccagcgagccacaggcatgggttaccggagcagaatgtgcctctgggtctggggcgctttctactctaactgcccgaggcagctgcagtaataatggtggtgctgatagggcctttctatggagctcttaagagggtttaatgacaggagcgaacacttggccatgagcttagaacagtacctgcatgcagtaagcaccacagaacggtgttagaatacacagctcaggtacagccttggcaggctcttcccacctccccacctcatcagcccacactgccgggtacgtcgcagtcccctaaggacagctgtgtggggctggccctgcagaggccagccaagaacaggatggtaaatgcgaaagttctggatgcccagcttcataaggacaggttagaaaaactaaatcaaactcctttgacgaaaccagatcctactgtctctgccttgaggtagattcttacaagagcaggaggctaacaaagcatcccctgctgcggattgtcaaaggacagtgaggctccatcccacaggaaggatgagcagccaggctacctggcctcagcccatccagggacaccgggcatgcatggatggagccacggatgagccagtgccgctcacccctgccccagcctctgcacgccacacatccacgtttatgcttgtgtttttccaaaagaaagatttcggtgcctgtctgcagcagaatgtagtttgaatttgcaaaggtcttttaaaactcttttcgtatgaacaatcaaagtaaaagatagctttgcagagagctaattgtttaccggccgtccaccaccaacagcagtctgattaaacaccagactcctgggtgctcagctcccagtcctgggcagccaaacccaccttccttaagtggtagccaggcaacctgccagctcgcttttcatatgcaaactgccccaagactgttaaaagtcgctgtgtgtcccggcagtcacaggattttccatagacttaccacaaatactctctagttatgttcaaaaccacttttcagctgctaataatgttaacaatcagagtctctctttaatctactaataatgttaacaatcagagtctctctttaatctactaataatgttaacgatcagagtctctctctaatctactaataatgatgttaacaatcagagtctctctctaatctccagttacttttcagatattccgggagttgtttctaattctctcctcaataacaaactctcatgtggaatcttcttcttcggaaactgaaaacataaagcgtttacccgggttcccaggcaggtatatacattgaaatagcagcagccacaaccctcagagaggaaggggtgcccggctggtgaaagcacagccacggaggaaaagctgaggagcggccacgtgccttgctcttcaagcgggcagtagaaacaccacgtgaagaaacacttgccatttagtgttaatagatacaccacccaccttaagttaagaatcgaaattgctcctttttcttctccgcttcttagagttcgagaactctaatttcttaaaattagagcaccattaaataattgattgagtttaagaaataatcgtacctggtttgccaaaaagatgcagtgatgactggtttcagtgttccggaccgagtcagaaaggcgcaggctctgctggagcgagagaccggccctgcagtgcaggatgctccggtggacgtggccgagcggctcccgggcagcgcggctttatatgccgcttctcctgtgcagggctgtcaatcagacacacgaggaagcacgtttaattcattccttcgaaggaatgacatcatcccccttctgatctcaccatttgctccgagtacctgctgcaggggtccaagtccagcccctctgtactggatgccgtctcctcctcctgcaccccggcccctgccagacaggcctgggaggagccagacggagagagggaaggcagggactcacttttcctgtcttctctcaggaaataagatgctataaataacactagcaagattggctagaactcctcattttgcttaagagaaaaaaatgcaagttctatgccttaaatatgtttcgaattactcaatgtgatattggtctttctaaaccaaatgagtgactctcaataacacatgaaatacatcggtgagtatcaataatcagtctgtatattaataaagttattatggtcaataatcaagtgtattatgtgacaaaaatgaaatttaatataaaaggaagttgccaacatttatctcaggcagttagaggactgaaaagctgtactgcagctttgggaaaattcatttttacccaaattctgcttcatttgctcagtgaggatcccctagaaggacgtctcccagtggacgtgcaatacccgtagaagggtgtgtcccagtggacgtacagtacccggccaagtccccttggtgcacacttgcacgtggccccatcacaggaacaacctgacgtgcaggcacagagcaaggactcgagagaacgagaagcagtggcagcagctaacccccgcccctcccacacctcaggcatcacccgcaatcagggtgcactctgcatgggggtggggggcaccgcttctcagaggtcagggtggacgatggatgcggaggggctgcttctcccaggtcagggtatacagtggaaaggggaagctgctgctctaaggtgggggttgatggtacatgggggaggggctgcttctcccaagttgggctggacagtggatgggggaggtgccacttctcccaggccagtgtgaaaggtggatggtggagaggctgtttctcccaggtcagtgtgcaaggtggctggggatgtgttgtttctcccaggtcagggttaatggcagacaggggagctgctgcttctcctgggttggggtggaccttggatgggggaggtgctacttccccaggtggggtggatggtgactggggagctgctgctttgcccggagccacctgcacctgcttcatgtcggcacctgcctgtcaggttccttcacgtttgtgtggagttgtcagcctggccatggatccgtcaagtcctagttagagaacattaaagcgaatttctgtggacacaacccttactgtgtctgtggcaggggagtgtctcttaagcctcctggcattcccccacaggggtccagcgctgcagaggtcggcaggcaccatgaagagcaagcctcactttctggcctctgtcttcagggaggatatgcgagcgggtgtgggagagggaaggagctttcatttgtgaaaacctctgtttttcctaatggcacctgtttatttatcacttggcaaacatcagtttccgacacatgcacagacaaaagcctccaagagtgtatgtgtcatgtttaaggtacgttattttgctttttaagctattagggacaaagtcatcatttgaattaaaaagtagtttaaatagattgatgttatctcaaattcaaaaaaagtataaaccagttccccttaaagaattttcagtggataattatccattcatcagtttgagtttttctgcctccaggttagtttttcctggggccagaacatggagggcggcatcccctactctgcgtgccacggcctctcctgttcctcagtccacagaatgcgtgtttcctgattaaagctgaagacaggcagctcagctgctcagcacttcaggagcatgcggtgaagaccgtgacactcactggggagcaggaaggtatgtattcatgactccacgtgccgatgggcaggtacagagaagatgggcctccttctgtaaaatctggcagcccagaatcagggaagtctgtttagaggagacagaaggtaagccgattggaacatggcccgtgaatggggtgtccccagttgagaaagtatttcaggcagagagagtgggtaggtgttcatggtgcaaagaacagcaggctcctggtgcggcacccaggccaggtgcatggaatgggcttcatagacgatggaagtcacagagagtttcctggcagggtgaggcgggacttcatgggcccactgtgcaggggaccagagggggagtagaggggacagcccctggtcagcatcttccctgggccccctgggggtgaggaggaagggagatgtgaggatgaaacaaaaagcagtcagaggcttcgtcaggaaagccagcgatgctgagggaagcatcatcacatgtgtgcgcgggaggatgagggacagacacgcagcaggtggaatcatgtccccccaagttcacatccaccccaaacctgtgaatgagcttactggaaataccacagtgcttgtggatgaaatcaagtgtagatgtcgtcgaactgatgtaggacaggctccaaatctaatggctagtgttctaataagaataaagaatatgaagacggagacacagggcgagctccgcttgatgaaagaggcagagaccacagtgatgcaaccactagccaaggtcaccaagggctgccagaaacaccagaactgtgggagacagggaaggggcctctgccagaacattccgaggacgtgcagccctgccacacactgcatttaaaactgctggactccagaaccatgggacaatacatgtgtgttgtttgtgatacttcatcatagcgggcccagggaactaatacaggcacaccttggagataccgcaggctcggttccacacctctgcaataaagtgagttgcatggatttgtgctttcccagtgcatataaaagggatgtttacactccactattgtctattaagggtgcaatagcattatgtctaagagaacaatgtgcatatcttaattctaaaacatttcattgctcaaaactactaaccgtcatttgagccttcaatgagccgtcatcttttcgctggtggagagtcttgcctcaatgctggtggctgctgactgatcagggtggtggttgctgatggttggagtgtctgtagcaggttcttagagtaagaccacaatgaagtttgctgcatctatggactcttttataaaacgtttctctgtagcatatcatggtttttgatagcagtttactcacacaataacttgtttcaaaattgatgtccattctctgaaatgctgctgctgttttttcaacttagcttatgtaatagtctaaattatttgttgtcatctcaacatcttccccaggagtgaagcatttcacaacatcttcactgggagtacatttcatctgaaaaaatcattttctttgctcatccttaagaaataactcctgatccattcaagttttatcatgagagtacagcaattcagtcccatcctcaggcccagcttctaactctacctctctcactcattccatcacatcttcagtgacttcctctactgaagccttgaaccctcagggtcatccctcatggtggggtttggaagaatcagcttcttccaaactcctgtcagtgtttatatttttccttttcccgtgaatcatgaatgtactagtggcatctagaatggtgaatcctttccagaaggttttcagttgactttgctcatattcatcagaggaatcactctctatggcagctatagcctcatgaaatgtatttcttaaatagtaagacttgaaagtccaaatgactccttgactgatgggctgcagagtggatgttgtgttagttagtaagcatgaaagcaacatcatctcattgagcatttccatcagagttcttgggtgactaggtgcattgaccaagagcagtaatattctaaaatagatcattttttgagcagtaggtctcaacagtgggtttgaaatatttagtcagccatgctgagaacagatttgctgtcatctagactttgttgttccatttaaagagcataagaataatacctttagcatagctcttaagggctaaagattttcagattggtaaataagcacaggcttcaacttgaagtcaccggctgcattagcctctaataaaagagacagcctggcctttgaatttttgaagccaggcattgacttctcctctgtagctatgacagttggagatggcctcttctaatgcaaggctgtttcgtcttcattgaaaatcagctgttgagtgtagccacctccacaatgattttagttagatcttttgggtcacttgctgcagcttctccatcagcacttgctgcttcaccttgcatttttgtcttacagagatggcttcttccctaaacttcatgaaccaatctctgccagcttcgaacttttcttctgcagcttcctcatctctctcagacttcacagaattgaagagagttagagctttgcttagattaggctttggcctcagagaatgttgtggctggtttgattttctctccaggacactcaaactttctccctatcaatcagcaataaggctgttctgctttcttatcaatggagtgtattatatccgatgggcatatttcagtggaagccggatggatgagtctaaagcctgggcgatccttcattagagatgatgtttaaatccatgggcaggagacaggtgaggccactggaaagaggaaggcaggaaggggcagacagagccttagggcatggacctctggctggagctgaaccacaggtgtggtgagggagagggctcccttctgccccagaaactcctgtccctgaaccgtggtttccgttgtcaggttgtgcatggactgcgtcagaaacagcaaatcctggtgtggctctgttcctttcacagtgacgcaggggggttgaaaagcaactggacacattgaatgtgcagaggcctgagctgaagaaaagagcacgggctggggaccagggccaggcacactcgtcacagcccttctgactcagaggtttttatatcacctccccttgctcttctctctggcctgaacctgctttctaagcaccccaaggtgatctggggatacttgccggatgggcgctgcttggagcttgttaaaattatcaaaagaacaagcagacagacttcccctgcacggcttctccacctggaatgcgcacacaggacactgggcctggcccaaaggcagattccgactcagtaggtgtggggttggggaatctgatggtgggttttgaacaagctcccctgctccaagatcacgcttggagtagcaagactttagtgactgtaactcagcagggcactgttatcctggccaccaccctggggtgggtttgttgtcacactcattctacagaggagaaatcaaaggtcctggctctggcctcgccttgtcgacccttgggtcctcgggaccaggatccttccctggagaggggcccagaattcccagggccagggctgaggccagtccctctggctttgattccacccaagctgcactgacttggagcatacacaggaaaaggaatgggggctactttgtcgatttgtttgaggctccatttgctcatccatttattcaaaaattactcattgagcatctgtggcacctaacacatcccagacactgcaaacagcacagtacacatgaggcataaacaggtccctgccctttggggctcctatgtagcctggcctgctgcctaattgaattcccactaagcctcatggaactgtggtcatcagctgatgctctgtgtcttgtgtgactggagccccctacctcacaggtaaccgtaaggggtgagcaggaatcttctgctcatttctgttgtgcataaattctaattatgtcccggacaccacagattccctttcccaggtgttgtgcaaacattccaaggcacgtggcagggccttctcggacatttgtgtggcccccttcttcacctgcccagccatcactccccttgtaaacccagcgtggacctgagcccatgcgctccacatcaggaggcccaggggctgcgttcatggcccaggcttcctgtgggcatagcccaagccccctccccctatcccctgccctggagtggaggtcatccctggagtggagggaggccatgcctggagtggaggtcatgcctggagtggtgggaggtcatgcctggagtggagagaggtcatccctggagtggaggtcatccctggagcagaggacatccctggagtggagggagatcatccctggagtggaagtcatccctggagtggaggtcatccctggagcagaggacatccctggagtggagggagatcatccctggagtggaagtcatccctggagtggagtggaggtcatccctagagtggagggaggtcatccctggagtggaggtcatgcctggagtggagtggaggtcatccctagagtggagggaggtcatccctagagtggagggaggtcatccctggagtggaggtcatgcctggagtggaggaaggtcacccctggagtggaggaaggtcatccctggagtggaggtcatgcctggagtggagggaggtcacccctggagtggaggtcatccctggagtggagggaggtcatctctggagtggagggaggtaatccctggagtggaggtcatgcctggagtggagggaggtcatccctggagtggagggaggtcatccctggagtggaggtcatgcctggagtggagggaggtcatccctggagtggaggtcatccctggagtggagggaggacatccctggagtggaggtcatgcctggagtgaaggtcatgcttgagcaggtggatgtgtgtcacttcatcctcttgcactgagctgcctggacacccaattcatcctccctatcccaagagccccttatttcctgggtcatgcctgtttccctgctggactggaagtgccggtgtttcagacactgaatgtctccctcacttcccctctttgcctctcagcccctacattcacctgccctccatttggggagtttggtttccagattgtggagactttgatctggcccagcttgccttcctcctgttctgcatgggccatttggatgactagcttgggctgccttttccacctgctgagaccttttgccccttcatcacacacattgaccttgcctccaagactgccacagatgcgagtttgctggctgtcccctctgtggcactggtcactgacgggaatgctcatggccaggactgcgcacagagctcacggtccttctcatgccattctcaaatcgctgtcctctgtctgccttccctcctccctacgttatcagcaccgcaggcatctgctccctggactcagagtctgtctctaatcacagggctcagagtgttctatctcttttagggactcccactgtaacgggggatctttgggactgcacgaccactttagaaacttctggaataatggaagtttcaggaaatgcatctgcacagatactgcatctttacaaactgaaggtctgtagcaagtctgcaggtgccatttctccaacaacaagtgctcacttcatggctctgtgtcatgctttgtaattcttatgctatttcacattttttattattattctgtctgtgctggtgacctgtgatcagtggccttcagtgttaactaccttaattgtttggggccatcaacaattgcacccatgtaagatggcgaacaaaatcgatgaggattgtgtgtgctctcacttccccaccgaaggccgttccatctctctccctctcttccggcctccctcttccctgagatgcaacaatattgaaattaagccaattaataacctacaatggcctctaagagttcaagtgaaagggagagttttgatttctcactgcaaatcaaaagctagaactaattaagcttagtgaggaaggcatatcaaaagctgagacaggctgaaagctaggcctcttgctccaagcagcgcccatccggcaagtatccccagatcaccttggggtgcttaggaagcagattcaggccagagagaagagcaaggggaggtgatataaaaacctctgagtcagaagggctgtgacgagtgtgcctggccctggtccccagcccatgctcttttcttcagctcaggcctctgcacattcaatgtgtccagttgcttttcaacccccctgcgtcactgtgaaaggaacagagccacaccaggatttgctgtttctgacgcagtccatgcacaacctgacaacggaaatggttcagggacaggagtttctggggcagaaaggagccctctccctcaccacacctgtggttcagctccagccagaggtccatgccctgggggctctgtctgcccctccccacctccctctttccagtggcctcacctgtctcctgcccatggatttaaacatcatgtctaacgaaggattgcccaggctttagactcatccatctggcttccactgaaatacgcccatcggatgtaaaactcctccccgctccccaggaacagaggccaccccatcccaacctcccccaaaccagcaagtgtcctgatcactaggctccacaaggcaagacctctgcgtcacctctgattcttatccctccctggaactggggtccaatccatctgcaagtcccaagagcgcagccctggcccaggccccctccgtacctcctgcactcgtggccactactgcaaacccagggttccaccaggccccctccgagcctcctgcccccgcggccactactgcaaacccagggttccaccaggcccctccgagcctcctgcacccgcggccactactgcaaacccagggttccaccaggcccctccgagcctcctgcacccgcggccactactgcaaacccagggttccaccaggccccctccgagcctcctgcacccgcggccactactgcaaatccagggctccaccaggcccctccgagcctcctgcacccgcggccactactgcaaacccagggttccaccaggccccctccgagcctcctgcacccgcggccactactgcaaatccagggctccaccaggcccctccgagcctcctgcacccgcagccactactgcaaacccagggttccaccatcttctccctctggatcctggccatgggagtggtcagcggacatcctcactcagggtccccaggaagccacctagccaccttctgaccagcacaatcataataaaatggggacaagcctggggccctctcctagggagctgaggccacatcccacagagtgctcagaacagatcccagcctaacagcagagagaggtcagtggctcactagtgccaggcatcccaatcctccatccctgcacccaccctccgaacagcccctccccacacagcaaccacagggacatctgtgacggagaccccactggaaaaatcccccagggaccttccagtgcacttagtaagagctgactctcacagcttcctcccatagtctggccctgccccttccaagcttcccctccctcccagctgcccttctgtgcctcagatgccgtccttgagctctctgtccttctcccatcacatcctcagaggctgggtctttagtcacccagaccccaggcccaaaccctcctccaagggtcttctctgaccactggccccaaaacccccaccctgcatcccagtccctttctgggtcatttcactttttccttagcatctgtcagctggctgtctctgaggtcagctggctgtctctgaggtcagcttgctgaccatttaccacgcacatccggcttcttgcccaccagcatgagctcctctagaagagaatcttgggaccagcacccaaccttcctctctcggttgctctgcatcccccacacagagcagagtgcagcacagagccagtgatggacactggctgagggcatgagtctctt

SEQ ID NO: 559 - DNA, 458810 bp, Homo sapiens
gaggcaggagaatcgcttgaacctgggaagcggaggttgcggtgagccgagacggtgccactgcactccagcctgggcaacagagtgagactccgtctcaaaaaaaaaaaacaaaaaaaaaaaccagtacaaaaattgaacacactttcaaggtagcttttccattatttaaaattcaatatgaaaatgtttatttttattctaatcacttagatcacttttaagtctagattaacttttatatatttaacagggcggtgaataactttacaagtggatacaaaactgtaattagaataaaggcattttccagcttgttctctacaaatgccaattttcacttgatttgtcaaaaccagagctagaagcttccaaagcgaacttggcaccatctcatcatctcagaacactgagaacattgaggccctgcagctttgtcgatgtgggctgcgggagggagagagagacacagcaggtggtgaccactaattggtcacaatgataaagtaggtattattatccccactgcagaggtgcagaaagagacacagaagcattggtgttttgcccaggttcacacagctggtcaacagaaatgtcaaggttcaagcacacagggggcccaccccaaagcccatgcacttcctctccattcagacgccctgttctcaatacagaggggaagagtgagaaagcctggactgccctcgacaataactctgacttctctgtaaaaatttccaatttcttctcagaaactccctaagataattttgaaaatatattccttctgacagctaaatgtcataataaatgtttttattaccaatttaagtagtttcaaaggatgctatgtctggctatggtagattactgcagtaatggtccctaaggagtcacacttccctggatccatgaccctggagagttccttcccaactggacacacggcttgcttttgccaagggttatgaaaaggtgaatcaggaagaagcctgaaaatcacttgtgttctggggcttgctcctgctactctttggaacctgcagtcaccatgtaaggaagcctatgctagtctaccggtggaagagagaccacgtgaagctctcctggctgaggttcctagaccaagcagccttccaactgacacatacgtgaggccacagggtgtgagaacatgcagccccagctgagctgaaccgccagctgaccacggagctccaccaacccagccaagtccagaactacccagctaaacccccagattcatgaacagcataagtgcttgttgtattaagccactaagccttagggtgcttttgttacctagcaattgatacacttacatattataaaatttgatattttcaaataaaactattatgtcagttttaatgtatccagtgtatccaaaatcccaaatcaatttaatgctcatcatccattcaaaggatacatttaaaaactcaaaaatttcacatcattccttttttcttttagccccattttctaatatcctattatatcctattaccctatcaaacttctctagaacaaagatctagataaatgtctatgttaaaagttttggcatttcctatgaccataaagctccaactatttttttaaaaaatcacttatggattgtgttatcactgcaattattattggtagacgattgaccaatataaaaatatatcagctaggcacagtggctcatgcctgtgatcccagcactttgggaggctaaggtgggaaaactgcttgaagccaggagttccagaccagcttgggcaacatacggagatcctgtctctacaaaaaatgtaaaaattagccccaggggtcatggcatgtgtctgtagtctcagctgttcaggaggctgaggtgggaggatcgcctgaatccgatttgaggctgcagtgagctatgattgcgctcttgcactccagcctgggtgacagagcaaggccctgtccccctccaccgccaaaaaaaaaagtgtatgtatatatatatatatattttagtaaaaggtaccaaggtttatttcaagtgaatgacactccatccctaccttgactttctatccattccccaaactaaacaactctgttcctggagccattaccactttcccatctgctggagtttatatatatatacacagagagagagagagagagtttatatatgggtatatatatatatatatatatatatagagagagagagagagagagagagagagagagagagatacataaaaatatcaaatataaagagtaaaatttcactggaaataatctcttaaatgaaatggatatttttatttttcaattagttcatgtatccagtcagtggatcttatttttagctagacagagttctgcatcaattctatttctacttttcatttttgtagatgcaagcacagaaaagccttgtttgaagactactgggagtgaaagaagtttaattacggcagttttatgtgccactcaattctctgacctcttgaattatctgcaccaaatcagagatatcatctataattaatgatttatcacctgacgacttgattaggtccttcttcaaactgattaggagcaaataattagaaaccacctggcttaccgaaggattagcttcctggtcggtggtgtcatttactttccgaacacaccacttctctgtgaccatttgtttggtatcccagaggttcttcctctaagtacaatccaggacagctgagaggagtctctttttttaataaaatgggagcaagatgactgtcaaaagggagggagggaagagaatgtgcagtttatcacaagcacattcccaagcagatcagttttaggaaagggcatttgacattgagtatctagataaggattccccttaaaccatctgcacccttgaacccttggaaagtcacattttggttcaaggatcattgctctattgggtctgatgcaccttactccagctggtggcgagaaactccctgagacttgaaaggttaatacgagacctgccagtcattgtctgtttccctagttttccacaaaaacacatcttttatgcaagggctcttagtaaaaggtatcaagatttgtttcaagtgaatgacactccgtccctaccttgactttctgtccattccccaaactaaacaactctattcctggagcaattaccactttcccatctcctggagtttaggagtgaattgtaagattatggtcacttgagacctagtcctgtgacatcactggtccaactattgagtctattcaaaccttaaaaaaaaaaaagtcaataaatccttattcctcaaaatggccatgtctgtcatataaaactgatttcatcaatatcataaaaaactcaaccttcatttaaatctggaggcaagacatcagacagcatgtatgaggtaagggaatatttaaaatctctgaaactttgaaggggagttcatggatgctcaactcctgtcaccagaaacacccaataccctaaagactaacagtaaaactgagtgtgcctgtaatcccagcactctgggaggttgaggcgggtggatcacgaggtcaggagatcgagaccatcctggccaacatggtgaaaccctgtctctacaaaaaaattagccgggcgtggtggcacatgcctgtagtcccagctactcgggaggctgaggcaggggaatcgcttgaacctgggtggcagcggttgcagtgagccgagatcgccccattgcactccagcctggcgacagagcgagactccatctcaaaacaaaacaaaaaactgagtgtgaacagagaaaggaggacaggagtgggagaagtcccagctcaccaagcatatccggcccaaataatcgaaatacaaactcaggtggaaaagccatttctgtgacaaagtggacacactagacaggaagtaggatcttgacatctcaccagaagccaaacaggaatacagcatcttagaatttagaaatggcaatcaagatctttaaaatgtatataaatgttcccaaagctacctcttcagtattccctcaggaagcaactggaccagtgcacagaaatatccaatatgggtgttcatcatgttttcttaataacaaaataaaacccctggaatccttcatgcccatcagcagggaattggttatgtaaattacggtgaactatgactattatgatggatgtggccatgacttacagtgacgcagacctttttagaatgtcaagaaaatgtctacaacttgtatcattaagagtaaaaatcaggttaacaaaactgtatgttaataaaatataaactcacttttaagtgtgtgtgtgcacacatgcacaccccatgcatatattcaacaaaccaatcaaggacaatcaaatgttaccatcttgattgaaagtgaggggcctataattaaccaaccattaatgtctaaaatacaaggtaatggcaccacgcggaacacccaagcacagagtacagcagaacagaacacaggacatcctgtaaccaaatcattcttgggaacagcccaggaagccccaggtggtgttcaagacaagaaactaagtatcgaagttaaaaacgatgaagctggtgcccagaaagctgaaagtaatcccactagggcctcttgggctaaaaaaatctaacttcggcttgacctgggtatgaagtatgttgaagaacatggaaaaaaaaattctgaaggattatgtgattcctgaatttttaaaaaaatattagggaccctggatttgggttttttaaaaaagcgtcacacctccccaacctgagggtagttgactgtacagaaagtgcaaggtgtgcacacatagtctaaatcccttgtcatttttaatcccaagggactgcctgtaatcacagcactttgcgaggccaaggcgggtggctcacctgaggtcagatgttcgagaccaggctggccaacgtggtgaaaccctgtctctaccaaaatatacaaaaattagctgggcaagtgatcctagctacttgggatgctgaggcacggacaactgcttgaacctgggaggcggaggttgcagtgagccgagatcacaccactgcactccaacctgggtgacagagtgagaagaaagagagagagagagatagacagacagagagagagagagagagagaaataaatcccaagtgacaacagcagaggatctactgcacacaagttagaagccgtcagcccagttcgacagcagtgacatgaagatgtgcgtgactcacatctcactcaggaacacagtcgaggtggtggactcagtgacagcagaaattgacttactgaaacagtagaatgtatgggctaaaggttgcttcaagatgtagaaagaatagaccagaataaactccattgtcgacgaatgaggttttctatgcaatgcattctattggtacatggtggaggcggagaggcatatgacaggcagaagaatggaaacaaggtgatcccaggaacacgacctgggagggtttctacccctgcactgttcagcaggagacagtatcttgccaacagcatccatactccatgtgtttacagaagccttacacattcatgatttgtgttctgaatactcctttttccttctaccaacaatgacttcctttagagaagcctagggggattgtgacactgccttttttttttttgagatggagttttactctgttgcccaggctggagtgcagtgcggcacggcaatctcagttcactgcagccccacctcccgggttcaagtgattcttctgcctcagcctcccaagttgctgggattacagatgtgtgccaccacgcctggctaatttttgtatttttagtaaaggtgggatttcaccacattggccaggctgatctcgaactcctgacctcaagtgatccacccgcctcggccccccaaagtgctgggattacaggtgcgagccacagcaccggccatgacactgcaattttgatctcacacattctctacgtaagtggctgaatattttgagtatttctttctctccttgtattttcatgacttccccccaacctgctcaacacctcccttctaaggcaactgtcacagggattccctatcccagaataggtttgcatcaaaaagcagaactgcctataaaacttgggtatcaacaaaaaatttgcaaaaagacacaaggtaagggctccccactgcaacccagcttcactgtcctcatccccataaccacacacacacagaaaaggcaatagccagcagggcacgatggctcatgcctgtaatcccagcacttcgggaggctgaggtgggtggatcacgaggtcaggcattcgagaccagcctgaccaacatagtgaaaccttgtctctactaaaaatacaaaaaaattagccaggcgtggtggcgggcgactataatcccatctactcgggaggctgaggcaggagaatcccttgaacctgggaggcggaggttgcagtgagccgagatcacgccactgcactccaccctgggtgacagtgtgagactccctctcaaaaaaaaaaaaaaaaaaaggcaatagcccctggctggggatacagtcaggagagctctgtggaaggggagggaccagaacttgggggaggcatcctggcaacgtcccagagaggagacagaacaccggggaccaggctgcagaagaatcctgggtgagcaaaaggatacactagagagcccaccatcacgcgtgaaggagctcgtggatggatgaggacactggtcactgctacagttatctttgcagaaggaagcaccccgcccccaaaccttaagaactgaaagggagaggaaaactgaggatgttttctgccagcctggtgggagggagatgagcctgaaaataaatgaaaactagtggggaaaggcatgattgttcctctatagttgactttgagcactcatttcctctgcacacacaggctcagctattggtgaggaaagcagcccaaactgctaaatctcatttacaccagagtacaaactgctggaataacttcatggagcaggtgttaaagctggcttcagtcatcccccaagtcggatgcactggctacagagagacatcttgtgtcttaaagatgtacatattgctgctgtaatgcctgaatatatttaaaataaagaggaatgtgctccaaatcactgctcaacatcagaatgtttggaggctaccaaacgaatgtgactcaaacatgaacatggatgagtcatcagaggatcctgttaagatggaagttctggtttagtgcctctgggtggggcccaagtttctgcatttttcttttctgagacagggtctctgtttcccaggcgggagtgcaacagtatgatcacagttcactgcaagcctcaaattcctgagctcacctcccacctcagcctcctgagtagctgggactaaaggtgtgaaccaccacgactagctaagtattttatttttcgtagagatgggggtctcactatgttgcccaggctggtctcgaacttctagcctcaagtgctcctcctgcctcccagttttctgcacttccaacaagctcccagtgacaccgacgctgctggtgtcaggacctccactgtgaggagcaagtagctacaccacagggctccccatgcgccagggagaggctcttctagtgacaggagacaatcttttcactgagggcagggatggatggggtaacattgatgggtaaggtttgtaagggactcgagaggctcagatctggggactctgacaggaagagaaaggcagcccaagactgtatttaccttgtttggtgattctgtgaaagactcaggcagcaggcccccggtgataaaatgtggagtgattcaagagctcagtcaggccagtcagagctctgcacttcaccccaatattttcacaggaacccccccagcctgctcccatcgggataggcaggagactggaaaagaaacagtgcccagtaggggcaacgttaggtcaagatgccatgcaactgtaatgcaccttttgttgttgttaaaacttcaagcgctacaacagcgttctcctgatgatcacgagttatttcaataaatggcattcccaggaatcttctcccacggccgctctcccgccaacaattcatactcatcctcccatccaaaaaggcatagaaccgcccagacacttttcgttatttttattgtttgacaagcatttacaacgttccattcatagacctaaaaacataaaaatagaccttctttcagcttataaaagaaatatataagaacttttgacatagacacgtcatgaccttatgtacaagagacaatggcaccctctccaagcaccagacttccgagtgttttcagatggatgtgttgcactggagccagtaaatgcgacgattagaagcctctgcttccgttttccatctggacgcgatcgaaccggagatgatatggaaaaatgcagtgatacaaagggtatagaaaccattctaaagctttttcagaaaaccagaagatatagcaaaaatttaatagaataaaactttcaaaagatcaagctcgaagccctggaaacccgaaaggcggggggaatacagggtgggaacgcaggaaaagcaggcagaggcacaagagcatgatgtactgaactctctattgtctggaaatataaagtcataactgatttttataaaatataactcctaaagctactataaaattcaggtctttaaagtacctactgatgtgtcaaacaccaaatagatattttccccaaaaagaaagttttcatagtattttaaacccttcttaggaagtggacattgtgacatgggaaaagaaaaagctataaacctttttttaaaaaaaaaaaaaaaattgaaagtgctataacttgtttttcttcttagtatttggatatctgtttagactgttaatgttttgagcatgtttaccctgtttcgttggcatgaagaaagtgttaaacacaagagaagtttttaaagaggttgttctgtttaaaggtttggttatggactgtcagggaaggggaaggtaatctatggatgaagatgcaattttgatggaaaaaccaatgatcaccatggcaaccccatgagaaggaggctcccctccctgccatgtgcaacagacacacacaccgcccaccggggtgtcatgtttaatccaaccaaactcccatctcaaatatagattcaaacattaaaaaaaaaaaatccgctttttggaagaaaagtatatccttcgcatgagcttgctggcctttcatatataaatataaaaccaccacgcctcactctctctgtaaaaggttatatcctcattttttaggctcagggatacatacactaacactgtaaaattctcatctatttgtgcccctgtatctcaggtaaaatacaaaaaatagtgtttcttttctttctctcaagcgataaatttggatctcttttcaaagagtttggcatctctataattctatgcaaaactagagcttccgaacatggacacagagtaagaccagccatagaccaaaacaggaaggaaaaaaaaaaagaggctcattgaaacatgaatcgccaccctctcctcacacattcttaaaatacacggagattctcagacatggaagagggaagggtacagtcagaacacggcaagctgtacacatttcattttgtgtgtgaaagaggtttccccagctaggagactgatttcagatagaaggatcgtgtgtgtgctactatcccttaaattaatctgttgtacatccgttaactcctggggtgatttgctttccagtgctatagaatcttttttcttttaattgttcaggccctgatttattgagaataaataaaagcccttagtaatatacagaagataggactcaagcttatttgggattctgatcaattctttctgatgttgttgaaaatgacaaagttgggtggctacatggcttcagaaccaagtcagctgccaaaaccgtgtgtgcaagagcgcgacctaaggggacattcttgtcgacggtacaggagggtgggcagagttagggcaggaagtatctacacacattctctacggggcaggtgacgcagtcagatctcagtgttcagtttcctggagggggcaaagtcttcacgcctaacccaaatgacttcctcgcttgcgctctccaggcctccattgatccccgacagggcagcttgcttcttgagctgtgccatgcgggacgcgtgactatccagggttttccggcctctttcccgctgactgatggaggtggcctgaagccgctcctgcaggtctctgtccactgaggcacccttcacggactcacagaactcatcatcgtcactgaggatgtctgtctccttgatgtcatcttgctcctcatactgagcaagatcaaactgctcctctacccatcggtcagtgtccccaccaccggggggctgctgggactctttctccgggctgcttgcggagacggcatcagaatcaatggtaaacctgtttcgagccagccgccgcctcctcctcccaagagacttgcttggggcagacactgcacacacacacaaaaatataaaaataaaacccccacatgctttacgtgagatgaaaatccagaaagcaaaggacaggagaaaataaaaaccaaaacggtatgcattgaatgccttgatgtcttttggggcttaaagtctacatatcaccaatctgtcatggagcatttaccttgtcgaggtatctggacttagaggatgttctagcaactgatgcaagggcaagggggaaccggggcacacaggagaggttgtaggttatgggcaaaggggcactcaactccctctgaaataatctactgttctagcctgtgcacctaagagatgggtaacacagacagcagctgctctcaagtagacagaccactgatttggggatcagttagtgagttagtgtcctcaatcctggccatgtcccatggcccagtgctatgaagatccccagggctgtcccagggttgtttagctggaataggtctttagtaagggtgggggtgcatctatggttttgctgtctttgtagaatgtgcatcaaggaggcagaagcaccagtgtaagttacttgttttctgggaactggaacataacatttcttgggatctgcagttagattaagggcaccacgtcactcttagagagcctatgaaaaagagtggctctcaaagacatgggatcttcagttatttccctgtcttctttctgacaaagtcccacatgagctaggaagctaagcaaatgtgtgccttagtctcccccaattacagtctgtgtatcactcattcttctccaaagcaattaacatatcagtgcctcattggaatgagaaataaaaaaccgatgacatccaagcagtttgatcaacaaagtgctgtataaagtgactaccagttaagaaaaattcattctttcacctactgccctctaggaagccagaattaaaaacaagcaaacaaaagacaccatccgatcaagccaacaatcccaccacacacatacacgagactgctcacagggaaggcttctgcttctccctcgagagtgaagcggttgttgcattagacacgaaaaggtgaaatgcaacacgggctttccagtggaggggaagagtctcaacgccaactgggagctgctttcctgaaacctaagccccagaaccatccaattgcttcagtgctgctagaagatgcctcgtgtctcaattactgccaaatgcagccttgacttcgaacccagcaggcacagggttagagtggtcaacgaggggctgaattggctctcatggcagccatcctctgcttcagacccctgcgtgtccatcactattcctgagtgttccgccatctaaaactgtggaacaaatggacactactgttggttgaggatgggaataaaagccatttccaggcaaaatggaaaaagggaatagaaaataggaaaaaaaacaaacaaactctgacttctattgagaagagacaaaaattcttgttcacttttatctcagcaccagcaaaatacagcatccctctctccaatcaccacattagaactaccccaactcaaagctactggaaatatttgttaatgatttgcatgctgaagtatctaggagtaaagtgtgttaatgtctacatctttgaaatatgtcaaaaataagatgaggtgatggatgacagatggattctaacagatgagtgataatgagaatatagaaaaacattatagaatatagatggtaggtatgaattctttcagctcttctataagtttaaacattttcataagaaaatagatagaacaaagaaaaaaatttttaattgggttattggcaaacgtatagtactttaggctgaatatggaagcagagtatttggctttactatcctagccaaacagaacagagggagaaataaactacctgagtattcaagacaaagcaaaatgaagcatgagtatctgttcctagtatgcttaagaacccggctaccattattgggttcttcccagtctttcagggatgcaatctttgactatttccagtggtcactgttaagactgaccagctatgctgtgctgatctactcaggcaccattttaaaatcctctgacatgaagattctgaggatagtgagatgcctccaaacaaagtgatacagactttcttcagccaaaaatgagccatcaggcagaaagatctttcaatcagctaaatccaacaggctatgacatcaaggctttctcttggtaatcatgacggacgatggtgttaaattgtgggctggttttgttttctttccaaatggatctcagcaggaaaacttctgagtgacagactaaccatgcttagtttcaaagtaaatgcagctctgaatttaggttcattgattaacaactgaaacaggttgagttccctgaggttgagacacatattcccaaacctttttaaacatttccctagcaaacaagaggggcagataagacaaatccaagataaaaatctctaaagtgagttataaaggaccaataaactattcttccatggcgaccccatgcgaaactgcgcatatggacgtatgaaagactcttaggatacatcagaaaactcagcaaagtgctgggtgttcactgcactaagttttcaacaaacatttatcaattgattggagaagaggtttacagtaactagtcccctaaattaaatttaaggtgcttgaagaatgtaatatcccatgtcaagccaggtaggttttgtctatgaaaaccttcaagcattcacacttctgtccatccctcttcaataggtaggatggtaatgggtacaaaggccagaaacttttctggcaagtgcaaagggggccttcttttaatgaaatcctccctgcaaaattctgggctgcctcttaagaaaggtttgataaaaatgttagtatcttgatgtcattaagtccctaagtattaaaacagccttcttcctagatacattttgctaccattgacaggtggcagtatttattttatttctctattgctccactgtaatggattaagtcctacaagaatatttatgctgggaccatttaaactctagattcttgtttccaagaatagctcgaggcttccccaaattaacatggagactaaaaataaagttgcaggcacaaggtcaggataaaaactggaagtgccatgtgggctaccaaacctagaatccttactactgagagcaggcattgctgtgctgccaggccgtgaagccaccatgttctcagaacagagggctgtgaccttgctgaaatgtgacacacggctttctgctagacaaagctggctgtcatgcaaagcagcgactctcattctgcaagcaggctgagacagcctctccagaaagaggatgtgtctgcaacccgacttggcaaatgagggaggagctcaccagccaaaaggagaagggaggcaaagggaaggcttgagggaggacaagaggaatgtagatacagggcggatccccaggagccactgggaaggaggcaagggcaaggaacctcacaccagggaaaaaccgtcctcctacatcagcccccaccaggccacacctcacccccactcaacaaggaggtcaagctcactggagttctactgcggagtgggggtgacgggaatcttgaacgtccgaatccccacagtacctgccctgctcatggccggcctggcccccttcagtgcacacaatcttttgcctccaaaagggacatattgctgggatgagggaaggctctcggttttgaggagctgtcttctgtgcttatcacgcaggattgaatgcacagcctttaggaaatcctttcggctctctggggagctaggaaaagaagatttacagatgttagagaatcagggcttaacacatggggaacttctaaggttatcaggtgcaaccaaataaatatcccttagggccaaaggctaaagactgaggccttgactccaatttctatgctgagcggtgatttcacgccagtgataaagagcacataactcctttcccttcatgctttgtgatctatctcctggcgctgatgtggggcagagtagcccattaacgaacagatctatggacagtgggagtttgtaccaagaagctgccaaattctgctcctggcactcaaggcagagtttttcattataaaatgtttttgagggcaaatgaaccacaagattcttgcggctctgcagagcacccaaaggccgacgtctcaacgtcctaatgtcctctagagctgagctccctcctggtaaatatcaatggttcccatgacacatttcaacatgtatatattaaggctgtaaagaactataaaatcttcccaagtcctaattctcatggttaaaaaaaaaaaaaaaaagtgcttcctaggaagagttatttttcttattatattcccaatatttttacccaggtaagttttacctggtattccctattaacaataaatacggcatccgtgtaggcagggctactaaaccccatggaccttaccaacaaaatcacaaacagatgagccaaaatagacggtaaaggtggtgctcaaaccccacgaggttatacaaacaacatttcacttatagtcctgacagcttcccggggatctgccttttgttgacctctgtcacccaacacagagagatctgatgtagcaacacaaaacatgggttttgaggttaaacccaccatttattttctttttctttctttttttgacacagagtctcgctctgtcgcccaggctggagtgcagtggtatgatcttggctcattgcaacctccacctcccaggttcaagtgattgtcctgcctcagcctcccaactagctgggattaaaggcacctgccaccaggcatggctaacttttgtatttttagtggagacggggctttgccatgttggccaggctggcctcgaactcctgacctcaagtgatccgcctgccttggcctcccaaagtgctgggattacaggcatgagccaccatgcccagcaccagtgttcattctctataaggccttaggctaagtaccatctctaagccttgcttccccatttgtaaactggagtaagaattgtattaggttggtgcaaaaaataattgcagtttttgccattaaaagtaatggcacttttaattacttttaatggtaaaaactgcagtttctttttgtaccaacctaataccttggtctgactaaatgaaataatgaatgtaaggtgtttagcatagttcatgcttggtaaaggtaccttcttaccatactaacattataaaatattgctaataatcataatattgattctattgtcttttgtaggtaatccatagtatattagtactcactgtgtgaggtactgggtaattactgagtaaatcactgagtatctacgattaaattaaagttagccagacgtggtgctcacgcctgtaatccaagcactgtggcaggccgaggcaggcagaccacgatgtcaggagatcgagaccatcctggctaacatggtgaaaccccgtctctataaaaatacaaaaaattagctgggcatggtggcacatgcctgtagtcccagccactcgggaggctgaggcagcagaatggcatgaacccaggaggcagaggttgcagtgagccgagatcatgccactgcactccagcctgggcgacagagcaaggctctgtttcaataaataaataaataaatatatatataaataaaagcatgattcaatacgggcacatttaaagccaaatatattaaacgccatctgttggagtcatctatcttgtatttttagaaaaataaaagaataggtttcatatgggagaagacctcaaattctcatggcggagggagagaatacaaggaagggcaaaagagggtggcagggtagaagaaaaacaacaagaaataagtagaagcccacatcatgagcccagcttcccctcaagacgtgcaggtgatcaacacaggctgacctccatatgtgctccaaatgatcaggaatcccgataacaccttcacaagctgtcagctcctcccagctgactctccatttactgcatctcagtgatgttacagtacaaacaacgtaccaaacaccagaacacaacgtaagacaccaaaccgttccaatctgcagaaatgtcaacacggcctcgactttacaggcccaggctcacctgcagcacaagtgaaagaccctctccggcctcccttcagactcggattttacatggacaatttcacacacggcatttgcctctgcatctaaagaaattaaaacaacaatgaatcagggtatgtttcaagtggatttatttacatgtttgcaaaagcatttttcagctgtgatagaggattaataatgcagaacactgtataagatcaaagatattttcctactatttcacaatctaaagagatgaagcgactgaaagcttaatggatgcaaagaagagaacacttggaaaatttccagttggtaaaatcttctagatggtctaaaaggtcaatcatatggaccgaactttttttttttttttttcttttttgagatggagtctcattctgtcatccaggccggagtgcggtggtgtgatctcagctcactgcaacctctgcctcccgggttcaagtgattctcctgcctcagcttcctgagtagcagggattacagatgtgcaccccacgcccggctaatttttgtatttttggtagagacagggtttcaccatgttggttaggctggtctcgaactcctgatctcatgatccacccgcctcggcctcccaaagtgctgggattacaagcgtgagccaccgcgcccggcctgaactcactcttccagccatgcagtctggttaactgaactgtgcatttcaattaaatgattaattgttttggcaacagttggactcagtggagccaaagcctcctatgcagatttcatccggccagggatacgacaggtaagcctttgctgtctgttaagggaggcttcccccaggtggctgggcctaaagccctggagacctaattgggtttctcgtccccagcctacccctggagtctgctttgaacacagcagaaaatggtatatcaagaaggtaagggacaattttaaaataattttgaagctctgtagtgcctataatagcacagtactttaagtcatgaataaagtgtttgtgaaaggaacaattcactgcagacattcaggccatacattgtgaagtctcacttttatccagtggttcagaaccctggtcacaaaccctcactgtggttgcatgatttaaccctaaccagaatctatctgcaaaaaattgtacaaactttccaaactaaaataaaaacctagaaattccacgttgtgattctcaaatccactagagtggatttcataatgaaagacatcttgactagcctttataactcaactaaaataagcttttatcttgatggttttaaacttgacttgaatgaaaaatagagagtgagaatggaatgtcgtattacaaagatggctttgtcttcaaaatttgaagtttttatgtgtttactcctcaacgcaggcgaaattcctggcttagaagctgtcagtttgctacagaaataaactttcccatttgtaaacctggcatgaggaaacaaaggaactagataattcataacctacgattctaagtaagactttagtatttaagtgctcaaacctcaaaatgctatgtattgctgccctagactcacaacttacaggtgcctgcaaattcatatataaatcaattttgcaaatcacatcataagtaaaagggcatccggcaaatctctactggaagcttagagagaaaccttctaaaacaaataatcattccaaatatatttgccctacatggtttttgcatttgagttttcctactgtaaggcagaaaaactgtgaaggaagagatgcctcatttaatttggaagagtaactcaaagtgtgcaaaatatggcaagagggttctcctcatgacgttggactagggtgggttggttttctgaggatcagatccagttttactgcttatgacaagtggaaacaaggaggctaaaaaacagaaattggatagtaggaacttgtagatgccaaaagcataaaatagaaattctcttgatcatgcacctgcaggtctctaccaccaaggcttttctttaccaaagctgcacctgctgtccaagtgggacagggaacagatgtggctaaagagtttccatttgactctccagagatgctcattccaggatgtgcctgggagagccacacagtccattcctcctcttgagaacttggcttcaaattaggcccaggatggggagcttctgggtcacagaaatatcacttttcttagtcagtacccctgctactcatgtgtttcaagcatcgtctaattatattatgaagtatacttatagctacccaacaactcacttcactgctatgtggatcacagaaaaagaatcaacatttcaggttgggcatggcagctcacgtctgtaatcccaacactttgggaggccaaggcgggaggcttgcttgagcccaggagttcaagcctagcctgggcaaaatagcaaaaccctatttctacaaaatatttaaaaaattagctggttgtgctggcacatgcctgtagtcccaggtacttggaaaagatagcttgagcctagaaatttgaggctacagtgagctatgatagcaccactgctctccagcctgagcaatggaatgagaccccatctttaaaaaaattaaaatcaatgtaaaaaagaatcaacattttaaaagccttcacactaacagcaaagataaagatttgtaatactttagggaaaaaacatgtgtagtcaatgctttttagtgcttttggtggtatttttggatctctcagttgaaaggcaagtgagtagtttatgtgggctttgtttgctcagtctcaaggattctttcaagaagcacaggctcactgtactcaggtggtagtcactatagtattaatctatagaatagaataactagaatcttttccaggaattttgaagacattacacatccattcactcagttcattcattcacttggttcattcattcattcattcaatatttaatcaatggctgggtaaataagaggcaatagagagaccgagagacaagagagttaagcatagggaaaaaaaaaaaaaaaagacggtagaagagttagaccaagagtgtggattcaaacaaataattcctacacacatcagaaatatgtgtgtgaaatacccagcacaggtgagagtttacctgcactcgccaaagctcgaacctgcagcgcttccgtggggatcatgtgtcgaaatctgaaggggtcccagtcctcataaatggaaagcctgtgagatcctacctgcagaggagaaggaaccagctgcataagaagaatctaacctgccccggaccagttccctgcattttctaaaccagcgacagactctcacgcagtaactctaggcgtgcccaaaggatcttcacccccatgagctcctgtccatccagcaggaagtgagaggctgcgtgataaatacgttgaggggagggtgtgcaaagaagtttgctaagcaaatgcagtgaagagagacacacagagaagaggagaaaaaggatcccaaaagaagaacaggggcaacagagaaggggaaaagtagcgttaggaaggttctgggccatggcagacccaatcaccaattgagtccagttggttccaattcacaaaaatgagaccaattcatgtttgtgctctaaacataagcctgcctgaaaagatggcaggatgagtgatctcaagcatccttagcaatgcttaagaaagaaaaaagatcataaaaaggctcatactgacaaaatggtagaattatgcaggcataactgataagcagatagagaaatagtttcaaaccatggggtaacataagatgtcttacaagtttcttcttctgtttggaaccatctttatacacaaggaccacagcagttttgaagactggaaaaaataaaataaagacagttatggtatgtcatgtgtagggttttccccttgacatcaccaacttgtggtaataaacactacagttatgaagaggacgttgagatcccagttaactgactcccacccaccttccattcattcatcacatctgtgaaaatcaaaagcctattgagacacaagtttccaggttcaaaataaacatagaaagcctacataaatggaattaacctatggcccaaaaaacttttgcgtaaaatatgttaggtatgatacaatttcaaggttaaaacttcagctgatacatattcaacaaaaatgtactaattcagtagatggaggaataatataaacgtctttcacaataacaatgcaattgctgaagatgatttacatttatgcaaattaaggtaatagtgcacatagacagtgataatttaggaaatataactcatcttttgacctaaagaaacaaaaatgagtttatgaaatagaattcaactgtatgtcttccagaatgactgaatcaggtaagctctctaggagtggtaaacatgtagtttcattcttatattctttcgggggtggggagatacaatggagttatgcataatcttccagagaatttgttaagcaatgccaagcacatttaacctgcagtgattctgattcttcctagaagggtaagtagagttggcacccagaaggaatagaagggtgactgactcctgcctgtcctttgttctctgtgtcagcgtctctgctatggtccaaatgtttgtgtttccccaaaattcataccttgaaactaatcacccttgtgatggtttcaggaggtgggcctttgagaagtgatcaggccctgaggactctgtcctcatgaatgggatgagtgtccttataagagacttgagagagatgccttgaccctttcgccatatgaagccacagctaggaagtaggagaaagcaggatcttggacttccagcctccacaactgtgagaaataaatctctgttgtttggaagctggccactttatggtattttgttatagcagcccaaatggactaagatagtctccattatcccttcatactgaccccaaggaatagcccagtcacacagcggctgaaggaggcacagccttgtacaccagacacagaattacaaaaggaacaaacattcagagaattctcagggatgggccaccaggctcacaggccctttggaggccaactggaagtatctggttcaatttctatcctacggagggcaggtcggtcttgtctcctctttgtgtaagatcatgctaatctccactgcagggaaataagcgctgagatgcaaagaaactgactccagccactcggtctagactgcccatagcccttcacacctcacagcatctgacccctcaaggttcccagagcacagactggcaggttccccacaaaggttcacactgacccgaggaggccacaccagctcttcacagcagctgagcacaagcaacctgagaaggccttttattcccactatgaagccttcagaaatcagagaggctgggacagctaggtcctcttagaaatgaaagagctctaccccaatgactctaatctcagaagcgccaccatgccactgggaccacagctcaatgctatgattccctcgatttccctcaatcttaaccattgtggatcacagcaggagggccagaaagtgagcttcagcctggcaccgggacctcagcctctcccttaaactttccctaatcctcggagctagtgttactcaagtgactccacagtgttgcccgatcccttcagacatggccttgatgatctccaaaactcatgctacctttgccagcctaaagcatccactctgtgccccaaaacgtgaatgtcaaatacccttcaaggcagaaggctatttctatttttgtttgtttctgtttaaggcaacaatcaccaacatttggtacacatgagccatcctgtgaaacatcaaggcgcttcgttggcagcaagtcaacttcggtttcagaagaaagctgcactatttcctgaggttagaggtttaaaccaaaacaagacaaccacattttaaccccaaatctgccgactgagggtaaccatgatccttccttcacagcacctcttccttatttcaactccttgctcagcctttctgctagttctgccttgctacttgaaatcacacccaaaccatcaaacttgtctctttaacggctgggaatccacagaagctcatcatgactacagcctttgttcataatcccaattttaatccttccccttctctttcctattactctggagaggattctgaataatgataaacacgtcttgtacctcagagccttcagtttttctcttatgaactacagcccctattgagtttgctgacagtgtgatgcccatgaagctggagtatgcagtctccatttacaccagggacaggtgctgtgggcccgccttcctggagacagcacccacaccgacttctcataaacagcccaggaggcagggaacagagtaatgtagagtccactatcggagcctgtgcagaaagtggtacctaaatccccaacctcaaaaccagcattttcctgaatcacttacaccatgggttggcaaacaagggccctcaggccagacccaggcctgctgccacctgtgtggtgcagctgctgatccagccatctcattcatttacatgttatctagggctgcttctggctccagtggcaaagcatgtggcctcttggcccaaagcctaaaatgtactatgtagcctttaacagaaaagagggtcgggcgcggtggctcatacctgtaatcccagcactttgggaggccgaggcgggcagattacaaggtcaagagattgagaccatcttggccaacatggtgaaactccatctctactaaaaacacaaaaattagctgggcgtggtggtgcgtgcctgtagtcccagctactcgggagactgagacaggacaatcgcttgaacctgggaggcagaggttgcagtgagccgagaacgcaccattgcactccagcctggcaacacagcgagactccatccccccagaaaaaccaaaaaaacaaaacaaaacgaaacagaaaagagtttgccaacccattttctcctacttaaattattttcttattctaaatctcttgatttctaactacagtgaatctgtaaaactgagggcaaagccatgaaaaatctaaatgttgacctctatgactgctagtctgtagtcccacatcactgtgtgggtcatttacatcaatatcctgcatcccatgaatgacccattaagcagcatccaggagatcccagactcctccaagaagaaatcactatagaagaaacacaagtggtgatgttgaaaagaaagcaaatactacttcccccctcccccaaaacacctaccccatcaaaaactaacaacttgttaaaatacccccaatattcctttgaatggcctatttagtcacatgctttctctgcacttacatttgttttgttttgtttttttgagacagagtcttgctctgtcacccaggctggagtccagtggaacgatctcagctcactacaacctctgcctccagggttcaagcgattctcctgccttagcctcccaagtagctgggattacaggcacctgccaccacatccagctaatttttgtatttttagtaaggacggggtttcaccatattagccaggctagtcttgaactcctgacctcaagtgatccgtccaccttggcctcccaaagtgctgggattacaggtgtgagccaccacacctggcctcctttgttatttttaatgaaatgacctcaacagctacaggggctctttggaaattttgggaatattagtaacttttcaatgaaggctaagtcattgaaatacaaagtccaatggatctttgcattaaatactttgattttaaaatcactaggacattccatttggggatactttgttcacatcatggaggaaaaaaaaaagtttagttaagaaggagaaagcaacctccgttcccagcaagcccacaaaaataatataaggcaagagaataaggcagatttccattatattatgttcctacccatgagtcttttagcaagaggctaggacaaaacgcaacctaaaacaaaagcatggagtgttgatagttttatattcatgaacaacacagcaatatgccaataagcatttacattgcaacaacaagctatgtttcctaaattatatgctaacccatgttttttctctctctcaaaaagcatattacaatacaatcacatgagatctctaattgcagcaactgcatccatctaaactggtttattaaaaaataagtcattcgcaaacatctctaatttcactagtattgagtggcaatgcgattgggatgcacctcacagctgatccaggcactccagagttgccacaacagctcagctgagaaccagcatcctaaatcctggccttaagaccaaacagcaacaaagtcaggaagcaaataaaagatctaggactggggggtctcagaaacagaggccattttgtcttgatttttcactttatttttccttggtttataattaacccattattttgaaaagacacgcagagcagcagccaaaaaaaaaaaaattcttttcctgcctctgtgtttatgtctgggatagacttgggcacagccatttccgcccacccatgtggctgagtgaccacatagggcaatttaactcgaaggtttcatttagtgtttgtgagatgttggtggctacggcaggaagaccgattcaagtaactgcaattaactttatttttaatcaattgggtcttgaaaaagaaatgttcttgttttgaaaactaagctagacttttccccctccataaaacgcttttctgatacacaccgaatgctgccaactctggttcctttttccacttgcccagcgaggccggcgggttcagccagatcacggtagtgtgcaaaagcaggtctcccatgctcagatctgcaacctgaaagccagagacgtgacaaagcttactgggtggtgttatcaatactcagattttcatgatgtttgaaaattcagcatgctgatattaattttacttcaagaaaatactgctcctaaaaacatttgcttaaatatgtgagataatgctaagttaaactgctggatttagccattccacaatgtaacatatcaaaacatcatgttgtacaccataaatatataaaatttttacttgtcaatttcatgtttttgagaaaagaaatcgcaccaaaatgacagactacattttttaaaaatattttcgatttgtgactgtctcaataaacaccacctcccatcaaaacaggctgaagatacaatatccagttaacctttccaatgggaaataatagtatcattatgttctagccaagtttgagctaggaacaatacaatgaaattttaacgaaaaaaaaaatcctttaattcatatgaaatctcctaattgaaaaataaatcctctccattcccaaagaaacacatggaatacaggggagagaaaaggctcatcttttttttccccatttattccatgcttgtctactagaatttcagaaaaggatggcaaataggtacaaactggggctctgaaattcacatgcagttagtctgtcaaaactgatctacaaaactggagatgttttgtgttcagagacagtttcccaaggagatgctaatggccgtccatgacaaagatccacccccagataactgcagacatttccaccagtgaatatccacttttgggaaatgtaggcaaattatttcttcttccaatccatttcaaagacgactttatttcactttagatgagggagagagaagccaataaagagtttgaagattcctctattggcacaggcagcgtgaatgctggaatcccaagagaccatgaggtttagtcgctcacccccagcggtcacacgctaaactgtctccgacagacaagtgctggttgcagagccatctagacacgatgatccagagagtctgatgcaagttcaacgtctatgcctcacaacagtcccgtctgcttttctcactgcagtcactggcctccttccaaatctagctgggtttcctatacagcagcaacctggcgacccgccactgaacacagtgcagtttggattgcccttctcgagccaccaaaacaggctaccgtgctgagatgtggctccagcagtacaggatacagaggtattgttgcctcccttgattgaaattattataatcatcactgtcattattactaagctatagtaccattagtacaatcaagggttaaaataatttttaagcagccatattattttgtctatagatattaagtaactcatcaaccaaacccccaggatatgatcagccaaggtaatgacatagtctccactacctatcccccgaagacccacatagaagaggaggagttacatacaaaagacaaattcccagaggccacagcccctgggagtacgtctttaaaagtgattaaaggccaacatggtagactgtccaaactctacttcttccaacagaattacattatctgcaccttctgccatgtgattttccagcacctcccactagactaggcagggtacacacatcgccgcccggatgactttgggtgtaggcatgtgacttagagcccaccttccagccatgggaaggacttgcccaagacagccattgctgcttcagcctggatcctggaaggaagagacaaggagcacaccagaaccttcagaactggagctaaccaagagaaaccaaaccttggttgacctacaaagccacatacgagataaatatctgttgtagagaaccactgagatttccagttatttgttacacaactgaaaatgggctgatgctgttcctgtgcacagggtttttctctggacaagcttcccagggcaagtggactagggggtcagggtgctccctctggccacagcctctctctggggcttccactggttcccttctgaatcctcctcccaaaccccaagaaagagttctgctgggaggcctccaccttactaaggactgggatgcccgactgagtcagcatttttaaggacttcttttaaggggaaatgccctcttgcattcttcttcctcctagttaagcaaaagggatttcttagcctaactccccagagtttaacatgggggtaggaggttgaaggcccagtttcatcaaaaagctgtttctttgccagctttgttctctgtgaacctatttgccttcagagatatcttaaggaatgttggttgaagacccaattcaggtaccttgtgttcctagaatgttaccattttacaataaacctgctgttaccagcagatactgataaatgttcctattcctctttacaaacttcatcaatccattctaggctgttacttcacattgccactaagagggaaccacaaggatcaggaattacttttgtgaaaatctgaatataatttgggtacctccacaatcacccgcctgagtctccgtaattcttccaatatactgctgagagcagtggaacagaattgtcattgatcttggcacagaccatcctatttcccaagactcattctccctagggttttgttcttacggcattgaggctgctgcatcctttccagtttaaaggccattctcctcaatggaagaaaaagagatgaaatggggcttaagacttgagtaaaaccaactgccttggagtaattgattcccactgggggtctatttcctgctcgtttgtcttatccttccacaacaatatcttctcttgctctctttggcatcttttccaagccagaaattttctgggctttgcacctcctggtaaaagtaggattttcctcctcttcagtcctggtactcagccagtgtccctccttccatcttttgcacatttctttttacaatctcagcccacaaaaaatactttgtatagcactatatcactttgttcctcactggaaagatttcttacatatcagaatttcattttaaaggacttccaggttcactgaagccatattcccttttacagtctctgacttctgatcatattcatctttttttcctaaattctttgcaacccaatatccatttcgccttctaatctttagcatcatggtcatttgctcctaaggtcattacaatctaataattaatttggcatataaagaaaatgtaatatgacgtaatgaaaatgttcatttccatggcccagtaaaatgcacttctgtcagaatgaaataaaccaaaggatgggaggacttcttataataaaaaaaagtttacagtattattcatattagtcaataacaaaaagcattaaaattctgtgatcaacataaaatcaaggtataaaattaccttcaagatataactaaacatatacatagatattaatttaaaacaatcaaaatcaacaccaaaatatggtaagttctatgtcttgaaaccatagttttcttcttgcctttttctgtattttgccctcttctttaataagcataatttttttcttcttataaagttttataagaaagtgagagctaagtccagggtggcaaccttcatcttttctatactctgatagattaaattacctgccaagtagtctcagaacattctcatgctctgcttgtaatgttatgtaaaaacaaaattgtgttgcagttgaaaactacatatcctctacagcagaccttcctgggctatcagatcctgactgtacactgtctttgagagcctgtgcgattctttgtaaagtgtaggtaacagacagatgtgtaaattctgtccagtctgatactggcctagctgatttcctccagctgtggaaaaaccagtttgtctcatttacaattcacctcaacatttcttcactccatatgtaaacttctgtgattgtgatttttccaatgaacctttacaacacctgcctgggtccttcacatcttatgagtaaaataaattatgagaggtcataattttacctctttcagaaaattatcctttaacagcctgaaaacttgttttgtttcattaaggacaaaaaaatgagcctggataatggcctttagtatctctggagataaggtgctttctctagcctacactaaacaaccaaactttgccccacccacactgcttttaaccctgctgctagtcacagcaagagtgtttttcctctaggttccttcccacattttctcttttttaaggtggaaagaaaaactgagtctaatctctagttgaatttgagcatacagaggcattgacgaatgttactatatatcatatccctatgattcctctaagtattattggcattttgtaattgaaaaataataattgtatgtattcaggggtacacagtaatgctttgatatatgtactgtataacccatcagatcagagcaattaacttatccatcatctcaaacatctaccactcctctgtgttggcaacatacttttattcaggtaagtgcatgttaatgactcaggcacaacttttagctcaccttaagtctttctcaggtgtatctgttcctgccactgctcttctaagtaggtttttgggtagatttaactgattcagagtcatttgaaattttcattcctttgacaactattttttgggcacccactatgtgcctggtgtcattctaatctctggaggtagagccttggactttcatgacatttctagaaacagcccagattgtggtaatggaagttcactttcacacttaacacagaataaagccagagatccccagggtgaggagctgaacatcaggaaaacatttcctacaggaagaaatagtccagctgaggaagaaaattcacattgcagccttggataaagcacagatgttccactaagaaaaacaacagcatcctaactattttacttacaagtaacacctttttaaaaaataaataaataaataaaagcaaactcaaactcggctttcctgacagatgtcctgagaagatggggaccctcacctcttttttctcaccagtctgttcagcaatcagctggtcaaacacagccccaaactcttcatggattttctgcatctcattgatgtgactggcaaccttgttcatggtcttgatggccactggaagaaaacaggttgtgaaatgagaggctatttagagaccctcatggagactcaggcctgccgggggtcccaggccgaggcctaccgtccaggtggtagtgctcctcgctctccgcatcggtcagggcgaacagctccctgagcagaagtgggtacttgaggatcctctggatgggcttgatgaggtacgactccagcgtggatgagtgctgctgcttcgggttctgggcatccaagaatgccttgaaagccgtgtctgtcttggctggcagggtttaaacacaggtcatgggggtggaacgcccacgtgactcccttcccacaatttccctcccttcctcagtgactccaaggtgcctttttgcaggactgagcagagagtgggtggcaggaagagggacaggtaggggagggggcagtcagggagaccacaggcagtcagatctatgtatttatgtgttgggggtggggtggggagaagcctgatgagttaaaggatgacggagtgtagactgcagacacccggatttccagcggctgctctttatcctcctcctattacacatgtttttttatcctgatgttttgacacctggggccttactgtccatggggagactgccccgcccacgctggccagttcctggagatagtaaaagacttgccaggaaatgtgccttttatagagtccccacacactgccacctcctgtctgaggctcttacaccctgggccaccattcccctgtcctaatcatctcagggtggggagcacacatctcggcttcgagtgcaccacagagcccggcctccccagttccttccctcagaaaccccaagaaaggctcttggccacattttcccctcgctccctctgcctcctgacactgcatgtcctcatctggcccgcatggcatggggtgcccctgcctcttgggaactgtgagtgacaaactaataatcatccgtcccctgagctgttggccctgtcatcccaaaataatgataaacctacattctgaacactccttaccctggttttcctaatctttcaagcatttcactgctggaaaaacctcttttgaaaaaggcaagcatgccgtgcacagtggctcatgaatgtaatcctagcagtttgggaggcagaggcgagcggatcacttgaggtcaggagtttgaaagcagcctggccaacctgctaaaatctcatctctactaaaaatacaaaaaaaaaaaaaaaaaaaaaagccaggctggtggcaggcgcccataatcccagctactcaggaggtggaggcaggagaatcacttgaacctgggaggcggaggttgcagtgagccgagatcgtgccactgcactccagcctgagtgacagagggagactccgtctcaaaaaaaaaaaaaaaagaaagaaaaaaagaaaaagaaaaagaaaaaaaaggcaagcagatgcagaagcagcagcatctcgcagtgccagtgaagcagagcaaggcaggatctcccacggtgatctactcaaagttaactcggtggcaccacctgtgggcatccgtgggctctgatctgatgcagctcaggcagcactttcctcaccagccttgcctccttcctcagtgtcccagctggtttgggaagcagccctggggagttgtgggaccccaaacagaggtacctggcaggggatgatacgaagccgtggctaatgtcttccaggtgcaaaggaatgtcaggggagggcaaaatatgggaagaggaggggacagtgtatccaagcaacgtaacagtggacacacgctgcctctgggctggtgagcacctgggggtgatgggggctgtggcacgtccagcgtgggcactctggacgtttccagtgtggaaactccacacacccctcccccatacctcgcccagtcacctctccatttggctattcctgagcagcatcctttatgataaaccagtaaatgaacacaatcaacattggaaaaagcacattcttcacattcatctggatgactttcccccattggaaattcatttccaatgaatattcatctggatgactttcccccactggaaatttaacatggcactccagtgactcgatacttttcataacagcacctggaatgtcacaggaactcaaaaatctcttcaataaataaataccctctccccgcaaaaaacagtgggagtgtatatataatttttatatatatatatacacacacacacacgtatattttattagaaagtttaaaatatagaaatttaaaagtttaatgatatatattttttattagaaagcttaaaatacaaaaatttaaaagtttaatgatatttatagattttattagaaagtttaaaatatataaacattaaacttttaaaatgtctaataaaaatgtctttccatccccagtggttaggggtatgagctaagactaaagatgctataaaagggcatcagaacatgattcttctgtcttttttttttttttctgagacggagtctcgatctgttgcccaggctagagtgcgatggcacactgtggatcactgcaacctctacctcccgagttcaagcaattgtcctgcctcagcctcccgagtagctgggactacaggcatgcaccatcaggtctggctaattttttttttttgtatttttagtagagacggagtttcaccatgttggtcaggttggtctcgaactcctgacctcaaacgatctgcccacctcggcctcccaaagggctgggattataggtgtgagccaccgcacccagccctgtctttaattttaaaacacagcaatcatgggggaagacctcataagaccacaatcttgttatcccttttaagccccattaagagaacagactccctgggttggcatcatttcttgtctttccaaagcacaaaatcctgaagagaaaggacactgggaagagtggccgactggccccatgtgacaggagagctgggccgggctgggggccagcatatgtggaactgatggattttgtggggcatcccaagtctagggccacatctagaaggacctaggaactcttccccaacaaaatattctcgtccaaaaatatggctgtgggtatttcacccatcgactgaattccatatcagagcaaaagactgcacagttcacagcgcttggcgcagtccaggagcgtcactcctccaggccagctgtgagtccgcgatgaacatgaacatgcactttgttgttctcagagttatcctgacactctgggctcattagacaattagaaaatatgggtcagctgggcatggtggatcacacctgtaatccgagcactccgggaagccaaggcgggcagatcacctgaggtcaggagttcaagaccagcctggccaacatggtgagacccccgtctctactaaaaatacaaaaattagctgggcatggtggcgtgcacctgtaatcccagctattcaggaggctgaggcaggataatcacttgaacctgggaggcagaggttgcagtgagccgagatcacaccactgcgctccagcctgggtgacagagtgagactccatctcagaaaaaaaaaaaaaaaaaaaaaagaaaagaaaagaaaaatatgggtcattcccactgttttaagggatagttttgaaagataatataatatttttcttattgaattaagaaaaaatccatgggggcagaatttaatctaattgagtgattaaaaataacacaaattgctcaagggcagagatgggtatataatttcactgtggagcaaagcactctaaaattgttactttaacaatctcgtaacaattagcattcaataaaggttttaaaagaaacacactgcacacacagagccatatgcccaacacagcacacgggaaaggtcaggcagcatgacaaggagaatcccaggtccccttttcatttgaggttccaccagaactctgttgcacagaccaccactaccgttaagactgtttttatctggggcaggctctttgttacccagagatctgtattgtgctaatacttcctataataggttttaaattaagtcaagctagttctctttggcagcaaacataaacacaagaacattatttacatatccggggacctgatcagcagctgtttacttggcagctacagtgaagtgttaaggaacagcaagctgatttccagagattctttaaaatcaaactttctgttggtgcaactgtttgccaagaaaatgtttccttaatccttttaccatcaaaaaccaccatatgctgaactatggcgacataaccactttctggagactctcagaatgttccaccgtcttctcagagcacttaaggaaaagcagcttgcccatataaaaattctactgtgtcctgcacaaaaataactacaaatgcagcagttttcaaggataactgagacaactttagaagtgcttttgggagctgttatcacactcccaggaacaaaagtaggtgaaggaaagataaaattccacaaaaaggtatacggtaagtcctcacttaatgtagtcagtaagttcttggaaactgcaactttatgcaaaatgacatacaatgaaaccaatttttttcctcatcaacattataacaaaatgatgttgaacaaaatgacattagttgggaacctgctgtacatcgtgtcacttaaaagtcacagtttccaagaacctgtcgacaacgtgaagtgaggacttagttatgaagtgtggtaggttataatcgaaattaaagaaaaacagaaataaagcagggaatttctaaaccccctacgtttttacataactgcaaaatgacccatcaattctggccccaaatagcaaggtaaaactttcattacaagaaaattgacaaaaccattaattcaagatattggccaggtaatcctagcactgtaggaggccgaggtgggcggatcacctgaggtcaggaattcaagaccagcctggccaacatggtgaaaccccatctctaccaaaaaatacaaaaattagccaggtgtggtggcaggggcctgtagtcccagctactcaggaggctgaggcagaagaatcgcttgacctgggaggtggaggttccagcccaagtgacagagcaaggctctgtgtcaaaaaaaaaaaaaaaaaaaaaacaaggcagggagcagtggctcacgcctgtaatcccagcactttgggaggtcgaggcgggtggatcacctgaggtcaggagttcgagaccagcctggccaacgtggcgaaactccatctctgctaaaaatacaaaaattagccaggtgtggtggtgcacgcctgtaatcccagctactcgggaggctgaggcaggagaatcacttgaacctgggaggcagaggtcgcagtgagccaagatcgtgccactgcactccagcctgggcaacagagtgagactctgtctcaaaaaaaaaaaaaatgaaaaaaaaatgaatacattacattgctcagcacccatatcagtggcttgctggaacatctatctggcaaccaatgactcttagatttctgcccaaaagcccccaaccactgtcagccacacaactgacaagcaacacacccccacctccacatcctcagaggccttacctttcaccaggaccttgggaacttttgtgtggctggcgcagaaggcactgtagagcttgaagcggtcagcataatacaggaatgatccccccagagagaacagcactttctggatttgacgagaaaaggcacagttggttgtttccttcctccactggaaatatcagcaggttatggcagggagctcacatctgcctggcccaccccacaaatcaacatcttccgtgcctgtcagagcctttctttgctatcaaatgccctaaaattgcccattacaaagtatgtgcttgtacaagtttgtgtaaaaggtgttggactttttgtcttcttagtatttatagggtagatgtccctggttttccaggtctgtgtcttttaataacctatccgggctgtttgaatgttgatgagaaagtatatactttggaaaagtcagaaatctcaattctctcattagctcctgttggcaaactaaataaaggcaggaaatgctcatacctcccgcccccgaagcagaaaacatgttcctctgatcactatcttcatgccttccaaaaccaccttctcctctagcaactaagaacataagcaatattaaaggaagaaacacgctcaactatggaagtcaggtatcatctccccagcctctctgccctgtcccagtaggatcacaactgggtagaggccttctcattaagattttactatgcctgagaagatactttgtatcccacacattatatatagagatatgttatatgtaaatatataatatatagatatatataaatatatattctataaaatatatattttatataatatataaaatatataatatataaaaatatataatatataattaatatattatattaatatattatattaaaatatatatatatatatatggcctcagaaaaacaccttctgtttcacactgaaagagtcttgtttagagagggaccttatttagcttattgaggcttagaattaaaaggcagggttcaagcaaagaaataaggttttgaatttgagtaacaaactaggttccccaaagtgcaatttatctaatgaacaatgcagaggattctgagtctgtccatgaccaaaaaaaaaaaaaaaaaaaaaaaaggtttattttaaaccatacataattggtaattagatgcctcactactcttcttacgtgttctccttttcctcctttactttccaagccctccgcaaatctccaccctggcttggagggtgtcagcaggagtaccctgggtactgccatcggactctgtgagggagttatccttggagcctgatatggtttggctgtgtcctcactcaaatctcaccttgaattgtagctcccataatccccatatgttgtgagaggtaactgaataatggaggcaggtttttcctgtgctgttctcatgatagcgaataagtctcaggagatctgatggtttttataaagggcggttcccctgcacacgctctcttgcctgccgccatgtaagatgtgactttgctcctcctgaggcctccccagccatgagggactgtgagtccattaaacctctttttctttacaaattacccaatctcaggtatttcttcatagcaatgtgaaaatgaactaatacagagtcatacccaagaattaagcaaaaaaagttgtggaagaaaatgtgctaaatgtaacccctccctttagccatcctaaagccattcatttatttaacttaatatttactgtttatttaccctaccataaccacagatgaaacactaaggtattcacttattcctcccgccttaaaaattgattctcagggaacaatgtgcacacaaatatgagggtttatacacaaagactccacttccccaatgtttctgttctgtaggacttcagaacgcttctcacaggctgacgtacattgcaaatttccaaatgaaaattttatcaaaacttatttgacatcagaactaattatttccttctgatactaccttgagactagtgctctatgcaacacagtttgaagattttaacaagtttttctttttcttttttttttggtcaaatatacaatgaggagtttaaaaagagcagcaattgtggaaatcagcagcaacaggtttgggagcaaatctggaaaccaactcagagagcctggagagaatcctgcaggcaggcacactagtgttcatgagccatctcaccttacagatggaatggagacaatcagattgtgccataaacagcaaagtgaaggtatatgaagagggtcccacttatgtggaattgagaagagtgatggttgagtatggaagtaccggtttggtatccttgatccaaaatacttgtgaccagaagtacttcagatttcatattttttcatatttgggaatatctgcattatatttactggttgagcatcaaaaatcgaaaatccagaatgctccaatggccatttccttagagcaacatgttggcactcaaaaagtttccaattttagagcagtttggatttcagattttcagatttgagatgctccacctgtcactaaaagaagcaatgtacctgcctctccctagaataacactgctctcagtacactcaagtctatatcaaagttctggtacccaaagtctcctttttgtgaatctttttagtgattaactggacccaaactcaaagaaccagccccacagcaaaagacttgtaaatgaatataatgaatgttagctactttaggttaaaacgtagtattttaaagtatgtctataaccatattttaaccaaccctggcctccagaatatatccatttttattaagcagcttttttgtttatctaactaccaggccacattatgtgttctactgtgcaaattatcaatttactaatttagaaaacaggtatcactacaatgaacctaacttatttcaaatgaagagcataaccaccaacaagcaatttttgaacacaaaaatgaactatatggagtatttagggtgaaagatatattattgtgcctacaactttctcttaaatggttttggaagaaaatattttatatgtacacatagacacaccatacatgcataatgtacacacatgcacatatggatacatatacacataggagacagggagggaaagaaagaataaagcaaatgtagcccaatgctaccatttggggaatctagatgaagggtattcaggaattctctgcactattcttgtaacttttctgtaagtctgaaattatacccaaacaaaaatgaacacctataatatatacatatatattcacatacttatgtgtgtttgtatgtaattcttagtagctcctgttgcagagaggcaatgtaaagagataacacatacacaaaaaaacatatattgaggtagaatatcgaggtgaggcagtctttaccccggctccaaaacttgtaccctaacattacacagctagattcctgcaagtgttagaaggcaggcaaagtgtatgggggcctatacacatatgaacagctcattcttaacacaaatgcaaaagaaattgagtggaaaaaggatcaaacgacagccattgcaacaaacaggattagaaaaattggatattcatacacacacaaattaactttgattcctacattaaaccataacaaatttaagttcaaatagatcagaagtctaaatgtaaaactataaaacttctaagagaaaactacaaaacttctaagagtaaacacaggaaaaaatctttaggcaaagatttcatagataagacaccaaaagtgtgattcaaaaagggaaaatttgaaaaactgtacttcatcaaaattaaaaacttctgctctgtgaagggcactgtcaagaaaatgaaaagatgggcctcaaatacagaaaaaaatatttacaaatcatgtatctgataaaggacttataaaggatatacaaagaactctcaaaactcaatattagtaaacaaataacccagtaaaataaatgagcaaattatttgaacaaacacttcaccaaggtggatatactgagggcaaaaaacaagcacataacagaagacgctcatcatcgtaagtcattagggaaattaaaattagaaccataatgagctgctactacacacctgttagaatagctaaaaagagaaagtgactgtgacctcagcagaacaatgaggaggaactgctggagggagctgcaatggtataaccactttgtaaaacagttgagcagtttcttaaaaagttaaacatacccttaccatatgacccaaccattcccttcctgggtacttaagagaaatgagagcatatatccatactaaaacttgtacacatatgttcacagcagctttatttgtaattaccaaaaactggaaacaacccaaatgcccaagaaaggtgaatggataacaaagtgtggtctatccattcaatggaagacaatgcagcaatgaaaagggatgagctcttgatacacacagcaatatggacggatctcagtacaactacgctgagtggaagcagccccagaaaaacgggtacttggtatgggattccaccaatataaaattccagaatgcaaacatatttaacataacagggagcagagcatggagcaggggtagagtgggagggcagtaagaggcagaagagaaaaaccacaaaagggcaggacaagactttcaggagaaatgattatgtgcattgtcctgattgtgacgatggtttcataggggtgtgtgtgtgtgaattcatcaaattccacactaagtatatgcagcatattctactgcacaattataccccaattaatctgttaaagcacatgagggtgacacgtaagccaacacatgaagcaatgtgctttgttaattggaggtgcaacacaggaaatctgcaataaaagaaagccaagcaggggagaggaaataagcatccttgctaaggcactagtcataaatcctcattaggctgcaaggacaccgtgtgctggaagattgtctttcccctggataatgataagcatttccattaagcaaagtttcccagaacacgataaattaatttgtttactgggtaaccagaagtgccttttttttttttttttttttttttttgtaagacggagcctcgttcttgtcccccagactggagagcagtgctgcaatctcggctcactgcaacctctgcatctcaggttcaagcgattctcctgcctcagcctcctgagtagctggaattacaggtgcccaccaccatgcccagctaatttttatactttttgtagagatgggattttgccacgttggccaggctggtctcaaactcctgacctcaggtgatctgcccgccttggcctcccaaagtgctgggattacaggcgtgagccaccatgcccagccaggagtgcctattctaattcactgatagctaaagcattaaaggcccccacataaaccaaacaaaaggtcaaggttggtacttcttctcacgtaaaagccagcagctgcaccagtttaatgcaaattgatggcattgggcttcccttagccagaccagcaagacacactccattcccctccctctcagacacccttaggaacagaccccactgtggccctccaatgaagacatcaacacgatcaggggattcaacttgagccacactatagccctgacgctggaggcagctttgcactatttaccttaaattgatcaaccttctcaagcttttccaaatcaggtaccagtctcactccatcttctagagttttaaggaattctacttgaaactctaccatttccgttaaatttccaaaaagcacgtcaagctagaaataaaacagaatttaatgcacctcatatctcattagtcttcctaaacgttatttatatctgattacaaggtttttctatcaattcttatcaattaagagaataatcccactaccagagagcggggcagttttttactcttcatgagcacaccaaagcttagcaggcaataatttcagctagttacaattaaataaatttaaaatgttttcagtgttacgcatgtccccatttttcctctttaccaacaagtcaaaccacggtatgatggtcacaaagttgaaaccatttccagcatacctcatcctgggtgagaaaagtttctttttgaagaggctttaggtatctctccataagacagtttaaatcctaagaattgaaaagagaactcattagcttatgtgttttattttttatataccctagaacttaaagtataaagcatatgttaatgtctataaaaggatctagaagagaacaaacagatcctgtcccgaaggctaacgttagagactttaggtcgttaaggtccatttcatgcaggagtaagccaaccttttctgtcaatattttaggcttcgaggactaaaatacggtctccattgcaacttcttcaactgtagcacccaagcaggcatagacaatatgtcaaggaatgagcgtggctgtgttctcatcaaactttatttgcgaaaacaggcagcgagctggatttgacctgagagccgtcgtttgctaacccctgatttaaaagactaagatatagatacttaaacagatcaccctgctttcgcataggaaatgtgaccaggtgtcagaacaagtgataacacaaagacaacagacctggcagtcttctggctagattctaattagattatgaagatcataccctcaacttttaaaaaaattaaatgtagctttcttattaggtcaacaacacatacatatatatatatatataaatgaattgccgtgaaaatcactaggcttccttaaaaatcacaagaaggctgggcgtggtagctctcacgcctatagtcccagtactttgggaggccaaggtgggaggatcgcttgagcccatgagttcgaaaccagcatgggcaacatggtgaaacctcctctctacaaaaaaaaacagaaaacggggctgggcatggtggcatgcacctgtggtcccagctactcaggaggctgaggagggaggattacttgagcgcaggaagtaaaggctgcagtgagctatgatcacaccactgtactccagcctggccaacagagtgagactatcttaaaaaaacaaaaaaaacaactcaaaacaagcttttaacattcagagtataggcaaaattccaggagaaaccaagacgctcttcatgaacacagtttaaatcagctgttaatgaaaaccagcagacacaccaacttcactcctttacgaggcagagggagggcagggggagaaaaaagaaacataccttcacgtaggtgcgctccgtctccaggagctcgcagatcaccttgcgcagcttatctgcatccgagagttgtctcatggtcgccagctgaggccccgtggagtcctgaggagatgggctctggtcagaggggttcatctcatgcaaactgcggcaaaatgcggccacctgttctgtactcttcggagcacaggggggaagggaaggcagaggtcattatccctcattagacgcacctgacacctggaccgcctagaggtgttctccctggttagtcaactgtcacatatgaatgtcgtcttgtgtttccacaaattgctccacatttaggagagcttcttgaatgctcataacaaccaggataacaattgctaacatacactcatcgcttaccacacgcctagtgccggtctaatgcatttcatctgcccacacggtaaggacaacggaagcccagaggggttaagtaactcatccaagatgatgcagtacgtaagtggcagagctgggatttgaaccaggcaatctggtttcaaagcctatggatcttaaccactccccaagcaagaagtcgataaatcaggagacataaaagttagctgcatttcacccaaggtacaagcctcattaattatcagactcccagttcagtaaactatctactttgcaatgttgcaaagatgattttacaagctaaggttcttcctgttaaaaatggacactgagtcaactttctagattaagaaagatacccatacttaaataaaagtttctccctctccagcttctccaaaggcaaaaagataccactcccctttaagaataacgagattagccctaaaataggcctcaatgggagatcccagtctccacatctaccagggatgaatcaggtgtagaccataaaggttgcacacgttttgtcatccatttgaaacgtaggattccaggattctaaaattccaactcttccagttacacaaacagttctccaaagcaagggctgctgtaaaaacccatgagaccagtagttttccaacttggctgcttatgagaatcactggggagcttttcaacctcccgatgcccatgcacaccagagatcaatttcatcagaatctctggggtgggatatgcagatatcaatatgttttaaagctctctgtgtaattgctctagaggctatgtagtagcacaaaatttaattcactaatatttgttccaaagcaccactcaatgaatgtttgatggaaattttcttactttttttttttttgagacggagtctcgctctgtcacccaggctggagtgcagtggtgcgatctcagctcacagcaagctccaccttccgggttcacgccattctcctgcctcagcctcccgagcagctgggactacaggcgcccgccaccacgcccggctatttttttgtatttttaggagagacgggatttcaacatgttggccaggatggtctcaatctgaccttgtgatccacccgccttggcctcccaaagtgctgggattacaggcgtgagccaccgcgcccggccccggaaattttcttgaagctagtggctgtccttctcacgcttctctctctgcttctattgtctaattcaactctaggcacaaagcatttccagtaaataccggtgcaaataaagaataacttcttctatcatccacctacctagcaagaacatgagaataccctcccaaaaacaatcgttggtgcacagagctaaaagtcaaggctgctgttttgtgtaggtcagaaaagctaaaatcaagtgtatgccatggaggagttttaaacacagaggaaggcagccaacactgaagagcctttccctcattagcatatccaaaagggaaggaagtctggaataaagatgaggcaaggacagggaaaatcagaacctaagaaggatgcattagctgcagtggcatgacaggacagaggagagccaggacccacatccacataattattattctaattctcttacaattaccacagcttattcattgctagcactaaccctggtcttatatgccagaaggtgtcagtcacctgtcagtggcactattcaatgttttctgtggaaatgcatgtttctgacactgagtaaccccacaaacaattttcccttaggtgactgactggaaaaattgaccaaaatgggctcagctctatggtatgtaaattatatctcaacaaggctgttagaaaagaaaaactgtgtttttcatcaaagcttgtttcagtagaaataaactaaacaattttatttagttagctagaatttcactaactcaaaatcatcattaaatatacagtcaagtagggctttgtcttaaaaattacaaaggaacaaatacatccattttagcaaaaaatcttcatgtgtcttttagatgatccagtgataactgtaatagaaaactcattataacacagtcataatgagaaagaaagcaaacccttgccaaaatgaaaatccatggacagacagtgataacagctgacaactaactgtgccctgtccctgtcttatcccaaactctccttggttgctttgatttggtacctggcaaaggcacctaacacaacaaatgtataattggcacctcgctttataccatccttttctaaagcttccaacagtaaccacagctgtctgtttttcacagaattaataggaaagctactgctcatagcaaatatattcttcactgcagtctattacagtgagtcctcacttaacatggtttataggttcttggaaactgactttaagctaaacggcataaagaaaccatttttactgtaggctaattgatacaaacaagttaagttcctacagcacatttctggtcaaagaaaaaatcaccacgcttctaaataaagaccaaaagacttctaatattaaacactgaaataaatgtaagccagatatccatttaagtaagataaataaaaacaagttaagagaactatttacccagcttttggtgaactggtgagtgacggtggtcatagcggtagtgtgttaagtcaagcaataaatgtttgcaaagcaaaaattgttaaggggcacctcctaccatcatgcagttcaaaaactagcaagaacaactttggcaggatctctgaatacttttgtactgcatagtttcctgctatgcatttgtatgattgtatactttacaagtttttattttataatgatttgtattcacttattcactcattttccaacccacttattccagctcaggatcatgggtgactggagcctatcttgacagctcagggtgcaaggcagaaaccaaccctgaatagaatgccattccatcacagggtgcacacacatacacactcactcagggaccactgagacatgccaattcatcccatgtgcgcgtttttgggctgtgagagcaaacccgagtacccagagaaaacccacgaagacctggatttaacatgcaaattccacgcagacagtggtcctggctagaaatcaatttttttcacataaacgttatgatgaaatgatgttgaacaaaacgttatctgaggaactgccacagaggcagagcacacttttatcatttaggcaaactgtgtgaaatcgtgattcacgaaaggcaaacatggggatctgacacatatcaaaggcaggaaattccaaaagacaaaggaacctaacacattcctttgtgcttccaattcacacctcactacctctgggttttcattccatctgttctaccataaatactttgagaattccatttttaagagtgtgaacagggtttctgacttggtctatgtaagtttaccacgcctgaggtttggcatccttagtttgaagcaggcctgtggggtgagctcaggttagtaggatgcaggctagggcttcagtcctctaaattcagctgtctcctaggcccaacctcaccctcagacagccagagataagttctggcttatattaggaaacacctttagcatctcaggggacagctaaaattcccttgggtcctctttggacatttcacagccttaagtatcccttccttattaggtacgacctaggcctaggatagacttagctgagtggtctctcaagttgagcaaggggcaaagcagtttccccaccggcaaccctactcaatgaatcaaggcaccaaccctcaggtgtagcacaaggaactgagtccagatggatgtaatctctttactgtcaactgcacgttatttgaataaagaataaaaaggtaccatatgcatcattacaagttataatgcacatacatgttgttaagcggtgttatatacaagcctcttaaaatttgcttggaaacaaattaaaaggatgtcatcaagtttgaaaattctgttttattaaaataacacccccccaaattttttttggaaggaattatgaaatgcaggttttctttagaatacctctaagctagagatttttccatactgtggggctcagcttttaaatccccctccctctttactgtggccaaacttctttacatcaaaatccatcaggcccttctccacgcagcttagccatgatgtggaatataggaggagttgggttcaaggctttgccccgctccaccactgagtgttacagatggcatcctagtcattcccacaccaagcgctgtagccacaagtgccaagaaaggtcgcctcaatgggagcttctcaacacgctcccaaaagccaagtatcctggatgtgggacaagcagcttaggactccagcaaggggaaggcagaccaggtttctccagtggggaaagtaaaaacctctcccctacttgaggactgtaatcagtcaccctggaaaccaaaaaagtacttacaggcattttgagagtttaaaactgttaaagggtagcagagcttttccactgtcaggactaagaattatccaaccaacatacagacaaggagaggacaatggcaagaggaaatgggccactttactgagaccagcgtgatgctcaatgtttataatgctgctttcctcctgtggaagatgaaaagaaagtacaaaaagagggggtagacttttaagtacacactatcaactcaagccacccagctgtttaagctcttcctgttatgcaaccaccaaaggcaatttctaactctagatgagttcacagttctaaaactgttctttgagtctgaccgatttaacacatcccacagatttaaaaggggccagagtggcctaaaatcttatagcctttacttaagctttttttggggacaatgcgctccataatttcagagacactatgtacaatggtaatccctacagttctcgatcaccttttcagtttcctcttgaacaaacttcaaagaagaaatatccaagaaggaagaaggcttatttgagcaaatcaggtgtacgcactgtagaagtttaagtttgattaaatgacacaacatctaatagtcgacagactgagctattaataataaactattaaaaggttgaatctgattttgctaaattatttcttgccattaccccactacacttcctcattggagagtgaatatttactgtaggaatagacctgttcaaataggtcagttgctgtcaaaccagtaacacgtcccctgagccaacccttctatatctatctccttctcaaggaagcagaaataaagtcaaaaacacctcaagccttataaaaggaaacaagttgaacatcctatttccagacctccctgccgatcactcggacagcccgttctgaggggggatgggagattctcaccatgcacgtaacacaaaacacaatcaaaatctcaataaccaaaacaaaggcaaaaaatgcaactgaccattaattaaacaaaaaaatgcagattacatctttctgccatttaagtataaaagagtagaaaaatgtaaagatgctaggcaaattcaactccataccaactctgaacctccccacgtcccccaccaaaagccacaatacagactttatgaacaagggtatccagagggtaaaaggacagaatacggggaaatgggaaaggtgtaatcactgtcattcggattgaaaaacaactgagctagaaagtcataacacaatcaaacctagcaagataggattcaaacagcaaaggcgctcaccagatgaagtgttcgatacatagagtcaccggacttgtcattgttttcaatcctgggcttgcgctttattttccacagtgcagacatcatcaggaatgtattctcatggtaattaattctaccacctgacgtgttcagcacggagacagaagtttcttaaaatattcccagagcaccaaacgcctcctagctctgaagagagcatcctctcatatggacgtcccatgctggttttcccatgaaaatctacggccacgtctcaacgcagcaaggacagcgacggtgagaccccggagctgcactcgcttcccaccagtgccctctgggaagctgtcaaaggctaaactgtggaccagaactcaggctttgatttcacctggctaaacaacaaaagttccagaaagggagagctgaaactggcaagaaaacaaagcacaaaatgcctccccgggatgtaagcgtctctgccctgcagcctgagatcagctgattggccagcatcctgcactgctcaggaatattaaacctgcccggctccgacaactttcaaggtattccacactgagtcaagagcaggcaactaagaaaagttgtgtgtgtgtgtgtgtgtgtgtgtgtgtgtgtgtgtgtgtgtttaacagttgataatttcacatttttccactcatgctttgttataaaagcagacatttctgagacaaaaacaatatggatgagaaagaaaaagtcattcctaatggaaatgtcctgaaaattattctaatacatttgctaaatggaaaacacaatcacagctgccaggcggcctggaatgcatgacacatgaccgcactgccctgaagctaattagcattcatctccagaaacaagagttttcaatgagaagcagagaaaaaagtagccagtgatgatgaggctttttgaggttgtcacccacagtcacaggagagaggaggcggctcagaaagagaaaggctgctagactgtccctgcagtgtgacattcccctgcccctccccagcggctgtgacattccagtaccaccacgctcaacaacaagcatacaattatttacttgctcaactctaaaaggccacacatagcaaaaactgctattcagtacaagtgcaaaacatacagaactccaacatgctttttctttatgctgaccgatatcatgtaaaacagtccatttagaaagaaaccaagaatattacacaaaatcaacagctctaacatattcagctggaataaaaagtgattatttgtttctgtttatttagttatttacacatttacatctctacactcagcctcgtgcattcagacaaggctaaatcatgcttccgagtttagacagctaacgattgaaaaattaattttcagcttattctcaagaaaagcttcacacttatataggagacgcatcaaaaaatatttagccttgatcaagaaacttcaggtgttttcttgctcttactttaaatcataaaaagagacacacagaaacattaagcattaggaaaaaatttaagtggtttatggctgtatatataaatggcctacagcaccactaataaattaattccttctttttatgaaacccagtatttaaaaccagatgttaacaatctggacacaaggtagttttaacatagccactaacaagacaagacctggagccaaaccaggtttgcatcctggttttgtcatcacagagctgtgtgaccttcagcaagtcgcttaacctctctgttccagtgccctcatctataaaatagggcagataatagtatctccctcaagagtgttgtgaggctaagatgagttaatatggaacagtgcctaatatatacaagaccttaaataagtattacttctcatttactattaataacacacagtagaacccagccaccaagaactgctcatttaagctttttgcgttcaaataccctaagtgagaaatttaattgaccaaaggttattttagctaactaatttgagttgcatgacaaaatttcaaatagagaagatgaagtctgaatcaaagcaaaaccaggaagtatttcggacacagaattacacagtgctccccacatccaacccagcagaatgaaatacgaacttatggtttgaatgcagtctactgcatgatctttaaaatatattcaaatcatcacccaaacttcttaatctttttttttttttttttgagatggagtcccacactgtctcccaggctggagtgcagtggcgcgatcttgactcactgcaacctctgtctcccaggttcaagcaattctcctgcctcagcctcccgagtagcttgtcaataattttgagaaaattctgtccctttttagaaagcccactaagaatttctacaagaaaatctttgaacagcaccatctatttctatatttgacccttcatgttccagataagttcaagagccttgttctctggaaaaagaaccacggagtcagagcgacacatgggaccagtcagcaaagccctggagcctcttccgtcctctccactgccagaacctcatattatacaggactctgtttatgacctcatgactcactatatttaacatggaaacgatctctctcaaaatccacaaggagatgagaacactgacctatcaaagtaaagtaaaaatgacctaatcattttggatccaatactttttaagtgttcagaaataaatgttttagatacaggaaaaatagctatttgcctaaatccagttagaaattgaaaattaatatttttagttcttataatactgtaacttaatagatacccttcaaattgtcttacatcagtatagaaatatctgtttctcctgaggacaactgaccgaccccacaaaagtaagtgggtaaaagaaatgtaagggtcacctaaataaaaaggaactttaagcagttggttttttaaatttgccttaaaaggaaacatgtgcatttccaatgatctgctttttaattaacaaccaacaacataatgcctttcagtctataaatattaatgttgctttcaaatattaaattttatattgtgcccaacttaaaaagacactgagaatgaagatcctacagtcaggaaagagaaacaaatatggataaaagatactgaagaatcaaatatgtgcacacaagaaagtcctacagaatatacacatacagggggaatcaaaacaggaaatgtacaaacgtaggttttcaaaataatagttcatgtttgaaaagcatttttccattatcaatgtgctttctcatagttatattatttgacccacccaaaaatccaatctccaagcaaaggtaagaatcaccctgattttgcagatgagaaaacaaaagtatacagttatgtgatttgcttaggttaagtgactagtaagcgtcaagcaaaaaaaagagagatcgtagagaaatatacatatctcaacaacattatagaaaaagatgaataagtatggaaacaaaatcacacgcaattgctttttttgcgggggcagtgtcgtttggattcaggtaacacagaggttttaagttgggttgtgttttgaagactgtggtaaaagaggctactgacccatggaactctttatgaagtggaatagaagcatgataagttatgggcaacaggccgggtgcagtggctcacgcctgtaatcccagcactttgggaggccaaggcgggtggatcacgaggtcaggagatcgagaccatcctggctaacacggtgaaaccctgtctctactaaaaatacaaaaaattagcagggcgtggtggcgggtgcctgtagtcctagctactcgggaggctgaggcagaagaatggcgtgaacccgggaggcggagcttgcagtgagccgagatcacgccactgccctctagcctgggcgacagagcgagactccatctcaaaaaaaaaaaaaaaaaattatgggcaacaatttcagtgtcttgcaccaaaaagtcaggagaactttcttactatgttcaactaagggaaagtgtatttggattaattttaaaatatggtttctttccctttaacataaaagttgctcacttttaacaagagctgaatgcaggtaattcaaaaggagttcattacagaaaccctaagtagcaagaaagcatagctgactcaatcccacatacttttgatgctgtttcatcctacacaaatgaagatgtaatagggaaatggaataaaattatggcattaactgggagctccagcagtggcagaaatttaagaaaagggattttatttcattacgagtgatttctcccctatattctcacatacaggtttgttaccaaggctataatttggatttcatttcctgctattcagcaacatctcagaagcaaaaacacttcgtccatggagaggcctggtaaccacatacagctgtgtaggtgacattgtcagctgtgattcttcagtggttcaaagcatgggatgtgaaaatgaaaatctctcaccttgctgctgtgatcagtctcatctgaggattccaagtctggcccctcggtctcctctggagcggtctcagcactgctgccctgctcgctgcaaaggctgtgccctgtcagatgaaatcagaagaaaatgtgggtcaacatggacagtaattgctaaaagccacccctgtgtgagggggacaaggaatctcgctcatgacatgtacatatactgtaagaccctccaagtacaagctccatcacctgggctcaatcaaattaaaatgatagttgttactgttactactagtattattactttatatttttcataataaataatagttgttgtggattgaatgtctttgtctccccccatacaaattcttatgttgaagacctacccctcaatgtaatagtagttagaagagggatgtttgggaagtaattaagtttagatgaggtcatgagggtggggtccccatggatgagattagtgtcataagaagagatagaaaccagagttcgttttctctctaccatgtaaggacacagtaaaaaggcagccgtctgtaagccaggaaaagagccctcaccaggaaactgaattggttagtacccagatgatggggcttcccaggctctaaaaccatgagaaataaatgagtgttgtttaagccactcagtttatggtattttgttacaacagcctaagttaagacaataataatttataataaaagaatatatatattatatactaaaaaattaactgattttgttgattttacaattagcaaattgatgaattaattcattaattactaaaataattaaataagccatactgagaacagtacaacaaaaaaaatgactgtcccatatccattacctgaaaaatcctgcaacgtctgtttttgccatgtctggcaaactataaacatcttataatacctgctcttcccatgatattctgtgcaaaagtgcaagcaactttcttcctttgctatttactgagtgcccaccacagtggttctctatagtggtcctctgcgttgagaagagaatatgaggatcactttcccctggggtgcttctcaaactgacagagcatctggatccccaggggaacatgtttaatgcagattctcattcaacaggcatggggttgggcctaagactgtgtgttccttactagctccgaatgatactaatcaaaactgcaggtccatggaccacacttggaatagaaagactctagaacattaaaaaccttctctaattgaatctgagaagacagtggattgagtaccactgtcctaaaatatgaggcactggatcacggactagagcactatcaatataaccagacaagagagaaggaaagagaagaaatgggagcagaaggagcccctgatgctttagatgaaagattccgtctgcaaagtggctaccttgctccaatgacaccattacagctgtaagctgcctggcaacactttctattcaggtccaagctggccaggaaagttagggaggaagtggacccctgagcaaacttggcaccaatgctgcctcctaccatccctttcttctctggaatgaagcaccaactaagtgagtgtaccctgaatggcttagaggtttctgtgtgtttccccaccttttggctctggctcttggattttcttgtgttacttttcagtattcaatcactcattacttgctcttaaggtggtagtggtcaaagaaggaagctcagttaacttggcagatatcatctatggcaactgccattgccaaagcaaaagtgcttgaatattttgcacaggggcaatgacctaggtacaggtactgatccctgatgtggaacagctgacaagctcatctgggaacacaatggcaacagcactcagtgctctgatcacaggaaccacagcatcctcagtgggacgtccggagcagccaggaggcacgactgacaggggcccccttcacactgtggtctgcagaatcacaacctcctggagttgaacaacccatatacactgtgcagagaaatgctgtaaccctgcacatcccatcgctcacaatgcctaggatagctgatgctcataaaatagtgggaaagcaaataaaaggatttccttttttttttttttttttttgagatggagtttcactcttgtcactcaggctggagtgcagtggtgcaatctcagctcacttcaacctctgagtcctgggttcaagtgattctcctgcctcagcctccccagtagctgggattacaggtgtgcaccaccatgtccggctaacttttgtatttttagtagagacagggtttcaccatgttggtgaggctggttttgaactcctgaatgcgcccacctcggcctcccaaagtgctgggattacaggcatgagccacagtgcccggctggattttcatttttaataataccgttgagagccaggtttcctgaagagcaaacaaataaatctacaaaacacttagaaatgctaaataaagtaaaacaaatgtcctttttaaacaaagctgagctccgaaaactctccaaagcccaaatgaagaagataaagttgataaaggaagtggggtagtgtccatgctatggcagcctaagtatatccatcaatccccaagccctaaaacggcgtttcccacagggtgtgagaacctgttggtgttagcagggggacaattcttttgggacagaattgtgcacttcgtaggtacacttggcactaggctccctggctcctgagcaccaaacgattaggacttgattgccactgtgacaatcaaaaatgtacccacacatttcccaacagcagcaccacccagtttgagacccactccctggagccttcggttttaactgtaagcccatgatacatgatacagaaaacagggcttgggtcagtacaacttcaggagttagaagtgaatgtcccacattcatatggttcccctgaggggctacacccctcagtctaaaaagacatagactaaaagagaaaagtgctcactggcaaaagaaaaagagatggaaaaagaaattctgcctatactttggggtaggagggtggaaaaggaatacagcaggtttcttccctgagattcttattatttttttttttttttggagacgtagtttcactctgtcgaccaggctggagtgcagtggtgtgatctcagttcactgcaacctccgccccatgggttcaagtgattctcctgcctcagcctcctgagtagctgggattacaggtgcccgtcaccacgctggctaatttctgtatttttagtagaaatggggttttgccatgtttgccaggctggtcttgaactcttgacctcaggtgatctgcccacctcggccccccaaagtgctgggattagaggcatgagccaccaggcccagcctgttccctgagattctttttcttttttgagatggagtctcgctctgtggcccaggctggagtgcagtggcgcaatctcggctcactgccagctctacctcccgggttcacaccattctcctgcctcagtctcctgagtagctggtactacaggcgcctgccaccacgccctgctaattttttgtatttttagtagagacagggtttcaccatgttagccaggatggtctcgatctcctaacctcgtgatccacctgtcttggcctccccaagtgctaggattacaggtgtaagccactgtgccaggccccctgacattctaatcataggactgacttcatatgtttgtattccaaggcatctggtaggagcaaaaacaaatctactctggtagaattcactcttaatgatgatatcatataatacccagagatagagcttggtcaaagaagaacccataatcccatattataaaacacaagaggcaacacatcactatgagcaagaggcaacagacacaataactgacaaaatcaggccaccaaggaatgacaccgcaatgatcagatgtagaatgtcaaataagtatgcttaaaatatttttttaaaagaagaaagggggctgaacacggtggctcatgcctgtaatcccagcacttttgggaggctgaggcgggtggatcatctgaggtcaggagttcaagaccagtgtggccaacacggtgaaatgccatctctactaaaaatacaaaaattagctgggggtggtggcacatgcctgtaatcccagctacttgggaggctgaggcaggagaatcacttgaacctggaaggcagaggttgcagtgagccaagatcgcaccactgcacttcagcctggcagactgagtgagactccgtctcaaataataataataataataatactaaaacagaagaagaaagagataatttcaaaaaacaccaggtaaattaatagaatttttagaaatagaaactataaccaatgaaatgaacactcaatagatgagatgtaaattgacgaaatgagagaagactggaacatctatccgaagacactgacttactagagctcctaaagaaaccttcaaatgttaaaactatcaatatggaattgcattttcagctaaaatatcatccacgaaggagactttaagacttttgagaaacaaagaatgagaaagtttatcatgaacagaatctcactgaaaaagttcgctaaaggatgtactttcaggtggggaaagaaagaaaaagatctggtatacaagcgaaaatgataaacagctgatacacacacaggtaagtcttagtatatatgacaaccccctcaactccccaaaaaaggtacttgggggcaaaaaaaaaaatacaaactgtaactaaaacaatggtggaagtgattatatttaaagccatttcataattttatgcaagagggaactagaaacattaactttggtttctgttaataatcatcttaaaattttaagatcaaacactaaaagaacagaaatagattatacaggttgaaaggagaaagcagaatttataaatgcaacctagaagaggacaggaaaggaaaagaaaaacaagcaagacaaattcagcaaaacaagataatagaaacaaataaaaatacacagatattctaaacaaatgtaaaacaggctaaacgtaatacttaaacttcatgtttagattatagaaaaaaacagtgcaaaacaaagccccagctgcatgctatatggaagtaatagacttaaacacaaaagacacacaagattaaaaggctggaaaactatattaggcaaacataaagaaagcctcaaaaatgtcagacacaatcgattagtcaggatacagaagatgtaaaaatcagtaattatacagcttgatccatgaatgcatttcaaacctattcccaagaaattggtgaatatacattttccataagaattagcaatttatgcaagtaggccacatattaggccacagtgtaaatttcaagcaataccaaagaatctgtatggatgcagaccacactggcaacatttttcttggaactaaatattttatgaaagaaaaaaaggccaataacacccaggacagtttttaaaaagaaaaacaagattagggtactttacctaccagatctcaaaacatattataaaattacagtaatctaaagcagtgcacaacaggctaacagaacagagagctcagaaacagagcctccatcccatgcagatgttcctcaacctatgatggggttatgtcccaataaacccatcataaagtcaaaaaatcattaagtcaaatcatcataaattggggaccatctggccaggtatagtggctcacacctgtaatcccagcactttgggaggcagaggcaggcggatcatgaggtcaggagttcgagaccagcctgaccaacatggtgaaaccccatctctactaaaaatacaaaaattagccgggcatggtggcacgcacctataatcccagctactcaggaggctgaggcaggagaaccgcttgaacccaagaggcagaggttgccaggagctgagattgtgccactgcactccagcctgggtgacagagtgagactccatctcaaaaaaaaaaaaaaaaaaaaaaaaaaattgggggccatctgtatatggaaatgtgaaatacagcagttatgccattgcggacaagtgagaaaggaatagaatatttgataaatgatgctaggacggtagattacccacgtgaagaaacataacattggaacctaactcacaccattcacaaaaatcagtaccagagatataaatcagtatatgaatagcccaaactgtaaatcttttagaagaaaatatagaagacagcgtttattacttcaggggagagagagatttcttaaacaagatgtaaagagtacaaaccatataagattgaaaattcagattttgctgaaattaaacacttttgtttgtaaaaaggcaccataaatacaagaagacatcacagactgataaaagttatcttcaatacatctaactaacaaaatgttaacatctaaaatataaaagaactcttacaaatcaataattggcggcatatctgattctaaagcatatatttttttatccccatatgtcatgttttctacccttaactgaaggtaaaaatcaataaaatgaattaaaatgggcaatgcagtttgtagcagatcatttgcaaagatgacagtgattatttctttcatctctttaagcgcagacttttatgtctatttcgccactccatgaatttgggctggtgttgtgatttgctttgataatatgttaattgtgatccaaggcctcaagtgactttgcagtctctggtcttgccctgctgggaactctgagcccaccatacaaagaaatctcaagctaacctcccatgagagaccccaaggagaggaggcccagctgtttagtcaccatacgtgggagtgagtaaggccatcttaaaccctccagccccagtcagaccactggatcacagagtcacatgagtgactccagggaaggttagcagaacaaccaaccagctgagtctggcccaaactgctgagccacagaacagtgagcaagtaaaacagttgtttcagagtggtctattacgtggtagtagataaccaataagtggtgagggggaatttcatgataccagaaagccagaaagcaggaggtgacagtggtacgcttcaaggaagctgaggagagacaccagcatggcaggaagagggaattcaagtgggaaagggcattgttctcactcccatacttgagggccttctctaaacactcccagcttaagaagtgtagacaacaacatggtcaagtttgtttgttttttttttaatcccatacaaacagagttttgcaatttcctactctagcttcccctgtgctactcacaatagtagtaggtgagcggctttcccctaatgacagaaattggaggaattatcctctttgttctggacattcctgtccccacctacttaccaggaaacaaagcacgacagctctgctaccaatcagagagagaagaaagctgaagataaggctcagtcgtggctggagaagcaggatgcccatccacatcccagtactgagcacactgccaggcatgcagcaggggaccgggggagaggaagagggctcggtctagagagacaaagtctcagggaatgaagaagcccagagcaggactgtggactctctcagacagggatcataggccaaatcaaaagctgctatagagcccggcgcagtggctcacaactgtaatcccaaactcttgagaggttagagcaggagatcacttgagtccaggagttcaaggctgcagtgaaccatgattgtgacactgcactctagcatgggtgacagagagaaaccccaactctatttgaaagtaagaaaaaaaaaaactgcggtaaccctgtaaatagaattgattgttgtgaacaggtaaaatcaatgctttgccttttaagttacctacaataatatttttgtgactgcaaaaacgtttgcaatcagtacctctgacgcaccatcaacaggacagacaacgaggagatttggggaagtacaaacatattagtgcagtttacattgagatttacctttcatttacccagattacacacatctactttggtttcattcaagtccatgtgggacttaagcttaaggaggaagaaaaaaaattctggcctcgtgagatgtcttaacaatgtgctctaagcagaccctccaattcaaacattgacaaagagaaacaattacaacacgaaacttttaaaaggtctttttaatgcctgagtttaaatccctgatggaaaaaaaacgtttgggggtgggggcaaaagaaagcttaaacactgtcaataaagatatttagctggaactcaactgttaggatataattttattttgcgtttcagtcattttactgttataagattttaagaattccatataaatacccataataacatcagcataaacactcacccctccaacaaagctaaaaaacaaagcaagaaagaaagagagagcgagagaaagagagagagagagagagagaaaagaaaagaaagaaagaaaggaatgttacaatttgaacttggtagacaaataataactcctttttaatcaaatgtcacaaaatctcagtttttgtttcctataaagagaaatttaaaattccattaaaactgtagatttaaaatagtaacttctttttagtcaaatgtcacaaaatctcagtctttgtttcctatagaaatttaaaaatccataaaaacttactaatcctgttagcttgttgtgaaagtcaaatatacattaacaatctttaaaaatatcaaaatagagcatctcagtctccgaaacatgttttttcacacgcaggatttgacggtgtcatcagtcaaatctcactggaagttaccccgcccccggccatagcagggcccacgcaggcaggccatgtgctgtgtgacaagaagcacagcaggccgacagtttacgaggcgcgcgtgtctccaaatgttatcgacaaacaaacagaggaccatgtgctgccgggtatctgtgagacttcagagaatctgaagccctggaccatatttgtttgtgggaagagaaatctgtgcagttcctcttcctttgccgcccctccctgccgcctgactgtcttcggttttcagaatcgagctccaggccatctccatggaacatcagaccaaaatagaacctcacacttcacgggtactgcacagaggcacgtcctgcccatgcagaccaagcggctgtccgtgctcagcacttggcaattcctctctctgaagcaaggtgccttcgactttcacggctatcacagaggcctttcctgttcaacaaacgctgcttaatctacttcctgcaggagggacactggtctggactgcagagcacaagcttccacttggcatcagacagacacgcctgaggtttatcaaaggatctgactctgcaactccagcgctggccctaattgcctttaacatgccataggcctgctgttagccacacgcacttggctttctccaacaccacagcaggaataaccattttttgaacaagaagcagctcttggaacgctggaacttttattatttttaaaattgttaccttttttctctttttctttttttgagagagagtttcgctcttgttgtccaggctagagcgcagtggtgcgatcccggctcactgcaacctccacctcccgggttcaagcaattctcctgcctcagcctcctgagtagctgggattacaggcacctgccaccactcccagctaattttgtgtacttttagtagagacagggtttcactgtgttggccaggctggtcttgaactcctgacttctggtgatccaccctcagcctcccaacgtgctgggattacaggcgtgagccatcgtgcccagcctgttactttcttttttagagatagggtcttgcttgtctcacaggctgtgtgtagtggtatgatcaaggatctctgcagcctcaaccttctgtgctcaagtgatcctcctgcttcagctgcctgagtagctgggactaccggtgcacaccaccacgcctggctaatttttaaatttttagtagagacaaggtctcactatgttgcccaagctggtctcaaactcctgagctcaagtaatcctcccgcctcagcctcccaaagtggtgggattacacgtgtgagccacaacgaacgcttggcctctggcacttttattgtaatcctgtgggctactcactgaggtaaaccaaggcacctgcttcgccccaactggtcaagtggaattctagggacaatcacagcacagctgtataaaccacaaaaataaagtgaacgtgaacccaaagagagagagaaacaggcgtttgaaacttcggaaagacactaatggtgtcacttcaactatgattcttataatttgcataaaagctgaggttttgcataattactgttacataattccatttattttttcttggctttcttcttgatgtaaaaaggaaaaacaaggccataaatggggatttgtgttggaattctctcaataaatgctttataaaacttttttttttgagacggagtctccctctgtcgcccaggctggaatgcaatggtacgatcttggctcacagcaacctctgcctcccaggttcaagagagtctcctgcctcagcctcccaagcagctgggattacaggcgcccgccaccacgcccagctaatttttgtatgtttagtagagacggggttccaccatgtcggtcaggctggtctggaactcctgaccttaggtgatccacctgcctcggcctcccaaagtgctgggatgacaggtgtgagccactgcgcccggcctataaaacttttttttaagaactgttttacatctagatttgctttgctttcctatattgatgttccctgcaacatttccctaaaagggtgatagagctataccttttaataaattaggccagtagttctcaactgggtaagatttggctgcccagtggccttttggcaatgtctgaagatatgtttgatgggcacaacttggggaggtggcgtactattgtctcgtagtggcttgcaggggtactgctaaacatcaacacacaggacagctccccacagcaaagcattacctagcccagattgttaatattgctagataagatcagtattcaaaataaatcacacaagaacacaagagagacttttttgaaacctcatacaaatacagttctgcaacttcctattctagcttccccttcactgctaagatctttttataaaaacagccactgaaggaactatctttttgtcctagacatccttccctttttttcctaccaatatgtatgaaaacaaatgcttaaaaaaaaaaccaaaacagatgaaagtagctccagtaagactgcaaccagaactcagggatggcaaacagccaaggataggaaactgagtcttacagagaacactcagcatagactctccttatgcagatcctggctttctaagccaacgtggcaacccattcagcaggcttccctcgtaaaccaaggaacgggagaatggagaatgtactacaggaccacctaacaaattttcattacaaaaaaatctcaatgaagcagatcacaaaatgtgatcaagaaactatagaaggtttgcatgtcaccgtaaaattccaattatcttatgattccaccaagacaagaaaaaggacagggagcagtaaccaggaagagttggtgacctaaggcagtggctcccaaccagggctggacattagaagcaaccaccggaacaaatgcagacccagaccccatcccacactaggtgactcatgagctctgaaaaagggcccaggaacctcagcattctagactacagcattcagttctttctactcgagaaaggaaaatatgaacaagctgtaattcacaaacttagttatcaggtaattcacctgttgcagactgaggtggcgtagaaggcagggagaatactgaaaaagagcaatctctggtcataggccagggaatcctcatgtcccccataagagaatggcttcaggtacaaaacatttattgagcgcttactgggtaatattctaaatgctttacttttatgcctcatttggtcctcacaacagcccaatgagatgacagtgtggcattatccccattttgcaggtgaggacactgaggcacagagggattaagcatgaccaggtcaaggtcatgaagctgatgaacatagaaatggactgatttctggccaggcatggtggctcatgcctataatccctgcactttcggagggtgaggcaggtggatcacctgaggccaggagttcgagaccagcctggccaacatggtgaaaccctgtctctactaaaaatacaaaatttagccgggcgtggtggcggatgcctgtaatcccggctatttgggaggctgaggcaggagaatcacttgaacctgggaggcagaggttgcagtgagccaagatcctgccactgcactccaggctgggtgacagagtgagactctgtcccccccaccaatgactgagttccaaagaaatggactaagttccaaataacttggttccaggccctaatcttcgccactaggctgtgatgcttctacatagaagaaacaaacctctctatgagaaagcagttcagaaataatccaactttgaaagctaatcccatactcactcagggtccttaagggaggacctggccaagtctgaccacttgagtttgtgagactgtggagctctgcaggacaagcctccagcagccaggtagcagccagcactcacgtggaccccaaggtccctgagacccagcaaggctctctgtcgaggacaccaatcatccaccttaacttactcccatcaaacctcaaacctgccactcaggatgtttcctatttttgttacttctaaatttagactaaggctgtagtccatcctgcccgttgtacaaaattttctcggttgttttctattttaactgcagtggtctgctgatactgctttatctctgccccatcacagagcaatctttcagttattttatcctgtttatttgcctccacttttatcttccactgttaagtggggactaggaagcagaagcaatcagaaggcagataggcagagacccaggtggggaagtgaaatgccttctctccaccagcaggtccaattgggctgctacttgaccaagtattcaggaattctttttttttttttttttttttttgagacggagtctcgctatcgcccaggctggagtgcagtggtgtgatctcggctcactgcaggctctgcccccggggttcacgccattctcctgcctcagtctgccgagtagctgggactacaggcacccgccaccttgcccagctaattttttgtatttttagtagagacggggtttcactgtgttagccaggatggtctcgatctcctgacctcgtgatctgcctgcctcggcctcccgaagtgctgggattacaggcgcgagccactgagcccggccaggaattcttctgaaatttactaattttgaagccagtttagaaactttaccaaaaacaaaaacaacaaaacaatacagtggctttacttccatgctttattcctgagtcagtctgattacctaacttgacaaagcagactctgttctggaggatttttcttttttgatggagtttcgctcttgttgcccagactggagtgcaatggcacaatcttggctcaccgcaacctctgcctcctgggttcaagcgattctgccgcctcagcctccctagtagctgggattacaggcatgtgccaccatgcctggctaattttgtatttttagtagagacggggtttctccatgttggtcaggctggtctcgaactcccgacctcaggtgatccgcccaccctggcctcccaaagtgctgggattacaggcgtgagccaccacacccagcctgaaggatttttgatgattgtaaaactacaaaattttaagaaataaagcaatgtggccgcacacagtggctcattcctgtaatcccagctctttgggaggccgaggcgggcagatcacccgatttcgggagttcgagaccagcctaaccaacatggtgaaaccccatctctactaaaaacacaaaaattagccaggcgaggtggcaggtgcctataatcccagctactcaagaggctgaggcaggagaatcgcttggacccaggaggcggaggttgcagtgagccaagatggcgccattgcactccagcctgggcaacaagaccgcaacttcgtttcaaaaaaaaaagataaagcaatgaaaaaatgaaaaactacattaaaacataaactggaggacaaaatttgagtcatagttattatcaaactttcagctccatgcctggcacatagtaaatacttaaaaaatatcagctccgagttatggccgcttaattgaaaaaaaaaaaaaaccttccaaagatgatcccaaaattgcagttttaatgtgttttaaaataatggcagggtccatggatttagcgcacagcctccaaaggtgagcggtctgaaggaggtaacgtggtcagttgtaaagtccagttgtttagtttaaaactccaccacacaaaagaccagacagcaactgtatacacagaaatactcagatatttctaaaatagatatatataaaatgcattttaaaaatcttttaaatgcatttcaagatttattcaatgcattttaaactctattaaatgtattttaatagatttttaagcaaacacacgtacacgtacatatacatacacagatttttttttttttttttttttgagacggaatcttgctctgtcgcccaggctgaagtgcagtggtgcaatctcagctcactgcaacctctgcctcccgggttcaagcgattcttttgcctcagcctcccgagtagctgggattacaggcgcctgccaccacggatggctaatttttgtatttttaacagaggtggtgtttcaccatgttggccaggctggtctcaaattcctgacctcaggtgatccgcctgccttggcctcccaaagtgctgggattacaggtgtgagccactgcgcccggtagactttttttaaaaaagaagaaagaaatagacgaaaacattaaccgtgtctatccttaaaaaaacaaattgtgagcaatctcagtcatactttacatcagggacagcgaatttgatgtgtaaagggccatagagtaaacacttttggctttgtagaccctaagtccttgtcacaacgactcaactctgccattacagaaggaaaacagccagagacaaggtgtaaatgaatggcatgactgtgttccaataaaactttatttacaaaaacaggtggtgggctgcttttagcctatggattatagtttacccacctctttttttttttatatctgtaacccagaagaagggctcagacagaagaaaaaaatccaaagaaagttgagtacacactgttgcttatagcacatatgtgcaagcttataaaatcctttaaataatctaatctaacataatatgtctcattcaaagtcatattccagaaacaactctatctgtgaaccgttttatgggatcgatcctgccatcttgtggtcacatgaaataacagcctttatagtcttcattctcctttactaagggtacacaactcactggagccacttttcaaaaatttgattgggatgtggggaccacaataacataatgagtcaaggaagtcaactgtaactgagagcaatcaattttctgaagcttcaacttgtcaaaatcttccaaggagccaatggacaaaagaatgaggggtccaacttccttagcaagccaagcttcagaaaatgatttgaaaaacaacaatagcagggcaagaatatccaactacccaagagccttccatttcagattttgaacagaacgctccttttgtatcccaagctttgaaaagagaaaataatgacaaaaccccaacttactaaatcaacccaaacccgagaacccggtcatggagaaataaatgatagtaatctatgctgttcatctgttccatcactcactcactctcttgctgaacaagaaagggccacccatgtagcaaaccacatgtaaagagccgggaagacaaaaatgaggaatataaacccagtctcaggaaacacatttaggcgaaaagagagacacaagcaagtaagaatcgcatgatctaatgagggcccatatggaagtcaaatttgcagggttgtgggggcccagaggagagagctaactctatggggtcccaggaagacttcgaaaggcaggtggcactcacgctgcttctagtagaatgagcacaggttgccagaaggagcggggagaggaaggaagggcagggcaggggggtcactgaagcgctcgggttcagtcttcaggttgaaaaagtccaaaagacaaacagagctctgcacacatttccactctgggcctctcagcatctcagctcacgtccttctctcagacagcaggaaagcagggctgagtggtggtttggaagatgacgatagagaaggcaggaacagaggtaggacttagtctcagcatcttatgtgattcccagcacttcttcttcttcttcttctttttttttttttttttttttttttttttttttttttttttttttttttacgagacaggcctctgtctcccaggctggaatgcagcagtgcaatcacagcttactgcagcctcaaactcctgggcccaagcgatcctcctgactcagcctcccaagtagctggaactacagatgctctccactatgcccagctcatttttttttttttggagagatagagtctcgttatgttgcccaggctggtctcaaactcctgacctcaaggtatcctcctgcttccacctcccaagtgctgggattacaggtgcgagccaccacacgtggcccaattcccaacacttctgtgcctctgtatctctatccacagcaaagtcttctaaatattcacctttccccaaaatgagaaacagcagaagcattataaagctgcccatgggtgacaggtggatctgtagcaaaacagctctatgagaaaataaagttccctgcgcctttgaaatttcaacaggaaatgcagggccagtcatcagcccatcttgcacacacattttataccacctgccagacagaggcactcactgaaacacacaagccgcatgataaactccccgggtcgtggcacaacggagttcagactcgcccccagcaccctgcacagccatacctgggttgctggtgagaaaggcgagggggctctcgccaaggtcggcagggccgtccactcggtggggcgggctttccagcagctccactccttcctccagctcggggtaggtcctcaccaggaggcccagcgagggctgtgagaggaaatctttgagcatagaagagttcagggcgtcagcagcacgattattgatctcaagaatctcatctcctgctttcaggcctgccaacgcaagatggaaaatttttaatttcacacacattatcagaacacaacagcttaggagctctgctataaagggcacacctgctgtgggtctcacagccccaggtgctgctgcagacaggctgcggtgctcgggagtgatcctcaggagaggacaggggcctcaggttctgaaggttctagatttgcaggttacaacatgcctagctggtccttcatacatcaagcaaacaaacttactccttcattaatttgtgtgttccaagcatctgcaaatttctcacaaatgctaattaattccggttatcttcctacacttttggggcggggcgagcggggaatggcagtgctctctgatgactgccatcactgtgttttgtacatgttcatgcctcagtgcacacttaagtcacagccagctaatatctattgattatttccaaggaaccaaaatgcagggcgttcactctggctatgaggacagaagtaagaatgtctcattccaaatacacttagagatgacagtttcaagaacccaatgcaatcattttgtccttttttgttttgttttcaaactacatctgaaccttgggatgaatctcttttggtagatccccaaaggatctgctaggggaattgccaaaatttgggacccaagggaacgaccatgaacaagcccaacctagaagaacagcaagttgagacaccaaggtgcagttcaaactcgcactggaagaacattccagcagcctgagaaatggagagggtgggaagaacatgaaagaaaataaaataatcctttcagctagggagagaaaaggagcccaatttctaattttatacaccaatatggaaaaaccaacttgaaaaagggagtgagcgaagggcaggcaaagataaattgcaggaacgagaagcctcccaggccctcgggcatcccactcagattctgcagaaaatgaccctacaaagaagttctcgcttcccagcttcacagagtcacatgccctggacatccttattcaggtttctaaaatatctgaaatcattttttttttttttttgagacggagtctcactctgttgcccaggctgaagtgcagtggtgcgatcttggctcactgcaacctctgcctcccaggttcaagcgattctcctgcctcagcctcccaagtagctgggattacaggcactcaccaccacgcccagctattttttgtattttcagtagggacggggtttcaccatgttggccaggctggtctgctgacctcaggtgatccaaattttttaaaatttttatttatttattttttctgagacgaagtctcactctgttgcccaggctggagtgcagtggcacgatcttggctcactgcaacatctgtctcccgggttctcccattcttctgagtaggtgggactacagtcatgtgctaccatgtctggctaatttttgttttgttttgtttttgagacggggttttgctcttgttgtccaggcttgagttcaatggcgcgatctcagttcactgcaacctctgcctccccggttcgagtgattctcctgcctcagcctcccatgtagctaggattataggtgcgcaccaccatgcccagctaatttttgtatttttagtagagacagggtttcaccatgttagccaggctggtctggaactcctcacctcaggtgatccgcccaccttggcctcccaaagtgctgggattacaggtgtgagccaccgtgcccggccaattcacagctaaatttaacataaaatacccccaatatctttctagacacgccaggtgttgggatcgtgtttgtggaccaggaggacagaatggacatcactcttgcatctgttgagaacagagcaagggggttagtacagatgaccgttcatcttcatttaacaccagggctctcagattcaaagacctaaaacaggatgtgactgaaaccagagcagtagattccccacccccgtgccacgcaaaccggcacactcgttgtgatgaaagagataaaaatcagtctttgggcttgaaggggaagaaatcctgtcatctctgctcttagctgagatacagctcagtgactgggtcaaactctggccccaggctgcctatggcctagaaagtatagaaggaacaagaaggaaaatgctcctctgtgacagtcagcagcagataaattatcctgactttatttctcactcgtcacacctttgcctttccatgcatagccaagtccgcggttgtgcttttccagtgtttacaggacaggtcaatataacctgcacaggtagctttgcaagccatgaactacccagaactcagctgaaccaggacaaaaaaggcagtggcgaagatcagcactcaatttcccttctctgctccattcagcagtagttaacacaacagatgcaaggtaagtacatctaagcacagttgatctggatgtgttgatctctgacgttcaatacatattatttgccacttcttggatgaaactacaaatcccatagcaagaagaaagaaacaaaggtggatttccagccctacctacctgtcccatttatttacagcgagtatagtgggtcgaatagagtccctgtccacctagaatgtcagaatgcaaccttctttggaaatagggatagatatatatcacagatgaaattgtaataatataatcattgtaattatataataattgcacatcataattatatataattatgctatataattatatataattatgttatataattatatataattatattaacgattattatataatgtattaatatattctatatttatatattatatgcttatatatttatatataatatgctaatataatatattatgccattatatattatatattaatataatatattatatattaatataatatattatatatcatatagctatatattatattaatatattatatatcattatatgataattatattataataattacaatatcatcattataattatataataattacacataattatatactattacacacgaaagttacaatgaactcacaatgatttagtgtaggtcctaaatccaatgactggtgttcttataagaaagccatgttaatgacacagagacacacacagggcagaagccatgtgacttcaggcagagattggagtgatacagccataagccacagaatgccaagtgctgctttcacaccagaaaccagaaggaggcatgaagccattcttccctcagaggcttcagagaaatcaatcttgccaataccttaatttcagacttctggcctcctaaacggcgagaggataaatttctgttattttaagccacccagtgtgtaacagtttattacagtagctctaagaaattagcactgtgagcaaatcatctaggttgcaaagactttccaggggtagaaaaaggatgaagagttggggttccccaagtagcccaaatgcattataggccatttaagggctaaaatgaaacaggcaggatgtagcggggaagcgctctctaaagaaggggagggaggctggatctcaaatccctaggttctcaactttcgcagattcttctatgaacggaagcaacagaacaactggtttgaaagagctctgcaggctcaggcaatagccaatgtcagctttgaccagtgtggaccaaagtacagaggggtcttcccccatgctctgctccaggaagaacccccccaggatccccacaccatcctagaagatggagaaggacgaccacatgattagaatggaatttcccaccagccccagggtaatgggctcaatcagtttaaaatccaaaaatgagtgacttgagaggctgagacaggaggatcgcttgagcccaggagctcaagaacagccggggcaacacagcaagacccctgactctgaaaaataaataagtaaataaattagtcaggtgtggtggcatgcacctgtactcccctagcgacctggggggctgaggtgagagggtggcttgagcccaggatttcgatgctacagtgacctatgattgcgccactggactccagcctgggtgatagagcaagaccttgtctctaaaaattaaaaaaagaaaaaaaaagttcaagaatatgacctttctggtacacttaagttaatggaataaaatgcatattccctggaagggttttcaatgagaaaatgttcaaatactttccacaaatgaatcctttgggcatatctttctccttcaaaaactagagaagccccaaagggcatttaagacagacagaccagccctccttcactgacttacctttcttggaagctaaaccggtttccttcacactattcacgtacagccttcgaataccatcttcttccacagaagaaagtgaaaaccctgtgaaacacaaaaagacagaatggcagggctcacaccttctgaatgtttagcaaacaacaggaagtgcctgctgtgaactaggtatgtttcatgtttgtcattatagtttggactgattgttttttcttgttttacatagcagaaaagtgtatttttagatcactctggaagtcactacttgtaaaaataaagattactatgtacgtctatcttcatattacctaccaatcaactcaaaggaaagcaaattattttgtttaatcttgcttcctggtaaacgccatcattttttcttttccatactctcctccaaagcagaaaacagaaagattagcttacctcaaagtccccagacgtttttcatcaaatctatgtcctagaatatgttaacaactgtactgttggagggtgtgtgttcatccatatgtatgactatatggacactgctttaatacaattctgcaaacaggagcaagatgcaactcacattacgaatctgtaatgtgaattacacattacagaaactgtacctgatttcacactctagcagtatctgatcataagattatcttatacttctctgggctcccagagctcaaagccaacttgctaattaaccctgggctctgctacatacttcagagaggaaagcagagtgaggccgaggtattctacgtggcttgaggatcctaggtactcaaaactctatggttacaagtcctggtcactcctgtttccagaccgcctcatgtaaaactctttcctaatcaattactttgaatgtccacagtgaatacctactttgctaagggaaagaaatacctttgcagatatttctaaaaagggcaaggggaacacatgtcattgtatatatctgcaataatttcagctctgggaaaaaaatcatcccataatatagatacccatcgtaatgctgaggggagagcagtggttgaaaaaaaaacaagcaggcaaatagcaaaacagaattttgtaagattgggttccagggagtcattgagcctttttaggccatgtcatgatgaacacatggttttttgtttagtttacaggaccaggaaatggataacctcacataggcaaaaaggctaattgccatcgccctctcaagtaccgtaacaccctcagatagggaacagcagagggccacccgtgaggactttccaaagtcttcatttcattctcttattttaaattctcttctttcagcaacttctaactttcagattaagtgtcaagaagccctgctgaaatcaaaatatttttacacaagaaccatttaagttacattagccttaacacaggtgtatttatctgcattttagtggaaattaaaaaaaaatctattaggcgagatagaatcaagggctacgtcataggaaagaatgaataggattcatctaactattggaatttcctttttgaaatgccatcattctactacattctgagaccaatttttttgtttgtttgttattaaagagacagggtcttgctctgtcccccaggctggaatgcagtggtgtgatcatagctcattgtagcttcaaactcctggattcagacaattccctacctcatctaccagaagacctgggactacatgtgagtgctaccatgcttgactgattttttaattttttttagagatggggtcttactatgttgcccaggctggtctcaaactcctggcctcatgcgatcctcccacctcagcctctcacagtgttgggattacaggctttcactactgagcctggccccagttttttttctattaaaaaattagcacccctgtggggtaccaggaaacacctttgcttaactggaagatggcaggagaggcaacatggtgacagcctgctgcaagtcacctgaagccaattagatggagacatggagacacctcaggtatgatttgctccattccctcttttttttttttttttttttttttttttgagatggagtctcattctgttgtctaggctggagtggagtggtgcgatctcagctcactacaacctctgcctcccaggttaaagcgattctcctacctcagcctccctagtagctgggattacaggcacacaccaccacactcagctaatttttctaattttggtagagatggggttccgtcatgctggccagactggtctcaaactcctgacttcaagtgatccacctgcctcggcttcccaaagtgctgggattacaggtgtgagccatcacacccagccattccctcttttcttggtcctctttttgtataatcaaaaggttaaatagaggagacttccagtctgaggactgcaattgattatgtaatttgtaccagacaactgggtaaaaagactaggtctgagaaacagatcagacatctctaattagtggggaaatctctatgataggaaagaggatggaagaaacgataatgggcataagttccttctttgaagatcacccaaatgaaagccaaaaatttacaaaagtgaatagcacattagctctgtactggaattcatattggacaccagtttaggggtcaaacaggagcccctttcactgttccaggtaggcagccctccccacaccttgccttgcaacaaacatgtgagcggcttccatttaaagatgccaatactttgcacactgggggaaaaccttataaccatcttctacatgaacaaatataaagaaaattatgaaatatcctacagctggattatgtggaactgaatgaagaacataatgattttaacagttaatcagcaaagtcagatctatttcttttaaataggacagcaatgttctaactctcagcagacaactctaatatcgtccaaaatgattgccaacagggggcagagggaaattattcaatataaacctatgtatccaccaactggaaggctgttagcttcaaatacaggaagggatcatgagtggcaactggaataatgatcaggagaacgaaggaagtgcttaaaattaagtgatgaaactaaggtcgggcgtggtggctcatgcctataatcccagcactcttggaaggctgaggcgggaggaaagcatgagcccaggagtttgagaccagccctggcaacacagtgagaccctgtctctacaaaattttttttaaaaaattagctgggcatggtggcacgtgccttgtagtcccagctacttgggaggctgaggtgggaaggatggcttgagtctaggaggttgaggctgcagggagtcatgatcccaccactgcattccagcctgggcgacagagtaagaccctgtctcaaaaaagaaactaagaacaaactcatgagatgaaccaccaaaagattcctcaacctagaaaaaccataacatgataaacaatagagaattactcaaaactagagtccaggatacaatgaaaattcagataacaagcacaggcacctataacatgaggagaacacacgactaaaaaatataatagtactagaagtacccagagaaaaggaacattaagttgctgaaatgacgcatccttctacttcaaggcagccgagggtctcatgcttagtctaagtatcatgtaactggatatgtgaactaatttcaacagtaaagtgtgggagtgagctgagggctgagatggagagagaggcaagagagagaaattaagtaaatgttcccgctttaagtgtgttcagtcagttggattattaaattatattctcctccctaaagtgttctaaaatagaaagcagcatatgatctgtattgtgaggtgtttctgtgtttgtgccggcagcttttacttgtactgaactcagtatctaaccagaagccacttagctaggtgttaatattagatacagatgggctgaatttcgactctgcggtagcttttaatccagaggcaatcagatctctgaggactgggggaatgtttcacctcttcaatcaatacgctgctggaacatcaaatgccaaaaccaacccgagcacggagaagaaatgatttaactgagcttattagccatgagtggcaggcttttcttttcttttttttttctttgagacagagtctcactctgtcaccaggcgggagtgcagtggcacaatctcagctcactgcaacctctgcctcccaggttcaagtgattctcctgcctcccgagtacctgggactacaggtgtgtgtcaccaagcccgtctaatttttttatctttagtagagatggggtttcaccatgttggccaggatggtctcaatctcttgacctcatgatctgcccacctcggcctcccaaaatgctgggattacaggtgtgaccctctgtgtccagcctgtggcagggcttttcaaagtgaagtcagggaacaggtgccaactgtttgctaatggcagtaatgtcaggacagaaatcaagactaagcattgagaacctcttgtagctttgacattgccacaacctccaagcatgggattttgtatttcacaaaagcagcagtggtcacaaaagagtggaaattaaaacaaaacaaaatacctgcttctttacatcggatgagttgggaagcactgtttgtaacactctcaagactgacgcctggtgccctgtcataccctcctcagggggtaaaagtaaatgggttctgtgagtaattcagtgactttaacaaaaagtattaaaatgtatacaaacggtagcagtttcatgcccagttccaatttctgagtccctgaatcactcaatcttagaagcagagtccaagagctttgaaattcagccttctgaacttgatctttgctagtttatccttactcaacaaaaattaagtaaactgaagagaaaaagaataatcattatggagcatctaattttggaggatccaggcacttcactgctaccaattacagctctaattactgaggtcggctttttgctgcataataagccgctcataaacatttattccttgccatgagaaacattctcctggctttattatgtctttagttttaaggtcaagaaataaacagcataaagttataacgcaagtggccagggttcaaaactggattctcttcattaggcccaaatcctctattgagtattccgagatgaagactggtggcctacaggggaaggtgcagaaggaatgtaatatcccagtgctcagaaaagagttttaaagattttcaaatgctaaaaagcttaataacctgggccaggcacagtggctcatgcctgtaatcccagcactttgggaggccgaggtgggtggatcagttgaggtcaggagttcaagaccaccctggccaacacggtgaaacccgtctcttctaaaagtacaaaaattagccaggcatggtggcacacgcctgtaatcccagctacttgggaagcaggagaatcacttgaacctgggaggcagaggttggagtgagctgagatcgcgccactgcacttcagcctgggcgacagagggaaactgtgtcttaaaaaaaaaaaagacagcttaataacttgattcagagagaaatcttaagcgagcatatgaggtagtctttatgtctttccaccgggaactttgttctccttctaccaaacagtagaatcacacttcagtgctccctcgtaggtaggtatggctgtgtgacttgctttggccaatgaattgggagtgggacaacacctgctttcccatctccccttccccctctgcagagtgacaagcactgtcccaggtggcagctgctccagacctgggtgtggaatgaggacaacgtatggagtcccagccaacccacaagggacgcgtggtgaatgtgagaaataaatgtcactgtttcgagccaccgggctttggtggctgtctgttacctcagctaacctcgccactcctgactgatacagcacagcatggattttcctcacttaatttactcaggcaccaactctgttactattcaagccatacagtgtaatgctaagtaaagaagactggtcttaaacatatggaaaggaatatatatttaactccgccagaatgtagacaaccgcataggaaagcgttaacacagcaggcatgactgctattcttcgaaaggcccgcttacaaatttgaaccttggctggtatcctgagaacttggattttgggagggttcccaacaccctgagtggctcacagtgcctaaactgtggtacaaacaatgggatttatggtgaacgcctactttcctcctgggagtctggaattttggtgcatgctaggcagagggtgcctagggaaccagcctccccagaaaagccctgggcactgactctctaaccaccttccctaggagagagcatttctcaggtgtcctcacaacttggtgctgcaggagttatcctcattctacgtgactccactgaaacagggcccgctgaagctcacacctggtttcccctagacttcactccatgcgccttttccctttgctgattttgctttgtgttgatacaggagttaagatgaaatgatttaggcagagagcgaggagaagaaaatcctcagtaacattttccttttaatgaaaagcaacccccaaataatttttttttgtaacaaaaagcagcctgtaaaatcaagctgcacacacagacaagcaagctggaagcttacaccggtgagtgccggcagtgtgaatcgggaaaagctagctgggactaagcatgttcaaaatggcggctccatcctctcttctctttgtcagccatgcgtacagtaagaagcagtgaacatggcccccgccaggcaaagactccatttgcataataaagattaggatagggcagccagcttccatgcgtgctgtgtagacctcacacctggtccaaacaatctgtgggccttatgtaaatcagacaccgcctcctcaagcctggctatacaaatccagtgcattccgccgctggccggaagacccactcgggcacccctctctctctgcaggagagagagctattctcctttctctttttttttgcctgttaaacctctactcctaaacccacttcttgtgtgtccgcatcctcgattcccttggcatgagacaacgaaccgtgggtatttacccaagacaacgaagccgcttcagtataatttgctattaaaaaaatcatagttgtgagtatgaccagaggctgagctctgtgggtcttcctagtgaatcagcaaacctagggatggtcttggggacccccctacacaccaccaaaatagttcctttaacattatttgtatgggaagggaggataatgtaggataatggcttacttattttgagatttctcaaaatttatagttttcgggagggggtgtaaaagaataattcctacattactaaggtacatcatagtatatgttaaacaaaaattatgggaggtcattgttgtgaactgagttcctgcattatgcccgaaaggccagatcaaataaaaatggaatcactcatgctggatgccacataatcaaactaaaactttcaggaagcaagtagatccccaaacagaccagtttttcctgaaaacatgagattccggtctacctgagtcaacaaaataagtaggtcccctctgctttaacccttacaaaaaagtaacctgaagtaagctaagttaaacaatcagttttcttcttccactgttctgtttccttgtcgccaacttacaaacatcactgttctgccactgcccagagggagctctcattctattttgtagaatggaggctatcccatgcatgaatcacaaataaaagccagtcagatttataactaaacttgttgtaattttatcttttgacatataaaataagctacccacttcctttttaggacagtagaatcccagtaattaaagttatgaaatttaacaccaaagtctacatcgtacccagagtaaatatccctgttattccctagtgtggctgccctccacagagcaggagccagatatactatctgttttagataggactcaaaggcattttgttgaactgtaaataaatgcatgcttacataagaaatactttaccttaaaacacaaacaaagaaaaataaacttaccgtaagtatcagcagctgtatctgacttctcaatgtggatgctctgagtgacttttggacagatttcaatttctttgtacagctgaaagttacaaaggggaatctaattagaatttcattataactaacttttaaaaatggtcatcatttcataaatctattttttcacaattgatacttacgtgaatttgcacttcacaatcttatcattaaacgaaactcattaaaagtaaaaagtaaaagtaaaaacttccagctgtcgtcctcaaacatagccacagtttggtttctaagtaattcctccacatcactctgtctgtctattcctacccaatgtctatcacagacctgaaaaataatgctaaagtaatggagatctctagttgtggggagaaaaagtttattaaaatcaagaagaggttataaagatcttggtatggaattcatggaaataagataaatctctatgcttccattcaaaaagttcatcatagtacaaataagtagagacaaatgatagcattgaaacagaaaacaaattacgtaaaggaggatattcttttttttagccactgaactgtatcgaaattagctagaaaactgaagtacacaaattaatcagccttctaaaagcccaagaaaggaaataacttatgactaagtcctcaaaagcaactgcaacaaaaatgaaaatggaaaagtgggacctaattaaactaaagagcttctgcacagaaaaagaaactgtcaataaacagacaatctacagtatgggagaaaatatttccaaactgtgcatctgacaaagctgtaatatccagaaactataaggaacttaaatcagcaaaaagtgaataatctcatcaaaaaatgggcaaaagacatgaacgggcacttctcaagataagacatatatgtggccaataaatatatgaaaaaatgtacacatcgctaattatcagagaaatgtaaaccaaaaccacaatgagataccatctcacaccaatcagaatggctattactaaaaagtcaaaaaacaacaaatgttggtgaggctgcagagagaagggaatgcttttcttttcttttttcttttttttttttttcacacggagtgttgctctgttgcccaggctggagtgcagtggcgcgatctcggctcactgcagcctccatctcccaggttcaagcaattctcctgcctcagcctcctgagtagctgggattacaggcgtttgctaccacatctggctaattttttttttttttgtatttttagtggagatggggttttgccatgttggacaggctggtctcaaactctgacctcaaatgatccgcccacctcagcctcccaaagtgcaggaattacaggcatgagccaccatgcccggctgagaaggaaacacttatacactgttgttgggaatgtaaattagttcagccactgtggaaagcagtttggagacttctcaaagaacttagaactaccgcttgacgcagcaatcccattacttggtatacatccaaaagaaaataaatcattctaccaaaaagacacgtgcactgtatgttcattgcagcactattcacaatagcaaagatgtggaatcaatctatatgcccatccagggtggattggataaagaaaatgtggtacatgtataccacagaatactatgtagccatgaaaaagaacaaaatcatgttctttacagcaacatggatgcagctggaagccattatcctacgtgaattaacacaggaacagaaaaccaaataccttctcacttacaactaggggctaaacaatgagtactcatggacataaaaatggcaacaatagatactggggactaccagagggggaaggcaggaggaggacaagggttgtgagactaactgctgggcactaggcttactacctaggtgacaggatcaacagtaccctaaacctcagcatcatgcgatatactcaggtaacaaacctgcacatgtgccccttgaatctaaaataagagttaaaattatttaaaaaattttttaaacaaaaaaggctggaaaaagagctttgtacaaagtcaagataagaatgatgcagagttcacacatcataaatgttgtttaaattaatcaatatttcattttcttttttcttttttttttttttgagacggagtctcgctctgtcgcccaggctggagtgcagcggtgtgatctcggctcactgcaagttccgcctcccaggttcacgccattgtcctgcctcagcctaccgagtagctgggactacaggcgcccgccaccgcgcccggctttttttttttttttgtatttttagtagagacagggtttcaccatagtctcgatctcctgacctcgtgatccgcccgcctcagcctcccaaagtgctgggattacaggcgtgagccaccgcgcccagccggatatttcgttttcttatgtcaagatctatcatcaagacaataacttacagagttctgaccatgtgtcacgcctctcacgctaactccatgagacaagcgtgatgtccattttacaaataaaggcaagagcctaaagagaaagtactttcctaaattcagaagaccagttcatacacagctgggattatgaacccaggtctcactggctctagagccgcattctttccactacactacgatgcctcccagatcagccttcactggaacacagggtatgaacgcaaagggaacctaccctcttaggtcagtcaaaggttcaaatccaaaatttataataaaaactcacaaacaaatagatgtgtcaaatgctcatatagatttttaaaattattactctatcttaaaatgaaaaccaattttgagccaaggtcaataacaaaaaacgtggccgttagcactaaagagaagtcttgatgattatctaaacttgcccgtatccctgaccacacagccattcgtccagaaacgattttattcaggcaggtagaaaagagtggccagtttcttctctttatttgcttggggcatttgaaaggtcagcataatacttgtgactcaggagcctgagaaagcgtttgctataatagaatgccaaggagtgtgggggataggaacgtggacaggacagcttggatccttttaaacacctcaatttaatgcaatttccaccaaatgcaacgtgtcaagggcatgactgaatgtggtttcagtgttatactttagaaatgtttcatactgatacatttacaaatgagaagaaatcagttatactactttttcattcagaaaatagccaccaaaactctaaatactaaattcaataaggtttacaatgtataacctaacaccacaaaatgctcaaggaaatgttatcaactacgttcacttcaacttatcaggagccttacttttattttttaaaactttaagagccaaacccttcctccaggtggcagtatataactgtttgttttaatcatttccacaggatctagtgggactagagctttgtgcataatctttcctatattttcataatactacttcctagttttctttgaaattagtgtgaatatcactgtgtcttttgctggtctcagacaacaactcagtatcataagacaggcccgctggccacaacatccttaggctggttggactaaagccaggtttagtgaacaaaactaaaactatatctcaagaagcgtttgtactttaaaatatattttcaatgcaaccacgatatctggaactagaaatctggaaattcagtagttttatacataaatgcacttaatgatgaaatagctcacatcttccctttcttttattaaatcaataatgttgcaactttccctgttttcaaaaactggatgagaagatcaccagattttaagaaaaaaattgcttacctagggctcttgagttctcacaaaatcaggatcatttctttctctgtctcctttgggtggcttggtctgagccaccgtcacgctcttgcctgacgatgactctctacagccttctatgggccctggctgctcatcttctcatgccctatgggcccactcatctgccatagtgagcctttcaaagccgacaatgccctttctctctggggtttcctatggcacttaggctctacatggcctatcctttttccctcccccccaccatctcctgcatcccctctttcgtgccctctccgccaatcctcctcaaacaccaggtaagccacctccaccatggccaccctccccctgcccaggccttagccagctttgttctctcagcctagaacattttttttttttttttgagacagaatctggctttgccacccaggctggagtgcagtggcacgatattggctccctgtaacctccgcctcccgggttcaagcaattctcctgcctcagcttcctgaatagctggaaccataggcgtgtgccaccatgcctggttaatttttgtatttttagtagagatggagtttcagcatgttggccaagctggtctcgaactcctgacctcaggggatccacctgctcagcctcccaaagtgctgggattacaggcgtgagccaccatgcctggccagcctagaacacttgtctgcaaaatacctctatgattccactccctctcttcactcactcaccctgttcgaacatcacattaaaaaaaaaaaaaaacacacaaaaaataaataaaataaaatagcaacaagacccactgcagatgtgccatctccctctctctacttgccccaacttcttgtctctccaggctttgaacattccctgacatattacacattcacatgtatttttacttgtttctgcaaacttgaatacaggttccaccagaagcagaattgttttggtgtatccccagtgcctagaacagctagagtagtgccaggcatacaaatgctaaataaatatttgctagatgatagctgggtgtggtggtgggcaactctattcccagctacttgggaggctgaggcaggagaattgcttgaaccaaggaggcagaggttgcagtgagccaagatcgcgccactgcactccagactgggcaacagaacaaaacttcatcacagaaaaaaaaaaaagtgatatctttatatttacaaaccttaaactgaaaatcagcatttccttttatcctaaatgaatgtaggcaacaaacatagtaatagtagcagtgcctgtgactccgtcacgaatggaaatcacagttattttcatatcatgttttagctgctgctagtgtctcaaaatattatttatgctcatcgttacctcagaacagtggtagctattagatctactgctaggtcttgtaatttaatggtctagctattaggtctatgtctacctattaagccttataatttaataagctaataaataagaacatatattaccaataattcaaaaaatatttttgagaactatttcaatatatttagggcacaggtaagcctatgtattctattttacgcgattgaaaatatcattctgagaaggggtctggaggctccaccaggctaccaaaagtatccaaaggacaaaataattaagaaccttggttgaaacagaggttttgcaagactgtggcatttgcatccttacagatctatgggctggagaccttctgcaacaggccaagaaataataccatggtctccctgtacttaagattcttttaaaatacatatatagctatctgcatacaaaaattgtagatccaaacagactaaagagaccacacaatgggcaaggcttaaaaataatgagtccatacaatttcaaaaactatgtctgaagtacctatacctcttatgtgaaaaatatgaggaacatggaacctggttaggcatgatccctataattcaggatgcaaaatactcattaaccccaagatgcaaaatatataatctaataactcttctagtgttagcaggaaagcacttcccttttttaagtaagaaaaaagggttttctttcctttactcatacagcagcaccaagactggccttttccccaggccagaaaaagaatacatcagccctctctgttaaatgtactgaacacagaacagttactgatttaagtgatagttggaaaagggctcattattttgataatcttctattgcataacgtgctataagtgttacaaaagcacacgctctcttacatttccttaaaagcccttaaaggggcacaaggtaacttttcagataacagaaatgttccaaagcatgatcacagcagtggaaacaagactgtatacatttgtcaaaactcattggattgtgtccttaaagttggcaagagtttccttaaatgtaaagtatacctcaataaagttgactaaaaacacaatttcctactcatttttaaatcatgcttcccttttccaaaaagagaataatacttgggtttaaatgttcagttccgctttctgtggtgaaaccctctctgaagtcactgttattcacacatccatggcaagcagtcagagcccccagaggaatgactaagaacagagagagcacaggaactccaaaatagaggcgccttgctcccaaaatgtttctttcctggaactgacaaacgcaccactttgctaaagagcaaagagcttgtcactgggcttactgcaataacaaccattgtaatttaccaagtaagcatattatctctaatctttgtaaaatcctagaaattaagtattagcatttcatttttttttcttggctagttccatatgattagtaagcaggtctgattcagaaccccagtcccataagtatgttcaaactcaaatatatgtaaatgtccccgagaagctatataaatacagttccaaaagactaggacatagatggcagcttttttcacccaacaagatttgatccagcagtttcaacatggctacggatgtcacacaaaattagaattagcactgttttctgtaacaacaaccagctgatttttaagtcaccaattaaaataaaagactggccgtgcgcagtggctcacgcctgtaattccagcactttgggagactgaggtgggaggatcacttgagcccaggagttcaagaccagcctgggcaacaaagcaggatcctgtctctacaaaaaaaaaaaaaattaaaaaataaaagttcgtcagccatggagctgcgtgcctgtggttccagttactcaggaggctggcacaggaggaccacttaagcccagtagttcaaggttgaggtgagctatgatcacaccactgtactccatccagcctcggtgacagagtgagatcctgtctctaaacaacaaaataaaaatactaaaatacaataaaataaaagattgccaatgcaaggaaagctagtattataataatgactaaagttctatctaagagatagctctagattttgatttgtcatgatagcactgcactgcttcgtgcgtaaacaaaggtgatcattccactctggaatactgagctaagtagggccatctccaccaacttaagggctatgaatgaagctcatttatttttgaactcgttccactccaccaactacaattaacacgagaacactcataatttgaagataatctcccataaagtgtgcttggacaacagtcataacattaccagctcatagatgtcttcctcgggctgtggaacatagagctgcattttgttttctattagaaatttcaggcgcaggtaatgagcagaatgatccagttgatgtgtctgggacaaaaaagaaagaaagaaagaaaatgtctgttcaatagtaaataggcacaattagttctccaccaacatacgatgtattcctatgaccaatagagtttgttgttgttgttgttgttgttttgagatggagtttcactcttgttgcccagcctggagtgcaatggcgcaatctcggctcactgcaaccttcgcctcctgggttcaagtgattctcctgcctcagcttcctgagtagctgggattacaggcgcccaccaccacgcccagctgatttttgtgtttttagtggagatggggtttcactatgttggccaggctggtctcgaactcctgacctcaggtgattcacccgccttggcctcccaaagtgctgggattacaggcgtgggccactgctcccggcccaatagaaatttgatgctgaatgggggtataaagtttctatacttcttaaaaagtttacatcgtaaatgcaaagttttaaaataactttcattgaacacactggtaacattccaagggtatcttaggattcaatggaaacaactgactcacatctccacgcctccttatttgattcattgtgctctctaacactggtaaaattttcaacacaacacagcagatcaaaaaggttcttaaatataacttcatagataggtgattaaagaaaagggtaacaagaaaggtaagaaaatactgtatttacaatgagagaaaaaagctgtgcccaggcaaagttgtttttttaaccacatagggacagtgggacagttgttaacagttcatttgcaagcgagtcagtgtgaagacaaggcttttggacttcaatcttatttatatactccccaagtgagactccctccaggggcagtgctaataggcgtgtgtccaactatggaaacacactgaatgactcgctcaaagaaaacaattctaaaattgaaattttcaaggaccctttagtccaggatggaacaatagattttttcttcctgtctaaaaagtaatctttgaattaattttgaggaataagtaataataccaacatggttttataaatcattctcagtagacagtcaagaggatacagggaaaaaaagaaaatgctctccaaaagttacacagcaacatgaaaatatattgctagagagaaaatgtttaaaccaagtgatttttttaagcatccttatcttttaggggtacatcctaaagcgctaatagatagaaatgatataatgtctggaatttgcttccaaaacaaataagagttgggggtgggagtgagtaaatcgataaaacttaatttgatcattacagatgctaggtgatagatacatgagaatttattacattgttccctacttttatacaaattggacatttttcacaaaataaatataaaacctcttcacattcaaagctctgcaggtgagaattatttcaaaataaataaagttaattttaactggttcagtactctttctacttaccccaccctcaaaataatatttttaaagccaaactaacagcattccaataaccattccagtaatatatattcagttacacttaacgaactcttagatacgccagacaccatgtgcagtagtgagaatacagaaactaatacaacataaatgcagtcttcaggagtgtctgcagctgcaggtaaaagctatgtagatgtggaaggtgaggcagcagtggtttagcattttaaataaatatgtacatgcaggacaggcaacctgcattcttgtaaaagcacatttccagaaagtggaaatgagttcactctgaacacatagcagaaggataaagttttctatcagtgattcttgggaaccccaacctttctcctctcctgagtaatatgatagtttgcagcctgctgtgccagacacagatgccattcaccgaacatgtcccagtgcacctggcttttgtcctttcactgcctatatttgagaccagatgctcaatgtctgacagatccaagattgttgatgtcaaagataataaggctggaggcgaaagcccagggaacataaaacaggaactttttaagtgtgctacttactgctggagaatcatcaagataaataaacaacaacaaaatactaatatttagggtgatgtgatgagcaagaaaagttttcctaagagagatcgaagctgcaaatgtttcccacctacctgggtcctcactgaaatctttaattagaagcaaaaattttggttcaccatctgtttccgactgaggcggaagggaaagaaatgaaatttcatgggttcttagtaacaggaacaaattcacttggaaaccttatcatcatcattaataaacactttgtgggcactccttaatgagactgccactgaaacagactgtcttccagaaatcaggccaaaacagcaacctcacccaagaagttctggttcctgaaacttcagtgtgagagacagcccactgtcaggcacaaatagcctaaggtggtcctggtgtggactgcggagaactgcagcatcccctaaatgctacagtactgaaaacatttatacaaacatgcagagaatgtcaaggcacctcacttgaattgtgtaatgcattgcagagaactaaagaatgataaatatagcaatggtaataagaatgattcttggctgggcatggtggctcatgcctgtaatcccatcactttgggaggccaaggtgggctagttgcttaagcccaggagtttgaccagcctgggtaacatggtgaaaccctgtctgtatcaaaaatacaaaacttagccacgcatggtggggtgagcctgtagtccctgtaggctactcaggaagttgaggcgggaggattgcttgagcctgggagggcaaggctgcagtgagctatgactacaccactgtacttcagccgggggacagagtgagaccctgtctcaaaaaaaattaataaataagtaaaaggaaaaaaagattattgccacaaaccatcatatttttcaaacttctttaagttacaataatgtcttgataactttaaaaaataaaaatcagcacaagcagcaaacatgaaaattataatggtcttacttgtaacttaagagccctaattttggtcagtaaatagttactctcaaaacaggacattggatcaaaatatataccagtgtgtcttactattttggtaaaagtttctgaattatgagcccttgttaatcacggctggtctaacataaaaataaaatcctaatgaattaattaaatcagatcatcagaacgatcaagaagaattttatgctccttagatacctgttagtcaatatcaaagcaagtcaaacaactaaccatgttcagaatacatctttgtgcaaaggaatttcaaatgttaatgaatatttaaacatagtaattctaaatgtgtggccttgctttagacataaaacattcaagtgaaaactcaaaagaaaattgagactcgtaaaacattcaaggaaaattcagttaggaaaaaatttaaatggtataaatttgttttccaatgtacatgtacttaagttacttagcatttgatgcattttgaggcaatgcagccgcaaattataccctaagtattatggtacaacaatttttagtttagttggcataattttttaaattcgcatcttactatgactatttcaaaggatgaaacagcaaaacacaatgtagatattttcagtaaatagtttgcaccaattaaaatagataacatgtctcagaatttactgccttagagctcctaatccattatgttttgctatttttcttcatattcttccatttcagtcaaacttctagaagacatacaaacatgcaattactgcatacacaaatgcaaacatgtagtcactgcatacagaaatatgtatacacacacacacacacaaagtgctattgtagaatttctaaagatattttccctccccttcaaagtaaccttttctttctctaaacgccaatggttatagcatatccaaagccacagaatgacgtagtaaaagcatgaaataaaactgacacatggtcacatgtgaataatatcagtaggtataaatgaatgaaaatatgttgcaattatttttgtagttgtaacgatcagaatatatccaaaacctacagggcaacatggttacctgctatatttagcaacaatcattccagtaacatctgtgacatgaattgtatatgaaatgaagatcttgaaacatttactataccagaacttgactggtgctcagatggcagatggcaaactgatgtgaaatgatgtggatcagatagaataggaaagagaatgagctgaatgcaagagacagaagaaacagattgattattaaatattagagaaagcatctatcaccaaacattgagaataacaataatgaaacaaaagacaggcatttttacaatcatgtttgttttcaatgaggaaaaaaaaaccattcgccattatatcagattgttaataacatgggacactgttttccccattatctccttccctcttaagaataaaatcagatccactaattacaataaggtgttttccaaggaagaaacaagctttagaaggcacctggccctgagcatactatatcacttttcctacatgggtgcttttccaaagaccatcaatttctgaaatgcacacacaagtcttccagttttaaactcatgagattttttatgtgtgtgtatttttagtacagatggggttttgccatgttggccaggctgctctcgaactcctggcctcaagtgatctgccctcctcagcctcccaaagtactgggattacaggtgtgagccaccgtgcccggcataaactcatgagatagaagcttgttccacatcacgttgtttttgcttttatttctatgtcttgggaaaaagacctgaaggcccagggaaaattggacaggactaacttttactgttggagaaagggattttgtaccttaatgatgccatcagaaacctttcaggtgacagaaataaacactttaaaggggatcaggtccactacattatctagatatggtctctaactgtcaatgacaatactattcttcattcccctagtttcttccaaagcaaaagcttgaaacatacgtaaagtgggccaatcattcattgcttcactcactgatcaatcttccaccaatcaatggtaatcggaaaactttggcttaaccttcgattcctgatccagtttaaagccaatgtgcacaggatgctccaaagccatgttattcttctggaaacaccttccagagttcggcttatacaaaaaagccagaaagttctacttttaacaccttcatctgcagatctgacaataactcttcagctctgcagaatgttaatgggtctctaaagaattgtgctaattataaataaaggaatgcagaaatcctctacagaccaattttgttaagtaattaacatgaaaaaattgtgaactgagataccattatctccaaaagctagaaccctcgtacatgaaggattcaaagcacacagagaggtgataccatttatttttagcatccatgtcagggctgactttagttatggcccaaaacaagtgattcttctatttttcctccacatacataagacattttaagaggctaatttgagctgaactgtccatttctctgattcatatgaagagccatgttttttctttaaaaagccgtctgtgatttgcttttttgaaaatacaaaaattgctgatagtagaactacaaaattgaggtacttgcggaggtagtgaaagtcattcagtatttacaaacattgtgttgaatgatgagatctttaaaacgtcatttcatccatccaacttcttctaggataaaattgtgatagaaaagtttttcatttttttttttagcagccccaaagaagaccaattcactcccctaagaatatattctagattcttctgagccttactgattgtccttcctgaagactaacccaggttctgagagttcttgtggacactcggcactgcaggatgcacccagctgtagagaagccagacgtgggttcagtctctcctttgcaactgactgtgatgtgagttcaggcaagcagctaaggccctctgagcttcacttcctccatgtgtacaatggcaaagtctcagctctttctcaggctcagacctgatacgactacgacatagaactattaatgctattcattatgtaaaaataaaaacaagcatgcaagtaaagttcttctttcctctctctcccctcactcaagaccattcacctggctgcccttcacggggaaaaatgaaaccaggttcactttgaaaaagatcaaggcatttcttccatggtttaaggtgaaagagaaaaggagctcaatcatttgtcatgtttctaaaaaggctaattctgtgttcacaaaagaagaatttcccatcaatggaggtcaaacttatatttccttccattttccccaattctaaagatgcccatagtgtatcggttactgattaaagagcaggtgacagaacagtacccataatatgatgccattgaacacatgtatctgtatgtgtgcggaaaaaggaatgaatggtcaaacgccaaaatgtttgcaatggttatttctggatttcgtgaataagagtggccttaattttctgttgtgttcttcacctagattttctaaaaggtttgcaatgagcatgtgatacatgcattagaaatctatcaaacacacacattgaaagatgctacttagaagagttcctctcttcccaaaggtgaagcattcactaatataattttgaatactatcacaaaggaatgcaatgctgctccgaaatgaaagggaggtgtgttttaagcaccttcctctcccacacggctctgggtttccacatgtgccttagaagattgctacaccccattctgctcttcttggagaaacaacccaaagcagctccataccttgcaaatcagctccagggtgtcccgtgcagtgtcgcctggccggacgaccgtcagggcaggctgattattgggcagacagaaccaggatggagtgaaatactcgtggacccaaatgtcgcagtcagggttgtgctggtgaacgttaggtaagaccacttctttctccctctataacaagaaataaagttagcagggcagcagcagtggagctctgacaaccctagattcccagactgcacacaggaatcaccgattcccatgaaaacagcccagggcagaagcggaggcagtggtgggaggcaggggaacccttggagagagagaaactactgagaaagcagatttatggtgcaatggagagatttcaaacttcagctgtgaggcaggcttcacaacccacagcatccataggtgatcacggcatgaatgagtgggcatcaaaatttggaagaaaagaaagaaagagagagagatagggaaggaaggaaaagaaagaaagaaagaaagaaagaaagaaagaaagaaagaaagaaagaaagaaagaaagagagaaagaaggaaggaagggagaaagaaagaaagaaagaaagaaagaaagaaagaaagaaagaaagaaagaaaaagaaagaaagaaagaaaaagaaagaaagaaagaaagagaaagaaagagaaagaaagaaagagaaagaaggaaggaagggagaaagaaagaaagaaagaaagaaagaaagaaagaaagaaagaaagaaagaaagaaagaaagaaaggtcaccattcagctcagctttatggctcttatttcttccacaaactcatttcaagtttcaagcagggaattcctacaacaagcacatctgccatgagaactttacagttcaaagcaatggtgaagccccaatcatttttttttttcaaaaagatcatgttttagcactacatatttatatttatatttatagacagcatcatttttgtgctctccttggaccttcagcacgacccggcgccagagacaattcagttttctggaggtcaaagaacttgacggataacatcatggcacaatgtagcaaaaacaagcctcctttgctgccatcactgtatcctctccatcactgcctgaggaccagggagtggaatgaagtttgtgaatgtgggagaagggtcggaagtcctcctttagcagctgggttaaacctaagcaagctaagcagatgaagcagaggatgttccttagcttgatataatgttactttccttagattgatacaatgttaggagccccgcgaaataagcaaggaaagaatgatgttagatttcagcaatgtaaacataatattgatgctcaatatatgctaagtaataggccttcattattgatttataaccaggccactagttggtaaatatgtatctactgatgaccaagaacaaggctggtatcagcaaattacaagaaggaacaaatttcccaatgaaggctgagaggtggtaatataacctccattcaaaagaagaatggaatccaagaatgggggaaacgttttcgtaaaagccattcaactaaatccaactggggaagataatttcagcctcgcctttgaacagagttgctttagcagataagctggactccagggaaggaattgtcaaaaagcaatcaacatacctaaatcccattaagtataattggaatattcagactctgttccagtgtgccacattaaataaatgccccttagcactggatcaacccaagttttgcatctaaacactctgagaacaaggcattctagccaggatgtgggagaaagacgtaccttagaaaaatggaaaaccaaaaatgctacacagaaatccaatggaaaaactttcgcagtttccaagttctgtggtctagagaagatatctcagtattaaatgtggactaataatggtatgcaagatgaactggccaacctcagaaatgaccaagttaacatcaaaaactatgcttggattgcacataggcccaaaaactgaatttcttcaaatttcatcagacagagatgctcagacagtggccatggatgagtatttccaaggacagtggcctttatatccaggatagcatcattcatgagtagtttgtgtatgaaggaaagaaaaggccttcccatggccactcttctctcttcccctccaatagcagaactccccatggcactctggattctgaagctcagctccatctacaacatggggctgagccactgatgactgacactacttggatgcatggcaactgagggctgaattctgtcatattgattctgagcccaagaaccagaggatcccaccaaggtcacattatcaacatcagaccatcccccatcccccacacaaacaggctcccagtatcactactagggtcttgaaaacgagagacgtctatttatttagaggctgaaaaaagtggccaattaaaaaacaaatcagtatttttatgggctttcaatcagagcagtttgaaagcccctgtttaaatccaagcacaaggctgaaccaagcctgtgaatcttttttttttttttttttttttttgagagagagtcttgctcggttgcacaggctggagtgcagtggctccatctctgctcactgcaagctccgcatcctgggttcacgccattctgctgcctcagcctcccaagtagctgggactacaggtgtccagctaattttttttttttttgtatttttagtagagacggggtttcatcgtgttagccagcatggtctccatctcctgacctcgtgatccacccgccttggcctcccaaagtgctgggattacaggcgtgagccaccacacccggccgaatctttaattgaatacttgacttgggaggcaaatgcgtttttgttgtttttctttttttaaagaacacgctatcagaacagttctttgaaactaatgggagcaaaacagcatgtgtgggcagagagggagggtagtaagaacacacctcttgggaagagaagttgtacatggaaagaaattggcaatggcataaaatattcagctattcagaacccaaatttcctcttacattctagttagaaactcacacatcaaatggtaagtatgggaaatgttatgtcagcaggagaatgttccctctaccactcagttttaaatataaaatgattttccatctcttgttgacttattacataacttttaaaaactgatttcagtttttaatattgagtttacttaattttagtagctcaagacaacactgcaccatgtatatgttgatgcacttgtggtacttttagaaaagaaaacacacgtttatttttaccttgccatctggaacaatgtcatcaaatattccctctaaagatttctttacagcttcggttccctctccaaacacctgcatatacaaaagtaccaccttaaaaaggaatctgggcaacagggcaaacgaaacgtaggaagggggaaggaaatgggcatggctatgacaaaaccttacacacgtgttcagatactcctacatcaaatcccaaagcaggtacaataatttatgggagcagacctggaaaaacacatccctctatctagatcacttccctacgtgtttgacagttggaaaaaaaaaagtttgctctcaaatatggataattcatctctacttaaagaaaataggctgggcatggtggctcatgcctataatccctagcactttgggaagctgaggcgggaggactgcttgagcctaggagtttgagaccagcctgggcaatatagttagacctcatctctacaaaaaaaaaaaaaaaaaaagaattacattaaattagccaggcatggtggggtgcacctgtagtcccagctactcctgaggctaaggcaggaggatcacaagatcacatcactgaactacaatctgggcaacagagggagaccttgtcccaaaaaaagtaaaaagagaaagacaataggttaggcgtggtggctcatatctgcaatcctagtactttgggaggctgaggcaggaggattgctccagcccaggagtttgagaccagtttgctcaacagagtgagaccctgtctctataaaaaatttgaaaattagccatgcatagtggcatgctcctgtagtcccagctacttgggaagctgagatgggaggatcacttgtgccctggaggtcaagtttgcagcgagctgagaccacactactgtactccagcctgggcaacagactgagaccttgtctcaaaaaaaacaaaaaaataaaaaaccagaaagaaaaagaaaaagaaaaatataaataaaagaaaagaaactagcaaaagcaatgagctagataaactcacaatgaagcatttctcctatagcctcatatacctgaccagatacttataagtaaaaatctgcttgctttgtaatacattcttaagtagaatgtgagaatattatagttttttacctcaacatggcaacataggggtttttttaattaaaaaatagaaaattgtctcttccttgaaatgtaatcaatcctgctaacttaaagatgccatgaaaattagaatagggtaacaatgccactaggtaaggaaactcatggacatgaggaattttgtgattatccctaaaacaagaatgtagtatcaggataatgtacacaattgagaaaaagcctttcctccatgcaaataaaatatacaaaaacatacaatgtttttaactttttttcggtagagaaagcatgttgctatgttgcccaggctggtctcaaactcctggcctcaaagaatcctcccaccttggcctcctaaagtgctaggattacaggcatgagccaccaccccggccaaaaaaacataatttttgtccatttcaaattatagaattaatgactaaattcctactggtatgtttatggctaagcaaaaggttcttaaaaactcatacttttagaaaaaatacaagaattgtttctaagacattacattgtgctttgattttagaaaaatgttaaaacattctcttgaattcatttaaattcagtcatatatttcagtagaaaagggcggtaacataacctggtgccaatcaagcagaagcacatgaacaaagggttttgttagaaaacaagtccaaactgtgaagtccagaagcagtgggctgagccatctctcagggcagaagacacatacacaatgacaccaccacctcccaaaagaagaagagaaatgggccaggcgcagtggctcatgcctataatcccagcactttgggaggccaaagcaggcagatcacagggtcaggagttcgagaccatcctgaccaacacaaaagttagctgggtgtggtggcaggcgcctgtaatcccagctactcaggaggttgaggcaagagaatcacttgaacccaggaggcggagattgcaatgagctgagatcgcgccattgcactccagcctggggcaacagagtgagactctgtctcaaaaaagaaaaaaaaaaaaaaaaaaaaagaagagaaatgctgatggttcatgtcctcctttttgcaggttttaactgagaaccatcaagtctcttttgttatttttctgatgaaatgttgactttcctccacagttttttctttagatttacataaaagtaaaacccatggaagcaagctcaatgatctactctccccaaagatcacaagacaaactgcgaaactgcttcagtctcacactcgcttagcatttgctcatctgctctccgcaggttccatcaaggatagggaaatgccacattaaaacagagagtatcagccaggcacggtggcccacgtctataatcccagcactttgggaggccgaagtgggcagatcacttgaggtcaggagttcgagaccagcctggccaacatggtgaaaccccatctctactaaaaatataaaaataataagctattagctgcacgtggtggtgagtgcctgtaatcccagttactcaggaggctgaggcaggagaatcacttgaactgggaggcagagggtgcggttagccgagattgcaccactgcactccatcctgggtgacagagcgagactccatcacaaacaaaacaaaacaaaaccaaaaaaccaatgagtatcacagtcagctaagggactcagggcatcagctttcaggactaatctcttttctaaaattcatttcttaagtaaattaatggctggaactgtccgagcaaacaaggagagatcattctatcaagtcagtcgatgacgtcctctcacttttcacaagggcatgcggtgaataggtcaaactagcagtcttagtcatgacctccaaaatgctgaaggcctgactttccagccaccgcagcccacaaactggacattcttcttccgaaagactacagatgctcacgttcctttagtccctgaaatctaaacaagcagttctggagctactcatttctcaaagccgaacgacaaggaagacagtaacaacagacagtgggcttcacggaagtaaccccagcaggagactggccttggcgagtgaagaagtcaaatttaatgggcaagaattgggtggctgtacatggtcagtggacacccgtcacggcaccaggctatgttgcgccctcacgacataccgagatcccgttccagcccctggacctgagcagaagggggctgtggcagtgggcgagctctctcggattcctgtctcctcattccagtaggcagaggatctgcccatttaatgtcagctccaaaaagtcaagggcagagaataatcagaattccctggaggctgcctttcatccagtgccagaggcagcttaaaaagtctctgcatggccaggtgcagtggctcatgcctgtaatctcagcacttggggaggctgaggcgggtggatcatgagggtcaggagttcaagaccagcctggctaatatggtgaaaccccatctctactaaaaacacaaaaattagccaggcatggtggtgggcacctgtagtcccagctactcgggaggctgaggcagaagaatcacttgaatcagggaggtggaggttgcagtcagccaagattgtgccactgcactccagcctggtgacagagcgagactctgtctccaaaaaaaaaaaaagactgcactcaggtacccacttggcttcattgcagagccctgctttttcctgaagactcagggtgaattgtgcgctttgagtaggtctgtaattaatgagggtttggaaaggatgcaggtgggaaactgcagcttggtgatagactaatagcagagttcaatgttatgggtatgcattatctattaaaagtgtctagcacagctagtttctttgtgccaactagttgattttaaataacactcggcctcactgaagaaacacacacaccccaaattgaggtggccacagaagtgatttgtgcgggctcacttttcatctgctctggaacctacctgattgatgcttggccgtccctgcttctttttggaggtagtatccagaccccacagagaagaaaacctgctccttcgcttgctcgcggatctggacatggcctgagtacgtcttctcactccagtttcaccagtgcgtgctgccacctgaggatggcaaggacaagcagccacaagggagatgcatcaggaccacccacttgtgccttgaggtccccgtaagtcccacccttcaaaaaaccctcctccatcatgccagccaaccctgaccccaatgcctaaagtattcaatccatgacccagacatattgggactttgagagcccttcatggattcagaatggaaatgaaaagctggcaaattcaatccttgtttgaaatcatcagcaaaaatacataatataggaataaaatatatgttctgtttccaaaaatgacatgtccttctggtcacaggcttgaactacagcaagggaaatgagccaggctttctctccaaatgctacagagctgtttctgcattctattgaaaaatggtgctaaagcgtcagcaacaatagtggaaaaacaacagattttggttcctgggtttccaggttaaatctaaaattaccaatctctactattttgttttcttaggatatataaaatcacgttttaaaatcagacgagtgatcattggcccccaatatccattctctattccatcttagtcagaaaaatctcaaatgtaggccaggtgcggtggctcatgcctgtaatcccagcactttaggaggcagatgcaggcagatcacctgaggtcaggagttcgagaccagcctggccaacatggtgaaaccctgtcttaactaaaaaatacaaaaatcagctgggcacagtgacaggcacctgtaatcctagctacttgggaagctgagacaggagaattgcttgaacccaggagatggaggttgcagtgagctgagaacacgccactgcactctagcctgggcgacagaacgagactctttctcaaaaaaaaaagcggggggtggggaatctcatatgtaagtgagcatgcagccactgagtccaagatgacttattttccttgcagtagggcatggattgggcttaagtcctggtcaatggcatacaagcaaaaaatatttgcaacttccaggaactgtgctcaatgggagggggctttctgttattctttccgctatcctatctgttttctttttcctgataaaaggaaggtctgtgttgtggtctaggatgtccctacctaagccttttcaaggatggcagaataacaagacaaaagggactgggctcactgaagatgaaggcaccttaccagacttgcatcacttacatgtcctatgtttaggtaaatgggaaagaaaacttgtatttttttgttgaacaaaagctaaactctgtcgaggtattacaatgtgccagcaacccagagaagcatttcctttttttttttttttttttttttttttgacggagtctcgctctgtcacccaggctggagtccagtggagcgattccagagaagcatttcacaagggaacaccctaaatgtaaatctgtcaccaggataattgctcaagtagaatctccacaaggactccagaaagtcctcccaggcaaaacattcaggcttgaactttatcctaccaggtggcaagcaaagtcccaggaatttaagggaacttctgccagaaggtctccatgggccacccacccgctcgcctttcaaaaaagggagtggcaggaggaacagcgagtcagacttgaaatgaaacttctccacccactcttttgttgccagaggtgaatgtcttggaacctacttgtagattcccacacaggcaactcccaatgtgacagatgccaattggcagcaatgcaggggatgaggcactgttggtaacatgaggggcctccccagcagtcagcgtgttggttggaaggcacgcccctctggggcttcagtactgacaatgtaaacaccgcagaagccccacgggtggcagggacccctacgtacattaaaaacaggaatcaaaacggcttctctacaagggtattagagggaaggtttttggacccaaacaaaaataggaagatgagggagctgagaggtcttgcattttgcattttctcagcttagcacgttaaaaaaacaaaacaaaacaaaaaaaaaccccagatcagggcatagaaaaatgtggtatccaagacactggtgagaattttcatgagaaagatcttaatctaagattacaccggaggtgtcacagggaacaaaatcacaagacaaacacaccgtaaaatatgtaaaaattttctcttctctattttcatcactttctcagttaaaggtaaacaaaggttgtaaaaggaataaattataacatgcagacatgcatatgctcacatgactatgtcaacactgaataaatggtgttaaaaatttttaaattctagaggaaaaaaatgtccatttggcctcacagtcatatagtcattttataaataaatccagtcattaacagtgacacatacatagaggcaaccgtataaaatacgtcgacatatattactgtttgctttcttcatacacacagcaatacctgtacttactgtgtctagttaattgtttacttatttcttacccttctctcccacaagaatataagcttcaagaggacaggatctctgcgctgttcactatagtcctaatcacaaggataaaactgacggatgccaggcacttacatacatttgttgcttgaacaaataaatacataaataccacaaagcaaaagcacatcctatataacacggtgacaacaatgggtgcatcacaccaacacggcacatgtatacatatgtaacaaacctgcacgttgtgcacatgtaccctagaacttaaagtataatgtaaaaaaaagaaagaaaaaagaaaactcttcagtttacaatttccagacaaagacagcatgaaagagaaattcatacacccataaatattctcagttatcagctgactagttagtttagtctgtttaacaaacactttacttaagtttcttataagcagtaattctaaattgcttggggccttgtaaactgcaaaagtaaccactatccccaagacaataatgactcaaaatgagcaaagggatttagaaaaagggctggcagaagaactgctggaccagagctcaagagtttcccaatgatctttgcccagacaatgcctccctttgtggcctgaacctgattactctatcattctgctcatctgtgcaaacaagaacaatgataaccttctttcaaagagtacagcgaggacccttcagttaattactgcaaatcactcagcattatgggaagctttctcagtgaatgctacttcaattgtagctccccaatctacccagccctgttaccctcacacctcctccttcctcctcccccactaaaaagaagaaaaaaaatttctggacaaagactaaattgaagaatgtttcaaccccaaggagaaaaaaaatcccaggggtcaaatgacaaggagaggagggaaagaaaataagagttcctaataaatcagactgcaaaattccctgcccgggatcttccacaggagctaaagcaacaaataggaacagacacccaacaggctcgcctgacttgttccggctgaaatgaaacccctcatagaaaagagaagttgcaggaacatattgaaacacccagacttgtatcactgacaaagcgagcaaaaacccaagaaaggaacagagagttgaacgtatggacttcaatgttctttaaaaccactgaccaaaacacctcagagtaactaactctcccatccccatcttcagctggccaaattttaatagcctgcccccctgaaagaaaagtacacacacatcacagacattgagatgaaggaaattagagggtccgaagatgaattatggaagagtaaaacggtaaccttctcagggaggctgcgcccagtggctttgaagaaaataatgaaagcatacaagttttagggagaaagcaaaattattttctccaaaatctagcaaggtacagtaagaggaggaagccacttcgatgctccgggtttggtattaatacagatggtacctcgatgacatcacgagttcccttcataaaaatgcgtcctcaatggatgatattctgacaaggagataaagaagaatttctatcctagtttttttgtttatttttgttttgcagaataggcgaactgagatttggctaagttaaaaattggtgtccaggtctccaagaaatagatctggagtcaaaaactgaaaacgttttgtaagtttattcaacacagcactttgtcccaccactactgaaaaaacaggatttaatagctgtatggagaggtggtagccagggagaccaagagctgagctgtaattagcagaacaaatcaggatgccagttttaataactccagaaattggtttaagacttctttaaaaatgtaaatctacccctaattatctgaatgatgatgctaatctatttataaagaatacaaacgcctctgactgaattatagctctgaatgcaattgaagggtacagctgacaaagcaagagaagaacagcacagctaaggttttacaaagcagtttctggaacctgagacttaacatttaattctctagcaaatgtgctaaggtgcagtacattctaagtgggtgtcgacttggaaagactaaaaccatgttactcatacagcaatttttgagaaggagccaaaagtacacaaagctgctcgcaatttagcaagtacatgaaattacagattataaacacacaacacaactatacaatctgccgctctagaggtcagatggaaattcccttcctcaagcaatgcatatatgttcagctggcgaatcacagagttcttcgccttgctctaatgcatcgggtattcgtggtcatcaaaacaatggtaaaaataaagtgaaatggagagctccaaagagatctgtgttccatatatggtgtatgtgtgtatgtatgtgtgtgtatatatacatacatgtacacatacatatatatatatatatatatatatatatatattttttttttttttttttttttttttttgagacagagtctcactttgtcacccaggctggagtgcagtggtgcgaccttggttcactgtgacaacctcctcctaggttcaagcgattctcaggcttcagcctcctgagtagctgggattacaggtgtatgtcaccacacccaggtaatttctgtacacttaatagagacagggtttcaccatgttggccaggttggtctcgaactcctgacctcaggtgatccacctgcgtcggcctcccaaagtgctgggattacaggcatgagtcactgcgcccagcctgagaatgcattgatgtatgagagtgagcactccactcaccattcccaccaagtttatataaaaaatatgtatttgggttccaaacatgacactgtctaaagatgacaagagctatcaacaaatactacatgtgaacagcgctgaagatggtacccttcatatttcctttgcacaatagcttaggcccccccatcaagagatagatgcttaagtaatatattccagacaggtttaaatggaaatttgcatccactgcaaagggagggcatttcagaaatccatacacagcaggaagctcgaaaaacacttaggagactcttgtcaagtcctgctcaggattaagcgtcaagcttaatgtttttcaaaaattcattagcttctactcaccagggcatgaaacgatgataccgaaaagattccaaggcggcccatggccactttcgttggtcgacttgcaaaagcgagaagccttttggggtttggcagctccccaccctgaaggctggctaaataacagcggaaacgaaacaggtccatttggaactgctcgagattttgctcccagacaaagatctatggtagtgaaaacacgggaaaagaaaaagtgagaaaatgggaaacaaatgctaatatctttatcctatacagatctatatgtcgtaaaggcattcattataatcctaaggaataaacaacaggtacctaagtttcttagttacttatgtttcttctgcaagatctatagccataaattcagcatcataaatagaaagtgacaagttcctctgttccctcctatcttggagttcgtactgggggcatgataggtctatcaactccaagatctggaccacaaactctagactccagaagtaaaaatgtagagatttccatcaccaaagaactatatgacttaacaagaggtaggttttcatacaaagaaaagtgagacgaatgaaaggctagaagcaatggaccaagtgcttttgggaagagcggggtagcccggaacacagggtggaagtggaacacaagatggtggagacccagactctggaatacaaagttccaactgtagcatgtctctgagacattcccttatttttcaaagtggcaaaataataactacctccttaggctgttgggatgtttgaaaaagataatacaagcataagtacaaggtctggcatagagtgaaggtgcagtgatgctgacaatggtacagataatgaggaatggttgaaatctccctttttgcttcaacaaaatatatatcactgtacacacatgttcatagcagcactgtttgcaaaaggtggaaacagcttgaatgtccatcaagaaatggccaataaacaaaccatggtgtatacgtacaaccagaacccaggagtaaagtgctgatgtatgctaccatgtgtatccacctccaaaacatgaagctcagggaaggagccggacacaaaaggccacgtactgtgcaattccattcatatgaaatatctagaataggcaaatccatgaagacagagtgccgggggcagagaggagcaactgcttcacaggtacagggttacattttgggccagattaacaatttcagggctagatgggggagtgtttgcaccacatggtaaacgtactcgatgttactgaattgttcgtgttaaaatggttgattttacattgtgtgaattttgcctcaatttaaaaaaatacaatgtcaggtaacaaagggaaaccccagagggagagaaatgtggaaggcccatgtcaattgttcaatgatttaaatatcatttattcatgtaattatttcctgagcattaggacaaagtgtcaaagcactaccagatggctattactgacagctgaatagcaggcaaaaatgtgctttgttcatttcactaaatcttttttctttagcatgaaatatacttatgcacatataaagcaattatatatctagatctagatagatagatagatatatctctctctatatatatctatatatatagagagagagcttgctctgttacccaggctggagtgcaatggcacaatcttggcccaccgcaccctctgcctcccaggctcaggcgatcctctcctctcggcctcctgagactacagttgcggctaatttttgtattttttttgtagagatagggttttgccatgttgaccaggctggtcttgaaatcctgggctcaagcgagtatgcccacctcagcctcccaaagtgctgggattacaggcatgagccgccacacctggccagatatatatttttaatgtacgttaccttttccaaattaagaattcaaaatttactgaggagtcagaaatgagtccccaccataagagaactccaagtcagtctgataacatgggaaatgaaattgcaaactttctaattacacagatcccctagaagagcacatcattgatgggggccagggctcctctactgggtttctgtctttcattcaatgtaatattgttccgtttagctattaacaatcagctatgaacaaagggtgaagaacactgacagtcacagtaaagaacttagcatcctggatgacaggctgtcgaggagatatccgatgatgtttcacgattccaaaacagcaaaaaaaaaaaaaaacccttttagagacctaacaattttgtccggacctaaacacggaagaacgattacctgatctaatattgttttctttttctttgagtcagtgactgaagacagctgcatttcacccattttcttcatcttttcatccatgtcaatcttctgttccagttttttgatctctgatttcaggagtcggagcgtgtcttccttgtggtggtgcctcgcgaccgcagtggcgcaggcagagtggatggcggtgatccagttttcaagctccgtctggctagtggtctgtaccaggaagaaggggcaggaagaaaaaggcacctcttaggaacttaagagaaatgaaccggagcatttccagagaagcaatgcctgggagtcgaggtgacaggtctagacacccatggataagaataacctgacctcctctttcttcaggaaatcagtaacaaaaagtgagtctcaggtcagatgcccactctcccctcctccctttcaagggctgtcctgaatgaagccaccatgtctgctcactcaatgtacttactgaactcacttgtgaaagtgatactcctaacacacaacttggtgtctactcacgagggttgctgtgaagcaaaggtcagtttccagataggatcggtcagttataggacatgagtgggactgagggacattactgacataggaagctacaacagccctgcccctcgtgaaccactgcaacccaaatccaaaggtcctattcctggtgctaagcagcaagacagaactagggttggggaagtggtcaggtagccagaagaaataccgtctttggggactctatggaaccctctaagaattgcagccgcccaacaacactccatgtgctaaaagtggcctgtttgagaagggcattaagaaaatggtgagcgacacccaccaatggtgacctgcatgggattggtgtgactcggtgttctgaaaggcaaaagtcagaatagttttcaagagacagcacatgtgataactcgctattaatgattctttaggaattcaatcaatgagtttttacaagtgaggagatactggacttttccagatactctcttaagcccagagaggtgaaacaaatgctcagaagttagcccatctcaagaaataatctattcagccactacaatactaaaggagctactaacattatttttcatgcacaaaaacacttcattgttttttctcctttgaagcgccttcttagttttctaactaatttgagtgatggcttgtatacaaaattctgtgttttttttttttttttttttttgagacagggtcgtgctctgttgcccaggctggagtgcagtggcgcgatcttggctcactgcagcctctgcctcccaggtccaagcaattctcatacctcagcctcccgagtagctgggactacaggtgtgtgccaccatgcccggctaagttttatatttttagtagagacagggtttcaccatgttgcctaggctggtctcgaactcctgacctcaagtgatccacccgcctcggcctcccaaagtgctgggattacagatgtgagccatcttgcccagccacttgtaaacaacattctattaacaggaacccaccagcacatgacactgtgctggctggcagctggaatttaagtcaagatagtactttatctttattatttctgaatctgatcagttttgtattccacagaagaaacagcatcaaatattaaaaatggtgtcagccaacaaagtcacctcccactgggcaaacctaactggtccagcagttgttatgtggataacaaatattttgcctgtggataaacatttcaatatgctagacaatctgaagaagaaacagcagaagtaccacctgataaagcaaatggaatcactttgtaaagactgagtgggaggaggagaggcgataaagaaaccggaagccacaggtgaggacttgtagattgagaaacttaggaggaaaaatgcatgtctatttatgagattaaatttgcttcactttattttatagttgtctcctctttgcaggtcattatcttatagtttgtccttacatatcatcctgaagttccaccagaaaaagagaggctctcctgcatctaatgagagcaccaagcttgctcctgctgatgtactgtacaaagcttgatcattggatctcccagtgcctcacaataaatgggtatctcgttaggtggggttatactcccagcccttttttttgagacggagtctgtctgtcaccaggctggagtgcagtggcgcgatctcagttcactgcaacctccgcctcccgagttcaagtgattctcctgcctcagcctcccgagtagctgggactacaggcatgtgccaccacgcccagctaatttttgtatttttttttttttttagtagagatggggtttcaccacgttggccaggatggtctcaatctcttgacctcatgatccgcctgcctcagcctcccaaagtgctgggattacaggtgtgagccaccatgcccggcctcctttttttaaaaaaaaaaaaaaaaaaaaaaaaaaaaaaaaaaaaaaaggaaggaaaaaaagaatccaagatgaaaatacccagtgttggcaaagatatggagtaaccagaactcctatgcactgctggccactggctggaaagtaaacttgtacaactgctttagaaagctgttggatattacctactaaagttgaatatatgcataccctgtgacccagaaaatgcactctgggtacacactcaagagaaatgcactcatatgcacacgaaaatatacacacaagaacatgcccagcagcaaatcatgggtgaaactggacaccatccaggtgccaccaataggggaatggatgaatatgtgggataatcacacaatgaaatactatacagcaagaatgaaggacctataactatagattaacacatataaactgggcacacatcttgttggggaaggaatcagatgcactgcagtatatactgtaggattctatttatataaagtattgtattagtccattctcatgctgctaacaaagacatatccaagactgggtaatttataaaggaaagaagtttaattgactcacagttcagcatggctgaggaggcctcaggaaacgtacaatcatggcagaaagggaagcaaacacgtccttcttctcacggtggcagcgaggagaagtgcagaacaaagcaggggggaaagccccttataaaaccatcagatctagtgagaactcactcactttcacaagaacagtatggaggtaaccgcccccatgattcaattaccttccaatgggtccctcccacgacaagtggggattatgggaactacaattcaagatgagatttgggtgggggcacagccaaaccatatcaagtatcaacacagataaactaatatacagtattagaagttgagagggcaggtttttttggtgggatgagatgcaatgggtagaatctggtaagaagcacagtaaggtttctggagtgctggccaccttctgtttcttcatctgggtgctagttacatggtgctgggtgctggtgtatgacaggggtgtgttcagtttgttaaacaccatcaaaatgtgccttttctgtgtatacgttaaactatcatagaaagtttcaaagaacatccttccaaggtatattatcctaatatttgagtataatttttctataactatgctaaaaatatgatacctcatattccggttttcattaaaaactgtccttacaaaactacaaaggaagttccaaaaagcttcacccttctccaccatttatttctttgtcctcccaagtgcctggtagtacctgataaaaagctggttccttgacccgaaacatgctttccattttgtttgtatcgctcagtggaaatgaggagcttttagattttaggggagttcgtgtcttcacccccccttttttttttgagatggaatctttctctgttgcccaggctggagtgcagtagcagtgcaatctcggctcactgcaacctccgcctcccaagttcaagagattctcctgcctcagcctcccgagcagttggaattacaggcacctgccaccatgcccagctaatttttgtacttttagtagagatgaggtttctccatgttggccaggctggtctcgaactcctgacctcaggtgatccacccgcctcggcctcccaaactgctgggattacaagcgtgagctaccgcgcccggccatcttcacccatttttaaaggataatgtgtgggcatccagatgcaatccctgcagaggcgcacgcagcactaaggagaggctatggttcctgcacaaacacctggcaggtggaagctcaggggcggtccacatccatatcttcaaggcaaacctctctcatctctgcctcagttagaacctcccagcccctaccctcaccccctaactcacagagtaagaaaaggaaatacctacaaccctgacataatacctgagtaatggatagaaagatctgaaatttctgacagcaagctcggctgaatatatgttatgaacttaagaatttaaataaaaatatttatccagaagggactcagatgaccatttttcacagatggaggaaaaaagcccagaaaaattaggaagaacacagtcatttattataaatcccaatctccaccaaccctgttcttaaaaaaaaaaaaagttttggttctgttttttccttgtttaatatgacatactgatcctgacccccagctcttgttaattgctctgaaagccaggctgcagagtcacaagcattacccattcgataattattattttttagacagaatctcactctgttgcccaggctggagtgcctgggcatgatctcagctcactgccacctccgcctcctgggttcaagtggttctcctgcctcagcctccctagtccctagctgggactacaggctactagggagccacacacccagctagttttttgtatttttagtagagacagggtttcaccatgttggccagtctggtcttgaactcctgacctcaagtgatccgccagcctcagcctcccaaagtgctgggattacaggcgtacaccaccaagcccaggtaatttttgtatttttagtagagaggggtttcaccgtgttggccagggtggtcctaaactcccgacctcagatgatcaccctgcctcggcctcccaaagtgctgggattacaggcatgaccattcaatattttgagctcttctcattctaggaatatgggagaatagaactttctggccccctctgaagccaggcatggccatggcacttggctttggccagtaaaatgtgagtagaagtgacatcactgctcaacaaaagcctgattcgccccattcttgccccgttgccacggtcacagaagcactgtgtcaagatagagcttctgtctgcctggatccataagagtctaggatgagtacggctctggagccagcctcgatcatgccaggaaggagaaagcatgttaagccgctgagatttaagtgctcctttcttcagcctaattctatccatcctgactgatctaccagcaaagtaagaattccactgcaaaacaggggatgcctcaaacataacggagtctgtgtagtgcacttggaaccccaagaaagaccataatctgatatgttctgtggaactgcagccttttgctctccttatttaatgaaagtgggtcttctttcccctgtgaggaccccagcccaattcagccaatagcaacacaatccattctgatgtcagagagttcacgtttgtcttccacgtaagaaggaaaaacgaaggaagctgaccaaagttaaacaccctttgaatggtatatatttaatttcggcaaagcagctatcctggaacttataaagaaagacagtggttgctaggggccggagtgaaggggatatggaatgttgttatgtaatggggaccgcatttaagctttgcatgatgaaaaagagttatgggccaggcggaatggttcatgcctgtagtcccagcactttgggaggccaaggtgggcgaatcacttcaggccaggagttcgagaccagcctgagcatggtgaaaccccgtctctactaacaatacaaaaattagctgggcatggtggcacatgcctgtagtcctagctactcgggaggctgaggcacaaaatcgcttgaacccgggaggcggaggttgtagtgagctgagattatgccacagtactctaccctgggcaacagagagaaactccatctcacaaaaaaaaaaagttctggcgatgaataatggtgatagttgcacaacagggtaaatgtacttaacgtcactcaactgtccacttaaaaatgcctagatggtaaattttatgtgtggtgtacctcaatttaaaagaaaaaataattataaaataaaaaaagcataacaatccccaaaacctagagaagcatatatagaaatgtgtgatgacagctgcatgaaacatttagccatcagcccttttaactattaagtatgcctcagccccccaaactttttaaaaacctgtcaatggctgaaggcagttccattagagagaacttttgctcccactgtcttgtctaaataaagcaacagtccctaccattctctatcatgaagccaaatcaatttctcagaaggacaattcaataaatgagcttttctgcagtttgtccctttgcagtggcacacagggagctatgtgtccacaagaggagacgaactctccactgactgctttcaaaagctagttgggtggagaaaaagtcttgcaacatttcatgaccatttactggcttaacacctcaactgctcacagtggactcctgacctgacacaatgttgttcctcaaggtctctccaggatttaaattctgacatgctagaaaaagccatccgaagccactaaccttgcctccccttcttgaaccgggcaaggttagttagggacatcagattcatgatgggtcccttcgtcagaattcagaggccaagaaggcaggaaggagagaccacccaatggtgccctctcaacttgttaaccacaaatcaccttccattaaacaaacagcagcagacaggtaaagagagagggaattctgtgattcttcctttgccttctggagatgctataaatactgtatacagttcggtgaagggaataagcaaagttcttgccaacagacaaatataatcagcaaaaaaatgcattttgcataacagcccctttgagtgcagagataagatgaagctcaggacttcattatgtatttaaatagatccagcttcaactatccaatggcatggaggacacttggtgatttcagataatcaatggtttacgtaagtggcaggaaaagggaaattcattttaaacacgagaaatactagggaatatatgccaaatctaggaaactaaaatttgagataattcaagtttatagaagcacaagaataattgtaaagtaggtcaaacgctttcattttaaaagaaaaaaaaagaaagttaccattttttaagaggctagataggaataaagctccagtgtgaattctgaaaaggcttttttcttgttgattctatactcatcatattttgtttacataagacttatttaagctattatttttaatatctgtaaagagaacttaaggccaggcatggtggctcacgcctgtaatcccagcactttgggaggctgaggtgagatcacttgagatcaggagttcaagatcatcctgaccaacatggtgaaagtccatctctactaaaaatacaaaaattagccaggtgtggtggtgcatgcctgtaaactaagctacttgggaggctgaggcaggagaattgctcgaacctgggaggcagaggatgcagtgagccaagatggcgccactgcactccagcctgggcaacaagagcgagactccgtctcaaaaaaagacaactttaaatttgaggtttccctcccccactgaaaatggtgatataatggatccctctcaccctcacccacgccgggttcattctttggagaagaaaggaagctctggactccaggaagacagacacaaggaaaacagggaccgtgcgctgcaaagaggcgaacagatggcagcctgcctgaggaagggcagtggcaggattcatctctggcaaagctcagtcgcctccaagaaaagactcacaaataatcgtcaaccggagtctctccacaaggccgcttactgtctgtccatgctatgaaaggtcccagtacttctaatgtgcacagatgatataagcagctttttcatatctcacatgtaaatatgaccagtcaaggatcaccagacatttgctgaaagcccccagcatgaaaggcagagactaaagcacacaggagaaaatgtactaggagaaaggagaagccatgcctgaaacagagaaagcttccctaaaatctacacaacccttggagatgcaagggaatctaaaactataaacaagtgaacaaaaagtacaggttacaataaaaaggaacaatgagactgaaaagagagcaggagaggggaagggagggagggaaggaggaagggagagaggaggtggggaaggaaggaaggaaggaagggagggagggagggatgaagggaaggtgggagagaaagcttcttttaggaattaaaaaaaaataaccaaaattaaaatgtcaatagaaggaaatcactatgaaggatcagaacaccagcaaggtgcagtggcttaaacctgtaatctcagcacttcgggaggctgaggcaggtggatcacttgaccccaggagttcaagaccagcctaggcaacatggcaaaaccccgtctctacaaaaaccacaaaaattagcaaagcatggtggtgtgcacctgtcatcccagatattcgagaggctgaggtgggagaaccacctgagccttgggaggctgaggctgcaatcagccatgattataccactgcactccagcctgggcgacagagtgagaccctgtctccaaaaaaaaagagaagaaattgtgcttgctttggcagcatatatactaaaaaaggatcagaacaccagtgataaggaaatgatgctaaagagaaaaaaagaaaataaaacacaaacatgctaatcagaaatgggaacataatcagaaaataattaaaccaaggggaaatgatctccaagccaaaattccaaattactcaaatattatgcaagtaaaaggtagaatgaagacatttttaaatgtgcatcattttataagaagttactccaggttattttcatgaaaacgaagcagctggtaattctacagaggctgttgtacatgaggcccggagagcagccatatgggagcaggacaatgtgccaggggagggcaggcttcaaaggaaaacatcaatgatgaacaagctaacatgctggagatttagaaaatatcactgccacataaccaggaaaataagcaatatgagccttcctcccaaaaaaagggggcagtcattaactacagaaaaaaaaattaagaaattattacagaaaagaaataagatcacagtacactacttgactcagcagccaatactatttatatggtcataacaatgtaataacactgattagtgctttaatcctaaatgttcatatacctatatgggaagatgaggaaagaagaatttatagctaacacagctaaatgttcatctatcataatagaaagtcagtagtatctaaaatccattagaaacagcagtataaacatgttaatgagggcaaatacaagaaaacaaaaacatcagctaaagtagttttgtatcgttgcttctagggaataagcctcatgaggcgaagagggcaaaaggaggaaaataatttcactttaagccttttaatgttagctgaattcttttaaactatgctgatattgatttaatacaaatttaaactaatgtaagaaaaggaagaatacagttagtaacataatttgcatgatacataacagtatagaaattgtataggaagatctagctcaaccacaattatacctctgcagtgtggggaaacctctgaggcacccacaagaaggcataaaatctagctgatttccagccttgtatattcattttgcacttcaacatccacattctccattaatagtctcctaagaggtaggcaagtggggcccctgccagggctctgcacctcaggaggtcccatagtttggagggcttttcttgaaattttccaagtctccctctgtctcctggaaaggggaggtttcaggaggtttctccccttcagggagctctctcaccctgtaccagctattcagtgtcaaaaagatgcccgaagctcttgaacttgagtctgtggctagtgagtcgcacccaccagaccgtgtggtatttctttcaccagattgcttgagattgggccaccagaatggtgctgacagttgatccggagtgagccaaattctttatatagataaagcctccataaaaaaatatttgcctggggctccacatatcctagagttggcccttcacaactaatccatgccaaaatcaaaggtaaatatttctacagtggctggctaggggcagggatataatctacggtgtggggaaaacaggacttagctacagactaagtcaacacggaaaccaacaaagagaatgaagacctcgcactcagcttgtcatatcagtggataatgtgaagttaagaggaatataaacaccagggaagatcaaataaggatcccagaggatttcaacagtttattagaaggataaaagccacaaggataacatatcaaagaggtacatttaagttctgagttgggtttttgaaaaaaaaatctattaaaataagatggggaaggccttgttgggtaagaattgatgttgagggtttaagataccacgagctcagtctgagtcaacagtttgatgtggcttttaataaaaggaattgactctagaggaaacaaggacaacgggaacctcactgcagcctgcatggggcagaccacacagaggctcacacaggatgctgagcgcctgggcacgcttacaagtaagaacagggagaatggcttgggaaccttaggcagggttgcccaaagagacgtggcaggaggtaaatgaaagccgtttttaagtatttaaaaggtgatgagtaaggataagcagaagacttgcacaggactctgtgggtgaatatagaaacaaagagaaatggcaagactcaccagaaagaacatattatctcaacatgatgaagaactttctaggacttagggctgactaacaaaaccgatggttgaaagctgggagatctccaggaatgggagaggctgcccagtgggcaggctcacctgttggccagggtcttgcagggaccatacctcctttgagaggggcactgggtcaagatgccaaatccccattaaagtctcttctaccacaagtccacttgacacctccttatgaaagatgatttacaggtttttccctaacctggctgcccttgtccagggcatgtggccatgaccttcctcaagtctgacacacacagctagacatggcttccaaggtagttctcttgagcctgacgaaactcaagaccttagccttttcacagtgaagccacacttaatttttgtaaagatgcttatttaagaggagcccatggaactagtctttttttctttattactaaaatggtaactgttaagcatttgctatctatcagacacttaccatcattatcacacttaatcttcaactcaacttaatggcatatgagtcttttaatatgcatacaatacccttgcacaagtgactttctaaatgatgagaaaactttctatgggaagaaaaggcaatcaattcctagagataacattttctatacccctttagatatataactgcatatgattttctactctattgtctttcttatttgcctggtagctgtgttcccaaggcatttaacagacaaattaataactaatattaggatatgttaccataaaggtgggtgagctttttggaattgtatgtgacatcctaaggtaatgaatgaatgaaggcccaataggaaattgtactttgtaggtggtaggtactgtctctggcttcaagttgaaggaaagaacttaaattaaaatagtgcagacagcatagcacttcttccatatacatgactccaacattcctgctcattcccactctcccctggcctcacacatataaattccttttctacttttgttggtaacatgaatctcctttccatgggtgaatctgtgggtatttgagtaacagtgtcaaatcagcagcacacaggctctggaaactgtgtgcactgaattgagccctggggctggaataacctacacattacttccataatcatggctgattgcctgtgctttagcctcacccctacacaaacaggtttcattctgattcggctgctccagagttacatggatttataataagcagaaggcagagaatgccttcatggtatccaaacagcagtaatttcctccaaaagcttccttttgtgctctatccctcataaatggcataaagctttcaccatagcaagaagacacaaaggttttcaaaactaagatcctacgttgtcacatataaaaaagtttacctcatgtgatctattgggtatttacattctactagcaattttatggccatgaagttcctttcaaaaggaattcacatcagaaatgtgtaagttaaaaagaaaaccttctgattccacttgagggttaaaaaaaatttttaagggaacctttctgaaatccatctgagaatcatctaacctgtgtagtgaggcaagaataaccaaaatcaggtttcactttagaaatatttccaatgagtagcttaattgtaggaatgagaaaaagctagtcactttttactgtagccactgactcttgcccacgttcttcttagggtcaacagtaataggacaaatagtatactcagacaataaaaggctttggagaaacataggcttgatttgagttgagtttgggtccaattactagcttttgtaagcctcgacttcaacaaatggggtatacaacacacatcaatggattaaaatgtggatacataatccaactaactactgctctaagaattacatgtgactcacattaagatggtggtatacaataagggctaagtaaaacatagccaccgatctcacaataatgttactgttgctgtcaggtagttagacatttcctcatttgcaagatttccaattaacaaataaaaaccatgtcagatgcagaaaaacaattttttttttttttaagatagggtctcgctctgccacccaggctggaatgcaatggtgcaaccacggctcactgcagccttgacctccttggtgcaagtgatcctcccacctcagcctctcaactagctgggactacaggtacatgccatcgtgtccagctaattttttttatttttattttttggtagagacagggtctttccatgttgtctaggctggtcacaacctcctgggctcagtgatctgcctgccttggccccccaaagtgctgagattacaggcatgagccaccatgcccagccaaaacaattatttataacatatatacaagaaaattttcatgacattatagcatgtagatttaaaaaataagacactcaaagcattacccattaaggaaggcttaagaagtgagaatgggctacaattaagtttcactgcaacaaatgacaccattaagagagtaaaaagcaagccacagagtagaaaaagatacttgcaatgaatataatcaacagcgatgatatacaaaatacacaaagagctgccataaatcattaacaaagaaactctgatggaaaaaaaatggacaagagagtaaaataagcacttcacaaaagatgatattgaaatggtcattaagcgcatgaatatgtgctcaatttcatattaatatcttaaaaaggattttaaaaaatctcagtatcaagtttgcaaagatgaggaataactagaattctcctaggctgctaatgagagtataaattacattaatcattttgaaaactgtttggcatatcctgaatatgtgcctaacccatgaccctgcaatgccactcctaggtatatatgtttgtccaacagaaatgtggacaaacataacctgagaacaggtacaagagtgctcacaacaacattgcttgtgatccttaacacctgggaacaactcaaatgtacctatggaatggttgctatatgtcccagttggcctgggactgtcctcgcttatacctggtatactggcataactgttaatagcgtctactctcgaaagtgtcctggtgaatgccatcaacatcaatgggggttggggtggggtaggagggttaagaacttccaaagagccattccttcacaaaagcaacacgaacagtggtaaaaaatggtcaaaatcaactttttcacaattccagaaattaatctaagttctgcaacaatctaagctgcatttattaaagacaaatggctgaacttcagtaaaaacagcaagttttgtgatattttaaattgctctatttccatctttttctcctcatctatacaatcacatgaaaaccagctgtgtagcaccacaggagggaacaaccttcctcaagtctgacacatggaactaaacatggcattccaaggtagatctctacatcttccccaaaacacctttctcagagaaccatcactaagcgacctgtctagcaggtcccagaaaaacctcttcacgagcttgttgctatttgacctgactcagacctcattcatgcaaacactcttcactccagggggtgcttgtgaaaaacaattaatgacaattgtttagcactacagtcgcctgaagcagtgataacagtcgaacaaataagaagttgaccaagaaacttgaggaaaagttggggaatacgatttccacaaaaggctctgaaaagctatgacacagtccttggaatctggaaggtcactgatacggtttggctgtgtccccacctaatctcatcttcaattgtagtgcccataattcccacatgtcgtggaagggacccagtggtaggtaatcaaatcatgggtgcaggtctttccatgctgttctcgtgatagtaagtctcatgaaatctgatggttttataaaggggagttcccctgcacatgctctctcttgtctgctgccatgtaagaagactttgctcctcctttgccttctgccatgacggtgaggcctccccagccatgtggaactgtgagtccattaaacctcttttccttataaattacccagtctcgggtatgtctttattagcggctaagagagtcacaacacagtcttagtgaattgactaatacagtcacaaatatgtataaggctgtccacaagcccagatagtcccaagaagttcctaagctcaccctatgactgaccctacagctcggtgaaagcagagatgaaggctaaggcagagatgaagctagttgcctgagtgttgatcatgtgcttgaacttgcaaacttctgttcttaggaaagactaggaaacttattgcttctgtacttttaaggaaatctctctctaataattagctgactactaaactagctgagcagagacttcagtgggcacacataacaaagcctaaatatttcacagattttaagaaagtcactaaacaaagaagcactatcaccaccgataatcaacaacaatagcaaatcctggaggatgggaggtggatctgctttcagagttgccacatttatattattttaaatgtacaatttaaaccaaaaaagtatgagacatgcaaataaacaacaaacaacaataaagtatgggccaggaatggtgattcatgcctatcatcccagtgggttgggagaccaaaatgggaagactgcttgaagccaagagtttgagaccagcctgggcaacatagcaagattctgtctttaaaaaatatttttaaaaaatcagccaggtgtggtggtgtacacctgtagtcccagctacttgagaggctaaggtgggaagattgcttgagtccaggagttcaaggttacagtgagctatgattgcaccactgtactccagcctgggtaatagagcaagaccctatctctaaaacaattaaataaagtatggcccatatatagaaaaagaagtagtcaatagaaactgtctcagaaaagtcccatgttgagtgtactagacaaagatttcaagcaactattttgaacgtattcaaagaactaaaataaaccatgtctaaagaaataaagtatgaggctaatatcacattaaatagagaatatcaataaggaaatataacttttgtttgaaagaaccaggccaggcacagtggctcatgcctgtaatcccagcactttaggaggctgaggcaggaagatcacttgaggccaggggtttgagaccaccctgggcaataaagcaagacctccatctctacaaaaaaatagaaaaaattagctggctgtggtggtgcacacctgtagccccagctattcaggaggctgagctgggaggattgctcagcccaggaggctgaggctgcagtgagctgtgatcagtgcactactgaccctacagctcagtgaaagcagagatgaaggctaaggcagagatggaagctagttgcctgagcgttgatgataggcttgaacttgcaaacttctgttcttaggaaagactaggaaacttattgcttctgtacatttaaggaaatctctttctaataattacctgactactaaactagctgagcagagacctggcaatttatgagacatgcaaataaacaataaacaacaataaagtgggttgggagaccaaaacaggaggactgcttctattgacattctagtagtcaatagaacctgtctcagaaaagtcagatccaaaatcagtgcaccactgcactgcagcctgggggacagaacaagactctgtctcaaaaaaaaaaaaaaaaaaagaaaaaagaaaagaaaagaaaaaatgaccaggtgcagtggctcaggcctgtaatcccagcactttggaaggccaaggcaggtggattacctgaggtcaggagtttgagaccagcctgactaacatggagaaaccccacctctactagaaaaaaaaatacaaaattagctgggcttggtggcacatgcctgtaatcccagctgcttgggaggctgaggcaggagaattgcttgaacgtgggaggcagaggttgtggtgagctgagattgtgccattgcactccagcctgggcaacaaaagcaaaacttcatctcaaaaaaaaaaaaaaaaaatatatatatatatatgtatatttcatatatatgtatattttatatatatataaatataaaaaaataaaaataaccagaagagctcaacagcagatttgagttggaagaaaaaagaatcagtgaacttatgacagatcaagtgagattaaggaatagaatgaaaaaaaaatgaacagagtctcagaggcttatgggacttcatcaagcatactaatgtaaacacaacaggagtcaccaaaggagtggagcaagataaatgagcaggaagactatttgaagaaataatagctaaaaactttccaaatgtgatttaaatacacaaacacatgcacacaaatctacagatccaaaagacactaccccataaatatatacacattgtattttgtggctactagtacccacaacaatttttaaaatttaaaaatattaaaagatacatatctgaaagacaataaattccaggtaaagtaaactcaaagagaatgatacctagacacataatactcaaactgtttaacgacaaagtcacgatcttcaaatcagcaagggagcctcataggataaacagctgatttttcatcaaacaccatgaaggccagaaagcagtgggattttcaaagcactgaaataagatggtcaattaagaattctatatccagcaaaactatccttcaaaaatgaaagggaaattaagtcattcccagataaataaaagtgtcctggcttggatgataaaagacatactcaattcaactagtaggctgcatttgtgagtggggtggggttggggaaggtggcttaggtgcctgaaacttctatttcttgtcctggttggtggttgcataattactttatgatagctcactgagcagtacacttatgttgtgtgcactcttctttctgtgttttacatcacagatttttaaaaaagaaaacacagatgctttgtctttatataatcaaaattagcactttatatttcttactttaattgtccaaatagaaacagcttctgaagccaaagccagaaacttggtgaaataaatgatttctttcctctatacctttgttctagccccctccttgcatgttatattcttacggtccttgtcacgccatttatacctgctcttcctttaatagtcattggtaggctttaccacattataaagatttgctatgtctgtcccctccgttatatgtgaacacttttaagaagacgaactgtcagctgggcgcagtggcttacacctgtaatcccagcactttggtaggccgaggtgggtggatgacctgagatcaggagttcgagaccagcctgaccaatatggtgaaaccccgtatctactgaaaatacaaaaattagccaggcgtggcagcaggtgcctatagtcccagctactcaagaggctgagacaggagaattgcttgaacctgggaggcagagattgcagggagctgagatcgtgccactgcacttccagcatgggtgacaaagcaaggcttcatctcaaaaaaagagaggaactgtcaaaatcttcttagtattctcaatagcactatgcagagcacataggaagcacagaataaaggtttgagaaaataattcttcaatggaatcaataaagaaagccttcctacataacaacacaaaaaagttcttgcagagtatattacaactattccaaactcaaaagattccctatcagaaaaatgttaatcctgaagcagttagcagagaagtattttttttaaaaaatgttgaaattcaaggatgctgagtagaaagttctgatcagatgaggaagagaaactgtttaggtgatgccagtcatttctgagatgtcattattttactttatgattaatatgagaaaggaacatattataaataaaactttttgacagctcaaatcatgtctaaaagaagaaattcacgatccctttcttaaatgcaacagaaatggtactgagaccacacaaagatatccttcaactcatgacaaacagagcaagtttctcacatccaactcatagccctccttagccttcacttggaaaacttctgaatgtacctactcctggaatttaatatagatgtttattttgtcattcactgtttttgtttttataatgagcaacagattaatctcaccactaaaaaaaaaaaaaaaaaaaaaaaaagcagtggagggagactgggtgcctaggcaagaaaagaaggtagccagttcagaggtttgaaatgccctgcaaaggaagtgcccaacaaacctgaaaaaggaaggcatcacccagggaattgctgaggcagaagacaaagtccttcttggggtgctcaggcaccgcctgcacaatgctgttctccacccagacggcgtgtttggggatgctgttgtggtctatcccagacctgccgtcgctctcgtagaaaaatagcgtgcatcctgaggaaacagaacaggggtgtgcatgagtattcagtgcttgggaaacaaaagaacccacagttgaacctaacatgtgcaccctgtcagaggctgaaaattaaagcacgtggaacccaggaagtaaagagaatggagccaggcttggactcaagtcttggatgggcctaaagaaggacaaagatcttaaattgtagcttctcagcctgcccgggtttccttcctgcatgccctcaagttctctcaaacccttcctttgggttttagaatgattcattacaggtctcctcacagacatagggtcttgtgactcctctgtcccgaggcagaggtcctccaggccagaactttgcctggcactatgtgaggatcagaagtcactaccgtccgattgaagcccattcaaatatgtctcgtatgatatgcaaccagaaaaatctagaaaatgtatttagttccagaccatgcccttggataaaacaatatataataccagcgttaagtactttaaggataagaaaaacaatgatacatttttggtctaacatcccatctataaactttttttttttctagaagccaaccatgcccttgttcctactgaaagaggaaatctatggcacacatacaaaggcctgggagaagccggagtcctggtccatgcataattgcactgtgaaactaacaagatagtagcaacagaatattttatagacttgtggcaagatggcttccatagactccttccattatcatctaaacttgaggctcactttaatagcaattatgagctgaacatttactccaaactaactgaaatcaatttcaggggaagccagggtataactttatgactcttcctcaacttcaacataagctgtccgtccattttcaccattttccttaccacaaacaagtgccacacttcctgtgaactgcacaacccttgaaagttcaatctattcggctacaatgggaatctgtcaagcaaatttgcttatatgcgattagtagtgtagaatgatgcagatcaatggaaaggtcacactggttcaagggcaacttttcctagcctataatatttcacattaccacagaatagctgttgaactctacgtccctccaaacagatgaatgtagcatattgatatgccctgcccacttatttcacattttttttctcttggtacagtttgaccatgggctctgcttacaagtccttattgcacggtgctgctgagcatcatgatttcatacttgtggtccttgtctccataatttaggagtctcaattattccttctacccattcaagttacagttgcttcttttttcaaaggtaaagccctatgctaatgcttttttgaaagataaagtttgccaggcacagtggcttatgcctgtaatcgcagcactttgggaggacaaggtagaaggattacctgagcccaggagttcaacaccagtgtgggcaatatagcgaggcctcgtctctactaaaaataaaaaaaatcagccagacatgcctgcggttccagcgactcaggtggctgagctgggaggattgtttgagcccaggaggttgaagctgcagtgagccatgatcatgccactgcactccagcctgggcaacagagcaagaccctgtcacaaaaaaataaaaatgaaagataaagttttatattgcttattgttaaaaaattttagtggagttctgcagggttatttttattttttattactattatttttgtagatatggggtcccactgttgctcaggctggagtacagtggcacaatcatagctcactgcagccttgaactcctgggctcaagtgaacctcctatctcagcctcccaaatagctggaactacaggcatatacaaccatacctggctaatttgtgtatttttttgtaaagacaaggtctcactatgttacccaggttggtctcaaattcctggcctcaagtgatcctcctgcctcagcctcctatagtgctgggattacaggagtgaggcaccacaccaagctaatttcttttagtttggggtttaaaagttgcatggtacaatttaaatacatacctgtagagtagtctgccccaactctatttttctcaaatcccaaagattttgaggatctcaaggcttttcaggaacacttgtatgaaaaagcagaataatctgtacctcctatttccatgccttaggctagcacagattagagagacaaagaaataacaaaaatgggagggggaaaccgttttcctctaagtcagaggttcttatgatggggcaaacttggcaatgtctggtgacctttctggttgtcacaacttgggggaaggtgctattggcatctagaggacagagcctaaagaagctgttaagcatccacaatgcccaagacagccctcacaacaaataattatccagaaaatgtcaacagtgtcactgttgagaaaccctgctctaaatagtttttacgactaattcaacactaatgaaaagtagattcctaacataaaaggagcaacacacgttagcatagcttaagaagagagaaagaagcctgtggataatgaattaggggacactcaccaatcctaacacacgcacctagtgaatgttgtatggtcccatcaggtaactgtttgtataatttttcaactttgatttagaatcatccacaacaaagcaccaccaaaagtgattaaaatcagcttttactcatgatcaactcgttccaactttaagatgaacgcgaagcagcaaatctgagaaccacgttctccctggtgaaagtctgtttaccttcatcttccctggaacataatctgtacgttcttccgttgtccatggaaacactccagagactaattccaaatgaaatctttttttaaaaaaatcaattactttgcctaatgggaaagaatctttagggaaaaaaaatctctatcccacagttccaacatgttctgctttttatttcccaatattcaagcattgctaagaaaaagtcagctgcaagtcttgcttttgagcagcaaggacaaagccctgaggatgtcaacaaatcctgggaacccatcaggatgaagcaaagaactcggtggctccatgttctgggcctgaattccaacaggctgtgtcactcagctctgcgtcaccaagaaagtaaagactcccttccctaaagggcctgtgggctgtgctcctggacacctgcaccctgacttcctgtgtcatttactctctgagggaatggcagaaacaaaataaacccctctgatatgtcccaagtaaaaaaaagccaactaatcatttttattttatgccactaacattgctgctctcaaactgagagtgagaatcccctgggaagcttgtttaaatcacaaagtcagggtctgctgaaggctgaattgtgtcctccaaacatcctaaatccagttagctcagaatatgatcatctttggaaatagggcctttaaagaggtaattacgataatatgaggtcacgtgggtggtccctgatccaatataaatggtgccattataagaaggaatttgaacatagacaagtaaagggaagaccatgtgaagacatcggaagaagacagccatctccaagtcaaggagagcagtctcagaagaaaccaaccctgccaacaccttgatcttggatttccagcctccaggactgtgagatgatacatttctgttatttccaccatccagtctgtggtgctttgctatggcagccccagcaaactcatccagggcctacctccaaatcttgtgattcagcaggtgtggggtacaacccagaaagaccctcaagaggctgtgatgcaggtgatcttcggatcaagctattaagaacttggcactaattaataaaatgaatgctaagatgggctgctaaggataagaggctgcagcgtccagaggtgtgcccatctaggggagaagcgggaagtggaagaggaagaagcctttcccctcatctcctctcactcccccagagcagagcagctggtgtgatccaggcccctcagacataaccctgtaacacctccaagttaagccaaggcacgtcacacatgagaaagaacactgcagttctccaaaatgcttccacacgatgcacatctatgtctcataggcaagaccactacagcaaaaaatcatcaaaagataatgttctaggaggccgggcaccaatgcaactgtaaacccaaggccaaagcaggaggatcgcttgaggccaaaagttggagatgagcctgggcaacatagtaagaccctgtctcaacaaaaaataaaaacattagccaggcatggtggcacatgcctgtagtcccagctacttgggaggctgaagcaggaggatcacttgagcccaggaatttgtggctgcagtgagctgtaactgtgccactgcattccagcctggaagacagagtgagaccctgtctcaaacagaaaaaaaaaaaaaaaaaaaagaaaaagataatgctgtaggaatagctgggcaacaaaacttcagaaggagccagggcctctgagtgacttcatagaaaagagttatcacacaagccttaaatcatctatttttgataggtgggagggaaataaagttctgtcttgcttatggcattgggattggcattgctggtctctggcacatgcagcaaaacctatatcctgaccaataccctcccttcctgtgtcatcaggcatctgagcaacagctggcaccaagaataatggggccaacgcaagtcctacttgtgcaagggttgacctgcacctgcacatcaccgcataggcatttgtgttcacctcactgagcagagctctaggctgctccatgtctctaggattgcatgttcccaaaccaaccacagtctgtgaaatccagtatcgaacggtctagtttgatactgataagcccaggcttcttcctcttgtgcccttccatcaatcctgttgacctatctaacctagcctgccatgtattaaccctgtttcaagtctagcttgggaagaaaagtctgtgtgtttgagaagtgtttttccttttaaaatatagagctcataaatatattacattttctaggctaccaggatgtatgcagtacgtgcaacaatacgtacatgtacttcacgaaaatgtgcaaaatgacaacaaataccaacaaatacaagcatggttatataaacagaaaataaagtgatctacacatgcatgtctgtatctatatatacacagtcaaaaacacaaagtttgactattaaatagtgactggctttttcataaacatgatggtctatacaatccattaatatcaggttgaatcctatgaaattaacattattctaccaattttttcctttaaacatggcaatttcatagaattcaagctaataaatttccctccaaaatagtcactttgaaagacaaaaagctggatgagtccaaaaagatttggtttttttggaactcatcctttgaaactgtcatcaaaccagttgcatacatgccaaaactagacatgagatgctcctctagcgttaactgtgaaaagagaaaatcaaacatcatttgcaggggtggggatgggagagttactaattagggggcataaagtttcacttaagtcacatgaataggttctagcttatttatttgtttgtttgtttattatgagctggtgtcttgctatgttgcccaggctggtcttgaactcctgggctcaagtgaacctcctgcctcccaaagtgctgggattacaggtgtgagctactatgcccagcccagatgactagattctagaaatctgccttacaacattgcacttgtagtcgataatgccatattgcacattttaaaatgtaagagggtagatttcatgcgaagtgctcttactatgataaatgttttaaattagtatgattttcaaattctgtataacaacaacaacaacaaacccacccatcccgtgagtatgtgcacaacggggcacctctattggtgcatttggcacatagccggggccctcccgctctcacctttcagggacacccagtagtgcttccacttcctccgggtggctgactccaccttcttgttcttcttgtgcaccaggaagttcttgacggccagggcgccggccttgcgcaccgtgccctgtgcggcggtcagcaggatgtccgactggcccggagagctcagggtgccgctgctctgctcatcgctgtgcgccgagccggcctcctccaggctctcgctgttggtggtgctcatctccagctcccgccggaagttctcgtacaccccctgacgagccgcatccccggtggagctgctgccgctgtcgctgcccacaaaggcccggcctgtggtgggtgagtagctggagttggtggcattagatcgcctggacaggaggtccgtgtcggtagtggccccttcaatcccactgtctgcaaactcactgccctcgcctgcattaacatccttgggagcagaaagagagagcaaagaagacaagcgtcacgtggagaaggaacccagggtcacgtggagaagagccctgggtccagccagggctctgtagcagcgggatacgcataaggcacagccactcctgacggctcctggaccaggtcctgctcaaccctggacccgcacagacccagcagagctgctcaggaaaccttcagccgccctccgtgagagcacacgatttggaatgttcaagaaatataaaagaaataaggagcacttcaaagagcttattatttctctaagataattaacgaattggcaaattcgcgattgagattctaccgctgccatgctgagaacccagcatcctcagcctcatcagcttatcctgaactccaggaaattctgcaggcagatgagttaattgttccagacgtagggggtgacaatgaataactaggtctttatagctgatatctttaaaaataaataaataaaaggcatgcttaggagtctcttttataatggagtgactgaaaagatagctagtgcaccgcctcacccactcacccagcacggctccgtgttccaggagcaggcaagaatcctcatcctctaatcagattcgcttcttgaaaacaagcagcctctcactctgcattgtgctaaataagtctgtggggcctacagctccattgagctctccaattaccttgccctttcaaagctgggatgctaggagccttgggcaggctacttgctgccccagggccaaatgacagctcggggcaactgccaagatactgagggtatcagttcccagtttaaaaacattgggaacttccaaagctgcttctgctctgaagctgaacatttccgggacagacaggtctgttctgaaatcagtatcttaattgctctaaagagctacaggcatttccataaacaataattaaataatggtagtcatcaaggaaggatactcactgcagtattggacagacagctcaaagtcttatgcataagaaaggagcctaattgttctccaaggaagagaacggaaggctgagtctaatatagaagatgccaaagtaatacacagtttggcagtttcaccaatttgggggcctttagtctcacaaatggctcattctggttcaaacacgtaaaaactaaccagatattctgaattaccatacaaatgaatgctctgggctcctatctttgctgagaggcaatgggggcagtatgagccatgccacaaactaatactggcctacacaaggccccagacagacactgtgcccatatctccacgaacttcacttagttctaagaattgctcaaagttcaccttcatcatgaagaaatactaaataagcaactaaaagagatgtatagcaagacatggaaaaaagagggtggtgggagtagaatggcagcaggagattgctgggtgagcttctagggatcaactccattataaatggagcttagacccctgggagttagagggacttaagggaaagaaagaaaccacgaatgcagctcagatgcagacccctataactgctggttcccacagctttgctatctgctatcctgcttattaacatccacgggtggtcatgaaagacctagagccaattggtaaaaatcctctacacaaacaggaaaacactgttatcaacccacatttctccttggcagggacattgaccatatgcttccctcttgatacaagacaaaagaaaatttgacaattgttgattattcaggataaccaatgagttacacaagatgagtctgtgaattttccaaacttttggattcattttcatgtctcagtccttctgggaagaaggtttggtatgcgtgaaaacatcagctattaagctctctctaaaatgcaaagaggtgaaatgcttctctgcaagacagggaaatttagctacacaggtaacatccctattccataagagagactttggtacaaaggagaaaaaatgatcccaggcatcttgtaattcccagagctccagaagaggaagggacttggcaaagctatctcattgattgacagcctgcggcttagaaaatcacaagtctggttggtggcagatgggaagttgaaacctatccttccaagtacactttccactattatatggtgacctcatgactcagctgcaggtagcacctgaccagattctgtctaaatattcagtctcagcagggcatggtggctcatgcctataatccctgcactttgggaggctgaagcgggtggatcacctgaggtcaagagtttgagaccagcctgggcaacaaggtgaaaccccatctctattaaaactacaaaaaaatcagccacacatggtggtgcacacctgtagtcccagctactcgggaggttgaggcaggtgggaggatcacttgagtccaggaagtggaggttgcagtgagccaagactgcaccactgcactccagcctgggcaacagagagagagagaccctgtctcaaaacaaaacaaacaaacaaatcaatcccatgccttcccccttttcttaccaacaatggctcttccagattttttcagcaaaagctgagtgactgtgacctgcctggcaaaaagctaaaacctgcaagtgcaagaaaggggaaggaggatgggaagagagaataaggaaaagcgaggcagaaacccgaaagaccaactctcaagggcgtgtctcataagagttcactacattgccaacaccatccatccctttacagaaggccctcacatctgtctctatttaaactaagagtaaggcctcaatggacactcacctctgtataagacctgaacatctgctcatgccaactgatgctgtagctttgccatgaccagactgtgtgtgttcaactctgggacaaccactaaaccaagcaaggaagtgattactccaggtaaaagacctgcgggccccaggtgagcttgcatgctttggaagcaaacagctccgtgtcatcaacggggaatgctcttgtcatctgtgatccaagacaactccaccttgtctccttaagtggttattcaggctcagtggtacacatgcccccactgatatgtgacccagcccattgagaaacggatgcaggttgcccagccccagcccttattcagtcatgaaacttgggatgtcccaaattcccagaagtccattctccagcattgctggaaagggtgatgacccagccagaggtgctactcaacaccgctctttctttccttcattgtgttgcaaacttacttagtggtcatctttcagaggggctcctgctactacccacctgagaatcctgatcctccccctatcccagaagcacctgtaaacctccccagtcttcccagcagtgaggaatacagaagactgacaccacggaatagtcccaggggagcctcagcagtttttgtagcaactgcaaggtaggttacctcttagagtcaaatactaaattttaatcaaaaaaggcagaggacatcaagggagatggtaagatcctggctagacagagaaataattctaaacatggttcatgatctagctgagacttccagaaaacagctcaaaataaactctccatgttagaaccactccgttgaagagatttccgatcatgaacaacattcacagggccgagaggctcttcaatcctgttctcccaggacaaattctctgaagccagattttcagggcactcaccagttgccattccactggcagcttccccaaaaaatgaatgtatgcacaagtggccagctgtagcctaatacatacaacagctgtgggcaagagttttcttagcatttgagctgggcaacaaatgcttaaatgagctcccaggctaaaatgagggaggcaagaggcaaattcaaagcctgttttcactgccttgaaaactggagggtcacgcagcatgaatgtagactaatgacacattgtggtaaggctccagttgttttgacaggagacttcaaatactaccaaagggagaggttttctgtgctaatgatgtgcgaacacaattttgaaaatgcaattagccagaaagtgcaaaggctctgggacaattccaggaccagtagaatcaattggccacttgtagttaagttataagtcgaatgcaattagatactgtttcctttgtcacttgaatttccctgatagatccagcttgaatacacctgtgttaagatgctaactacaatgcagaattcactgaattccagggggtaaagaaatgtggacctacagaaaccctgaattagaactgtttctggcttgttaaattctaacatgtccttcctctgatttatcatcttcttcctaaccccaaaatattaagtacccctcactacacacacacacacacacacacacacacacacacacacacgtatattatctttggctctcagtattatctccttggtattctcagtatactctcctttgataatctcagtacagcaagtatcaattctaggtaaatgactctgaaccaatccatgcctcaatttcttgatatgtataatggggagagcaacacatctactttgtaagacactgtataagacactgtgagattgagttaacccaggaaaagtgtcttaaactgagcccagcacatagtacctgctcaaaaatgttaactataattacggtcatctctaccttcagccctacttacatcttggcccaaggagagaaggcattgcctgaactcagttgctaacttcctgcaccaacatggaagaaaggtctctgagaaacctgggaaaaacacaggcataccaaggctggtgccagcctaatactaattaggcttgttaattgttctcacgttcacaaaacagcacactaaactaggaaaatggtgacgttctctacattataaattagtaactactggtcactattatgaaatactaataattgccatccctgatttgccagaataggaaatcaactctattttccctccccttcctttcttagggcaaaatctctatgcctttctttttatgtttccaacaacccattccttttcttctaacgatttccaatgggagtgactcacaatttcagctacaagcattggaaccaaaattcctactgttactaaaaagggattccaaagtaagttggcaaaagcttgaaatgttccttcaggtaactcctgattggagaagctttatgtctaagttaaatgaatcattgcctctcctttcatctgcttttctatgtatgtgcttataccttacagtcatccctcccctccctcctcactatccataatatatcagagactcagttttttctcttcccctccgagtgccacatcactggttgagcaataagctctctcttctaacccatcttccttccatcaatccatccggcacaccactgccaggtaaatgttccaggagcaatgtggaggactcctcagactgctgttcaagaccctcccccggtgtcccgcgttaaaacttgagcttcgatgtccccacccactagtgaaattgaagaactcattccagggcatactcccaacctttctcactcccaagaatactcacgtccccccttttactacaaccagaaggcttctctgtgcttcctccaactaccatgccaacctctccacagcatctcctctcccacctccaccccaccccagccaccctgagctcctcctccttgctcgaatgtgctgggcaccctcccacattgcaactcaggagccagctccctcctcccctcctctccttccaagtccctatccaggtctgccctcaccctgaccaccctgtcagaaattgccccccacatcccccacaccccatcttcctcaacatgccctgtctttcttccacagcacatcgcttccttattatgctaactgttttctgccacacacacacccacttcaccccaacgagctccacgagcttgtggatctttccttgttgacgcatcccaagtgccaagaataaagcctggcatggggaaggcacttcaaaaataattgctgaatgaactcactgctgctcattttccaccacaatctcaaaacaaggaaaacagtttctcatggaatgcactgcagctggagttaaaggttttgtcatttctaaactcagctcatgctcaactaaagttgaggtgacaaatgagtcctagctataaagcttacatttataggctttaagcagcctagttggattatgtcttgtgtggatgcaatcggagttcacttaaatttttgttctttaactcttttaaaaaattgaggaagtaagaaagatatattaggctggacgcagtggctcatgcctgtaatcccagcactttgggaggccaaggcgggtggatcacgaagtcaagagatctagaccatcctggccaacacagtgaaaccccgtctctactaaaaatacaaatattaatgcacctgtagtcccagctactccggaggctgaggcaggagaatcacttgaacccgggaggcggaggttgcagtgagctgagattgcaccactgcactccagcctggcgacagagtgagactccgtctcaaaaaaaaaaaaaaaaccagaaagatatattgaactatcttatggcccaagctagatactcggtcaactggtggtccaaagccaactgggcccaaatgacaatgtgacaggctggtcaggtgtttcctaagttctccattgggatccatggagaccctgtcaggcctttagggcaggctggctttatggccacatccaacagtcacacatttacagttatgctgtaaaaaaacaatgattacacattgttatgacacaatttgagtcaaggggctcaactttcctctattcttatactaggaatgtgatcttctttttttttttcctttttcttttttgagacagggtctcattctgtcatgcaggctggtggaatacagtgacatgatcatagcttgctgcagcctcaacctcccaggctgaagcatcctctcacctcagcccactacgaaactgagactacaggcacacaccaccacacctggctaatttttttgaaatttggtagagacaaggtctcactatgttggccgggctggtcttgaactcctgagctcaagcgatcctcccacctcggcctcccaaaatgctgggattataggcatgagccaatgcacccgacctaagaatgtgatcctcaaaagctgaactggtgggcatagtggtccatgcctgtagtcccagctacccaagaggctgaggcaggaggatcacttgagcccaggagttcaaggccgcagtgcactatgataatatctgtaaatagccactgcactccagcctgggaaacacagcaagacctgtctaaaaaaataaaataataataataataataataataatcctgaatgttcccaacctgtattagcataaatgaccagctctcaaagtatggactagggttccctaaaatacttccagggagtcagtgaggctcctccttttccaactaccctgtgcaagtccaggttctgctcatagggtccaaccaaacagtatattgcaagagagtgaatgcaaaagtaggtatgagacgctagtgtcttctgttaagctagaaatcatagagatctgcaaaaatggaaaacaatgcctctgtcccacatcttttattttagagaataaaatattgtattactttagagatagggttctcattctgtcacccaggctggagtgcagtggtgtgatctagctcatgaaagcctcaaattcctaggttgaagccatcttcccatctcagtcttgcaagtagctgggacaacaggtactcaccatggccagctaatttttcctttttttttttttttagaggcgaggtctcactatgtttcctaggctggtcaaaaaatatatttttaatataaataaataaataaatatttttatataaatatatattaataaaatatatatatacacatatatacttttttttttttgagacggagtctcactctgtcgcccaggctggaatgcagtggtgcaatctcggctcactgcaacctccacctcctgggttcaaatgattctggtgcctcagcctctcgagtagttgggattacaggcacccgccaccacgcctggctaatttttgtatttttagtagagacgggggtttcaccatgtaggcaaggctggtctcgaactcctgacctgaaatgacctgcccacctcggcctcctgaattactttttaagagtataaaaaggtctaagaatggctaacataagctatctctcaactacctacccaccttccaacttcccaaaaacagatcttggcaaagaagatatatattcttgttgaaaatgcatgggtttgtttgcaaaataaatatctcattgcttaacttacgtgccagaaaaagaaagataaagagaaaagaaaaaaaaaaaagcatcaaacagaagatagaggagaacagaaaaaaaaaagggtgttttaaaaatcgattttacatgaaaaaatttgttttataaaaacctgaggttcttaaccagaaagaagcctctagatggactttaggggacctatggatcccttgaaatgatatgcagaagggtggtccctgtctttatctaaggaaaacgtccacatttttcatctgattctcaagagtctgtgaccaaaggtcaagaatcatatggttgttgatgtgcattttcagcccaggaaacaaacttatctctgagtcattgaagctcagttgcaaaataaaacaaaactttaaacatcaagacaatttttctaggaactcaagctcctcctctgacaatgctgcactctttaccttgttattaatgaaatcatcaacgcgactacttgcttatcaaagaaagcagccgtgagggatggctctgctacagttatcctggccatctctctccgtaatcagtgttttaggtgacaaaagtgggcagtaataattttcttttcagccaagtcctttttttttttttttgtatctgtaccaaaattgagggttttgatcttaaaatctgaggatattgagctgaaaccttttcaagcacggggaggtagtcagtgtgggtgtgtgctttggaagaaaaggccctccttgattagcaagtcagaaagaagacttggatttttggccgggtgcggtggctcacgcctgtaatcctagcattttgggaggctgaggcgggaagatcaccggagatcaggaattcaagaccagcctggccaacatggtgaaaccctgtttctactaaaaatacaaaaaattagccaggcgccgtggtgcatgcctgtaattccagctactcaggaggctgaggcatgagaatcgcttgaacctgggaggcagaggttgcagtgagctgagaccgtgccactgcactccatcctgggcaacagagtgagactccgtctcaaaaaaaagaatacctgggttttcatccagttgtgacacctcatctcctaatctctttattttctagggatgctgctgtgtctgaaactggccagtgaaacccacaaatctattcaccagcaccacacctggctagggacgctccgagagccgggctccttgctggtctcctgaggctgaggttcccagagacatgctcagtacaacctggccgtgttccttcatctcccaagtggatgaatgaagctctcctcacaagcatgcacaacggctccacgccaaagcttcccacagaacacagaacctggctataaggctccatcaaacggcaggtttctctctctctccaactcacccactgaaagtttcagagacacgggagagcagaaccctagaacaatgaggcaatcttcaacatcacaactaacaactcctatttattaagcatttgtatgtgtaaaactgtgccatgagttttccattcattcccttgcagaatctccagcctcatttaagaggcactgagatccatggaagtcaaataaccaagaggtaacaacctcaaagttgcaagctcagatatgctgctaacttccttgtctgacactaggcagccccctcctctgtctgtaaccaaagaaattcataaagttcaggcccaaagacgaactagccatcaactaaatctaaggagtaacctattaagtacttttacagaaaccaacagaaataaattctgcttcaaatagcatgaggctttactcatactgactcccaagacaaacttttctgcacagcgcacatgtggatgcacaacaaacatgctcataaaatacacgaattaaaccaaaaattgccagcagaccctgtagcacatatgtgccaccattcaagacttaaatgtgaactcctgtgacttcacattacaataatccatccaactactgaaaaaatccaaaaacaggaaaaagggccaaaaacccatttttgatcattttcaaatcaaatgaagttgttcacattatttcagataaaatgtgttttcttccaggcttagaggtcatgctcttgggtcaaatgtctgccaggaactcttttctggggagtaaaattgctgacaggatgatcacagattcaactacatcatcagggcagccaaggagactttaatatctatgattcaagctcactggagaggtcccctgggtcaaaaacttttaccaaaaaaaaagaaaaaaatttttttttaaaaaagcattcttttcaaggaagcttccacacccactgcctcttaaaatacactgtttggaacatagtgggctctcaagaaatagcgttggatgaacacgccaaacttagactaggaaatgtgggcgggtggatagtgttgtgcataattccggggtttgtttcaagtcattaaagatcctcactcaacatataaagtcaatacaaaaataatacttccgtgcattttatacgctccacaagaggtttccatgcatggtatcctatttggttctcccaatggccctgtgggaggctggtgtcactcagactggacagcaacagatcctggggcacagaagatggagtgactggcccaaggtcaccactgggtaagcacacatgccaggatgcaaatgcacttcttaggattcctggccaatggcacttcccattacattaagctgcctaagcagtgattttatgagacaccacctttagatgatctcacttccatatattcacaattttagaaggtgacaagccaaagaatagaaatttcgtataataatgacacatgagagctttcagtggtaccagacctagaggggagaactgtcctttgctttgcccattttctgggggtagccgtaactcaaaggctcaaatccccatcagccatcgagtataggggagagccatccctagtgtcagaaccacagagagccaaaatacaacagggcacccttctcaaatcttacatagcatatgcactaactgagcactgttcaggtagaaatgaaagtccaaggtgatgttctgtttttaacagtctgcgtcactgtatccttctctaagctccgaaggccccatagatcatctctttgaatcagccttgcagtgccaatctgataatgccttcaagacagcccttcaatccctttcaggtgactctttaataggtcacatatctccatgatctgtccaattgacagtgcagaagtagccctcgcagggtagacagaggggctgcaggtgggttatctggtcatttgtgtcattacaatctcaattcagaagagatgggtttaaaattcagggagtgcatctggaggcaagcttcaggcttacgttctcagaccacagatgcagccttggtagcaacttggtttctaggacacaagtgtttttttttctttccttagagtcaaggggtacacgtgcatgtttgttacatggatatattatgcaatactgagatttgggcttctattgaacccatcacccaaacaatgaacacagtacccaataattcgtttttcaactcttgctcccctccctcccagcttttggagtccccagtgtctactgtttccacctttatgaggtactcaagatattgatccaaacaactaccccgagtcctcaacccatatgcctccactaacaatgatgaaaattacaacagctaacaaagttgcccttactggctgcttcctaagaaccaggcactatgcttcacatattatttcattctactttctcaaaaaaccttattacccccatttgacagatgaagaaattaaggctacaagaatgtgaacaacttacccaaagtcactcaggtaagaagacgtggagccaaaatatccggcttggacaccatcagcaaaacctgtcctcaggcaggaacacagacagtctaatgccgattttctttttctcggcttcccctacatcctccatcctatgcccattatatttagaccccctttccagcagaacatacccttgaaatgcccatttgacttgcactggagcaaggctggaaggtgcagtaccacctcctactgggcaatcagagtgctgactgcagggaagtctgctggtcaaccttgaggctgctccgccattcaaggcaaacggacccagtctggaattttaacctgaagcaccatctacaaaccacctccacatcctcagcaaaagccaagactccctgaactctgcctcagagaacagaagtaccagaaaaggcccaatgcatgcaggattactccacatttctttctttctttcttttattgacacagagtctcactatgttgcccaggtgggacttaaactcctaggctcaaagcatccccctgcgtcagccaccaagccggctcaactgcccaacattttattatcctaatcttaattatcattgccagctaaggtaatggtgcctccattcactaggaaaacactttcaaaatcttttttttttttttttttttttgagatggagtctcgcttttgttgcccaggctggagcgaagtctcttagtttcctccccacggtttcgtgcactagaccccgaagcaggcaagctgagcatctttatccccatttttcagaggaatgactagaagtcagggtttgcccaaggtcaaacaactagctggttgcaaagtaagaattggaagccacccatgttattccttccgctacacctccctccagagacagggctggccagcatcgcacggaacaggaaattgaaatggctcccggtaaggcagcgagcctgccaaccaccgagagaagctgacaagtgacccaaacccgcccagaatttaaaatgcctcctcagaggagttgccgactaacctcctcccacctgctgcagtgaagaaataagttccaagagtctgcaacccaccatgcctgtttttccacgggaaggaccaagttagaaaggaagcttgaataagtgggatgctgttgaagaactaagatgtagaagcagtttcccaatatgaacttactagcttttttcccactcctatcacatcgccactccccccacacacttcccttaatccccaccccttaaccacagaactctaagaggggcaaagcagaagagagagaaatcctcccaaaacagcaccagctgcagcaactaccaggcaaacagggtaaaacccgattaaaagatggaaatcttctaagagcaaagtcatgcacttaaagagtcatgcaccattcccaaaatattgaaacaaatttcaatcactttacctgagttgttttagctcttctgccttgcatgctgttgctatggctaatttgtgggttggtggcaccttcagagagacagtgagatttcctacagggaagtgtgttataattactgtacggaggagtctcttcagcagcagctggtggcatcttatggtttgcaagattgggaatatcagacaccaaattccgacagtagcctgcaaatttgctccccggccccccgtttgctgtcactccagagtttttctgagcatacaagtcacccaaggaattggctctctgacaggtgctgagctgccgcggactcgcccgcgtttccatcccccgagcctcctcgcagtccttctcttcggcggaacccaagatttcttcgttgcttgttaaatgttcttggctcagatcagagagtgagaattccaggctgtcctcccgccagatgtctgcagatttggagcgtttcttcttaaagctcgccgtctccatgaaagtgggcccattggatgtataggaatgctgcctcctgcctccctcagccaaatatgtagcgtcatccccgtaaagcctgctctcctcagtgtctggcatgctctgcacagaggctgctgtgaggacgatgctgctgtctacgctgggagtgacagaagagtcagtgtaagacacaggtctcaagcccatgtccactcggtccacccagatggggctcccgaagtcttctagggtaccatcttgggagaagggctccaggccattttcagccagggactgggggatgctgggggtgctgctggatcgggtgctcacttcggagttcctgtggatcaccttccccgaggaagcgtgcctggtcctccgcgtcttgtgcgagaggcgcagggagcgggaagtgtgcttgcgccccaggctggcatgcttttctccataaaactcgtgctctacatgttgactttctgcgtttcccatggttttatggtctgcagcaaagcggggggaaaggggagaattgagtcactattagtacaggtataggcatcttagagaaagcgctcagcctgcagggagggcagaacaccttggctcacaggggttgttaggtaagtaacagcacaacttcctatatgcacctggtaggttctcggactcttacctgggagcaggtgaacagtaacatcatctactgagactgccccctgagatgtgaaatgagctcataaatatgagcatcagagagttagacttgtctctgcccagagagaagatggccacaggccatagctgagagcgctgcttttggacagccagaaactctgctgaccttgtcttccttactaaacatttgaagttctgctcctatctatacattgaaaactctgaaagtacaaaccaaaatgttcaccaagggagtaatttctgtttgaaatgatacacatatttcaaaaaacaaaacttagaggtgcatttggtaacctccttccctccctgacaatgggtacgtttcgttttttcattttttttttttttttggctctatttgagctctaatgatacttcaaaatcaatcaaaaatggaaaacctcaaggtgtaagtctgatcaacttttcctagtaaatcaaagtcaaaaattaaaaaaaaaaagctttgacctttaatgtcacagccttctgagaacctggattttggggcatttggggagggctatggaggggtggtggggatgggcaaaacaaaatagaaaaaaatagaaactccgctctctgcttagcagtagattaatgggtttatttctgggagcaaatccaacctgtgaacattaatctggtacagcatgccctgcaaacagaaattcacattgtgaaaccactaagtgtgattccgccttctggggccccccaggttaattcaagtccctccttaatatttttacagtctctctcactgacccgatgacacaattctgttacccacagtgggaaagagaaaaatcttcaaagctcgacaactgtgactctacttagcctattcttgttccatgaagtctctctagcgcacttcaaattgtatgcacttaagataacgcacatgaaaatagctggaaaggaaagaagaaaaacagagtaactgggcatatctctgaggtggttcttttaaccacctatagagccattcattcagaaaatacacattgagcacctaccatgttctagaagccagagatacagcagtgaacaaaagggacacatcccctactctcatgaagctaatttctagccagggaaggcacgtgatagacaagaaagtaaaagcatcgtggtgaagcaggaagtgatattaccgtgatcattgcaaagagatcgaaagagcctggaacacaatataccttcacattgatcccagacttactctataattccactgttcaggctaaaacgttgctgaaactctcaccagcacatcttcactgaaataaaatttgtggcaacacaaagggaaaccctccattgaatgttccagtgagttcaggggtaactcatacagacaccagatgttaagctgttcccaggctggaatattccccaccaggtcacacatcacaggaatctcagagggaattttccaataaagacaatctcttttttactaggagcaagtagatttcaaagcaatatgttcacgcttctctggtatctttaagaagcaagaaaaaagataaaaacgaaaagatcaacggtctgtgcacaaccatttatattatctaaattcctaagaatggtacatgctacatttcttacaagtaaaataaataaatatgcatttcaataacactaaaggctttgaccaatgccttggagttctttatttttttaaagtacatattaagatacctggatgtgcctatgtaactatatgttttgccaataaataaagacttagaaccaatgttagtcacagccccattttaagactcacataggtttaaatttaaaagaggaaagaactatgaggaaataaattgagtaaaaggcaaaactgtcgcctcaaatatgctaagatttaccctcctctagcacatatatcaaaagtttgcaaacataaattgacacatatattttcaacaacagctttctggtaaggcttgtttctgccaacagaaaactcatcaagttaaaagcctcaggagaggtttcctgaaggaaatggccccaaccttcaagaattaccgcactacatgcatcacgctgatgggtctgttatattaatagcatttttagtagcaagattcttttcagctggccaaggtaggaaagaagccacttttatcttcagaactagaatgtagagaggaatgccaaatctcctaaatcctactaagagaaactctcaggggatggcctaaggagagtgagcaggaagtttgaagcaactgaagttaagaaaaataagtttctagggattgctgaaacacccttcaatttgaaagctgttcctgagaggttaataagaacgatgaaagcccatgtgggatcagcggaggactctgaaataacatcagcgtgaaaagttgaaattgctcattgcatacaggagacacaatctccacttcagggacaacccctgccccactggcaacccccagaaagttggtgaactttaagtttgtttgttttttttttttttttttgagacggagtcttgctctgtcgccccggctggagtgcagtggcacgatcttggctcactgcaagctccacctcccaggttcacgccattctcctgcctcagcctcccgagtagctgggactacaggcgcccgccaccacgcctggctaattttttgtatttttattagagacagggtttcactatgttagccaggatggtctcaatctcctgaccttgtgatctgcccacctaggcctcccaaagtgctgggattacaggcgtgagccaccacgcccggccgatgaattttaagttttaccctttccatgtacaaatgtaaaatgccagctacttccatcatcttaatttcttcctattcaatcttacttaaccctttttatttttatcttcaacaaacaaaacctgatttgcattttatatttgtgtgggttttgttgttcctgtagcccaaagaaagcaaattcagagcagaaattaacttttactttttttacggcttccacaagactagaaatattccacgcacgataaagcatcagtaaatatcggtgcattttagtaacaaaagcaaaaagtgaaggaccagcacctcactaacatcatcacacagtcactaggtaggagagagaatatttgggacaaggaggacaggctgaaatgcaaaaattgggattgacattgaaaaggtggatgccagaaaactggtactagatctcaagcttggaaacactaccagttttaaattcattaaactcttaatttcagactatgatttacttatatagaatgttagtggtcccacatagctctcatgtttagggactaggtaggagggagggaggacaagcttttagcctaagaacaactctccatattcaaacctcaagtctggcttctcgtgcttttctttctttccaatcttctaagtcaagcttgtccaacccatagcccacaggccacatggatggctttgaatgcagcccaacacaaattcatacactttcttaaaacactatgagatttttttgcaattttggtttttttggctcatccgttatcgttagtgttagtgtatcttatgtgtggcccaagacaattcttcttcttccaatgtggcccagggaagccaaaagattggacatccctgttctaagttctggcttccttagcctgcctcagggcctgtgcctgtccctctgcctagaacgctctgcctttccgcctactccaccaagttccttcagaccttcaatcaaatgtcccctggtcaaggaggcctttcctgacccctcctccatctaaaatgacaaccagtgctgcagcactcaacatttcttacccctcttcttttgctttgccttcacattgatcataattgtaaccaacatatatttcacttactggtctttcttattctctatcctttcccactagagcctaagcttcaggagggctggaagtgtcttgtttcctgctgtatcctcattgcctagaacccagcctgaaaggttgtaggtggtccattaaaaaaaacaccaaaaacccaaaagaaaaaaaaaaatactggaatgaatgaatgacaaagacactttaatctaagatgtgaaaactcatacaactacaatgcaacataggtgagaacatgaccacaatgctaatgagacacagcacacatcagtcttaaatacgctagcctcttctctcaggatgcctggaagaaacttcccaatcagctctctgctctctgggtcccttccacctgcaggtctgtgtcagtcccttactctggaccactgggttgaaggtcatcctgatccatgaacttaggggtgagggtgttcagcttgtgctccagtgtgttcccctccccacccccaattcttcctggggaaagaattaagggcttgcacctgtctaattccactgaattcttgcctccagttcctatcttcctcttccttttggagctgcagtgcagaggttcaggaatgaggttaagagttgagagggcaagtgtagaactgctcaggcctaggacgatccagagaaagtgagagcaaaggagtcttagtggcatgatgggcaagagtgtcatctgaaagtggtatggggtcaaagcatcaggagttcctgggggagtgctcagggccagggatcaaagacaataggatgagtgtgatttttcttttcttaccaacaccatgatccctctcttaaagtgataagttaaacttttcaataagtaatcaccttaagggcctttaaatcccaccaaattaaatgcagatgctcctccatttatgatggggtcatgtcctcataaacccattgtaaggtgaaaatatcctaagtcaaaaattcatttaatacacctaacctaccaaacatcatagctcagcacagcttaccctaaatggctcagaacacttacattagcctacagctgagcaaaatcatctgacacaaagcgtattttaagtattgaatgtttgttgaatatttatttataataagtgttgaatatttcatgtaacttactgaatactgtgctgaaagtgaaaaacaaaatgattgtatgtgtaccaccgtaaagttaaaaaaacacaagtcaaaccaccctaagttggggactgtctatacatagtaaaggaattaaaaggtattttaagaaactttatcaatatacacaaatacttattagttagggtggttcatatatatatatcaggtaggtggtcatttctcaggggctgcttttatagatttattaggctactaagccttttgtaaaaaaaaaaaaaaaagatatagaactatacacatatattgaaacaatgtcaaattcctggctttagtattttactataatcatgtaagatgcaaccattagaaaaaactaggtgatggttacatttcctgcatacaatttcctgtgaatcataattattttgaaataaaaagttgaacaaacaaaacgagccttaactaactaactgaatattctaatgaaactgtagtttaaagtaagggttcttccaaaagaaatatagttgaatccccttttatttttagctgaaaagcatctagaatattctaacataatttcaatgaattaggcaacaacaacaacaaaaaagcaagcatttagcatcatctggcaaaatgtgatcagaaagtacaaagcaaacagaacagtggtccaaaatgaggttaaataaagaggtgatgttgattataggataaagcttctgtcttaataaactagtgaaaaaaaaataagttgttaatatctggtgccagcaagttggagtaaaccaactaaggcctatcttgccccagctaatgacaactaaaaactctggaccaaaaagtaaacaaaagcaaacaaataaaaaaataaaataaaaaaagatcaaaacctgaggatgccacccatttaagggtgagtttcctattttgtttttgttgtcctaatttctcacccagccttataccaagggtgagtacggctccagtgaagctatggcacaggcaacaaaaactctggatcagaccttgttgttccacccagaggaatcaagaatggtccctgtaagccagagagagtgtggagatcttagagaaaagagaactggaaaagaacatcccataatggtgtgtataaatctgcacaagtgacaggctcactcctcagatgcacatgcctaggactgacccaaagcaagatagcaaaagctttgagaactgaatcatgacataaaccacagcccaaccctcagactaacccctgagtggcacaaaaacgggacaaactcaaagcagtataccaaaggctttgaaaactgaactgacattagagcctccacccacggaggtgagacagcacttacaatctgaaccaagtcaggttgactgcctgcaaaataacaacaaggaaaaatcaatattctccagatgatgtaacaatacctggagtatcacaacataatattcaaaatgcccacaatgcattccaaagaaccaggaaaatttaattagctctcaggggtaagtacaatcaatagatgccaatcccaaggttgcccagatgttggaattatcacacaaagacttttaaagcaactattacaagtgtgcttcctgagtaaatgtaaacacccttgaaattaatgagaaacttaactgcttgcaatgcctgtgcaagatcattatgaacatcaatgatgatattaatacatgagtaaatgctgggcatggtggctcatgcctgatcccagcactctggggggccgaggtagttggatcacttgaggtcaggagttcgagaccagcctggccaacatggcaaaaacccatctctacaaaaatacaaaaattagccaggcatggtacacacctgtaatcccagctctacttgggaggctggggcaggagaatcacttgaacccaggaggcagaggctgcagtgagccaagatcgtgccactgcactccagcctgggaaatagtgcgagactccttctcaaaaaaaaaagtacatgagtaaacaaacagaacacacataaaaaagaaaggtcaaccctatatgacccaagatacagcacgtaccttgcatttttaaaccacctgtactgcataagaaaatattccagttaatagaaagccaccctgtgttcaaagtcctgggcataaagaacatagaaaaatatttccacaaccacagattgttgagggaaaacaggaaagaaaaagacacaaaggaatctggaaacaacttcatcaccttgagaactaaggaggttataataatatttttatggtttaggatgtctaatgccctcaattacaccagcggttccagtggtgctcctagcagacagcaggacaggatgcctcaccccctagctgaagaacaggaaacttccacatgaacaatgcccagccctgtgggtcagctggccagggcttgccccgtgtgggagtaaataatccaaaaggtgattctaccactggggtcaaacatctctagtgcaaaattcttctcatcttccagaattaaaatctgagatttgagatgcacgttcaacatacagaccttgagacagctaaaaattttctccaagaatattaagatgtggctgggggcggtggctcacacctgtaatcccagcactttgagaggctgaggcaggtggatcacttgaggtcacgagtttgagactagtctggccagtatggtgaaaccctatctctactaaaaactacaaaaatcagctgggtgtggtgggggcggggggcaggggtgcctgtaatcccagctactcgggaggctgaggcacgagaatctcttgaaccctggaggcggagactgcagtgagccgagattgcaccattgcactccagcctgggtgacagagcaaaatgctgtctcaagttaaaaaaaaaaaaaaagaatattaatatgtaaatatttcacatgcatatacacatgataaatctgcgtaagaattttaaaaagcaattattccggatggattgcttgtagggcgttttaattttcacaattatacctttttttggtattttctaatgtttttatagtaaatacgtaattcactttaaggaaagtaaaataaatagaacatgccaacaggtttttaagtcaccgaatttttttttacagttgaagagagtaaggatgtgggcactatgctgacagctacaacaaaacggcatcaaacccaaactctaaaacagatggcctggaaaaattacctaagatgaagaaaatactacctagcttggacttattctactttttcgctatatttcaatggcacactgacctcctctcattgtatctatggcagcgttatttgtacactggcacatttgtcttgtttttaagtaccctcttctcattttattataaaatctcaatggcagaaaccatctcttacttgtgatggtaacctaaatatacggaagttttcgtctagctcttctgagtgggaatgttcaacaccgacattgccttataacaagggcacttcaaatacataaaaccttagatctcactggtgggtccatgatcatccaattcatatcatattcaagttaactgtgaaagcaaggtttctctgtcgttgggaaggacattgtgaaatctgaccataaggcatttaatgatgtaagttataatgattaataatataaattttcactcccctgaggtatttaaaaacttattaaaataaacgtaatcattacccttctatgacttgaaaacaggcctccaaaactgcaggagaaaggatgaaatgtatttatttctaagttaaatttgaagcgaaatcacaagacaacagattgcaaatgtaaaattagattctagtgggaggtcttggtttcaagcctgttttttccctactggaggctgagcttgaagacggtgttggggggtgggggtgagggagagctaagattaaattgagacgaagttctgaaagttttcgctaaatcgttacaacccatgaaaagagttttgccaagtcacacacaaataccctgaacaccagagactaagcaggaaagttttgcaacaaatataagatgatctttgattttgaaaagattattattttgactgtgtttatttttacttttcaaagattatccaaagcagaaacaaaacatatcattgttttcaagtcagattttgaagctcgggtttgcctttttcaaacataatccgatataaagatggtgaagcccagggataaatttacgagatcctgagggcaattcacagcggagaaaggatttcataggcacctactttgtcttttctgttttgttttaacgctaatgctttcgaattgtcagataggtgtaaccctaatccaaggaagtgattccaaattctttttcccacgagctacacacaacaatgatagtaaaacgtatctgtcccaccacctttgaagcatttccattaattcatacaaacatataggctcaaatatacatatgcaaacctaccttaaaaggcaacagtggtccccagcccaacttgctccaagagcactgtggcatttagatattgaggttggaaatgatgtccggatgaacagccacagggctggggacgatgtcagcacctgccccctgcggtggccatcacagtttcatctaagtctgtgagaatgcgccaaaaacctggagaggagcaggtcagaggagatagaaaaacagaaagaaaaggatgaggcagaaggaaggaaatgggcattttctgtcaaacccatttcgtcaattccatgacgtcaactttttgtgaaatactgtcagagacgtttgaaccacagcaactccatcttaaataggagctgggtacaatgaggctgaaacctactggtctgcattcccagatgcttaaggcattctaactcacgggatgaggcaggaggtcagcacaagatacaggtcataaagactttgctgataaaacagattgcagtaaagaagtccgctaaaacccaccaaaaccaagatcgtgacaagagtgacctctggtcatcctcactgctacactcccaccagcaccatgatagtttacaatgccatggcaatgtcaggaaattaccttatatggtctagaaaggggaggcatgggctgggcgtggtggctcatgcctgtaatcccagcactttgggaggccaaggcaggcggatcacctgaggtcaggagttcaagaccagcctggccaacatggtgaaaccccatctttactaaaatacaaaaattacccaggcatgatggtaggtgcttgtaatcccagatactcaggaggctgtggcgggagaatcgctggaacccgggaggtggaggttgcagtgagccaagatcacacctttgcactccagcctgggaggcatgaataatccaccccgtttagcatatcatcaagaaataaccatgaaaatgggcaaccagcaaccctcggggctgctctgtctatggagtagccattcttttattccttcactttcttaataaacttgctttcactttatagactctccctgaattctttcttgtgcgagatccaagaaccctctcttagagtctggatcgggacctctttcctgtaacaatatgacatcccaaatcaaatgatgcaacatttggatacaggcataaaatgacaggcttaaatcagataaataaataaatacacaccagcctatttacatttagggtaatacatagccctacagactaagttatcttattattttaatctatctgtgtatattaaggtgttggacaacagaaacaggttactacagaatgattcccatgtcccactcaatcttcagagtctcaagaaacagaaatgaaaggaaaccagcaaccctcagttattctcaaagtagtgctgtatttataacaaacattgaagaaaatgctgaaagagagtaaaacagaagcccaaatcacttacatagaactttccattgtatacacgttttcttacgaaggcaaacatcaaattcagagaaaatgcatgaagaatatgcacaggaaaaaatttaggtaaaagatccaaactgcaatttaacatggaaaatcaatggacaagagctccaggaacacgtggggttaatggggttgttttatttccttcatctttttaaagcctgctggtagaggtgaaattacaaatactaaggcaagcaaaagaaaggcctgaagggctctttgggtggcttcattttggtactttcttcccagacattcccctggggctgcccgctgctggtggtttcagcaggtgggaacctgagatgacaaacactttgagcaggaatatgaagaaaactgcctattttgtggaaaggagccacatacaggcagtaaataaatatatacgtctatccagaatggaacaataagcaaagacagttcttccttatcttggaaaatatgctatttaaccatgaagttagtgactcatgcttgcagggaaaggagcacgagttctcagcaataccccattattaccccacaatatattccctttccacaattcccccattgctacccggttggctccctttccctgggcatcctccttaaacggctctctgcgaatttccgaatttccaaagcagttcctgaattgcttaggaactggcagaaattaataagcaatagcccatttatgctgaaatggactcattacggtgccagctgccaataatttgcaaggctggattcttcctggcaaaggaggccggcaggcggctgtccttccacctgcacaacggaggctgataatgcattttctatactttaaaaaaattacgtattcagatagaataaaattttttctctatctatattcttctagtccctgaacaaaaaaatatataaataaataaataaacaaaaaaaaactatacagagagaaagggcattatttgaaaaacacgaaggaaagcaaaacggagtcgatttggtataacttctttctgactttcgtggggaaaaaatttgcctatgaccctggttgcggaactgatccatgacatggactaatgaagagctccacaatcagcagatatgctaaggtcacaatgtgccaacaagtacgtatccatttcccttacagcaggttaattgtctcatggccttgtgaatggatgccaccatggcaatttgggaactatcagtactctgggttttctccaagagctgcaaagaactcagtttcactgggagacagctacgtaccaagctcagtgttgggagtccaagctgggagtcgggctgcacgcatccggtcatatcttggctttgcaagtcaaatctttactttcagcgtgacttggggcaaactctaaatgtcctatccctctaacaggtggggatgataagattcctaaatcattgggttgtcatgagcattaaatgagatcatctatgttacagaatttgcctcgtgcctatcccattatcgtttctcaataaatgttaccctatctcaggatcggttctcaataaacattagctattatttccactactatttaaaatgtttaaaccataaagaatgtgctacagaatgggccagtattatgcaggcttccttagcaaaatgatacctaattcattgaaactgaatcatatgttataaattgaatgacatcagtcaccttaaatttgctgtggaacaaggagagttaactaatccagctagaagatgcatgcggtctactcaatcggctacagctcacacagacacacagacacacacagacacacacgcgtgcgcgcacacacacacacacagccatactgatgaaatccagcagtaccagtaggcctgcttacattatgttaagatgactcctagggaagcgaatgctgaaattaccaagtttttcagtctcactctgaggcatccttgatatggtttggcagtgcccccacccaaatctcatcttgaattgtaactcccacattcccacgtgtcatgggagggacccagtgaaacgtagttgaatcatggaggtgggtctttcttgtgctgttctcccaattggtgagtaagtctcatgagagctgatggttttaaaaagaggagtttccctgcacgagctctctctttgcctacggccatccaggtaagatgtgactttctcctccctgccttcctccttgattgtgaggcatccccagccacgtggaactgtgagtccaattaaacctctttcttttgtaaattgcccagtctggggtatgtgtttatcagcaggatgaaaatggactaatacaatcctcaattcatatggccaatttctgtgtcatgtgtcaaataagcagttttcacaggaaaatgtgtgtactggaagtattaccaaaactaatctcaggcttcaaatacccgcaaaaattgatggggctgagaagtcccactgctccactcctgtaatattatttaagatgaaaatacggtgtcagaaatactgtgtccacagcatttaatccttggcttttccaaaaatgtctgccaaaccagaactttctttttcaccttcaaagtgtcaaagacacttgggggtgggggggcaggggacagacacagtggctcatgcctgtaaccatagtgctttgggaggttgaggtgggaggatggcttgaggacaggagttcaagaccagcctgggcaaaacagtgagacacccacctctacaaaaaataaaaaaaattagctgggtgtggtggcgtatgtgtactcccagctacttgggaggctgaggtcagaggatcccttgagcccaggagtttgaggttatagcctgggcaacaaagtgagaccctaactcaaaaaaaaaaaaaaaaaaaaaaacaacgacaaaaaaacacactcataagggaaattctgtcatttttaagtccttgcaagttccaggcatcagtgtgtagagaaaaggatactgtattgtatttgccctcaaaatacccaggttcaattcaggtgctattacttcataaataaagtgacttttggatagtaaattacccattctgaaaaccatcagaaaaaatgaggacgtaaatattatttgtcttatcaatacttacctctaataccttttcttataggaaagaaattagataatcaacatgtaacactataaactataaaatttatgtaagtatggaaattcttactgtgtttactacgatttagtgtccccaaattttccataaccagtagtttaatgacaatcaggaggttttcctttacattgagcttaaacagtgggggcagaagtcttggatcaaaatcctaaacatgtatttcatatgcaataagcaccaacagcctttagcttttaacagtcatacttagaccccaaatcagtactgacagataaataggtggatggtagatgggtagatgaatggacagataagtggatggatggatggatggatggatggatagatggacagacggtgatggataatagatatatggatgaatggtagatggatggatgggtggtggatggagatagagatatggatgaatggtagatgggtggatggatggatagagtgatagtggatggtgaatggataattgatgggtggtaggtggatagatggatggtagatgggcagatggatggatgtagatggatggatctagcacattagaaaattttaagtggctcagaaattaaagaagtttcatcactttttaaactgttacttaagaaaaaacttgggaatgacttctaaggatacacaatttaaaaagtaataggaggaatgagggtaaccatgaatatcctgttgagctacacatctagctccatttaacagtaagctttataacagccaagtcaaataggaaaaacatggcagttgtaaatttcacaatgtccaaatcgatggctcaaaggaagcacaaaagttcttggttcttggtactcggatcaaacaggcatctccactggtgttcctctgaggccactgtgatatgatgagcaatgctctagacctcatccttccacggaggctcagtgacaaatttcataggaatgtttcttgtcttgaaaattatttttttaaaaaccgcaattcagcagcaagcagccgtcttgaagacgcaggatactgctgcagagtggacagacagtgttccttccaggaaattcttcttgagcactgcctgccctccacggagtgcagaagcatgactgagtgggggtgaccttgagatggactctctggctcacagctgattgtagctgggacatgctgacagatgaccacaccccatctggtgtaaagccactgttttcaccaagggtgtgtctgtctggcttctgtgaaagctgagatagcaataaggattcatgcacaaagcttcctaccttcccactgacggccctggggcagggccaggactcccagtgaaaaaccaatccctccgaacagatgaatgagccatgataagggccccaagttcctactccataaagcatgaatgaaatagttttagccccaccatatttcaaaggcaggtataaaaagacacccaaatcagaaaattattaaaaagtccccagaactttccatatccacagactgccctagttttgggcaatgttacttcctaatgtatccaaatatatcctaaataaactaagcaagagaacagattcatacaatcaatatgtttaagtcaaccacaagttgggaactatctaaaatcataactttaattttagagcggtaaatctttgacaatacttaatcaacaggttcagccaggacagacattaccatatttcttagaagtaaagtcggtacatttcaaagtgaagttactatgtatgtcaacttagggcgagctaccatttatggaaagcttactatctggctggcactgtgttcatggcatcaggccaaagtgctctttagacttcccctaagttcttggtgtttatcaccttgcaactacacctttgactgacagctgccaacatactgcaacactgacaccacatcacttcctgcaaagcttcctcccaacagggtttagaagccaccagacccccaagggctgtgttacatggccagtgtccaaatctcccaaatattcatacagcctgactctaggaatggttcaaatgaggccccagctcgctgaaatggatgtaataactttctcaggacacaccatgagaatcatgtgctttctccaaaatccaagcagcatctcttttcccatttctttctttctttcttttctttcccttttttatttatttatttatttatttttgagatgaagtgttgctctgtcgcccaggctggagtgcagtggcatgatctctgctcactgcaacctctgcctccgggattcaagcaattctcctgcctcagcctcccaagtagttgggactacaagcgcacatcatgcccagttaatttttgtatttttagtagaaacggagtttcatcatattggtcaggctggtctcaaactcctgacctcaggtgatccaccctccttggcttcccaaagtgctgagattacaggcatgagtcaccgcgcccatccccttttcccatttcttaaagccgcaaagctactgaacacttgggaattccacccaacactccaagagtagtttccatggaatgctagaacacagctttgggctcgctcttggctcctaaattccaagtttcagtcacatcaaaaaagcacgcttacatcgtaaggcagggtagaacatttgatccccaaagaaaatagaaatggagctgaatgtcattaacttctaatgcttagatctgtcctttgctatttcaccacactgtggcttaacgtacagggtgttccctgtgagagaactaggtaatctaagctcgtgcaagaagacagtgggagaggacagtattcattctcagtgttttcatacctcctatgaaacataagagagtaataatccttaaaccgcacaccaaaataatcgcctcaagaacatatcaacaccttggtttagaagagatgtcaaaatcaaatcactttatccaacaactcattttccaaaattgagccacccttaggtctcttcccttggacagagctgcctcccactcccatgtaagttgtagaagctgcaacaggcacaggaggaagccacacttcctaggacacacagcagggggggtggagggtaaacagagctcctctttcactgtcaaagactgaagttccaggaaaggaatttttttattttttatttttttgagatggagtctcgctctgtcacccaggctggagtgcagtggtgcgatcttggctcaccgcaacctccacctctcaagttcaagtgattctcttgcctcaacctcccgagtagctgggactacaggcatgtgccaccacacccggctaatttttttttgtattttttttagtagtgatggggtttcaccaagttagccaggctggtcttgaactcctgacctcaagtgatcagcccactttggcttcccaaagtgaggaatttggttctaattctctgttttccaagcctgaagttcagccttgagccagcctggagacaagggagtctccattccaagggacatggcccaacatgggaagtcagggaaaaaggcaccgcaagggactctcagactcagcagcttctgtctacctccaagacattctccagacctgccccagtgacccaaaagcacgaaagtgcaacctgcaatttccctgatggcctctgacccctacagcctggcttcccctaacctgttcccttaccatgcagccaagaggaaagtctttcagccaaaaatacagtcaggatatcaagaggtccccttccttcatcaggaagcagaacaggatgtggtcatcagctatgatttcattccccaagccacccccccaagccaattcccaacccatagctgccttcgcacacagaggggtgtggccactctggaatcagggaagagcttgtggggggggcggtgaggccatgaactcaagaggccagggtggcaactaagcctgttggcaacaagggctgggactgcctgcatccagacaacagagaagataatcccaagcactgctggaaaggtcacggggatggggtgtgaaaatctgccttgttgtccctggatgctttgagcctaaagggcccatccaaaaagaatcactccccccatggacttgctgctttcaccttggggctgtctctgctgctgttgcacttgtgttgacggcatgaaattcttttaacagaacatggttaaagagagatttcacgccaggcatggtggctcacatctgtaatcccagcactttggggggccaaggtgggtggataacttgaggtcaggagttaagagtccagcctgtccaacatggtgaaaccctgtctctactaaaaatacaaaaattagctgagtgtggtggcccacacctgtaatctcagctactcgggaggctgaggcaggagaatcgcttgaacccaggaggtggaggctgcagtgagcgaagatcacaccattgcactccagcctgggcacagagtgagattccgtctcaacaaataaattaattaattaatcaattaattaaaataaaagagagagttcagtcttccagataatgagaaagcttttaaggctatgacattgtaagtggagaggaagaaagagaatctagaaatattaagtatgtaagtgtgtgtatatcattgatcagcaacttaatttaataactaaaaggtattgggcaagtatgatagttgggaaataagagtttccatatgtaaaaagtgaaattgtaataggatcctgtgttgcaccattgctagggggatattatgaatatcatcaaccttgatatgtgtttaggtagcataacctaacagaaggattttaatcaaagactaaataaacatcgcagtgcagcaaagaatattgcattttaaagttaatgatttaaaaaaatatttaaagggtccaggcacagtgagtggctcatgcctgtaatcctagcatgttgggaggctgaggcaggaggacgacttgggcccaggagttcgagaccagtctgggcaacatggtaagacctcatgtctatttctttaaaataaaaatatttaaaggactgggcttggtggctcatgcctgcaatcttagcactttgggaagccgaaacaggaagatcacttgagctcagaagttcaagaccagcctgggaaacacagtaagacatcatctgtaaaagcaattaaaaaaaaaaattagtcaggtgtggtggcatgcacctgtagtcccagctactgggatggcttgcccgggaggatcacttaagcccaggagatcaaggctgcaatgagctgtggctgtgccatggtactccaccctaggcaacagagagagatcctgtctcaacaaattgtgtgtgtgtgtgcatttatttatttaaagaaattcttcccacagattttcaaaatacagatgattcttttgaaagagaagaactgaggttgaaacttgaggactttgtcagaggtaccacaagacagagtgacgtaaccatggtcaaaaggccttgagtcccaagtcactccctgggcacttggtcccaaattctcctttagtcactcctcattttaaaatggaaaaaaaaaatgaccttaagtttttatttgcaaatcatttcaagttgtttcacagttatacaattaagactacaagctctaacatgtaaaaacataattctttatttcattgattttaagaaacactatttttgactcttaacatctttgaaattgaatatatcttacaatcacaatggtgtattggggtttagtggtgccattttctctgcttcttagtggtatgcaaaatagtggtgcattttacaaatgacagcatcttatgaaaaagagtatataaaaataggcttctaaatagctacgcttagggctatctaaaaactgcttatgaattgtttgggtaagacagagtatctatgtagaattttactgatgatcacacattcagttcaactcaaccaacattttactgggcacctgttatatgtttggaatgaggaaatagaccatttctttatgatgcatataatctgggaagacagtgggcatctacccactcagacagggctgtaacagctagtctggcattattaatagtgaaggatgtgaagaaatagactaattctgctaggagaggctctcggttgaacctggtcctgacaggttaataggatttggcttagcttaggaggatgagaggaaatgaacagggataggagagagtttacacaaagagaaggacagaaatttccagtaaaagagaagggtataagcaaagactctgaggaatgaaagtatcattagcccaatgttgcagtgaggcgagtgcatgggaaaaagctggagatgatgaagctaaaaagatgggctggggctatggatgctacacaaaggaactgaacatgattgtatttgatgggattacacgatgagattttattatgggagttacatgatcaaacatagttttcccacctgggtagcttggaagagaagggaaagacttattgcaagccatcaataagttgggatggcccaacggggacagtgagtgccttggagtagtgagaatgacaggtaggatcaccaggactcggtggccacatacatcctttgaggaaagaaggaggaagaacaaggaggcatagacttctctgaagttcctggcttggtaactgaaatggaaggtgacaataacaccttccactctgaggtataatcaagcaccagattcaaatgttatccctgaggggccacaattcactcacagtgatcttactggaaatttggtgtccattccacaaaggacctcaaaaacaaaggactggaacccactagaacagcaatacagttaaaaaacaaaaacaaacaaacaaaaaaaacaaccttcctgccttagtatgtttgggctgctataacaaaataccttagactgagtaatttataaacaacagaaatttcttgctcacagttctaggggctgggaagtccaagttcaggttgccagcagattcagcatctgatgagggcctgttcctcacagatggcaccttcctgatacatcctctcctgatagaaagggcaaacaggctccttcaagtctctttcataagggcacgaatcccatttatgagggcagagcactcatgacctaatcacgtcctaaaggccccaccgcatgatactatcacattcaggtattaggttccaacatatgaatttataccaacattcagagcatagcaactcccaaaaaacttagatcagggaggatattggaatggagacacaaataatggccaattccaatgcagatttatggaacttaaaacacacacaaaaacaaaaccaaaccctctaattatccatgagaggccagaagtttcaaacattatctcaaccacactttgtatggactaaatcaatacctgtaataataaatggatttaacagcttcaataatttaatgcaaaaataaaaataggatgcctcagccttggcatcataaagttaaaaagtaaatcagatttgggttcagtctccaaaatattctcaggctgcaggaaacccaccatgctgttgactcacatcttgaactcactcttattatttaaataagatcactgaatgcaggcaatgatcaaagctgtacaaatcacagtgcaatatatctgcaatgcataaataagcatgcccaagtgccacttaaacacatgtagcatttaagaacaatcatttaacttttctgtgagtgtataaaataagaagtcaatagctttgcaacaccatgcagatctcaggcaatgccctggtttatgtgagtgaccagaccagcaaaggatgagagtggagcacatggtgatgggcacagagggatggcaagaaagacatgggttaactatgggacacaagtgacttggcccaactctcctaagcacccattctttttaaagttaggtggatggtctggaagtttttgtgctccctacgcctggaaagaagtccatatttctttaactttctcaagtcaaaacccacgggcatcacaatggtaaccaccatgagatttttctctactgggtattcttttttcagtataggtgattcaattaaggcaaaagtaccactgagctggaccccagaaaagtgacctaagctcatttaaaagccggtgcaagatattttggctgtacaacaattactgttcatcctagccaaatgacaaattgggagagaataaaaagcatatgaagtcattgcgaatcagatttgttatgtagaagaaaacaaaaatcaaacagagcccatattcccctccctaaaaatcataagaggataatcagcctcttttaatataaaggcaattcctggggagtcatgggaacgtttctcaaacagtgatacatcagtccccatgcagaaaaccgatacataaaatcacaaagcaaatctgtttctagtatgacagcaacaggctttaaaagcctgacattcactgccaagtaatatctatgggaccacacacaagggaagtgaaacagacactaggcttgccctctacgaatcaatgagtatactcctgtccagggcactatgatgcaaatggttttattggcatcaccattcaaaaaaatagttctaagcatgcccaccccgaagagtatgcctaccactgctgatttatttaatgtatatatacttgaagtactgttcaaatacattatgcacatttcaattttctgtatgtatttatatagcacataatttatttgaaccaacagaaatctaaaggcaaaagatgaaacataaattttgaaatttcctttcatgccctgatgaattcatcttgcacattcatctgatattgaaggccagtgctcaaggaaatacagggccgatctgggacctaccaaaaaaaaatcaggaaaggcaacttgtggagaactcaggctcaaaaaacaaacattggctgggcatggtgactcacgcctataattctatcactttgagaggccacagcaggcagatcacttgaggtccggagttcaagaccagcctggccaacatggtgaaacctcatctctactaaaaaaaagaaaaaaatatataaaaattatccaggaatgacggcgcgtgcctgtaatcccagctactctggaggctgaggcaggagaatcgcttgaacccagaaggcagaggttgcagtgagccaaggttgccccactgcactccggccccggtaacagagcaagactctatctcaaaaaaaaaaaaaaaaaaaaaaaaaaaaaaaattagcaacagattatggaatagctttttaccaaagaggatctgttttctgctgatggcgactgcttttgcaactagcaaaccccacctgtgtttcctcagtttccccatctgtacagtcaaaatattatctacattttagccttattacgaagtcatatcatgtgcgagggccaaaatctcccagaatcttcaggaaggtagcacatcaccattaaggagacatgtgctgatatcctctggctcctctgaaatcatctggtgatagcactagcgctcactagggaccactaaattcagctgtgcttttgcaacaacgataataacaaattatcccttcaccagtagttaataaaaccgcaccatatgtagaagaagaaaattataagacagaagggctcatctccacccaccacaagtcaagacaatactgtgtattgtgattcaccaagatgcagtaaacaaaaaaacacctttccaaccataactgcatttctcagtgtgggtgatttcagacacagccagggtaagaagccaagaaatttcagttctacagtctggaagaataaaggctaacaacaacaggcaatgaaaaattatttttaaaaaagttatacaaaacttttctcctcatagatagaaacaacaacaacaacaaaaaagcttaatcttccagaaacctgtctctggccagcttccaatccagaaagtctgctgatgatggaaggagctctccttaggaactcatatggctatgacctcccatctgcatctgatcctgctgatctgcaccccctccaaaatacacacccttccctcaaattccatgcctttatttatttatttgtttatttatttatttattgagatggagtctcgctctgtcgcccaggcgacaacacaatggcgtgatctcggctcactgcaacctccactcccaggttcaagtgattctcctgcctcagcctcctgagtagctgggactgcaggcatgcgctacaacacctggctaatttttgtatttttagttgagaaagagtttcgccatgttggccaggctggtcttgaactcctgacctcaggtgatctgcccgccttggcctcccaaagtgctggaattacaggcatgagccaccgtgcccagccgaattccatgcctgtataaccctcagatattcctcttgccccaactgtaggttctgcccacagccttctacatggctccatctagttccttccagactctccttcttcagcacaaatccctctttctcacctcctgggattatcctactgatgatccaccacttagggtcaaaacctttcacccttatgagggcagcgtgattggtaaatgtaacataggcttaggatctgagagacctgatcctaacctgccattcactgcatctgtgaccttaagccagccacttaatatccctacgaatcactttctccatctgcaaaacaggatacctgcctgcaggtttgtgctgggaattaagtgaggcaatgtatgtaaacacactttttcttggtatttagttggagcttcatgaatattcatttctttctttcctcttgtgtccttcttccccttgttcttccccgaaggtccctgaagtatcttctacatcttgtctcttctattcctacccttctaatccaggtcaggtcaccttgctttcaatttccttttttttttttttttgagacagagtcttgctctgtggcctaggctggagtgcagtgatgcgatctcggctcactgcagcctctgcctcccgggttcaagtgattctcatgcctcagcctcccgagtagctgggattacaagcatgcgccaccaggccaggacaatttttgtatttttagtagagacggagtttcactatgttggctaggctggtctcaaactcctggcctcaagtgatccacccgcctcagcctcccaaagtgctgggattacaggcatgagccaccgtgcctggcacttttttttttttttttaagacaaggtctcactttgttacccaggctggagtgcaacgcggtgatctcagctcactgcaacctccacctcctgggttcaagtgattctcatgcctcagccctccaggtagctgggatgacaggtgcgcaccaccacgcctggctaatttttgtatttttagtagagacatggtttcaccatgttggccaggctggtctcgaactcctgacctgaaatgatctgccctgacctcaggtgatccacctacctcagcttcccaaagtgctgggattacaggcgcccgccaccatgcgcagctcatttttgtatttgtagtagagacggagtttcgccatgttggccaggatggtcttgagctactgacctcaagtgatttgcccttctgggcctcccaaagtgttgggactacaggtgtgagccaccgtgcccagccaagatttactttaaagaattggctcatgcatttgcgggggctgccaagtttgaaatctgcaaggtagggttggagacccagggaaaaaatgatgctgcagtttgagtccaagggcatctggaggcagaacttcttccttctcggggacctcagtcttctgtcttaagatctttgactgattggatgaggcctaccaatgttatgaagggtcatttgctttactcaacccctactgatgtagatgttaattacatccaaacataactgacagcaacatctagacatctagactggtatttgaccaaacgactaggcaccacaacctaccaagttgacagatcaaatgaaccatcattccccacacaacagactttttctccagtgcctagtaatgccatcaatattagccaaaggaagaaagagaataaaatgtattcccacagaatgtctacaatgcaatatccaacaggtgctcctgacagactctcttccatcccacaaggccacctgtcctgtgctctgaagggaggtcagctcaggtgttccaggtagccacagtctccggggcatgaagaggtcgctgcgaagagcggcaagtcttgcagaatgtcttcctttccatatatttcaagacaattgcaaccatccaagcttttgtctcttggtagccaacatcatcaagagtggtgactaccttttatttcaacatggaaaactgcattaaaatatatttacagattggaaaacacacatatccaggaacaatgtggtagtttataccacagcttctgattcttgaaacagccgctacttttaaccaccctccctcccctcccaacaaacataaattatggaggtcctgggtacataagctaccctgttggtgttatttctgctctagtcttggatctgaaatcatcaccctctcccacctctaagccaagacttcaagcacacagcatggtgagggtggggggtgtccccagcaagtcctcaattccaatgcagctgggcttaaagttcagcatgaaaggccagcagtggggagggaggttggaatgattgttcaacagcctcccactccctgctcatgactaatgcatcatactggcagagcatttcctcccagctagtaagaactgacaagtcacatttaaaccaaaccaatgccaagaaggctcaggaggcactcagcccctccaagccctaactatacccctttctgaaaatacccatctagagagaaagcaagctgagagtgttggcttaggagtcctttctaactctgcttctccaccacagagcagggagtttgaattttcaagggtcaaaacaaagaacatacatagtgggtaagcaattggtattccattttgagcaccagggtaacctgttaacttcgggaaaatcagttaatttctctgtggtttcaggttcttcctcagtaaaatttagcacctagtaagggctttaaaaatgttgggcttcacagaaaagagagccgttgggtatggtatgtaaagagaaaaaacatgattgtgggcatcattaatgtagagatttatttttccagtagtgattttccattcaaaatagcatccatgagaagaaggagggaaattaatcaagtgtattcactaaatagagcttggtgatcaaaataacatcagccttctggttctgcggctgcctcactcgcacaagcacggggaagggggccccgcacacggcctgaacgcatgttggcaccagggtggcagctcttgagccacctgtttggttctgtttctctcactccgtccccacactcacaggaacagcctgccatctgcgctgcgccacccagcacagctcggttttccataaaggtaaataagatcctgacgctagttttcatctaaaaatttcccttcaatttatggcttccagacctccatctcaattcaactcaaccccattcactgtcaccatatgcttagcacccaccttgtggatggcatggttcaagattccacacagcatggtaggacaaggaaggtttaagacttcttaaagggtcttaaagggccaggtgcggtggcttacgcctgcaatcccagcactttgggaggccaaggcgggcggatcatgaagtcaggaaatcgagaccatcccggctaacacggtgaaaccccgtctctactaaaaatacaaaaaattagttgggcgtggtggcaggcacctgtagtcccaactactcaggaggctgaggcaggagaatggcgtgaacccaggaggcggagcttgcagtgcgccgagatcacgccactgcattccagcctgggtgacagagtgagactccatcacaaaaaaaaaaaaaaaaaaaaggtcttaaagattatttgggtgggtagcaatgaagacatgagatggggaccccaaaaatgtaatctaaggctcaaaagttaggtgccatacgataaactcagaggctatgaagagggaggcatgcaacttaatgaaattctttatgatgaacagttaacaggttatcctagtactcaaaaggaataccaattgccacaggatggtaatagagctgagagtctctacaattcaatagatgcccttaacaggacaaaggtaaagaatacacgtaccttttgagaatatgcacattaggattctcaggttcttgactctgattatttttgtttgtttgttttttgagacggattgggctggagtgcagtggagcgatgttggctcactgcaagctccgcctcccgagttcaagcgattctcctgcctcagcctcctgagtagctaggattacaggcatacaacaccgctcctggctaattttttgtatgtttactagagacgggttttcgccatgttgggcagactggtctcgaactcctgacctcaggtgacccgcctgcctcagcctcccaaagtattgggattacaggcgtgagccaccgcacccggccaactccgaatttttaacctggatttgatgattattcaggaaaatagtatgatcattttggtatactatttaatgtataatcagaatactattgaaatccttgggaaaggaaacatttctatttctgggggtaataaggagtatttggatatacttttaccctaaaatcctggtatagaagagaatactcattccaaaaaaaaatatgcacacctcaaaaggtttaaactttatttaaatgaacaaaaacagataatttcaaattttcgactatttatatgtgaagtggatgatcttcacctaaaagtgacagaggacttccccaacggagccccaaatcaaaaacaaccattttaagacaggcagaaatgacaaaatacataatttttaaaactcctgcttatgcatgaatcatctgcaagataatccacaagagaaaaagataatacttaggtgctgacactcatgtctcttctatttcaaatccctggctgaagaagaaacaaaatgagtcttcttatcaggggagtccagggtccttttagtttcaatttgagattggactggaattttttttttttcttgagacagagtctcgctctgtcacccaggctggagtgcagtggtgcgatctcagcttactgcaacctctgcctcctgggttcaagcaattctcctgcctcagcctccagagtagctgggactacaggcatgtgccaccacgcccagctaattttttgtatttttagtagagatggggtttcatcgtgttagccaggatggtcttgatttcctgacctcataatccgcccgccttggcctcccaaaatgctgggattacgggcatgagccactgcatctggcctggactggatttctgatctgcatttctcaaaggcatatccttgacatcccttctcctaaactcatgctactaactcttcagggctgttctagaggaacgttctagggatacatgcacccttccaacttcatgctatgtaaaagaatggcactagcggtgagtaaattaagaaaatgaataaaactcaattacaatttcacattatataaaattagagggtatacttgaaaacattatgctaattgaataaaccagacaaaagaggacaaatactgtatgattccactaatgcggggtacctagaacagtcaaactcattgaggcagaaatagaaaggtggatggcaagctgttggtgaatgggtacacagttttggttctgcaagacgaaaagagttctggagatggatggtggtgatggccacataacagtgtgaacgtactttcctttgagacggagtctcgctctgtcacccaggctggagtgcaatggcgagatctcggctcactgcaatctccgtctcttgggttcaggagattctcccgcctcagcctcctgagtagctgggattacaggcacctgccacaacgcacggctaatttttgtattttaggtatcaccatgttggccaggctggtttcgaactcccgacctcaggtgatccacccgccttggcctcccaaagtgctgggattacaggcatgagccaccgtgcccggccaatgggaatgtacttaatgccactgagctgttcacctgaaaacagttacaatggccaattttgtgttttacgttagggttttgagaccccaaaaatatgatataatgctcagagttaagtgccatacgatgaactcagagggctatgaagagggaggggtgcaacttaatgaaattctttatgatgaacagttaacaggttatcctagtgctcaaaaggaataccaattgcccgagtatgacgatacatatattatggcaataaaaacattagagggtgtaataataactgctatttgcagggtgcttcataatttgaaaaacgtttctatgtacattagataatctaatcatcacagccacctgggtgggggagggcacatgacttactcttacacccatttctgtgtaagtggcctgtccacagctgagcggatggagtggcttgactgtcatgagaacccaggtgggcttccttccaaacctgcagtgcccacttcactccgccaccctgccttccaataactatgcatatttctgtagaaatacaggaatgttaccaggtgctccaagaaatatgcattctatggccaaagttgggcactccaactccaacagtaacgaaatggatttcactttatttaacctagtgttttctaaactttcttaatcatgaaaactgattttgtaaactgtctattgaaaacctgtgaaagagttagtgtgtcatggtgactaccgcgggaaataatcttaatgaaatgtgctcagttctactcctacagattccatctacttgtaataatcaagtgatcaaggtgtttacttaattggcatttccaaatatcagtgtcatggctggccagctctactctcatctggtattcttccctctctaattgtctgtcttccctcatctaaaactttccatcaaccataaaagtaccacacataatagaccatgaagaaggtaatcactaacgtgacagacgtcatccttggctcctgtacttcttactcaccaagcatggatcagatcagatccaattgagggtgtgtgtgtgtgtgtgtgtgtgtgtgtgtgtgagaaacagagagagagagaaaaaaaaacaatgagagagagagagagagagagagagaaaaacagatggagagagaactgggccatgagaagtataatggtatatatcctccccacctcaaatcccttttcacaggcctgctacaaatgagtcagagaaagaagcaaatatatcactccgtgttaaataaatgttatcggaggagggaggcgtagggcgaacaggaacacaggttcaacaacaatacttagatttggagtttaatatacctcattagcagtttcttcacactaatggaaacaaaaacatcagcaaccacagaccaaaatttctaatcatgggtttcttgtcttgttttgttatgaacacagtgcatccaaaaacctttaagacaaagcaacaatttgttcaaaaataatttataatatgataggcatatttaattattgaaaagacttcaatagctccttctgggattcaattaaaaataaatgcccctcccctatgcctttcgcagccctcctttttaagttgtaaacctggccatgctaccacgtcaccaccttctcccttccatgacatttctgagaaggcattaactgctgacactggcccaggcttcagtggagaaaacactaaacctatcaactgttatttcttgttgggacttgcactgtttgttacgtatgttcaatttataatggagtttgtcagcttattttgtttgaacttgacacaatgggaaaagcccttacgggttaattattaatcttgaaatctgaaacagataatgaacaggtcttgagcaactgtgaaagagacccaacagcattagtcaaaatagggactgttcctagacgacagcagtctcaagccccaaggcacgacgttacccattatgtggtagggagtaagggattcatgcttggggaatgggcttcagagccagacagaatcggcggggattttgcctctgctgcttgaggcccaaatgacagtggaaagtcatttcacatcaccaagcctcggtttcctcactggtaaaatgggaataataagagtacatggaacaatctgttggaaatcacagtccgctgcctgagccacagaagtgatcaataaatggcagcctggaaaaaccaaaggtcggatctttccttacgtctgcatgttgattggtcatcataatctccagtctcctgagctgacagagcttggatgttgtccttgcccaaatctcatattgaaatgtcattcccagtgttggaggtggggcctggtgaaggtgactggatcacgggggaggatttctcatgaatgggttagtaccagccccccttggtactgtctttgcgacagtgggtgagttctcgtgagatctattcatttaaaaatgtgtagcacctccccactcggtatcttgctcctgctcccctgactccacactctggcatgaatggaagtttcctaaggtctccccagaagcagatgccagcatcatgcttcctgtacagaacggtgagccaattaaacctcttttctttataaattacccagtctcaggtatttctttatagcaatgcaagaatggcatgagccataataactggaatttttcaaaaaaaataaacaagtatgggaaatgctctctgaaattagtgcctgaattcacagaatctcattccttattgattacaatgaaaatacacaaactctttcatggccagaggaaggcacaacatagaacagagatgggggcatcctgaacccctcgtcaatgataaacgtcaaggataagaagtgtcaatgcaaaggaccactgacttgtaaagtaataatacatcaattctctagcttcttcacatctttactacaagtttttgcaaaagattattgttgctaaagattaaagtcacagacagttcatcttctaaacgtaagtaactattgttgactaaagatgaaaagaagcaaaaatgtaaggatcttggaaagaacattgccaatggcaaacattatttattgctccagaacttatcagaaaggcacaaagcaaatcagagttaccaaatagagatacggtaaaatgctaattctataatacttagattttaaaagtcacacttttgaggcataatcaaattccagctatctcatggtaggaggtgccagtagtaaaatgtatttgctgctaagttgactcaagaaaggcagcaccaaaaacatggcttatagtagacaacccccagttatgtatgaaagtaacagtaaggatgaaactgcattgtgaattttggagccgagtgagattataagatgtgatcactttttgttaacaaccatacacaacagctattatgaatattcccagtgcttaggacaggggcgagaatggaagttgtatcagctcgaatgcagatgtgctatcctcacgagttctcctggaaggatccagaccacaacaaggccaggaagccagtggcctgtttctagaaggcctaattcctaagaactagattaatacagtggaatttaaaattctacaataaaaaccctgggttcaatttctcattcttctctagattctcttaataacagcccgtaactatggaacacagatgagggtattaaaacaagacaccattgggattctacagcacaaaagaccagacaggaattacattctaggtaaattaatcaaaacatagaataaataggtagttatccatccatgctatctaggtgggattttggcttagagaatgaaaacattattcaacatagaatggaagccaggcacagtggctcacgcctgtaatcccaacactttgggaggcagaagagagtggatcacctgaggtcaggagttcgagacaagcctggccaacatggcgaaaccccctctttactaaaaatataaaaattagctgggcatggtggcacacaactgtaatcccagctactcaggaggctaaggcaggagaattgcttgaacccaggaggcagaggttgcagtgagctgagattgcgtcattgcactccagtctgggcaacaagagtgaaactccatctcaaaataaatagataaatagataaataaataaataaaatatatataatatatataaaatgtgtgtgtatatatacgtgtaataaataaaatatatatgtaacatatataaaatgtgtgtgtatatatgtgtgcgtatatatatatgtgcatatataaaacatatataaaatggagatgtaaatagcctgcaatgctatccagagtcaattttaagttactttttgtttctctaaaattgtattttaatttaaattacagggccagcctgaattctgataagaaattcacttttcctcaggagaaagaaaatgttttcatggcattgttaaaaaatgtatatatctccacttttttaagggttaaaaatcactttaagtaactgtcttatataaaattaaacctttacaacacaaaaagaaaccacttccagtatattagtcttggtaatatgaatatatttaactatcataacttcaaatgcaacatttcaaccttgaatgttttcacattgttttgtttaaaaacaaaacccaaaaagtcttaaggaccttcagattccaacgcaagagcaacacattaatgctgtattaatgaatgctgtctttgacataccgcaacccctcattctcttccacgtaaaaggctctagtgctacaacataattgccaaagtagaagctgttgtgttgtttaagttctaagaatgagctgggcaagaagacatttcttccacttaatgtaatccatgttttcacactaactccaaacgcacaacactacaccacaaaagccaggatgctgcataacggccaagtctgccttcctaaacatctaagagattttcttttcaaggagactacactgcttgcactgctttctgtagaaaaagatgaattatttcacacagattctggtaaagacagtctcaggaaaagatcattatgatgtagactgccattttaataaaattaaaatctatctatattttctggagctattttcctaattgatgttgcttgaagattttaaaatctcctgaaacagcaattgggaggcccattttactggccaatatataattccattagtaaggcagactagcaaagaataatcatatcaatttcctaatcagctgcaaccatgctgaatttgaactggcaaactctgatgtgtaagttgctagctgtgatcttcatatcactaaaacgaacaagataccattctaacaactttacacagacatagtctaggagacattgttctgccatggtcacagtaacaaaaaagtggtataaaatcagttactttataaatactgataatttgcagcaataaggaacaggacattaaaaaaagtaaattttcccataggacacctatgactaggaactcttcctaagagaagccaaagttttaattattcagtttcacaactactgtactgggttacctactctaagaaagaaaaggtgctctacagaggtttcccccacacacaaagaatcagcattaattgagcatgatctctgtcattcacagatctggcagattcattaactcattttaaatgaataaggccaacaggatgcgggaaggtgtggctgattgagttccagggctgtatctcagcttattgatggcaccccattaggaaattgaatacaaagaattggtttttttttcttgtaatgttgtcatatttaaataacttttgaacttaaaccttctggcttacagggcagcattgtcttcatttaattagcatcaaaatgatttataattttcaaaacaaaaaagaactagacctttaaaaaaacaccctcagggaaaaaaatcaccaaaagaaaacaaaaagtggtcgggcatggtggcttacccttgtaatcccagcactttgggaggctgaggcgggtggatcacctgaggtcaggagttcgagaccagcctagccaacatagtgaaaccttgtctctactaaaaatacaaaaattagccaggcgtagcggcatgcacctgtaatcccagctactcaggaggctgaggcaggagaattgcttgaaccctggaggcggaggttgcagtgagccgagatcgcactactgcactccagcctgggcaacagagtgagacgccatctcaaaaaaaagaaaagaaaagagaaagaaaaagcaaatgagatagtgaatatgacatagctctgtcccagggttctactttcaaaagcaacgaaatagaagatgctggcttggtggggcttctgagggctctggccttcatttggctgtgagagctacacacatgttcatatacttcacttactcctctagcaaagaaaaagttctttttccaatttcctcagaaactccaggccaacgtaaaggtttcctatctaagttagtatcagaggcataagaaatggtaaatatagcaaccatgcaaataatgtgtagctagagggaaggaaaacgaagagaaggaagaaaataaaattaaaaagtaaacgacaaaataatcttggaagcttttgtgaaaagggaatcaggatacacagattaaatcccagtctgaagttttgaaatgctctttattcattggaagctatcaggaaaagctgcttttaagaaatccatcttacagcctcaaaattaggggcccagttcaattccactcagccaaacaagtaccgtatgccacaggtaagagcaccgtgctaaaatatcaacgtggttaagattctttttaaaatgtggttgtggttgctgaaaattcaataagacaaaaagaatttttcagtcttagtaaatcctgacaacagattagaatattgtatcattggtatgtcttgaattttttatttttgagaccgagtctcactctatcgcccaggctggagtgcagtgacacacccagtggcatgatctcagctcactgcaacctccgcctcctgggtttaagcgattctcgtgccgcagcctcccaagtagctgggagtacaggtgcccaccaccatgcccggctagtttttgtatttttagtagagatgggttttcaccatgttggccaagctggtctcaaactcctgacctcaaaagatccacccgcctcggcctcccaaagtgctgggattataggcgtgagcccaccacacccagcccattgaatttctaaattcacggaactcctgtctccaataaatatctttcatcacactgctctgtagtaactttatatgtgtacaagagacagacagacaacatttataaaataaatggtaaaaatttaaaatattttgctcaacaaagatgtgcaactagaagtgttcattaggccctcactccactaaaatgctgacttttaaaaaatctacctataaacaatgttttaaattaaatttggagccaacagttttcactgattactttcaatgtggtaaatgagaataaaccatatagaaaattagatgataccgaataagcgattggttctacaactggccaaaaaggctggatctcaggactcagcagcaagggggtagcaaatagattagggaaggagcgatgggcattaactctgaaataaaaataaaaaaaaaaaaaaaacagttcttagcctttttccttctttacaggaccttggatgagaattttaaaacaatctccaaaggttccactgatagctgcccctcacgggggctcacctccttctctctcacccacacctctctttaaaaagctgccctcctagctccctggaaattttatcaacggccagttgctgagagaaaagtgattacgacattttcaaactggggttttaacatgactgaacccctcctgagtcttttaataatttgtatgagaatttgcctggaggcgcagagctacccttctgtgccagtttatgaattctaaacaggcctcattttttcaatttaggcacaaaaacaattctccctaaaacctccaggaaaaaaaaatgtctatggcttatttaacccaatctaactacaagatatactttttttaaaaacgtggtgactggagccagaaggtgtctgctcacgggggtgactgccatggtggtgtcagaagccccaaagggcaagtcccccaggggaggaaccgccagtgtcctcacaatccaggcagagcacaggatggtggcacacaacgagacagaggagcacacttgaaggggtgcctgcaggccaaatcagggacaatttgagtaccaaaataaataacagaatggcctggcaacccaccaagacctcatctctacaaaaaatttaaaaataagccaggcatggtgacatgcacctgtagtcccagctatttaagaggctgaaggaggaggattgctcgagcccaggagtttgaggctgtggtgagttctgattgcaccactgcactctggcttggatgaaagagcaagaccctgtctctaaaaaaaaaaatcaataaataatactactagcagattataacccactgaataaaataggaaactacaagtccatatagagagaaataaaattggaaatctgatgagaaagaagagacttatataatttcaaagtatccccccacaaaacatttactaacatttctttccttcacaaagaggaaaataataacttcacaactgggaaggctggcaatgctgtcttaaccaagtggccaaggtgagtagacagcatcagaagtaggacaggccaacttcgggagcactcagagaacacacaggaggaggacaccctacatcgtggcctgtgatgtgtctgccagtgatgcaacgatccaatgtggagtgaatcgtgagaaaacatctgggcaaaccaaactgaggggcattctacacaacaacttgcctggactcttccaaagtatcaacgttgtaagtccaggaaagactgtgcaactgttcctgactgaaggagtctaaagacacgagacaatcacgggcaaggcatgatcctccactggaaaccttcgccgttttccagcgccccgattgactggcaggaatgggtcagctcatgctgtgactctgacccctgtatggtggctgtatagaacagttgccttgaaaaacactaatgtctttggtaagagccaaagacatttggtactctcgaatgatttagagaaaataaaattcttcatactgcattgcatcgccaacttttctagaagtttgtgtcaatttcaaaacaaaaacaaaatctcaaacccgacggctgatttattcttagttatgtatacaggtgaaaacagatatggataactgatataatggaatgaggcacaaattaccacatcacttattctactaatgtgagaattaatgacaatgtataaaatttgctaattttgtattagaaaaaacaaaaggccctttagccacatgggttaatgtgctcttcttgtcctcaccagagtatccacaccctcagccagcaggttgtgcaaattcagggctttgctctgtcttttcatgccaagccactcttatgaccattaccaaccctctgagtacacggagggctaagaaacacctcctgcatccaagagtcccaggacaccatccagaacacggccagaactaaggaaccaaataggaatccttgtcaggtcttctgctttcaaaggccatgctgtcacagactgaacaaacacatgggttctagtcccggatctaccccggagaactctgtggcagtatcacactgggccttggttttgctatctggaaattggggaggtgggtgcgatcatctaattctgatcaaccccaccagcatttaataaaggtctccccttttgccaggtcctggttctgtcttcaaggagctcaagtctagcaaggaggggcttgcaaacagatgcctctggacaagtgaggggtaaggggagaggggccattatctcattagacggtacaggctccatcctgttcaggaagaagacactggagaggagggaaggttacaggaagatggagaatctcagttgaatttacaagataaaaaatagaggtttccctaagtgaaataaaaggatggggagaagagagccaagttaattcaatcagagtcaatactatacaatgggctgggtgcggcagctcacacctgtaatcctagcattttgggaggccaaggcaggcagatcacttgagaaacgaaatcggaatccctgtcagggttcaagaccagcctgggtaacatggcaaaacctcatctctacaaaaactacaaaaattagttgggcgtggtggtgtgcacctgtagacccagctattcgggaggctaaagtaggaggactgattgagcctaggaggtggaagttgcagtgagctaagatcgcgccactgcactccagcctgggagatggagtgaaatgtcatctcaaaacaaaaaactaaaagctgcacaatggttcgtctgcatgaccttaggcaaggtaggtaacctccgtctcatttcctcgtttgtataaggaagataatggcattatctaactcatccttgggaggagggttaaatgttttcatatattctatatgcctatatattttatatatttaatatttaacctgtaattattaaatcactaatatatggtttatattatatattaattacatataattattttaaacatttcataatttaatctacatttactatattctaaatgcttcagtcgccaggaatgtttactatagtatactctataaaaggacctggcacattgtatgcacgcaataaacgcgtgttgtaatttgttatgatgatattgataatatccattataatttggtgtgattcgggaaggggatgcaatgtgtgtgtgatggaggtgggagggttgcagcaactcgtgcaaccagctaatgccagatgagccagctgccagaggccaacagacgccaggacaaggagtttgaacttgattctgtcaataatgagcgtcattctgttgtagtccctatgtacagcctattgattctcaatttaacaagtttggttatctggtttgacagcctacagcaaactaaaggctgggagttgggggggttagtgctgatgcagaggaggaaacagggatgaaaaatgaagcaactataggaagcaaatgcaattagcttgaaaacttcaccattctgggccttacaagctcaatgacctccacctcaccaaatctctgcacgatataccgatcaattctgtgggagggggaaaaaactgactaaagatcaatttagagtaatttaacatattctgtcaaagacgactagtaacagatgaaaggtttaaaggtcttccaaaattaagctgggtgcggtggcacaacctgtaatcccagcactttgggaggctgaggtggacaaatcacctgtggtcaagagtccaagaccagcgtggccaacatggtaaaaccctgtctctactaaaaatacaaaaattagccgggcacggtggcatgcacctgtaatctcagccactcaggaggctgaggcaggagaatcacttgaacctccaaggctgaggttgcagggagccaagattgcaccactgcattccatcctgggcgacagagtgagactccgtctcaaaactaaataaataaatgaataaaaaaataaaacgaaactcttgcaaaattatttgaaaggtgaaaagcttttaaacttattgggaaaaaaatctttcagcaggaagagtcatgtgcctagaattctagagtcctagaccggagagtctggctggcgtccttctgaaaagtcatgagaatgcttcacaaatgaaaaaaatgaagatgtggcctacaagccctggagagctaggatcagtgagaaactcaggacaaacttaagggcatctctgaagtcagcatagatccctataagaaactatatgaaaaacccaaatctgatttcaactaaaatccatcatgcgtgaccagacattcattctggctctctgagctggatataaagacatcatcaggcaaagaagaaaagtctccagcattttaaaaagtaaaaaacccaaatccccttctttcccatctgtgagaagctcataaccacctaacgcaaaaataagtccagaaatgcaaatcaaatacccagctaccaagtgaagtaaattgcacagctaatgtcttcctaatagatacacttcaccttaagattaagtttaaatacccaacagtggcagagatgctaaatcaattcctttttcacctgggaagtaaggaaatgtacatttccaggcccatcacagctatgtgggggccacacgcctgagttcaggccagtgaaatgtgggtgcaaggaatgatggccacttccagaccctgccccagtcacgtccctggaaggcctccaagctctatctctagtattccctgcacaccaaatgcagagaagccaggtgaggattctgagagcttagaaccaactagatagaggaagcttgggtccttgtatgaccacatggcgagagagaaagcagtcccctcccacagccagccagctttggcctgtgacataggcagtaagtaaacctataaatccatgaagccactgaaattccgggttgtgcgttacaagagtcagccaccctgggtgaaaaatggccttgggttaacgaacttctgtgagaatcttctaggtagtcacaaagctaccaaaaccactccaataaagtctgggaaatttacccccatggaggttaaactaatttcacagacttacaaccgggacacacctgattcctaaaaatccaggtcactcgctgcctttcagacgcagaaggtaaccactccctgatggaaaacgctacctactgcatttccttctactaccaatttggtgaccccaaaatgacaaagcagacaagttagaaaagtgctcttgttagcgtagccaaaaaccctaaaggaaaggttacacaatgcaggatgagagaagaaggatggcactaacaaccgtcattgaggaaaatcatgtaaggcaggatgtcaaaatgtttatttctacagcaaagcatactttgcattttcggatatttacatttagctcagtgactcgtgcaatgcaatcctctgacaaagggccgcattccaatttttcttaagagaaaatagagtgcaaacttgtcttagcaagtcagcaacacctgcattggcttggcaggactctctcacgatatgtaaataatgaactgccaataagctcgttccagaacaaaggagaagaaatttgattcctctccctgatgtctctgccatcaggaaatggtttttttgtttgtttgttttgtttttttttttgtcaaatttggaggaatattgtcaaaattgctaactcaaggaggaacaaagaccctccaaaggggagcaggagggcctggattgggctgccagtttcctaaaaaggggatggacttcagtttgggaacaattcatattactaagaaattgtcttctctaagacattacccaatgaaagactaaagctttaaacatttaagtcaaatcatttcaaatatgcccaccatgggttccagggattatggcccaaacagaatggaaggtgatttatcatcacccttgtccaaataatttcctgaagaccatctgacacctgggtctaagcaaaaatgccaaaacagctccatttctgccacattggaatgtatcaagtgtgtgatgagcagtccatgaattgagggggagaagaggattctctacatctcctcactagcctatttatgcctggtacttacttctacaaaagtctctagtacccacttcttcacatggactgagcagtgattgagaatttaacctctgcggccagaaagacaatgagaggtgtgatagttaatactgagtgtcaacttgattggattgagggatgcaaaatattgttctgggtgcgtctgtgagggtgttgccaaaggagattaacatttgagtcagtggactgggagaggcagacccaccctcaatctgggtgggcatcatctaatcagctgccagcacggccagaataaaagcaggcagaagaacatggaggggactagactggctaagtcttctggcctccatctttctcccatgctggatgcttcctgcccttgaacatcagactccaagttcctcagcttttggactcttggacttacaccagtgatttgccaggggctcttgggccttcggccacagactgaaggatgcactgttggcttccctgcttttgaggcttggggactcgaactggcttcctggctcctcagcttgcagaaagcctgttgagggacttcaccttgtgacagtgtgagtcaattctcccaataaactccccttcatatatacatctattctattatttctgtccctctagagaaccctaatataagggagttaaccacattaaacatcagtttttcatccatatatgaggttcctaataatgaccccctcccaggtgagccatgagagttaagcacataatactggtcttggaagggaaacaatataacaggtgagttagcgtcattagtatacgcagcatgtagtggcagatcccttacagatcatgggaacatgaggaataatgagatttcaggagttctaaaaaagaccctccttgttcacaaaacactttccctaaccaaaaatttcactgtttgatttttaaattatttctcttcttaagaaacatacatacacccaaaaggaaaaaaatctgagccttatccgtatgaaggtgttttcactgaatccatccataataatagggtcactttacaatgagcaaactgaggcttggagaggtcaactatatggcccaagttctcgaaagtagctgagtagaaattccaacgcaggtccacttgctcttaagttcatgctcctttcccggaggattctgctagatacagtaactgcattctccctaagggaaggtttttatagccagacagaatgacgggaagaaaagaaaaaagaatatgaaaataggaaaaaaggcgaatgaaagaggttaggttatgatacagaaatgtgtgccagggggcatccttttaacaaaggtcaagccctctgagacatagctcagcaatcttctccagcccacatcacacacaacccttaaattacggcagctactcacctgcctggtgcaaaaagaatgtttctgtgcatagtgtgtccaatatattatttaataagatacgacaagcccaaacattcttcttgcaaattgttcagagtggtgcagaagccaagttttcatgcgtaattttcttttctaagaatgtgaatacatttatttgcagcagacatttgcttttagtatacttaataatcctggaaattcagtatgtttctttccttaaaaatcaacatgatacctacaaaaagtacttccggagggggatgggggtgaggaggagtacaccaggaaaattgtttagctctttgtgtgttttttttccactacatttactttaataacaaatccttgcagttgagtttcaatgttattctgagtcttctgggaggctcccatctgggttccaaataatcaccatttgcaacatttgtaggtgaacagactgttggttcacaatatagagaaaagaaagattgttcttttaatgtcattcatgatatgtgggggcaaaataatttattaaaaaattcaggagttcaatagagcacactttattttttttgagacagtcttgctctgttgctcaggctgccatccagtggcgcaatcttggctcaccgcaacctccacctcccaggttcaaccgattctcctgcctcagcctcccaagtaactgggatttgcaagcatgcacctccacacccagctaattttttgtactttcagtagagacgcggtttcaccatgttggccaggctgatctcaaactcctgacctcaagtaatctgtccgcctcggcctcccaaagtgctgggattacaggcatgagccactgtgctcagcacacttttttaaaaaagattaaacagatgcttttgaaacaaggccagagtgcccattcacttagttaatgcagtcagaatggacaacttaacagattctcagaaatcctaatgggagtgtaagatgtgattcctgcatggtagacaaacagtacaactgctactaagaagaacaatgtttatggaagaattacgctatgaattttacatataaaagctcattcagtcttcccaacaatccagagagaaaaatatcattattatcaggaccatttctcacttacaaatgagaaaagtgaggccaaggaggagaagtctcccacatgaaatggttaactagtggccaatcacactgacccttggcaaggatatattttttttaagttttactatcacagaaaatcagaacattcagcagatttaagctcactgatattagaggtatcctgagaataactgtggataaatgatgattggcagtaggatatattatataaaatgttagtaagcccactaaactctttgaccctacctatgaagaagaaaaagggccaacatagtcaaagcatttaatgaaaagaaagcaaatatttctttaaattgctcccactgccctaaatatatagtaaaacaagctgcacatacatcagtttttcttaaacagggacccatatttttatttctcaaccccagtacacacacataatagcttggtttactttttatcctattccaatatatttttttagaaatattggctgcaaaccactaaaattattttataaactcccaaaaggtttcaaccctcagttgaaaagcgctacccagacggaaattacaattttgcacacggagctatttgtatttttaaaacgtgcatgcttgtaaagggtaggggtcacacagacttgctaatttcagcgcttctgcataggccctgggaatggacccaggacaaggatgcttagcacacgatccctggaggactttcaaaggtatctgaaccttctggaattgagtgtaaaaattatgtgcagggacgtacctgcatttgtataaagagcagttccatggcttctaccagctttataaaggtggggtccatccaagtttcacgtatttatttatttaactactttaattttttggtgagagtcgccaaacctcgcaccaaaaccacattttggttaaatataaataaaatcaacatgcaatgaggctgggcgtggtggctcactgtaatcccagcactttggaaggccatggcggatggatcacctgaagtcaagagttggagaccagactgaccaacatggtgaaactccatctctactaaatacaaaaaagtagctgcgcatggccgggcgcagtggctcacgcctgtaatcccagcactttgggaggccgaagcgggcagatcacgaggtcaggagatcgagaccatcctggctaacacggtgaaaccccttctctactaaaaatacaaaaaaattatccaggcatggtggcgggcgcctgtagtcccagctactcgggaggctgaggcaggagaatggcgtgaacccgggaggcggagcttgcagtgagccaagatcacgccaccgcactctagcctgggcaacagagcaagactccctctcaaaaaaaaaaagtagccgggtgtggtggcgcatacctgtaatcccaactacttgggagactgaggcaggagaatcacttgaaccagggaggcggaggttgtaagtgagccaacatagcgcccctgcactcctccagcctgggcaacaagagcaaaactccatctcaaaaaaaaaaaaaaaaaaaaggacaggcgcagtggctcactactgtaatcccagcactttgggaggccgaggcaggcggatcatgaggtcaggagattgaggccatcctggccaacagggtgaaaccccgtctctactaaaaatacaaaaaggcgggtgtggtggtgcacgcctgtaatcccagctattcaggaggctgaggcaggagaatcacttgaacctgggaggcggacgttgcagtgagccgagatcgcgccactgcactccagtctgggagacagagcgagactcggtctcaaaaaataaacctgcgatgaaaggagatcatcaaccatgatgaccctgaaattgtgtcacaaaaatacggccgactgtcaataaccttcactcatttcttctacatattgagtgcctaccaagggtgatccactgtattaagattctgggttaaactggaaaaggaggaagttaaatgagaggtaccctgatgtcctctgcagtgttctagtataattacactacaattctgaaatccacaaaattgaagattgtcacctagctgtttcctgcctcccacagagaagctgccagaatgctctgaaagaggatgagtttaaaccaaaaatcgtatcgttttatcactgcttgttcccaattaacagccaaaatatttcaaggaaaggtttataccgattgagacaatggtgacatgtagccaccctcagatgaaaaggcatgagcatttttcataaaggagagtattttgtgagggctaaatcaaaaactgcattcccacttgaaagaccattaaaacactaacagtgcattcttctcctcaccctatggctgggaaacaataagctctgtcgctaagaagtaatcaggactgtgtggtttgacccttatcggatctaaggtgttctgagccaagataggattgtgtgatgggcatgcctatgcctcttgtttccttccacatcaaggattcgcaactacagcaaacttcctggcctctctgagccctcaggatggctctgggaaggtgagtcattgatgtcaacagaggagagagtttgggagaatgacccacacatgcctagataaaacccttctatttcacttgcttaggaatccaggcctctggggaagtcaaggttggaccaccgtggatcgtgaggtaactggaaagatcctgccccccagggagggaggcctgttatccagtgccaggtctgcctaggtgggtaagtctacctaactcaaatggccagggatgtccaggaaacctacgttgctgtacctctgagtcacaacctcaaatcctatatttaccgataataaagctgagcttttggtctccacttgctgaaccctttgtttgtctcagttggtccagaaattaagcaggaaaaagagcttctcaaatccccgtaagctctgtcctctccatcttctcaatttcaagtggattgacgacacttaaaacactgcttggccgggcatggtggctcaagcctgtactcccagcactttgggaggccgaagagggtggatcacctgaggtcaggagtttgagaccagcctgaccaacatggaaaaacaccgtctctactaaaaatacaaaattagccgggcgtggtggcacatgcttgtcatcccagctacgcgggaggctgaggaggagaattgcttgaactcgggaggcggaggttgtggtgagccaagatcgcgccattgtactccagcctgggtaacaagagtgaaactccatctcaaaaaaacaaaaaacaaaaaccaaacaaacataaaacactgcttggtcgggcacggcggctcacgcctgtaatcccagcactttgggaggccgaagtgggtggatgacctgaggtcaagagtttgagactaccctggccaacacagtgaaacccagtctctactataaacacgaaaatcagccaggcatggcagcacgcacttatagtcccagctacttgggaagctgaggcagaagaatccctagaacccaggaggcagagggtgtagtgagccgacatcacaccactacattccaacctgggcaacagagtgagactctgcctcaaaaaaaaccccaaaaaacaaacaaacaagaaaaaccccaccactgcttaactcatctgtgactttccaattttaggacaaaagtacatgtgcctacttgatgagacaactataggtcttattcatattctcaggcagccccaacacagcagagaagttcctagaaatcaaaacataactaatgacccagctcaacaggatttcaaaatgaagatatttttctttaggttactgcacaatcacagagtaacagcagctttgcagagtgagttaaacagtaatttgggtacagctcccaggtctttgcagaaagaggatcaaattcttttttattttttgagacggtctcagtctgtcacccaggtgggaatgcagtggcaccatctcagctcactgcaacttctgcctcccaggctcaagtgattctcccacccaaggttcctgagtagctgggaccacaggcacatgccaccacacccggctatgttttgtatttttcatagagacaggagaaagggtttcaccatgttggccacgctggtttcgaactcctgagctcaagtgatctgcctgcctcagcctcccaaagtgctgggattacaggcgtgagccaccgtgcccagccacaggataaaattctgtcattcaaagtgaatttccaaaataacaaatatcaagggtgagtgtcccaagacattcccacagcctaataaaatccaggatgaattatcaacaatttggtagttagtcaagagactctactctgtatatagagcatccaagaacccaaaacctactggttcctacttagattttctatttatgcatctgattagcaaaatctgtcaattttatcatggtaaagccaacaaaatttactactttggaaatagttctttttggctttgagtctgggaggggaaaaaatggaaagagttctgcatataaatcttcctgatgttattttgtctttatcttgataatgttactagaaagataaaatctgattcagcctggtttctcattcaggatgcttcctccataacacaacattacaagatgcccttcgagttggtggtttttgtttttgttgttttatacaaagacagggtctcgctctgtccctcaggctggagtgcagtagcgcaatcacagctcactgcaacctcgaactcctacactcctgagaccctcctgctccagcctcccagctggctacaattacaggcctataccaccatgcccagctaaacctctgagttttgaatcaaatttttttgtgtctccagcacatcacaattgggcctcagtttctactcatttggcttcccatcatgaagtacagcataaaggttgccaggccttttgtttctggagctttactttctgctgtgcaacaagctaaacacccagacagtgactaaccagccttgagaagggtgaactgataaaaaaaaaaatacatgttccaaagctgctcaactggtgtacaagtgcatagttgagtccccgttttcaattcttttgggcatatacgtggaagtggaattgtggggtcacatagtaattctatgtttaacatttggaggaagcagtaaattctttttcacagtagctgtgctattttatgttcccaccaacaatgcacaagggttcgaatttctccacattccttccaatactttattattttccattaaaaaaattactataacctggccgggcacggtggctcatacctgtaatcccagcactttgggaggccaagacgggtggatcatgaggtcaggagatcgagaccattctggctaacacagtgaaaccccgtctgtactaaaaatacaaaaaaaagtagtcgggcatggtggcgggcacctgtggtcccagctactcgggaggctgaggcaggagaatggcatgaacccgggaggcggagcttgcagtgagccgagatcgcaccaccacactccagcctgggtgacagagtgagactctatctcaaaaaaaaaaaaaaaaaaaaaaattactataacctttctagtgagcataaggtggtacctcaccatggttttgatttgcaatcccctacagatattgagcatcttttcatgtgctaatttggctatgtgtatattttctttggagaagtgtctatccaagtcctatgcttattttttaaattacatgttttgttgttgttgctgagttgtttcatcactgtttatagcagcattattcacaatagccaaaaaactgaaacaacccaaatgctcatttacagaggaataaacaaaacatatgtatatatacacctatgcttacatgtatataaacatatatataaaagatacatatatatatcatcaacccaaaacaggaatgaaattctgacacatactacaacatgaatgaaccttaaaaacacgatgctaagtatgatgtatgattccacttagacgaggtacctggaataggcaaattcataaacagaaagtagaatggaggttaccggggcagggaggtggaggatgagaaatgggagctattgcttgctgggtacatattctgtttgggatgatgaaaaagttctagaattagatcatggtaatggttgtgcaattgttcacttaaaaatggctacagtggtaaattttattatagatattttatcaaatgcaaaaaattcactttacacttctgaatatcattagtcaaaaaaaatccacaacattacaaaaaataatggctttggtcaatgatggttgagtctgaggtctccaaggcaggaatgagccagaaaatggcattcagggtatgtggtatcagaagcttaggtcaaccccagctgcacactgaccagtgagcaatggtaggtgactccctctacctctcagagcctcgctaaatgtggaattgaaaaaaaggagagttgggctgggcgcggcggctcacgcctgtaatcccagcactttgggaggccgaagcaggcggatcacttgatgccacaagtttgagaccagcctggccaacatggtgaaacccatctccactaaaaacacaataattagccagcgtggtggcacacacctgtaatcccagctacttgagaggctgaggctgcaaaattgcttgaacctgggaggtggaggctgcagtgagctgagatcacaccattgcactccagcctgggtgacagagtgactctgtctcaaaaaaaaaaaagagatctgggtacagtggtgtgcacctgttgtcccagctacttgggaggctgaggcaagaggatcacctgagtccaggagtttgaggctacagtgagctatgattgtgctaccgcgctccagcctgggccacagaaagaagggggcggggggggatgacctgagagttataggacaggtagaggaaattccctatgtgctcagtgcagggactggccgaagaagccattcagcatcggcaggcctgcacctctgcctcggactcaggctcctccacataatctgaggccggtccacactgccttctcagagtacgttatttcccatgctctactgtttgtttgtttgtttgtttgtttgtttgtttttgagacggagtttcgctcttgttgcccaggctggagtgcaatggcgcgatcttggctcactgcaacctccgcctcctgggctcaagcgattctccttcctcagcctccagggtagctgggattataggcacgtgccaccatacccagctaatattgtatttttagtagagatggggttttgtcatgttggccagctggtctcaaactcctgacctcaggtgatccacctgcctcggcctcccaaagtgttgggattacaggcgtgagccaccacacccagcctcttctgtgttttaaaaatagttcaggacagaattttaaaagcaagtaaaaattgctccttataacataagaagccaaactgattgaaactttaacccttcttgacagccttcaaaaaccatctcaggccgggcacggtggctcacacctgtaatcccagcactttgggaggtggacagatcacctgaggtcaggagttcaagaccagcctggccaaaatggtgaaaccccatctctactaaaaatacaaaaattagccaggtacggtggtgggcacctgtaatcccagctactcgggaggctgaggcacaagaatcacttgaacttgggaggcagaagtggcagtgagccaagatcgtgccacctgcatgagactccatatcaaaacaaacaaacaaacaaaaaaacaaaaaaaccaactcagcagagaaagaaataaaaatctagaaagaaatcatctaaataggaatagtgaatacctttgatagttttgattgccatctttttgcttagccatatattctagtgttcctataatgaatatgcatgattatctaagaatatcatatgcaaaaaggaaagaaaatactagcttggagtccagcttctcccaagtctccttgctccttcttctcctcctggaccacagtcttccctctcactctgtgtgttgcatctgcctcataatgatggggaggacaattctagctcgtattcacaaaggtgtacctgtggagagcactcctctaagtcatgacacacgtaaattcatgtcctactcacgatacctctatgggtgggggggggtgccatcatctgccatcttataggggaaggaactgaagcctggagaatgacagcaacttgccccctgggcaccctgctcgcctgtgacagccctggcttcaaacccacactgaatcctgaacccagtctcttggcctcaacaacctggcccctcctgtgggtgtttctacttttgccactgcctgtctctgtgtcacgatgcattgacttttctgtcacctccgccacactgtgaagcaggggctgtggccctacccgaaacagctaacccacagtctgtccactgaattgagttatggctgaatattaggtcccaaacgcaatgacattttaaacctatctacacatgcaattgtatttctatttccacaagggggtcaagcaaccactggtcacttcagccaggcggggcccacttcatggttttcccacagaactcccgcaggtgagacaaagcgcccctcagggaactcggttccttggtggagtccatggtagaacgctgtaggtgcacttcagggctccacagccaaagtaaagaaagatgagaggccgggcgcagtggctcacgcctgtaatcccagcattttgggaggctgaggcatgtggatcatgaggtcaagagatcgagaccatcctggccaacatggtgaaaccctgtctctactaaaaatacaaaaattagcaggtcatggtggtgcccgcctgtagtcccagctactcgggaggctgaggcaggagaattgcttgaacccgggaggcggagcttgcagtgagccaagatcacgccactgtactccagcctgggcaacagagcgagactttgattcaaaaaaaaaaaaaagaaagaaagtgcatgaagccataaaaaaagtggtgctaaaccagtctgaaaagactacacattgtaggattccaagtatatgacgttccagaaaaaacaaaactatttagagacatcagtggtaggccaggcgcagtggctcatgcctgtaatcccagccactttgggaggccaacgtgggcgaatcacttcagccctggagttcaagaccaacctggcaccatctctataaaaaatttaaaaattaggctgggtgtgatggctcatgcctgtaaccccagcactttgggaggccgaggcgggtggatcacctgaggtcaggagtttgagaccagcctggccaacatgacaaaaccccgtctctactaaaaataaaaaaattagctgggtatggtggtgcgggcctgtaatcccagctacttgggaggctaaggcaggagaatcgctagagcccgggaggcagaggttgcagtgagccgggatcgcgccattgcactccagtctgggtgacagagtgggactctgtctccaaaaagaaacacacaaaaatttaaaaattagctgggtgtggtggtgtgtgcttgtagtcccagctactcaggtggctgaggtgggaggatcactggaacccaggagttcaaggctacagtgagctatgatcacaccacttcattccagcctgggcaacggagcaagaccctgtctcaaaaaaaaaaaaaaaaatcagtgacttcctggaattagcaagaaaagggaagaattggtggagcacagaggattttagggcagtgaaactattctgaatgatactgtaatggtgggtacagtaatggccgcttgacccccttaaaaacagaacaatgactgcgtgcgtggaaaagtttaattcattgcgtttgggacccaacattcaacaataactcaattcagtggacagactgtgggtggatactgtaaaggagaatcacttgaacctgggaggcggaggttgcagtgagcttagatggcaccactgcactccagcctgggcgacggagagaaactctgtctcaaaaaaaaaattttatttggtgcctgcttatgggcagagggatgctgtccatgatggtgataacaacagtaatagtaattgacacttgtagaggacctactgtaagtcagacgctgaagaagtttcttaattttctgacaattctatcaggaaagtacttgtccccatttataaatgaagaatccaaagcacagagaactcaggcaacttatccaaggccacacagcctgtaagtgatggagctagtgatttttattcccacagtgctgctctcagccatcttttctgcctgtaacctttcagacagctgcctctagcctacctctgaattctaggattccatccacagggcccctaacattgccaaaagcaaagagattaactgcccaactagaatatgtgacattcaggctggagacaaagattttggcttgatttggtttccaaacaacaaaatcatttctttaagtatttcaaaaatgtttaagaaatattttggtaatgtttccctgtactgcccccaaagtacagggaaatggtgaatacctactccataccagcatccctcagtaggaccacaagggtaaacaatgagtacaccaacactgtaataaccaaaggaaagaacagaagtatttttttacaggccaggcacggtggctcacacctgtaatcccagcactttgggaggccgaggcaggcagatcacttgagcccaggagttcgagaccagcctggacaacatggcaagaccccatctctacaaaaaaaaaatacaaaaattagccaggaatggtggtgtgcagccgtagtcccacctactcaggaggcagaggtaggaagaccacttgagcctaggaggtggaggtgcggtaagctgtgatcaatcatgccactgcactctagcctgggtgacagagggaggccctgtctcaaaaaaaaaaaaaaattagtttttagtttcatactactagagaagaatcatggaaagatacattctcatagagtatgtttttagaatttactcagaaggggccaggtgcagtggctcatgcctataatcccagcactttgggatgccgaggcaggtggatcacttgaggtcaggagttcgagaccagcctggccaacacggcaaaaccctgtctttactaaaaataaaataattagccaggtgtagtggcgctcacctgtaatcccagctactcgggaagctgaggcatgagaaacacttgaacccgggatgcagaggttgcagtgagccaagatggcaccactgcactccagcctgggcgacagagcaagactctgactcaaaaaaaaaaaaaaagaatgtatacagaagaaggttcatctaaaataacataaatattcatcatgtatctggggaaatatagatacatttctaccttttaagtcaaaaagctggaaagaaaccagccatcagtgagttaagaggtgtcacacggagggggcattgaagaacccacacttttcaatatttttcccctttactgtttactttcacatgcaactgcgaataaaagcagtagatatactacacactggcatttagaaattgtttaaaatggagctaaagacattacatttaaaattgaagaagagcatccctttgcaaaccaaccgtgtttctcacgccctccagaccctccagaccctgctgaggcctctgcttttccactgtcaggcagagtccccctggagcaaaactgctgtgcatctgaacaccctgaccccagcgagaccccaactcccctcccgcaggtgagccactgaattcctcacctattaatgacatgtcctgattttgtttggttttgttctgttccatttttcttatagaatgccccattctctaggaatggagttgagcagctgccactctgtcctctgatcaaagttatggtcctctcctgtcttcctgttgtcccagctcacctgagagactttctgggaagagactcttagagggaaggggagtactatggcattcatggagaatccccagtgaccagcttggaaggcagctgaaattttcaaaggaacttcctgcctatctgtatcccaaactaaaaagatagaaagaaaaccaaacagctttaccagttaacaataccatccttcagtgcacaccatcagactccaaataatccatattaagtggtaaaagcccatgaactggaaagaaagaaggcttctgcaatgacaacaacaaaaagatagggcaagtccctagtatctcagggtattccccacgccctgcagatgtgcgtgatcatacacttcccaccaggtaatactcgggaagtatttaagatgctagatgaaaggcatttgttacccaggggcaatccccctaagtttcttgcagtggtgattaaagcgattgccctccatcccttccctaccttccagtgatgtgaggtttaactaatgtgcacttggggttttaagatccctagatgaaaagaggaccagatgtgaaagttattattattttgttcaaagtagacgggtatactaacatctgtgggcaagtttaccacacgccacttaaaacaggctaacagggtcatatgccaaaacgttcaggtttgcatttttgaaaagctcagagatctgacagatgtgttccggccgcgatttaacatgcggctccagtgagaaggaagcagatatgacaaatggttcacttatttcagaactaaaaccccagaggagcagcctgagccaaaaagggaagtgatcaatggaaaagacggtcgaatctgctcacaggcaaggcaagggggcaacacagagcatgtgcagggaggaggagctttctgtttggaaggtaaatgaaacactgggctgcagagaacccgaaattatcttcaagcattttttagccacgcttgaactcattctagaattcatcagctaagtacccttataggataaaaagtccctttcttcatcttctataaagaaagagatctgtgggctgggcgcagtggctcatgcctgtaatctcaacactttgggaggctgaggtgggcagatcatttgaggtcaggagttcgagaccaatctggccaacatagcaaaacccatctctactaaaaatagaaaaaattagcctggtgtggtgatgcacacctgtgatcccagctacttgggaggctgaggcatgagaatcgcttgaacccaggagaggcagaggttgcagtgagctgagatgtgccactgcactccagcctgggcaacagagtgaaacgccgccatctcaaaaaaaaaaaaaaaaaaaggaaagaaaagaaaacagaaaagaagaaaaaagatttgtgcctagagaaattgcaaaaataaagaccaccccaccatcaccctgcaccagtaggatccagactgtgtgagcaataagaaagtctaatcgatgcccaaacacaggcttactgagaaccatggtccacatgaaatggtgcgtagtctcctcccaacgcagctgtcagggagaacctatggacctaaaccagatcgtgtctccctagtcctatccacaaccctcaaaggcttcccatctcaccagcagtcccgcagaccctgccctgacgaccctcctctgtcttcatctccttggctctcccactttgctctttccacccaaacttccaacatgcccagcccagccctctgccctctgcctcgatgctccctctgtcagcacagggctcgcttcctcaaccccttgccatcttggctccaatgtcacccatgcagtggggccttcctaactcccctatgttcaaaagctcaaacacccaacacttccttgcttcaagggcctccactgtaacaatcaccttcccacatggtacatgttgtaactacagtcgccattccctatccacgggttcagtatccatggcttccatatctgtggactcaaccaaccgtagatcaaaaatattcaaaataaatcaagaaatgattgtgcctgtacttaacacgtacatattttattttattttttgagacaaggtgtcactctgtcgcccaggctggaaagcagcagcacaatcacggctcactgcagcctcagcttcctaggctcacatgatcctcccacctcagcctcctgagtagctgggaacacaggcacacggcaccacgactggcttattattattttttttttttattttgctctaagttctgggatacatgtgcagaacgtgcaggttggttacacaggtatacatgtgccatggtggtttgctgcaccgatcaacccgtcatctaggttttaaggcccgcatgcattaggtatttgtcctaatgctctccctccccttgacccccaccccccgacaggcccaggtgtgtgatgctcccctccctgtgtccatgtgttctcattgatcagctcccacttatgagtgataacctgtggtgaatttttctattttttgtagagatggggtctcgctatgttgctcagactggtctcgaactcccaggctcaagtgatattcctgccttggcctcccaaagtgctggaattacaggtgtgagctaccatacccagcccagacattttttcttgtcatcattccctaaacaatacagtataacaactattacctagcatttattttgttttaggtatccggagatgatttcaaatgtgtggaaggatgtgcctaaattatatgcaaatgctatgccattttccaaaagagattaagcatctatggattttggtgtcctcagggcagggaggggatgtcctggaacgaaccccccacaaatacgcagggacaacatctcttgatattgtctgtatccagaatgtcagttccctgagggtaaggatgcttcccagccttctgccctattgtctccttactacctgcaactgagcacgtgaacgcagtgaacacacagatgctgacttcaaaagtcaaagacaacccgcaagaagaaacgctgaggtcggctcccagaaaaatcctcgtaactgctcactttcgtgctaaggtgcctgtgcacacagtcctgacgactccttgtgggaagggtgataagactgaggcaggatttgagcatttctggtccccaggtcacagtacattcaaatacgaccaaatccctgctgtccgtaaccacccttgatgcaggaaagtgtggctaacacggcatctaccatatgaatcagctcaccagaaaatgcatccttagtgtccacagcgcagcacatggccagaaggaagaaaacaggaacatgaagtcagtgctttcacagctatgaagccgccagggaaaatcccattcttagagtatcagagcctcctgcttgatgagggattctcccctgctgcccagtgactgctgcccaagccgacaggctgcaaagaacttcaagaagtactataggtcaaaagacactttactagatgtcatgagtagaatgcagtgctgtgtctcctcaatttggtttgaatgttgttgctgtttcataataccattttatagagcagtttaaggttcacagcaaaattacgcagaaagcacagagatttcccatatacctcctgccccacacgcacagcctcccgactaccaagatctttcaacagaatggtctgtttgttgcaatcaataaacatatattgacacatcattattacccaaagtccatagttcacattagggttcagtcttggagctgtagattccatggctttggatgaatgtataatgacatgtatctaccatcacagtctcatacagagtagtttcaccaccctgggagcaccagtcctgtgtgccctgcctgttcatccctctctcctccctagcccctggcaaccaccttgatggttcttccatgttctttcatgactagctcatttcttttcagtgctgaataatattccattatctggatgtaccacagtttatacattcacttactgaagggcatcttggtcgtttccaagtttccaataaacctgccataaacatccgtgtgcagagttgtttttggttttttgcatggttctttgtattttttgtttgtttttgtttttcttttttgggggacagagtttccctctgtagcccaggctggagtacagtggtgcaatctcagctcactgcaacctccccatcccaggctcaagtgattctcatgccttagcctcccaagtagctgggattacaggcatgcgccaccacgcctggctaatttttgtatttttgtggagttggggtttcaccatgttggccaggctggtctcgaactcctgacctcaagtgatctacctgcctcagcctcccaaggttctctgtatgtttttaatagcagtttggtgtggggagacacaccgaaagagaaatgcaaagaatgaccttagtgagttagagacaaaatagacttcatactctccaagaaagtccctctttctaagaacacttttgagaagttaaatttggcaaagaattctagtgttagttttatatacacatgcatccatttctaatactatgattttttttcaagcacttcagatggatttataaactcggaaaggtaaaatgtgatttgaacattttcttttgtccctattaaataaacatgtccgtggaacttcgctgtagattccattatacttaggctatgttttcccaactggtactaccagcccacgtgttctctgagggatccactgttgtgacatacagagccagtgctaaaaaaaacaaaaatgctgggttgaatgcatttcaaagattcaaccaagtagtcaacgaagatgatgacaaactgtaaaacaaagatgcctacaaatttctggacacaggagtagaaatgaattatgaaagtaagcatccatcccaccaattatgtctcaaaatccatatataattattaaactgaagttgcaaaactgtaggcatctcaaggcagataggttcatcctttggaaaaggggagctcaccacatcaaacacagcctgcaggcccataggcccaaccagccacaatgactcccaggggaaaaatgaggaaggaggatgtcccagaacccaaacgtgtcttaaatgttattccaaaagaaactacttctcaactatctctaaaatccaaatgcattcctggtaggacagagcctaccctaccacactcctgaggactgggaatctccggctatgccacaccagcttgaaacatccaaccaaaaggcatttgaccaggccttccattggacagcactactttcctactgagggctgacattctgcagataaatttcccaaatcctgtatttaccactctaagtattcctgggcactcacacccactgccatttgtgagtcagaaagagggctggcaaggaagcctggtggatacacagacagaggtcacagaatgagggtcccacatgcaggatttcagtctgatttcaaacgatggaaataagaggcaggcaactcacatttcaataccaacttcatgtgctcttgagaaaagggaaatattgaacattcagatcagctttttgctttcttttaactacaaggtcccagcgaaaacataatccgtgtctaacatatccaattactgagaaaaagcacgtacatgctcctgtgttctcttcacctggctagtaacaaaatggtatattttcccattttatttaatttttctgctctcaaaattacttccagatcctattttttctttagttttcattttcatcctacatgaaaccccctactcctggagtaaaaaggaaagaaagaaaaggaaacaaccacaagttaacacggtattttaaaatacaacaccaaaaatataaaatccagccacggcatctgagactgaaagaaacaaataaataatgtgtaaataaataatgcagcactatcaagctaaaagttgagtcttggtacataatatccatattacaggctttgccaactatacagagagaaatttctatacactcaaggaacctaaggatgcaactcacagccctgagcaacaggctcaactaaggttgaagagtcaggaagagcccaggataagaactttggtctcctgacctctttctagcccagtgctcaccttctcatatttcatattaatgaaatactaactagcaaataatgataatcattttgtttaaacatacatgactgagcttaccagaaataccctcactcacctcactcaaaaaaacttttttttttttcaccaaaagagaaaaaccactgtgccctgagcaggaaccatttctagcagtatcaacactgccactggaaccacccagagaaaatgctcaaaccaccaccagggaactcgcgataaaacacccacactcacattcacactatgtatgtgatcattaaaatcaccctccaatgatctacaaaaaaaaaaaaagtctgttggttagagctcttcatgactaaatggctcatcagacatctgcccaaactagattcctctaaatattgagaaaggtgaagcagaaacactaagagtccacattggttttctgtcccaactcttaaaaagaactaaataaaccaggcatggtgatgtatgactgcagtcccagccactcaggaggctgaggcaggaggattgcttgaggtcaggatttcaaggccagcctgggcaacatggcaagaccccatctctcaaaagcaatttttattttaaataaataaatgaattaaagattgtagatgcactgttcactacttgagctaccaacacagggaaatcaggaccacagaggctagggtttctcagctgccccgagggctgaggatctgggtaggtgtggtttgtccgcctgggggctgctgagcctagtccaggcactttacttctctccaactccgtttttttcagcagtaaaactggaatattaacagctcattggattactttgaagattaaatgtcctgactcttcaaatttatcaaacttctagtttatacctctcatttgaacccttctaaacttctagtttatacctctcatttgaacccttctatgaactctctttttgttttttcttttgcgacagggtctggctccgtctcccaggccggagtgcagtggcgcaaacatggctcactgcagcctcaaccttctgggctcaagcaatcctcccgcctcagcttcctgcgtagctgggaccacagacatgcaccaccacaccctggctaagttttttattttcttgtaaagatgagccctcactttattgcccaggctggtctcgaatctctaggctcaagtgatcttcccacttcagcctcccaaagtgctgggactatgggcatgggccatcacgcctggcctgaacacttatgaattcttgatggtatatcttttcttcccttctacactgtaagctacgctgtaccccaaagatgatattctacactgtatcccaaagatgatattcatagctacccaacaaatgatttgttgaaagaatgaataaatgagctaaccataccaccctcccccccaaaaaattaatatgaagcatagtaactagatgtcactctcctaacctgaatacattaccttaccttggcttgttgagacttctgcaaatacattagaaagataaatagcaacagttactacgtagaggtgaaaatcggaaacgcttccaatcaacgcttatggctataggcttttccacttcgattcaaccccacgcttggtttgcatgcaggcaattgcaacagcccctagtgttccattctaaagctgaaaccacgaaaaatccattttattttcacttaatgtcaactcttgtgctttctttgaagagggattctgctgcctccagccctccccacctgggtgctgtttctttattatccccacctccccgcctttttttttttttgacttgggatctcactctgttgcccaggcttgagtgcaatggcgtggttctgactcactgcagcctcaaagtccttggctcaagggattctccccctgctcagcctccggaatcgatgggattttatgcaggaaacactgcactcggctgttcttcatcaatgcttcagtcctcattacacatattgatgctgtttgatcagcaaaaaaatcccactgataagggcacctaactgcgctatcttgactctccggggatttcagataccctcacctgcgcctccagtaaagctaacccaggcctctggaaagaatttttttctagctctgaaagtagttatctgcagcccatccctcccttcacagcccccacatggttcattcccatccccataagcaaaccgaactctgctgagcatcagttcggagcagagagaaaaggctgtgtgctttgagcagactggctccttcccaagctaaacacacttatgtgcatctgactccattaccgccccagcctgcacatgtaccagggcgcccagcctttccggaggtgagcttgtgtttacccactgccatgggagtatttcccagtcagcctctcctccccacagtggagactggctgcaaccacccgacccccaacccaggcaaccaaatgtgacatccaaggagttcccggagtggccatctgtccctgccatgccaatgtttacgcgacatgggcaggagaaggacaggccagggaagcctccagggtatcttgcatcagacccaaggcatccacatcccaggccgtttgtgccacaaaacaaaaacagtgaaagaagagtcctctgtctaaccagagaggttcccggttcctaaagagaagcatccatctctttaactttcctgagggtgttcaaagaaccagcctgatacgtttcacctgtggaccaacatctaaaaataaaatgagatccctaattttgcagtttttaaaatattacctcaccctccccaccctccacaaagtgaaacctaaacatggtatttcagacaataatgacttcaacaagctcatgaacagtgaaatgctaggaggaattggctaatgtagaaaagatttagatcagaaataaactcaagccaggtgcggtggctcatgcttgtaatcccgggaggccaaggcaggtggatcacctgaggtcaggagttcaagaccatcctggccaacacggtgaaaccctgtctctattaaaaatacaaaaattagctgggcatggtggtgcacacctgtaatcccagctacttgggaggctgaggtgggagaattgcttgaacctgggaggcggaggttgcagtgagccgagatcacaccactgcactccagcctgggtgacagagcgagactctgtctccaaaaaaaaagaaaaaagaaagaaactcaagagtctccaaattctagagttaatatgaccattagacatgctcatctaaatgtctctgtttatattcacaaccggaggtcaagatgtgtgggaacagtcacgagtttagaaatcagataacacacagttcaactccagggtcactgccacaatagagtgattttagtcaagctacctaggttccaccaagtagacttggagatgagaatacgcacaggctcagaggggctgtgaggtgcaatcatgtattctgttagagatcacaaagcagaagtatgccaggcacacagtaggtgctcaatgtttgcatcttcctttccagccctagccctccttccatagccttacaatgtcgggggcgcacccaggaggcagaagatgtccaagacagaataagtgaagacagacgccactggggagcgttcggccggccatcagctaagactcagcgcactgactctgctgggacatatttctgttatctttcgaatggggacaaaagatgcttgacatgtttcacctaccatttgcatgaaatctgttgaactacatctgaagtactgggggagaatccacattattcatcacataaatgtgcttaaactccctccggggggaagatgggctagccactgtgcctgaagccaagagatgacacatccattctatgactcaacttgagcagctgcagtgtgaaaatacacacacaggctcacacagaaatgggctaacaatttttagaattgccccttgctttttttttttttttttttttagttttgctctttaacctcattactttcctttgctcacagaacctggaagcaacgttgacatttctttggacagctctgaccgggttttaatcccaaaaagaatcccttaacactgtggcacatgaggcacagggcacagtcacaggtctcagggactcatgatcctacttcagggagagctcagaagggtaacatcatctgagaaggaacactggttccgaggggcaaaaatcacagtggctggggcagtccagaaagacagccgggaggaggtggacttgaactgactctgaaggagaggtaaaatctgaatcggcagagagcaggcaggaggccaatgggggtaaccaacaaggacaggtgccctgagacaggactcaggaaagctgactctggcgggctgtgtggccactcgttcagctaacatttactaggcacgccatggcagtcactatagccatgctggggcaagtataaagagaatccaagcaacccaccctggaggaacacacaatagcacggtgatcaagagactagactccataggccaggctgcctggttcaaatcctggtacctcactttccaatgctattgctttgaataggttacttaggccagaggtgagaagtcatgtatacgtttttgattaggaagtgttttcagagaaaaccagaaagtaggtaggggagatcttgaagggaaggaagccctgggggcactctagacccagggcaagataagacctcagccttggcctggaatatgtgcacccttctcagggttagcccttgctagggatgccctgggggtatagagactaccaggtagttggccaaagggaatccagcccctaaaggcaccctccaccaaagacagcaggagcgaaagcactcagggagagggaatttactagacaggtgaaggggacccaaagggataggggctgaacatggacagccggtgctccaaagggttaataattgttgtttttattattattattgttgttattattattattattattattattattttgagacagagtcttgctctattgcccaggctggagtgcggtagtgtgatctcagttcactgcaacctccacctcctgggttcaagcaattctcccgcctcagcctcccgcgtagctgagattacaggtatgtgccaccacaccgggctaatttttgtattttagtagagacagggtttcaccatgttggctagactggctcggactcttgacctcaagtaatccgcccacctcggcctccctaactgctgggattacgggtgtgagccaccacacccggcctattattatttatatgattatttttaccccttgaaaaaggcatgtagcctaattatgataatacaatgtgtctgtattatcacagggaaagtgagtgctttggctccgctctctgttggagggtgcccttagggactggattccctttaaccaactacctgggagtccctgtacccccagggcatccctagcaagggctaaccctgaggagggtgcacatattccaggtcaacccggaggttttatctgctccgtgtccagacagcccttgaaagaaaggtttctccaagccactgtgtacatgcggagaaaggagtggctacgctgctgtgcgtctggatgcaggcagagcggagcagcaggtaagactggaggaacaagtcacggcaagatctgcaaagcaggacccggaatgcagggtgggaaactctaaaagttacaggaatcatgcattcctcaggaagcacctgtgattcttgccctctctcaagtccacagtctcctattgtgttcaatttctggaccaaccaacataggagcccaacctggtaaaggttaaataatgcatcccgatgtcacctgctaacaaggtcgaggtgcgtttgtccacgagaggaaggcaaagttgaaaagaacaagagcaacttcacatagctagaaagccccttttggtctacgtcattctcctcctaggaagtaaacggggactgcatgggctaacgtgaccgttcccacttagaagggaaactgaagtacccacagccctttctgctggaattccctagaaggggtctgtgccacatacaggaagtagggagggtgtctttgcagcatatttcttctcttggagttaactgcgaacgttgcacggcgacctcttgatccattctgtgaaagccccaagcctgtcatgcaataaagacgtccagtttcaccgcagcagggaggccgcatgaaatattccacttgaacaaaaccacttagcagtttacatcaatgcttaccctgtcgcattgaaagtgatgtgaacccacacccaagagcccccaaaccagcacgttgataccaagtttccccagctgcatccaaatcaattccttcttcccctttcctagtatcatgggggcagacaaaagagaagtcagaaagacagaggattacccgcagccaactccaaaataaaataaccatgggaaccacccaggaagaatgggaaaggttcccaggaaacccatttcaaagcctcagattgcaagtggggagactcagcaaccctttaaccaccaaaacaatcgtcacaaacaatgaactttctattgtcccaaaaaaggtggatttgggcaggatcaagataataaagactttaaaagcttcaatcctcattccccagccttttgcaaacgccacacttaccccattggaaacagaagaggctttgtcaagatctccaaatgggccatctgcagggactgctcacatactaggtgagagactaggattcagagcattatgcccatggtaccaaccagcctcctcttcctcctcctgggcttcaggtctagaaaggtgggtctcagtccacagtgattctacctataagagcaacataagaaaataatgggttttgtgcttcgtttttacatacctctagagattgcaagattatcctcagaaacattaacgtgataacacaggaaaagtaccttacatgttgtagacactcaatacattagagtatggatattttgataagcagttcgtattttaataaagaagcatttaccaggcttagttatctatagctttgtagaaagcaccttgactgtagagattcttgcccaccaaaatctcatagttaatggaaacactgaagcatgtggctgcaaggtactagaggaagctctacgattcagtacaagagctcacaaatcaatccaccctgaatcattcaagaaacaaaactttccaaaagtgatgatctcttccctaaaagtgttaccaatgaaagccatgctaacacttgttttcaagcaacggcatcaaaataaactggagaagtgggtgttgcaaaatactcatgaaaacgacgcctccttgttctccattctcatgaaagcattggctagaacaaaatagcaccactgggtcatagtgggcaggccagaccaggtgcagctagtcaatctgtcttcattgaaaataactccacacttgaagctgattcactacccaaaatgtaaaccaagactcactccttgagcaaagcagaactttagcatagcaccataaagcaaatgaagccttttcccagctcacaatccctttccatccccagtccagtcccttgcaatactagatgcataaataaatgctaagtaattatgccattacataggacaaggtccttataccctaggaccttgtcaactgagagaccctaagaagaaccaatggctcagggttgggcaaactcaataacgctacattcccttgtcggggaatattaaccagccaagctcctctgtcctatgctcttattgtccctttttggttacagcatcaaccataatatcaaacaatcaacacttcccccaaaagtgcttagaaactccaaggtctgaaaaagtactccaaggtctgtggcacgaaactgctatggcagtcaccagcatcgtctatcttcacgtttaattcttttcctgttttaatttaatttttagagagggggtctcactatgttgcccaggacagcctcaaactcctgggctcaagcaaccctcccgtctcagcctcctgagtagccgggactacaggcacacaccgccatgaccagcttccaagttaaattcttgagtaactaaatttaacacactttgccttcatagaagcaacccactaacttacatctcagtcgctgccaagtttcgggctttgtactcatttcatttttacactaaaggcaggcaaaaaaaaaggaaagaaaaaaacaacagagcagagcagtgggtaagatccttaggagatgagacaaactgagaggaaaaaaaaaaaccaacactgggaaagtaagataaaaattggagggaagaaatggtaagataatcaactaggaaaacaagataaaaatactgaaaatatggaacttgcccataatgaagagagaacaaatgggggaagtggtttttgttttattctacggcagtaacttcaccttccttcaccttccattgagagaagtggaaaggttggaggtaggacaagaaagggtaggaggcagaaaatactaatcgttacactgaaaacactaagtgtcactattaaatgcctactttgtgccaaacaaaggatagaaaccttacacgaatattcataatgaaatctcattatacgctgaattcacagtgcaatttcacaatcagtttccagatcacatttggggaaatacaagttcagagaggttaggcaattttcctgaggccacacagtcaaaaggggcagagcaagaattcaaagccaggtctttctgactccagcatcctttctgatatacttagaaagaatctgttctgagaaaactttaaaatgctcagactcatgcattaaatatgaaccaaaatgaagtgtcttctccagtcattacagcaaatttgttctgctgtcgtacaaggtaaatctgtattgtcaagtgggttgaaagtacctacaattcactttaaattaccagtaagtcttatgtaaattctagttacatttttccagaacaatatcacagggtgtgcctcaattaatacacaaaacccaccttggaacaatttggtccactgtgtgtggtgttcacaaacagaaagtatattttaataaaactgaaaaaacataatctatgtcaaacatacaaagacaaatacatggtgtcctcctacttgcagctaacgaactcagttgctaattttcaaaggctgtttaaggcctttttcgacagagttccactgggcagaattttaaaaatgaatataaactcaagaaaggaggtggcctttgtttgtgttccaattaagataccatcaaaaatcgaagttggttcttccaaaagaccaataaaattgataatacattagcaagactgatggggaaaaggtacaaataacgccatgaatgaaaaaggaaacatatctacagatactacagtctttaaaaatattatgaggacagcatgttcaatattataccaattttaaattgtacataaaatgggaaaatttctgtaaaaattaggtattaaaacaaacaattttaatgatctagtatctattaaacaaatttacaatttaaaaacagtcagataaggtggcacatgcctatagtcctagctatacaggaggttggggcgggaggatcacttgagcccaggagctccagtccagcctgggcaacagagcaagactccatctctaaaaagaagaaataagtgaataaaatttaaaaatataaccaaccagagacaaaccagcttatttactgggagaggtggggagacaatatgaaaagataatgatacagaaattgccactttctctcacatctacacggtcatatactagcattaaccccaatttcaaatgtcctcatgatggtatcttccaacagtcacatgtgacaatatctaaaaacctttgctctatgaacaatgcagttcccctttttgtagctaagaattattgttccataaaactccgtctattagtcagtttcaccagcattatcatgagatccaatttggttgtctttcctgttgagtgagttactaaaggttccttgtggggtggaggggcgtgagggagtagatcacagacctcatgtcagcatcaatttcacatctacctgctgctgggtcctttcttgagctcaaaatgagctagaactcagggctctagccctggatcatgcaacctgttgttcttccctaagccatgtctgatttggtttaaaagtaatttcctctccatctgtatctttaacttcaaggaagtgggagagtcagagcaagctaagcaaactgcggccccagcaacctgcctcccgacccccaaagttcaagggaaggtatgctgagagagtctgccaattccgcttcgatataagaaaaatgataaaatcagctactgacattttcctgattgtacccaccccagacctgggaaagaacatttggcttgctataaatacaacaggagccacacatttttcaccttcatttcttcccctcaaagtaagatgattctgtaaacattctcatgaaggattcgcttacaaaaaaacaaaaaccagctccagctgctggtgtactattaagttgttgatcaggtatgaaacaagtgcaacaggtaacagttaacccaatagcctccctctgacccctacacactgagcaaaagctacacaggccaaatggaagcccagtgaccagctccagacttgaaataaaacctaaatcctgtctgtgagaagcctcatttgagctaagtttatcctttgctgggacatactgccacttgcaatgatcccagcccccagcaccaccttccacccaaacttcctctcacaaaattgacttaggcaatcgatccaaaggtaagctagctttcacagaaagacagacatttaaaaaaatgatccagataaacaaatcacacctccacagccaggaacctagagtcgaactaatttaatcagatgtaaaattaatgagaaccccgagacttccgacgtcccactccagaactcccatccaggtgcggtcgggagccacagcttctgaatattccttcggaacttttttctcacttgattcccaagcctgtcatggggttctttttcaatggcactgacctgcaattacccaacgagcagcgggacagccccgggcaggacgcatcctgggtgggtgacgtgatcccgcagtctcctccccgaccccatatcccatacaatgatcctcgcttacagaagtcaagggggaaagatgacgctttcaaagcccgaatctctttaccctggagccagaaccagcgtcgccgccgtcccctgcagctcagccggcaacgcgcgccgagcctcggggcgcagcttggagacgcgcttgctcgttctgggaaggggcacgggacgcacggttccccggccccagctgcacagctcagctcggggctctcacctatcctcgttcagagccacattcggctgcctcccctgaccacccgacacaaagagattcgccggtggaaagaatcgatttcaaaattcaagctcaccgctgctcaacaaggcgcgcacgtttctccccgtctggcttcacatgtcccaaacttccagtaacagaaatgaggaagcagcagccttccccggctgctggcggaggcagtgggtgtaacttgtgaagtttcgtgctatgatgaatctggtcacttgggtgtgttggagagggttggtcgctcctcccttcctcctcccaccatcacctccctcctctccgcctccctctccaatttaattcttccctctggcattcgccggctgtcactcagaatcccagcaccctccccaccacatccttgggggcaatgtatttcgaaaaggtcttaaccattttacggatgaacctggtcaccctgcacaaagcgtgagtgcttgtcaaataattttctacagcacgtggcaaaaaagcagcgcctcttaaaagatataaaaggccagcaatgttacataagcgccccccaccagcccttcaaggacagaaacgtgggtagttcattcagtggagacctaactcccaaacatctattgaaaaggagtgaagggcagaaaaacagaaaccaaactttcagttggctgccttttctttcatatgtactagaaagtatttccaatatacaacatatatttgaaaagaatataatgaacacccacgtgcccaccatgtagcataaaaaaattaaaattactcacatagtggaaactatctgtcaacctcttcctcgctgaaatacatccctctttccttccccctggaaagaaaactgccccaaatttgatttcccatgagcaatttttatatcagtttctaaaaatgtgaaagggaacatgctaacttaaagtttaccagaaagccatgcaatgaacatccctctgctgtgcttgaccttggtttccaaacagaagtttctttaaataaaactttaaatgacctcaggttaaatgatgcctcaggtggctggttaaagagaatgaaagaaatcacaaaagaagaaaacggtaaatctgaagtgacaagtgagaggctatatctgaaagggttgaagcattcatggatgaaattgatagattaatagagtattatcattttataaggttaaaagctgtgccaaaaactaaggatactcatccatactgcaagggtctttcctcaaagacacaggctacaaaaataaaaacccaacattcattaaagaagtcataatgactcaaatgccagccagggatgcagcctggaaacagtactctaaaaagggaactttcagaaacatttaaacttgactcaaatatatatgtatatatatccatatatatattttatatatattcatatatatccacacggattcacacatatatatattcatatgtatatgaacatgaagaaagagatggctggttcatctttacattcttggtaaagaatataggctggtataaaggctggtatagcagaaaatttaataaccacctgataaatgaattaagcaaataaacaaaagagtacccacaaacacatctaaaggaacagaatgggcacggtggctcacgcctataatcccagcacttcggaaggctgaggcaggtggatcacctgaggtcagaagtttgagaccaggctggaaacacggtgaaaccccgtctctactaaaaatacaaaaattagccaggcacggtggtgtgtgcctgtaattccagctactcaggaggctgaggcatgagaattgcttgaacctgggaggtggaggttgcagtgagccaagatcacaccactgcacttccagcctgggtgacggagtgagactctgtcttgaaaataaataaataaacagaatgaagaaagagaagaatgtttggatacagcaatggtccttagttggaggtgaatttgcctccggggaacatttggcaatatctggaggcatttttggttgtcacagctgggggttgctactgatatctagtaggtagagtccagagatgctgctctacatcctatcatgcatataacaggcccccacgacaaagaattatccagccacaaatgccaatagtgctgctgctgctgagaaaccctgatttagaagtttcactatcacctgtcatttaattaatgtattccatctattccatatagcatcatcaatttgaagagactctccagggacttagaaaaacatgaaacaacacttctccttttccactgtgcagcattcaatcgctgagaaccatacatatgggctcagaagaaagcagacactgagatcagaggcaggaaagcatcccgtggttttgggtgcagccttggcatccatgcactcaccaagctactgacttacgctgaatctggatgaaaacaatcatgaaggggatgggagaaggatgatgtaaagccaggcgggactgtcttgagaatcagagatcgcgtacttcggggaagccgacatggtgtgcagcgagagatgtgacagatactgagacaaagcagccccatcgaggcccatcagtcatttctccattgacaattatgagtctccgctggaactactccacacacaacaggaaggcgcttcatctcattacagcatatagaaaagaatgttacaaatcactcgtgggaagaggaaggcaagcaccatgaagtcagtggtcagagcatcagagcagtgggcttacacggggagcacatcttgcctacaggttttctggtctcatgattacctaagaaggtttcttttagctctgggtgggtggggggcatatacttttttttcaccttctttctgatattattatttaattttgcatggagggggagaagagctttttgttgttacttagtgtttctctaaaggggacgtgggggaacagtaggtttgctcatcttgaattttcttaaagccacatatatggtggggacgcaatacatacatgttggattaaaccaaatagtccccaccttcttccctatctctcaggcctaaaaataaagggtcccctgtagatgcttctagagaagaataacttgagatcaagagtctgagcaacatgtgaacacgttacataaaccctgctggctccatacagtggcgggcaggttttcacagatctgaacagaacggcttacctgatagtgatgaaaatacagcaatatcagaactggagaggccccaggcattggccttgggcctcggagggaagcaggacttagcatccaagaatttactgctatagcagaagggctgtgtcctcctgcccaggaagattcccccacaacactagtagacaagtgggcagtaaggaagacgcctatccctctaaaggtaccagtttcttaacctgcagttctgaaagccactcgttttgctttttaagtcatgcgaatttcggaaaagaaaatgtgaacgcaggtccgagccccatcagcagcaatgaacttatacacaaatgtacagtatttctgctccaaagaaatgcaaccagtagagggagcacagctgacttttgttgttaatttctcaagatcgggatgaacctgggaatgacgctaaatgatacaaaaataacacacatcaccgcaaaagaaaagatgcatgcacggacgttcagagaaactgcaaaccctgacacccttatgcacgaacgttcagagaaactgcaaaccctgacaactttatgcacgaacgttcagagaaactgcaaaccctgacacccttaggaggtatgtgaattgttagtggatatttgcacaagagctggctaaacagacagaagaggactacataaaaaataaattcatgttggaaaacaatatgtggcatgtggagaaaaggtcacaaagggttaaacttctttttccctttgtcaagtggatttacactcagaaatgaaaacgtatggagagtttatttaagcatattctctccaaaaattttaactcaagtgtttagcttgctcactctctctctctatatattagatctacaatagctgggctttaaaattcctttcaaattgcattctcagtgacagagatgacttccaaaagcaagcattttctggattgctcttcaggggtctccagaaccaacttggtcaggaatcaaggtgtcttcaagatctgcgaatttgaagccatcagccacaatggagcttacctccaccttttcaagccttcatagaacaaaaacaaggtaagaagtgctggcaccaacgcgtcctcacctatgtcacctagcaacaatgttatcagcagcaaggccagggaagagtctcctcctcctcctcgtgttaggtgatacgcaacaggggtgtcaacaccgtcaaattacctgaatccaaacacgatttcccagcataactgcagttccaaatatgcatcctgttaatggaatccatatttggactgctatggaaatgcagaaggtttttcataactacattttgtggttgactaccaacggattgccaaaatcaattttttatatttgaaactgatgaaaggtctaaatatggatccatcccacacactcccatgctaggtaatctgagggtctgcttgggaatacggacatgtttgaaaacactgcaaacacttgtttcagccctggatggggtctttctattctctgagagacaaacaaggttcacctttctaggcaaagttttaaaacacagtcttcattaaatttgatttgatacaagaatgttttacaacttcaaagtaaaccttatgccaaccaaacttagagactctttacatagttttctctatctgaaaacagaatacctaacaaatacatagagatattcttaaaaaatacagggccagccaaaaagaggccaggaaactctaatagcttttaaacaccacctccagaatgcattgcagggactgtgtggcaaattccctaaaatccaagggcttcaatttcctttactataaaatgatgaatgttcgatttaattttctctgccttctgagctctatcttccaattataagtttccatgattttaaagcccccattgttttcattaccccaaattagatttccttacagaagaacaactttcatctaacaagtcaaagtcaacagggtcaggactccttggtagcccacattcttctaagtgaagccaggtttgtaactgaaagggtgaagggaaaagggaggaagtgcaaccagagttagataaagataacaaagaaggccaaggaaacatccgtgagctcttagctcccaccagcaataaaccatatggggccagatgctgtcccacccacacacacagtaaggcttttgatttcaagggccctgggtgccttgcacaaatggtgcatgtgttcacggggggtaaaagcatcgaagtttttcctagtttgggacctttcagatacctccctgctcggcagcaataaacaataataattgttattggcactagaagtaagataatatagaataactaagaagacaaaaagtcaagttctaatttcagtcctgccatttcttcaaagaatgccaggatagctttataatccccagtatagcctcttgaaaaagctgggtcagggagtatcccatcggggaggcctcattgggtcatgagagaagcaaggatacaaaatgagaagagccggttcaagtccagggtccagcgacaaccagaagagtaactcagagcaagtccctctgcctacccttcggtaaagtgggaacttaaaataatagatgcctattggcaatggaatgcatgggttaacaggctttggactgggcacatgcccaacactgtctctaaatgggcgaatgggcactaaacatgtcaagacaattttcaatcaggaaataagccaaccctgtttcttaaacgatcttagcatttataatgttctcaatgttttcacattgacggtgctattttggcaaaaagtacagttctggcactagttacgtgtcagataacagaatggaggtccttcccaatggggtcacagagggctcaccctcttgagccctaagccttccccagagagtccctactgtggggaagtagcaggccacccttgtgagggtggacgcagtgagccacaaaggcccgacactaaccaggtccaaccaatttaatggtatttaatggtattcatgggtgggaatcattttgatttttattttatactaagatacagtaactgtcactttaaaattttggggggccaaaacatactggggcagggagtggagaatgacgctggctaagaaggtgatatagtttggatatctgtacccacccaaatctcatgctgaattgtaatttttggtgttgcagatggggcctggtgggaggtgattagatcatgggggtggatttctcatgtagagttgagcaccatccccttggtgctgttctcgtgatagtgagtcagttctcgcaagatctggttgtataaaagtttgtggcatctccccgcatctctcttttgctcctgctctggcacgtgacatgtctgctcctgcttctctttctgccataactgtaagttttctgaggtctccccagaagccaagcagatgccagcatcatgcttcctgtacagcctgcagaaccatgagccaattaaacctcttttctttataaattacccagtgtcaggtatttctttatagcaatgcaagaatggcccaatacacgatgagacatctagcacaggggtaggatggtgaagtgaaaaggaccccacctatagacctgcttgtaacacatgacaccttacagagttttgtactaaccacaggcacaaaatcaattaaaattaggtgacttgtaatgaataatggctagggaaacgtgttgatgagaatccacttgtcttgtgttcccttccactaacataggcatttgatttcactctaggaatacttgctgccatcttccctaatgtaaatgaaaaccaaacatgtacaagttactttcaatcagagaatacgacaaacctgtatctcaaaatattaaagggtctaacataggggtgacacatttagggtcatagacctctatatgtaagagaagaaaggaggtcttataaatcactcattcatctgaagtcagaaggagtaagtgacttgttcaagctcacataataaaaccatgacagcttcagcccagtacccaggtcaacagaaataaacttgctgtatgttccactcaattattacctcctttaaaaaatatgtccataaaatgaacattcaatgcagtgtatgcacatataatttgggggctccaacctagtacaaaaggcacatacaaataaaaaacaatataaattgagcccatctagaattaataagcaaaccataaaaagtgggtacatgagaaattcttggctaagctccagacaagcaagcaaggggcccagagacctgggagggaggacgcagtcaaacccggatggctggaggcagtctgactcaccagcagccagcgtcctcccaaacaaattacagaggcaggctcagcaagaatgcaggggaaagatccacatgtgcccaaggggttaagatagcaacctggtcaaagatacagacttcctcagttaggaaagctctacccctggaataccaagaaattaaagttcatctctggcagggcgtggtggctcatgcctataatcctagcactttgggaggccgaggagggcagatcacctgaggtcaggagttcaaggccagcctggccaacacggcgaaaccccatctctactaaaaacacaaaaattagccgggtgtggtggtgtgtgcctgtactcccagctacttaggaggctgaggcaggagaatcgcttgaacccaggaggcagaggttgcagtaagccaggatcacaccactgtactccaacctaggcaacagagcaagagtctgtctcaaaaaaaaaaaaaaagtgcatctttgctaacgccacaaaataccgtcattttcacttgtctgtgaatattcattgcagcattactcacaatagccaagaggtgaaaacaatctatgtgcccatcagatgaatgaataaacaaaatgtggtatatctctgcaatggaatattactcagccatttaaatattgaagttctgatctgtgctgctacatggatgaaccttcaaaatattatgctaagtgaaagaagtcagacacaaaaggacaaatattgcataattccacttacacccaagttttggacatagatagtggtgatggttgtacaacattgtgaatgtaattaatgccaatgaagtgtgtacttaaaaatagttaaaatgccaacttttatgttatatatatcttaccacaacttttaaaaaagattccaaaaatatcattttcaacgttttggctcacatatatgtagctttaaaaaaaaaaaaaaaaaagctgctggcctggtacagtggctcatgcctaaaatcccagcactttgggaagccgaggtgggcggatcacttgaggtcaggagttcaagaccagcctggccaacacaatgaaacctcatctctacttaaaaataaatagataaataaataaataaataaatattagccagggatggtaacgcacacctgtaatctcagctatttgggtggctgaggcacaagaatagcttgaacctgggaggcgaaggttgcagtgagctgtaatcatgccactgcactgtagcctgggcaaaagattaagactctgtctcaaaaaaaaaaaaaaaagttgctgctaaaaacaaaagtaatcaaaactttacacacattaaccaagccttccaataagccaactcttcctgtcatatcaccatgatcttcacacgcccagataagtgattttctctgattgtaagagataaaatgacattgcctcacctatcaaggtaaatctttcacaattatgaagataaaacaaggcacacccttgcacagtatgctggaggcacagcagtagggaacagctgcttccaccaacccatcccaaccccaaatttcaacgcatatcaagaaaccaaaaagggtcagatatgagtccaaaaccctaacagtggggcaaatgaatcaaacccaaattcttaattgtaaatattaaatgttacacatgttaactgaccacattcaggtgtaccctcaactcgcagtaatttcagcagttaagacgtaagcaggggtgccaggcagtctaagtgagaattgcgggtcagccaggaattcctcttccagtcacaggcctatcccttaatcttcataaagcctcagtccctcatctgtaaaatgggaataagagcatttccctcataaaactatgtgaagacaactttgatgacaatgagttgctgacatttcctgagcactttctctgtgaaagccactaggctaggggctgctcattcaattttctacctggtcctcatgacagctcagcaaggtactacttattactagacccatttaacagataaagaaaactgaggcacggagaggttaaatgaactgcccaaagccactcaacaagtaagaggcaggtctaaaattctaacctagtctctgtgaggctgggaccccagctctctccaacctcactactgcatttgggctacaatcttgtcattaacaaccttgacatccttacatttgatttatttgtttttatttatttatttatttatctttttttttttttttttttttgagacagagtctcactctgttgcccaggctggagtgcagtggagtgatttcagctcactgcaacctctgcctcctgggttcaagcgattctgtgtctcagactcccaagtagctggaattacaggtgcccgccaacaagcccagctaatttgtgtatttttagtagagatgggatttcaccatgttggccaggctggtctcgaacacccgacctcacacaatctgcccacctcggcctcccaaagtgctggattataggtgtgagccaccatgcccggccttattattactaatattaccctttgtatcatgaatctcagtttctgggttcacaaagtcagagggctgagtgtgattcccaaagcctacacttactcatggagaacctcatgccctcttaaggacaaatgtggcaggcaagcaacatattttagggtttgtcatgaagctcctggaagttaattgtcactccgtctgagaaaggtgagtgaacaaggtatctaacgtgagccagctcaattgcacaagaggcaaataatatgcataatgcatgtgtgggagattcctaaatgtattcctggggccctttcacagaaccaaggaccccccctccacacccccaccacacgaagaggcaagttcaaactctggactgagataattaacggctggtggatattttacactgacctatttataatacctccctgaagtactaatgttggttcacaatcaaaagaaatacatactgaacagaatcttgctcgcagctgaaccacccaacttcccggtaaaacatgcatgacaggtgactcacaaggatgacacagttcctggcacaggcaccaagagttactaccggtgtggaggaggctcagccagcaagttgacaaacacttcaccacatcacctaaaacaccaaagttcaaccctatgctctcagatgcctggtttctgagaaagggaatttctcagaatgggaccacaacgctgacaacctgcccagctgacaatccttgctgtgggctggcagacgccaagataagtcatctctgacttttatttttctcagcctcaacaacttcacacaccttgcttaggctcaggcttatgattcagacttctcacccctcccaaagccctgtaccctgggagcctttgttctttttctggccacagatgaactcagcccattaaagaagagctgtaatcccttacacatataactttccattggcaaaaattagtcaggtcggctgggtctgaggtcagcagtctcctgcagaaacacccaccagacactgttcccccaccaccaaaaaaaaaaaaaaaaggtagcggctaatgaactgcccattaaccgtctggtagaaacacacacacagatactactgactcattccatttcaataaccaaaaacaatattcttggcctttggcatgaatatgggtttttgttttcttaaggatagtggccaccttggtctatttgctcccgtgcaaacttgttcatcttccgcttatgaaggtaaccttagacttgaggtctttgttcaacatcaccttctcaatgaaggtgtcctcctggccagtggccccaccccaccacctccacccctcatccctggcacatttcctttcttacttccctgatttatttttctctcctttattatttatttatttatttatttatttatttatttatttattgagaaagagtctcgccctgttgctcaggctggagtgcagtgatgtgatctcggctcactgcaacctccacatcccaggttcaagcaatgctcttgcctccgcctcctgagtagctgggactacaggcgcgtgccaccacactgggctaatttttgtatttttagtagagacagggttttgtcatgttggccaggctggtctcaaactgctggactcaagtgatctgcccgcctcggcttcccaaagtgctgggattcaggcgtgagcactgcgcgcccggctatttttctctcctttgtacacatgctgaatattttcttattttactctttttcttgtttctctcctccactagaacataagccccacaagagcaggcacttttatccattttgctcacagttctattgcaagtgcctagaagagggcttcatacgtggtagactctcaacaaatattgcatgatttgaataacggtcattcattaccccgagatgataattcaagacaagaagcatgatcaaaaccacccaggtctgaggtctcttctttaaccatagaaaaaaagtccttttaaccaattccttctgaatccttaacagcaaagaaagaaataaggaacaataggagaaatagacatttatgtcaataatacacaaacacttggagttttcaacttatacattcactaaggatgttcaagacactgcatgccaaatctctgaaatacacagattattaataataaagggtaaagataccaattgcccgtatgccatcattgtcatgcatcccccccacagctcacacctcccatcttttcagaccactcaatctcatactctgttagggtctgaatgtttgtgtcccctcaaaattcatatgttgaaatcctaacccccaaagtgatggtattctaaggtgggggcctttgggagaggattagatcatgagatcggagcccccaggattgggattagtgctcttttaaaaagaggtctcggagttcattcatctctttcactgtgtaaggacatagccacaaggcgctgtccagaggaagcagcccctcactaaacactcaatctgctgttgcctagatcttagacttctcagcctccagactgtgaaatacatttctgttgtttataaattatccagtctgtggtattctgttatagcagcaccaatggaataagacacactccaagaatcccttcatagcttcgatatttcatgctcctccttaagaaatgtagattccatctgggcgcagtggctcaggcctgtaatcttagcactttgggacactgagacaggaggatggggcttgagcccatgggttcgagaccaggctgggcaacacagcaagagcccatctttaaaaaataaatgaatgaataaacatttttaaaatttttaaaagagaagtgtagattccatcatctgtcattaatttccctccctcaactccctggcccatcttttacttggtcatatccttttggcaaaaacatctggttaaatccatcagactgcccagttcacacctgtacccagacagctgactgtggctagagaaaacagaagaaagcatgcaaacatgttggctggtctcactttaaattcctgacccctaatgtcaagtgtccccttaaatgccactggcaatcacaccaaaattctctgtctattccctcacccacactcacgaagtttatgtcttctgctttccttccagattcccaacaatttcttcccatctgatgaccttttgttctacttctctgagaaaaatgaagcaatcagagaggactaccacaaacttctaagactatatatattctctggtgatctatctgcatgcaggtatatacactctacctttctgcctgttgatgtagacaactatccatactcctctctaaagccaacccctccacttgtgatgaggtccaatctccaccccttgctcactcaagggcaatgttttagcaattttcctctctctcctccacatcatcaaattataactatgaaaatttgctgctttctccctctcctttgcagaaatattaaaagaggcatctgtatttgccatgttcccttattttccccattctctcttaaacccactccagtgcatcttccatccaaccacgtgctgttctcaagggcactaatgatctcccggtttataaagccaatgtttctctcttgtcttcattgtacttgacctattctatcagcagcatttgacaccactgattactcattctgctctggtgtactttcttcaattgcttccaagacaccataaattcttctgccttgctggctgcctttgctggttcctcctcttctccctgacctcttaatgttggagaaccacagggcttagtccttggtcctcttctctcttttctttacactgtggtcctcagtgagggagataggtagatccactgtcccgatcttaacccaaagaaagacttgctgtccagctacgggggctgtggtcagaaggcagcctcgagccttcagttcctgcaggacctgtctcagggcagagggcggcatcccagggtaggccatatctggtgactgaatgaggcagggataaaggactggtcatatcagcctctgcaggacaaggatgatgggcagtattaattccagagcttccagccaggttgttctacaccactgtttgacttctccacgcggtcctgcttgcttcctctttcttttgcagttcatctaaatgccgtcttcttgcctgtttctggagaaatcaacctacaactcttggagatcccctccggtctcatgactgcgaatactttccacatgctaacaactcccaatgcatgtctctagccagtgctttttcccctagactccacaatcgaataccgcactgtgcacgtacaccctctgggtatcttccaggtgcctttcccagctgagctaagggcaattgaaccctcccaactattcagaccaaaatacttggtgccatacttgccttccctttcctttcacatcccacatcgaatcagtcggaaaattctgttgcatccactctccaaatatgtgccaatccaaatctcttctcaccccttcctgctgctgccactataatccgagccaccattctctactagattacgacaaaacctctgaacaagtctccctgtttccactcttgtccttctacaatccatcctcatccaggaccatggggatccttttaaagtataaattagatcacagcattcctccgctcaaggggtaaaagccaaactccctagagggacccacaaagcatatcacccctctggcctcgttattacttctctgtcctcatctcctgctgcttctccccttgttcatgccactgaagccacacttggcctcctcgatgttccctgaactttccagacacactccctctttctggaacattccaggtaggctgctaatttctttatattcttttagtcttcattcaaatggtaccatctcatcactataccctaatctaccccgcttacctcccagaactgcccacccacccaaagcaggtctactttgcttttttaaaatatcatttcccacttccaacacactgaatcattaagttaaacttaattaattcatttaaaatgaagacgtaactcattacaattaataaacaattatttattttttaatagtaattcacaaagacaagggtctttgcctcttttgatcaccaaagtatcccaagtacctaggacactgcctagcacacagtaggacctaaaaataaatacatttgttgagtgaacaaatagtatttgctcttcacaagattaggttggcagaatgaagcataaagggacaaaaataaaacaaagaaagaaagagaaggtaggagacatagaaaatacagtgaaagggccgggcatggtggctcacgcttgtaatcccagcactttgggaggccgaggcaggaggatcacaaagtcaagagtttgagaccagccaacatagtgaaatcctgtctctactaaaaatacaaaaatttagcagggcatggtggcgggtgcctgtaatcctagctattcaggaggctgaggcaggagaattgcttgaacccgggaggcagaggttgcaacaagtcgagatcacaccattgcacaccacctgggagacagtccacaactctgtcaaaagagaaaaagaaagaaaaaggaaggaaggaaggaaggaaggaaggaaggaaggaaggaaggaaggaaggaaggaagggagggagggaggaaagacaatgaaaggatgtaatatgaagaaaaaagagaactggactgaagagatacaggttggaaatttcccaaaatgcaaaaaagataccaacccatagattcaagaagtcctacaaaccctgaacagaataaataaaaatatatttacacctagacatgtcatagtggaactggaaagccaaaggcagagagaaaaaccataaaagcaacaagaaggagactgatgagctattgtactaagaagcaacaattaggcagagagccgacttctcagcaagaacagatgccagaagataatgaactggtatcttctaagtgtttgaagaaaatcaccgccaactgagaattctatatgcagcagaaataaagataatttaagacggacagaagtataataataataataataattaacaataatgtcttagatgtttagaatagtatgaaagaaaaaaatttactatatattataatccagtagagaataaaaggagttaatatactctaatgtccttgtattatctaggaaggctaatgtccttgtattatctaggaaggcttcaaagtactaatttatattagactttgcaatccaaggtagctatgggtaatcctgaggtttttttaataggatagacattaaaaagccagtaactgatcattctgactacattccaggtaaaaacttagttgtttacttaaaaaataaacaagacaataaaatgcaagccacacggtgagacaatgtttgcgactcatgcaactgacaaggagatattatgcagaataatttaaaacacacacatgcacacaactgtacaaatcaataagaaaaacatcaactaccaaataaaaaatgacaagtgacatttgtcaggcagttcacaaaagaaaatattccaatgaccaataaacctatgaataggagcttggccatgctggtttttcaatttacaaaatgtaaattcaaaccaggaaatccacttattaccagaagagctagaattgaaatgactaataacaccaaggttttctgagggcataatgcaagaggaactcccttatcctactagggagagtgtaattgggtcaggcactttagtaaagatgaaaaatcagcaatttcaattctagaaatacaccccaagaaacacatggacatgagtgctggggaaggtatctccaaaaaaagtccattgtagcactattcacaatagtcaaacattggaactaatccaaatgatcaccagcagtagaatggattatgaagttatagcctatttataccatgaaattgtataataattaaagtgtacaaactagagctacacccaagagaaaagttgaggaaataaagccagacccagaatacttaataaagtatgattccactgatatacagttcaaaaacaagcaaaattaaactacagtgcttaagaatctacactcaagcactaaatgtgagacaagaagcaaaaatatgattccataaaaatcaagcctggttgttatctttaggaggcagggagaaaattgtgattgaggatgggaggggaggctttcttgggggctgccaatgttgcatttctcgagctggtgatggccacattacccagtaggctgtacagtcacgtgttgtgcactgttctgaatgtgtggcatgtttcacaatttaagaagagttataaaatccacataaactatcctgtagacgaatatttcccactgaatagtaaccccttcccaaataagaaagccttttagattttggctatagatataaaatcttgtataaatatcactgcttcattaaaccactcaaaagcccaatgagtaacacatttaatgacagataagacaactaaaggtgatacttagttcattaagacattctcctcttccaactattaaactaatagcagatgatattatcatagattcctttgaggaagaaagattagatagatagatagatagatagatagatagatagatagatagacagacatgtgtatacatttggtatgtatacatatacacatatatacatatacatgcatgtaagtgtatatacacatacacatatatgtgcatgcaagtatacatatatgactgacataaaaacatgttccttggctgggcacagtggctcatgcttatagtcccagctaccagggaggctagacagagagattgcttgagcccaggaatccaaggttacagtgaggtatgattgtgccactgtactacagcttgggtgacggagctgtcaccctatcccttttaaaaaaaaaaagatatactctttactgtgactttatttgaaaatgaaggcagcataagagtgagttcagtgcatccaccctcttccttcactctctctctggtgtcactggactggatgagttatggacatgacaattccagcccaagggcactagaaagtaagtgagaagggaagagctgacttatcccacactgagcccagagattcaaaccagccacccaaggttcgcctttctcttcatgacgagtcatagatccattacccattaatgcagtgacaattattattattattattattattattattattatatttgagaaaaggtctcgctttgtcacccaggctggagggcagtggtgcaatcttggctcactgcaacatctagctcccgggttcaagcgattctcctgcctcagcctcccgagcagctgtgactacaggcgcccactaccacacccggctaatttttgtatttttagtagagatggggtttcaccatgttggccaggctggtcacgaactcttgacctcaagtgatccacctacctcagcctcccaaagtgcttgtattacaggcatgagccactgtgctcagccaacaattatttttaaagcaatgctagtccatcaccccttagggcagggagcgctcactctcattcttacttacactgtaagggggtttatcattgtattttctgattaggatgccctacagaacaggacatcgagttctctgatgggtattttttttgcataggattggtggaagagactattcctttccccctttatttgtaatgttttcctctgtactgcacctccatacttcttccaccatccttaaccacaagatgggcacaggatccagctgggatcattgttgaacctcaagccctgtacacagtgattggtccaggggtgggttcacgatcgatattagctaatcagagaaattccttgggaatttttttattttaaaactgcggacgtcagcctaaaactgctggcagccatgcttctgtttggttcaagctggcctgagaagaactaatctgatccagggaaaacagggatgaaagacagagagcatttgatcgtgttaacttccctgggtccagctgtcccctaaccccagccttaccctgactggtacacagacaaacgtattcccactttggccctaaatcaacttaggtttctgatccttacaacccaacattctaacaggaccgggattttgtttttttttctgggttttttaaatggttttactgctgatgttgttttgcaggggtaagaagcagagaagatctgctcctgtgatccacaacactcctccataccacatatttgtgcaaaaacatcttgttagtccctaagcttcctctaatgatgtcttttaaaactgcaccttacatgtcttctccttgattaacacccttgtttattacctcattcaatcctccttttcccttttccaaatgctgaatgatcacacgatgaatgtcttagatttttctctcttctgtgaaactgctgatcactcccaaattaagaattaaaaatggagcagctgcagacgctttgctagcatccagattacaatcttagagttcttccagaagaaagctctctgtttctgaggaaactctggttggttggggggcaacccaaggaagtatctctgaaaccacacaacatgcaatgaaaccacaggaaaaaaagggggagggggttcttcctgtgtatttgctgaagtattttgctttaagagagatcagtggtgttcaatttcaagaaagaaacacccatgaggaaaagtgcagagcaaaacagccccaggacatctctacccaacacacaggcctgctggtgtcacttgcattgaacttatacatttcttcattatcctagtaataaagtctgtgatttcagcattttacaggaaggtaaaaacacattcacaatagcactagccgatagctttcttaagtaactgcatggtgagcttcatagtatcccccgttcctaaagacagattagaggccccagcactgcactgtttcagatttctgtgggccaccaaaaataaaaagcatcccaggtggagtaaacttgttaaccaaagggctacttaaaaataaaattgcttgtagagagctctcttacagcttaatgaatgaggcaccatttctcaaactaagattgtgatcaaatgagaaaccctccaaagacctctgctgaatacctcacttacactcaagcctccgcagagggagccaatgaatgagcccccagcaactgaagtgggtgtgggggagtggagaaggttatatttgagcatgtgatggtagaattgagaaagcactgagacatcagccacagatggagaggaaagagcagctctacctataggaattgttaataagagttctgtactctctattaacaaatcttggaacagctgacaccatgatggccagggaccatggatggacggatggatggatgggtggatggatggatggctgcatggattgattgatggatggatggacgaatggacagactgagtaaagaatggtggcagttacagctgagtgggtgtgtgttgatgggggaggaaggacagaggacaggccaaccacaccataattgttgagtaatggcacagtccagagtgggcaaagtttttctttaaagaatcagataaatatttcaatctttgcgagccatatactctctattgagctctgcccttgttatgtaaaagcaaccaaagacagtaagtaaatgaaaatgactttgttccaataaaactttattcatgaatgctgaaatctgaatttcatgatttttacatgacaccaattattcttcttttccccccagccgcttaaaaatgtaaaagacatttttagttcaaggatcttacaagaatcagtggaatttggccctcaggccagaattcaacgaccccagatctagtctccaaacacgccagtcactcaggatagtgatcaggaaagaagatctccccagcagatcctgggaagagatctaacacaacgcacattttctattctgtgctctgtatatacttctccttctgtctttattgcataattctccatggatgtgctgatgtttccgtcttgtccaatgggatataggaagcacctgctggcagggtctgtgtctcacttatttctttctttttttttttttttttttgagagggagtctcgctctgtcgcccaggctggagtgcaggggcatgatctcggctcactgcaagctctgcctcccgggttcacgccattctcctgcctcagcctcccaagtagctgggactacaggcacccgccaccacgcctggctaattttttgtattttttagtagagatggggtttcacaccatgttagccaggatggtctcgatctcctgacctcgtgatccacctgcctcggcctcccaaagtgcgggattacaggcgtgagccactgtgcccagcctgtgtcacatatttctaaatcttcagcacttggcatagtacctggaacataacaggtgcttgagagatattccctgaatcaaaccatattccccaacaactgcaagatttcactgtcaaagtatgacataaggccgggcacggaggcttatgcctgtaatcccggcactttggaaggctcaggcaggtggatcacgaagtcaagagattgagaccatcctggccaacatggtgaaaccccgtctgtactaaaatatacaaaaattagctgcacctatagtcccagctactcaggaggctgaggcaggagaatcacttaacccgggaggtggaggttgcagtgagccgaggtagctccactgcactccagcctggagacagagcaagactctgtctcaaaaaaaaaaaaaaaaaaaaaaaagtgtgacttgaaaggcaatccaccttgataccaggcatcccctatctgatgtcacagccatgaatactatgcccttggcccttgggatggttgacagaggtcataggaagtaaaccgtactcataaccttgaagctggatttcaccctttgccaaaagcaactcttagtttgtcacattgtaaaaggcaggaaaccagttaccttattcttgccatgaccacacagatgttacttaacttacgcatgtcccaaatggaaagaaacatatccatccgttagcagagaatgaaaaacatgtcaccctttggctcctcagtttgggaattgatgggcaatgaacacactcctggttccttttctttcccatccatctctccctccaggccatccatcaggagaaagctcaatgtcatcttcatggtgagcactatgtagccatatcctacaggctttctttgcaatacttaagtttccaaggaaggcagagactattaaaaagaggatgctcaggggctttcttttttcagacagagtcttgctctgtcacccaggctggagtgcagtggtgccatcttggctcactgcaacctccacatcccaggttcaagcgattctcctgcctcaacctcccgagtagctgggaattacaggcatgtgccatcatgcctggccaatttttctatttttaacggagacggggtttcgccatgttggccaggctggtcttgaactcttaacctcatgtgatccacccgcctcagcctaccaaagtgctgggattataggcgtgagtcaccatgcccagcctctttttaacactttactggaaatcttgactagaagtatgccagggtcaaatctgtatacaaagggaatacaaagaaccacaggagaatctgtaaggaaatgactcatgagtattcagatttggatgggtcccagaaaatagctccagaaacataattgcaatcccaggcaggaagccaggcaggcaggtaagcaggcaagaagtaaggagagaaggaaggagggagggagggagggagagaggaaaggaggaagtgaagaagagaagaagggcacaaacagagcaactcacctggttcatcctcaacccccacctgccccagcagtctttcagttgcaagccctatgaacagcaaaggggacacagagctggaagaacgccactattgcctttctctaggtaggtctgtcagtaactctttgcttgatttgcaccaagacttagtttcccagtcaacagaatgggactagaagtacccagaccaacaggccgaaataacctcattctgtacatttttgaaattcactagttatccattttaaatggcatttggattctttttttctttgtgaagaagtctccatagcaactgaacttgaataccttggtattcaacccaaacttacctacctaataagtttggcaagaatgtttttattcttttcttaccaaaggccacatttaagaggatccagaaattctgacaggcctcatgcattctatctgagaccaaagagcagacaaccaagagacctgtttatcagcaaaagcagcaacattccgtttcttcgccatttgggtaactctgtcctttatcaattacagtccttgacagactcattcctattcgttacctatttgttcttgtgtgttggtattatattttccacatcctcatgggccactaaattataatattttaacttcaaatgacgtctaacttggaatcacgtaatcaatattactttactgagtgtttatcttccctaaactgcttcatggaccacaaaagaagacctaaaaaacaacatctgatgctcagtttcaatggatcaatgagctgaacccaaaaatagccactctagaatattcatgagaggcctctcagtataactggaaacttcataccaagtttcactttcaaagaattcattttaaaacatgttctctgattttaaactcagttatttatatgatattaaagagactttaaccaacttgatggcaaacctaacaaaagatgtctaccaattattttaacttcatcaaaggttttaagggaaactatttaagacatattaacaacttcctattttgttccataggccccattcttaaaaggctcctcagggctttaatattccataatattaaaagggctttaatattccataataatttattttacgctttcttaataaccttttctcaaactccaggtgaatcatttctgcaatttgttactgtttgtagctcaacaaattattcatttgagctggctgagccacacgcataacatttttaattagagtgccacagttgacttcaaatccaaaatatcccaatccaaaattattctgtaggcttcggatttgctgccaggagtctaaaaagctaaaaatagcgaccaaactttcacatcacaaggcagaaaaaagcatttcaagaaagcgtacaggcttcaaatagatgcgtgaacagatcccaaaaggcaggcataggctgacaagacttcagatttgaccgtccccagtatacttatatttgtaagaagaaaaggacgggagaaaaactcagtaaaacagcagctcataatgataagctacatagagtagcagcagggggaaatatggcaaaactggtaaaatacaagcgtctagactctctttagtataaaactaaagatattaaattagcatgtcaattttgaacaaatctataataatgcaatcagcaaacttcagaatgtaagatactttacaaagcaaaggacttggactcttaagtaaagagaaaagagaagaaagaaagggatgataggtcgggcgtggtggctcacgcctgtaatcccagcactttgggaggccgaggcgggcggatcacgaggtcgggagatagagacatggtgaaaccccatctctactaaaaacacagaaaattagccggccgtggtggcgggagcctgtagtctcagcttcttgggaggctgaggcaggagaacagcgtgaacccgggaggcggagcttgcagtgagccgagattgtgccactgcactccagcctgggtgacagagcgagaatccatctcaaaaaaaaagaaagaaagaaagaaagggatgataatgaggaagctacatgagactgaaggtacacatgcatcagttgcaaggtgctttggtctcaatgtctgtgtgcccttcagattcatatgctgaaatcccaacctccaaggcaatggtattagaaggtgaaatattagatggtgggaagggtaggagggaagggaggataaggaaaggttgcttaacagataccaaattacagctaaatggcaggaataagttctagagatctataccactatagggtgactacagttaacaataatttattgtacattttcaaaaagctagaagaaaggattctgaatgttcccaacgtaaaaaaataataaatgtttgaaatgatggatatggtaattactttgatttgatcatcacacattgtatacttgtatcaaaatatcactctgtgtcccataaatatgtacaattattacatgtcaactaaaaataaaaggaaaaatacatttaaaagaagaagaagggttaggaggctgaggcgggtggatcacaaggtcaggagttcgagaccagcctgatcaacatggtgaaaccccgtctctactaatacaaaaattagctgggcgtggtggcacgtgcctgtaatcccatctactcaggaggctgaggcaggagactcgcttgaacccgggaggcagaggttgcaatgagccaagatcgcgccactgcactccagcctggggtaggacttttgggaaataattggtgtccttataaagggggcctaagagagacccctttcccttccaccacatgaggacacagtgaaaagacagtagtctatgaaccaggaagcaggccctcaccaggcactgaatctgccttggttttggacttccaatacccaagaaccatgagaaataaatttctgttctatctaagttacccagattagggtgctttgttataggagccgaatggactgagacacaatgtatgggtgttatttggatcacgattcaaaaagatgagctgttaaaaaattatgagacagaggttaagtttgaaaagtgaccatatgcctgataatattgagatacacaggcaatatggcttttctttttattttttgaacccagacagaggctggaacaatatggcttttttatgttcttatctttagcagtatatacagatgaaatgagagcatatctgtgattcatatacagacaacccagtatgggtatgtgggtgtgtttttgtgtgtgcacgcgcatgtgtgtgtagtgactgcaggccaaagtagattggccacaggttgatattccctgaaggtgggtgatgagtatgtgagagtttctgtgggggtttatatactatcctctcaatgtgtaaatgtttgaaattacccacaataaaaaggttttcaaaaaacaatatgtacaagacatactgcggtctatatgcccagactatacctctgggtggcctgagggtgtgtgtggcctgcagacatattttgtttggacagtggactgtttaaaaaaatgttgtttcctttttgatccaatatttaaaaataagaagacttcacataaaaattaggatttccaactaatcttgaaaaaatagaaagatctggcagcagtaggctatagcaacaagccccggtatgcagcctgtgccgccctctctcagacccagcacccacacatttctggggcctccctggtctgtggccatttgagtttggcccccagtgtcccaggcttttcagagcagcaactcagtgccaacctccagggacaaactttccagaatgactgtgttcttctctcagcccagactcctagagctttgttttctgaccagtcatcaaaagttcctgacaacaacttcaattcaagcacttgaagagttttagtttatattacacaaagcggtgattcaaaacatatgggtagtcaacagactggaaaagaaaaccccagagtttctgaagtttatttggcttgaggacctctggccggttctgccgactctccttatcattcaggcaacaggactggctcctgtcttgctccacagactcccagaatgcaaaggcaggaagggggctaagagctcatttagtaccttcctcctcattttacgatgagactcaagccaagggaggttgagtaattcatccaatcactttccaaggggtctctggaggaagggatgggaaagaaaatgtaatgtaagatggagtgctgacagctcctatacacatgccagagttactggatgacaatttgttcctgcatgtttttactccctgcaaagtacttttccagtatgattatggaacaagagcaacgtttctctagaaaaagatagattttcaaccttaaaaagaactaagggttgaaccacttgggtcatgatattcctgtttaatggaccactctaagaggaatgaccgttgatgaggtctcctggcacctaactgatgttcctcacttgtacaattacttgtcatcaggcaagaagacaaataagaggaaggacaggaaagtccttctaactcctcaggttctctgaagactcttttagatcctagactcttcataacggctctcagactcattcaccccttcagcccggctgagtcaaaggaaattctcaaggtcatgcagtggccaccatatttgcagagcccaccctcggtgaacttgggttcttcccaaagtgaactcacccagttaacaatagactattcttgaaatttaattaattcaatggcagacaagccaaaagaagagaaattaaagcaaccctgaggcaatatgagtttgcacagtggagtacatgtaatactcccagctccccaacgcggaaggctcattttcctctagttccacctcatgggctggcacatcccatcagctttcttatcacttctgatgggctttaagttagcaactcttttctcccattaaaaatgtaggaaaacatcatcagattttgtcatccaaggtctataggcaccatagcaatcacttagctggggttccccggctttctgggcatcaaaaactgggcttgaggagctccttctgggccagtggtcacaggttatatcacattaattagtctgactcataattgctcaccaccactgttaagctgaaaaggtttgaactgagtgcccagtaggaaatatggaggctttggagccttaggggggcatctgtgaccaacccctgctcagccggaacctaagaaccacgagagcagtgggagaggagccacagaaatcagtctggcaagagagggccaaagttgaaactgagacagtggccaaagaggtgaagagaagatgtggacaggaaggggcaggcgagggtaggggtgggggcagggtttgaaaaactaggtagctagagaggctatgtaccaacatgacataaaagatacaaaactggctgggtaggtggcttacacctgtaatcccccagcacattggaaggccaaggcaggaggatcacttgagaccagcctgggcaactcagtggtgcggtggctcacacctgtaatcccggcactttgggaggccaaggcaggcagatttcctgaggttgggagttcgagaccagcttgaccaacatgaagaaaccccatctctactaaaaatacaaaattagccaggcgtggtggcgcatgcctgtaatagcagctactcgggagggtgaggcaggagaatcacttgaacccgggaggcagaggtttcggtgagccgagattgcaccattgcactccagcctgggcaacaagagcaaaactctgtctcaaaaaaaaaaaaagaaaagaaaagaaaagaaaaagaaagaaaagaaattccttctctaccaaaaacaaaaacaaacacaaaaattagctgggcatggtggcacgtgcctgtggtcccccagctactcaggaggctgaagcaggaggatcatttgagcccgagaggcagaggttgcagtaaggtgagactataccactgcactccagcttgggatacaggatgagaccctgtcataaaattcctttcttttgctctgcattagtctcttttcacactgctgataaagacatacccgaaactgggaacaaagagaggtttaattgcacttacagttccacatggctggggaggcctcagaatcatggcaggaagcgaaaggcacttctttcgtggtggtggcaagagaaaaatgagagacaagcaaaagcagaaacccctgataaacccatcggatctcgtgagacttatttataagccaaaccatatcatgctcatataacaaatatgccttgagcacctaacatatggcaggtactgtgcaaagcactaagatacaagagacagcagaaaagaacagggaagaaacagaaagagaggcaggagggtgtctggaatttttttctttcaggggagtactagagatgagagaagagtaataagcccattcagagagatgctgagttaaagagaaagctgatgagcagaagaaactagagaaaactaattcaagaaatgatcaaatctagccatgcgtctacataaatatacttccttttcccccatcgtttaaatcaaaatccctcttacctggtcgttccctcttcctctccccactcctcccatatcctcaaagctgccatcacctacaacagctccctctggaagcagcagcatcctctcttctcactcaagcacagccccaaccaaggtcaccagaagccccacccccaccacatctgtcactctaaatggcctttcccctccttggtatctgggtagcccctgaaaccaccagccatgcccttgttggggaagcctctcatttaaattctgtaccaattacagaaaattccatgtaagttccagacccaactcgctcagtgcttggcgctgtgaagaatgccaacaccgagtatggaacccattcctcccaaatggcacagctggtgtgcagcgggcagggggcgatcccataaaacagatactgggtgctggtaagaagaggatgggaagcaaccactgggcaaacgatcaaaaactatccactacagcatccaagtttccttcctgtagctttgacaatttcttcccaaacttcctccggctccctttccttctcccacctcatatacctacatatacggaatattctgcatctgtccctccaaatgcccattggaactctcagcaacttcacacatctactggaatccagcactcaggactaaaggatcggatatcctccctccctgactcctcaaattgacctgaatctcaaggtggaaggaagagatggacaggaacaggaggggctgtgaaactcaagactccctgggacaagctgacacttgctctgggttcccacccatcacgctgctcctgcaaagaagttcatcccatcaaactgaaggaaaacatcaggttcccagcagggggacagattgttccaaggcaatatgggataagacttggttcccagaatttatttattcagcttctaggaccaaagcgacaactagccaactgataattttggaatatatttataaaagaaaaacaaatattcgttattcctctgggccattaaattattttaaacagataataccctcctttaaaaaaagattaaatttctattttcaaccactaaaaatgaagtttggcatagattcagtgatgaggggaagcagagagaaatttagcaagaaatggcagagaaagggtgaaatttctggtctttacattagacacagtgactcagattctttagtttttcaccttgtactagaattctctgtatgttttttacacacagcagagaaatatacccacttttgaactcttaattttggctctttattctttactactaaataatattctaagaaacatccagtatgcggttggctttcacaaacatttcagataaataaaacatcagaaagtcactgtttaatagaaaaaaaagtgatttccaattaccaccaacattctaacaaacacaaacagagcaaagccatctacctccaggcaaatgtggtgtttgggtacaaaaatgtacatgcatttgtgcatgaatatgtatatatctccgtgtagtatacacatatacatgtgtatgttcaagtaataaagactaaacaatgggcaaaataccagaattatcagaatcactttcagtggtaagtaaataacaattattttccccttcgtccacctttctgttttttcaacttcccaccatgttcattcatatatagaaaaggaaaaatcaacaactttattttttatcacacatatgaagatgtatgttcttataaggtatgctcatcttcttatatcaaaaaagccaggcactaaatagaaacctatacatcctgtgccaccaaaaaaacccataaattgcaaagtgaagctgagtttctcttttttttactatatgcaaacctgtttattaagagtagaaaaaaggccaggtgtggtggctcacgcctgtaatcccagcactttgggaggctgaggcaggaggatcacaaggtcaggagttcgagaccagcctgaccaacatggtgaaacaccatctctactaaaaatacaaaaattagccgggcatgatggtgggcgcctgtaatcccagctactcgggaggctgaggcaggagaatcactggaatccaggaggcagaggttgcagtgagctgagattgtgccactgcactccggcctaggtgacacagtgagactccacctcaaaaaaaatttaaaaaaaaaagagtagaaaaaaatagagtcctttgtgtcaaattgctatgtatatgcttaagggcaagcatttcgtaaacgatactgccacatcctaccctttgttttttgagatctctggttctctatttccttaattgtgcttccccacatagagctaaaatgagtagcatgaacagatgtatacattcacacacgcatgtacacatgtgcacactcacacaccatccctgataaatgcatctcagtctctgaccataacaccaatcaccaagaacatgattctccccaaaccataggtgctatctcaggctcctgggctcactgtctcgcactccacggtatgcagggcacccaggtttccgtctgcaccctctccatttcatgtttccacagggaaagacatacagtgtttaaagcaaactcctgattatgcgtgctaatgaaggcaaacattggcacagatgcgtgtttggcacgagatttccctaattgcattttgcttaggctaccatcaaaattagttagtgctcccccaaacacacgcacagcagagggaggaggagatgcccactgaaaggacttgtgggtgatggagggatggctaaactgtgacatcggcctcaaataaaagaaccttttccatactcagtgcctacatgctgactaatgtcatgttcaactggtctttaaagtgcagaggaaatctagaatgccttctgtaatatcctggatgaatggtaagtgatggagctccaatctagaaagcacaaaattttaggcaactccttgctctgcttctgagataggaatttttactttattttattttattttttgaatcagagtctcactctgtcacccgggctggggtgcagtggcacgatctcagctcactgcaacctctgcctcccgggttcaagcaattctcctgccttagcctcacgagcagctgggataacaggcggacgccaccatgcctggctcatttttgtctttttttttttttttttttttttttagtagacacagggttttaccatgttgggcaagctggtcttgaactcctgacctcaagtgatctgcccacctcagcttcccaaagtgctacgattacaggtgtgagccactgcacctggctgaaactttttttttttttttttttaagatagatttaagagatgcctttctgcaactcccacctgctggagaaactcagaccaattctctatcatttctgtatggtaagccttcaaataacagaagaaagtggtcctgtcttcccttactgcttcttcctccgggtaagctgctacccttggcagggtttcctgtcaccattttggttctgctcgtctgactactcaactcactcaaggtcttccttaaaacactgaccatggagctggctctagtcctcaagggctggagtgccctcctgaaaattcagtgggatcaggacactatgctccccttagcccaagagtgggctcattcatctgcagtgactacatcacgcctctgacagacactgatgccaagccaaacccttctgtatatgtacaacaatttattctttttgtctcattgtcctcaaactgtacaggacatcacattcctgctttttaaaggttatctagcaggtttctgtctgccatcctaggctactaagggtatttagactttgtactgaagatcccgcaggggtcttcttggataccacatctcccatccagatgcgatatccagttcagaaacagtcagcagctacatttttcactgtgtccattgaggaataagaaaaaaaaaaaaaagtgggccaggtgcggtggctcacacctgtaatcccagcactttgggaggccgaggtgggcagatcacttgaagatgggagttcaagacctgcctgaccaacatgaagaaaccccgtctctactaaaaatacaaaattagtcgagcatggtggtacatgcctgtaatcccagctattcaggaggctgaggcaggagaatcacttgaacctgggaggtggaggttgcagtgagctgaggtcatgccattgcactccagcctgggtaacaagagcgaaactctgtctcaaaaaaaaaaaaaaaaaaaaagtcattaaaagctgcaggagagagaatgacataaataagaagaaacaagataagccaaaagagccacagagcccagaatcctgggggcctcaccatccagcacaatccctagataggtaacattactgttcatgttagccaggaggcaccttatgtcttcaaaaaaaattaacaccaacctcctttaaaaaaaattcacatgatcttggcttgatgtatgttatttgcaaacaggagtcctatctaacatagaaactattctggtagaaaaagtcagtgtcccacataaagtaccttgccaatttctattaaggtattgggcagtctgtcctaccagtgtgattcactaattaactttctttggtacgttccagcctgcttcaaatccgcaaggatccctgctctccaaagggcattttagtatcttaaccctcaaggcttttaaccattttactcccatttctacttggcttccctgattccctgaagacaatctttttcccactcatactcgctgccacacaatttggccaagagagttggtcttcggtatccgtaggttctgcacccctgggttccaccaactgcagatccaaaatattttaaaaaaggaaaaatagatggttgcactgcatccgtactgcatatgtacaggcttgttttgcttgtcactattccctaaataatgcagtataacaacaatttacatagcatttacattgcattaggtattataagtaatctagagattgcttataatatattggagaatgtgcataggttttgtgcaaatactaaactattttatttgttttattttgttttttcaattgagatggagtctcgctctgtcgcccagttgacaatgcaatggcgcaatctcggctcactgcaacctccattgcccgggttcaagcgattctcctgcctcagcctcccaagtagctaagattacaggcacccgccaccacacccggctaatttttgtattttcagtaaagacaaggctttgccatgttggctaggctggtcttgaactcctgacctcaggtgatctgcccacctcagcctcccaaagtgctgatattacaggcatgagccacctcgcctggcctacactattttatataaggaacttgagcagccatggattttagtatctgtgggggagcagaggtctggatccaattccccacgaataccaagggatgactatacagtgacattaatgaaataacatcaatgaataatttctgcttccaaaaacactgcactatgccctagccaaagaatcacccaaggttggactctaggcaagttataagtaactctagactccaaatggataatagaagacccagtccttaagaaaaaaaaaaaaatgtgaaaacgtatgtccacacaaaagcttgtacacaagtttcgtagcagcattagctgttatggccaaaaagaaaaataacccaaatgtccatcaattaatgagtggataaataaaatatggtacagccatacaatagagtattacacagcaataaaaagaaatgaagtactgagacacaatacaacaaagatcaacctcaaaaacatgccaagtgaaagaagccagtcaaaaaagactccatactgcataattcctttcatataaaatgtccagaacaggaaatctatggagacaaattaaatggttggggttggggattgggtgagaagagctggagggaaatacggatggctggtaatgggtacagagtttcttctgtcctaagaacaattttgaggatggtggcaaaactttataaatgtactaaaattatggaactggcagggtatgttggttcatgcctgtaatcccagcacttttgggaggctaaggcaggcggatcatttgactcaggagttcaagatcagcatgaccaacatggtgaaaccctgtctctactaaaaatacaaaaaattggccaggcatggtggtgcacacctgtaatctcagctactcgggaggctgggcatgagaatcgcttgaacctgagaggtggaggttgcagttggagcacgccaccgcactctagcctgagcgaaatagtgagactttgtctcaaacaataaatgttaagtggctcacgctgtaatcccagcactttgggaggccgaggtgggtggatcacttgaggtcaggagttcgagaccagcctgtccaacatggtgaaaccctgtctctactaaaaatacaaagttagctgggtgtggtggcacatgccggtaatctcagttacttgggaggctgaggcaggagaatcacttgaatccaggaggcggaggatgcagtgagctgagatcacaccattgcactccagcctgggcaacaagagcgaaattccatctcaaaaaaataaagtaatataatataaagtaaagtaaatataaaaataaaaaaattatggaagtgtacattttaaatggatgattcgaaaggggtatgaattatagttcaataaagctgttttttaaaaaatccatcagaggataattaatctattaccacagtataaagaaaaggaatagactcaataccctactttttttagttcattaaaatgtgggtcaaaatcctaaatttaacatatccacaatgttcataaagcagtttatatagttaattccatataatttgcattgtaccggatcggttagggacaggggctttagaataaaactaggtttaagtcccaaccccttcactcacatgttgaatgacctgggatcctcccccaagccccagcttctctataggtaaaatgaggaaaataatagtgcttctttcaccgatgagtgagtacctgacacagtgcagcactcaaacagtaactttataagtaaataaataacaacaacaaaaccaagtacttgtgtgcaatatactaaaccttgctagaagacacagataatacagtccctttcttctattagattatgacaccaagctgactgtttagtgctgcaataataagaatgctatggactgaacatctgtgtccccgcaaaatccgtatgttgaaattctaatccctaaggtgatggtatttggaggtggggcctttgcggggtgattagacatgagtggagccctcatgaatggtattagtgctcttataagaagagacactaccagcctagacaacatgctgaaaccccacctctacaaaaaatagacaaaattagccaggcagccgggcacagtggctcacacctgtaatcctggcactttgggaggccgtggcaggtggatcacttgaggccaggagttcgggaccagcctggccaacatggtgaatccctgtctctactaaaaatacaaaaattagctgggcatgatggtacacgcctgtactcccagctactcgagaggctgaggaacaggaatcacttgaacatgggaggcggaggttgcagtgagctgagatcacgccactgcactccagcctgggcaacagagtgagactctgtctcaaagaaaacaaaaaaatagccagacatggtggtgtacacctgtagtcccagctatttgggaggctgtggtgggagcatcacctgaggctgggaggtcgaggctgcagtgagccatgatcacaccattgcactccagtctgggtgacagagtaagaccctgtctcaaaaataaaaaacaaaaagaacagacactagagacatcctctctctctgccatgtcaggatatatatagagagaggctgtcttcaaaccaggaacccaatcatcagggaccttggtcttggacttcctcaccttcagaactgtgagaaataaatgtttgttgattaagctgcccagtttgtggtatttcactatagcagttcaaactgcctaagacaaagaccaataaagcattatgaggagagacttgtgcagaagacatttaaactgggtcaagcagaaattcttgaattagagaatgaaaagagggaaggaaaggaacaaaatgataagcacatctcccatgcaatatgcttttgctaactcttatccaaacaccagagacctctggggctagatgtttgaacgcttatcagcgcactgtatatccgtatgaaaaaccacaaggtaactagaaaccattggctaaaatcataggtgacaaaaggcatgacttgagatttacgccgtgtctagaacataagggcagaagaaaataaaaagcagacagattaattgtgtattttgaccaaggtacaaggatcaaatagatacatttcaatttccaatttccacatttctgatcattagctaccacactcctatgtatctcatgaaagaaagcaagaaatgaattatctcagagccaaacaacctcctgacaactctttgatctgtttttttccgaaagactgactacctccaatgacactgctctctgaaaaggcaattaatgagacggatgtagcacactgaatgagaggattgaagtacctatgctttttcttttgacagtttataaaacagatttttttaacatgtcagtcaattggtgatattttaaatgagatcacaaaagtcaaggtctttgctacaaaaaacacggcaaacaaactaaaaaaattaatgaaagcatgtgattctagtgtgaaacaacgaccctgtgtcattattggttcaagaagtatgcttttatgccttcaatatggaaaagtaatcaatttcaccttggcgaattaccattatgcacttaggtttaaactagatgtctcaatattatcaatatcttttagaagtgtaaaacataggccaggcgtggtggctcacacctgtaaccccagcactttgggaggccaaggcgggaagatcacctgaggtcaggagttcaagaccaacctggccaacatggtgaaaccccgtctctactaaaactatgaaaattagcctggcgtggtggtgggcacctgtaatcccagctactcgggagactgaggcaggagaatcacttgaacccaacaggcagaggttgcagtgagcagagatcgtgccattgcagtctaccctgggcaacagagcaagactccctctcaaaaaaaaaagtgtaaaacataatagttccataaattcagaatacttaaaagagtaaagcttttaatcccagccctgtcatgatctaaacatacagtgattctctgagtgccaggggccactaagcattacaaggattgtgcaaaatgatgttcattgaatacctattatgtacccgaccctaggctatatcccactccccaggaactcaaaagttggtaggatgagtcctttcccaggcacctcttcacacttcaacagttctttcactcaaccttacaaacaggctcaaaatgggctttcagagattcgccaaactgatactggcttgtccaccaacactgtacacctatctctttcaggctgtcatttccacggacaattcctgacatgccttgggaaagaaaacctcctgtatctacatgggactacaggtatcacatcgtatatatgtatctccataccttgtatctatctactacataaggttacacaccaacaggacgtgtccatgtaaacaaggtaggcatgagaaatgaaaagcgagctcattacagtatgtggggcactcgatttctttaagaccagcttcatttgctgtgattttccactttccagagtgaaaacctggaacggaaaatgaaacgatgtttccaaggttatgctgcaaatcatcagaacaatctgggccaatggacaggtttctagatctgacagctgctcctctatctgctgggacctgctgtttccaaattatcatatgcaatcgagcacctcaggagcaatgcaaattgctaaaatctaagtagagcaggtgaagacatttgctggctgacgaccatattcttgtaacgcactctggggccacatatcctgtggtgttcatagatgcacttccagtctcaagcaggggactgggcacctcgtaagtttaatgaacaaataaggcaattaagatactcaaggaaatatataacatctgaagaggatggaaatagaagtaatcaagcaaacacatcatcaaatgaaaaaaaaaatgtcaaagatcaagggggaagatacccaaattaaaaatgttttccctgggaggccaaagcagaagaactgcttgcagccaagagttcaagaccagcctgagcaacatggcaagaccccatctctacaaaaaaaaaaaaaaaaaaaatttaattagctggcatggtggcacgcattagtagtcccagctactcagtaggctgaggtgggaggattgtttgagcacagcagcttgaggctgcagtgagctatgatcacaccactgcactccagcccgggtgacaaagcaagaccctgtctctaaaaaacaaaagaaagaaagctttcccaacctccttgaattattctgtatcgtctcttgtacttcaggatcatacagcttgagtttgctttaaatttaaaaaccagaatctacaaaatatcttaccttaagtcccacaaataggtcaagagctgtcagtggagacccaagagggttgcacagaagggctacacataccactaatggaacaggaaaccatttttagtggtacatggaaaaccatgtttcatctttacagttataactatttttcaatgtgtattaaaaaatgtattagtagcacattaagcccatgacatcaggactaggtaaagtaacctcacacccacacaagcacacacacacactgatatgatttgaatgctgtcccctctaaatcctttgttgaaatggaatccccactgttggaggtgggggctagtgggaggtgtttgggtcataggagatgccacatggcttcatgctgtctttttttgtgtgtgtgaaacatggtttcgctcttattgttcaggctggagtgcaatggcgcgatccaggttcactgcaacctccgcctcccaggttcaagcgattcttctgcctcagcctcacaagcagctgggattacaggcacctgccaccatgcctggctaatttttagtatttttagtagagacggggtttcaccatttgaccaggcaatgctgtcctttcaatagtgtgttctttatagatagatagatatagatttttaaaaaacagactttatgaggttaatgactattatcaaccatcataaaatagaatgggactttcaaaatcatacaagccacaaggctgtgggctgctacgaaagaagggtggggtcaagggtcccaaggcattttggggtgcgagatgcagggagagcctgagagtcacccagtgtctgtagggacggttgggtcaaggcaataagctaggatctgtacaagtgaaacattcatcagaatgtgacccaccctgaaataggagggaggaaaatctttaagagtttcacaggtaaggtcccaaaactacaaaataataagggggtaatgtatattcctcacccagtcttggcatcaatttgtgctttaaaaaatatactgcactggaagatttaaaaaaaaaaaaaaatgtaccctacaccagctgtttaaaacgtaaatcttatgaacaaatatgtatatataataaattttaataatatttaatttaaaattaaaatgtttaatatattatatatttatatataatacatattgattatatattaattatattagttaatataattatattagttaatataattaatatattaattgataatatattaatgttatttatactggtattaatatattatatataatatatataataaacattttaaacaaataactgtattgtgcctatgcagaaatgaaccaaaattaaactctaagagaattaacttcaaggtcaaagcaaggacgaaggtggtggcagatgctggggtatgctatgtggaggggctgccagggacagggcatccctctcctgccagcagcctgcgccagctatctcgaggctctgagaggggctgtgatgaaatggggctgtttccctgggcccgcagccctggcacgggtgctgagcagagacttgtgttggcttctgtgaggctcaactctgctcctggtctcccctatcctgccctgcccctggcttctcagggaatggagacccactcaccctcccttcttggttctgggggtcccctggcatgcccagagcttctgaggatgcacttgggaaatctcacctagaaaagcaaaagcaaaatcaaacccacaccaaaagacccatagaagattaaagaaatgcaaccacgtgcaaaggtgtctaagcccaagaggtaagtggctacctggagacatggaggaactgccgcagcccttccagatgggccgctaagacacccatattgcatgtgaggctatttctccctgaggggactacttgggaactcggagcagagacccctgcaaactgcagggcaagggacccaaagacatccttgtgcctgtgcaagtgtccaacatgtgccacaggtatggcccagggaggacaggccaggtacatacatcttagggagggcacgggtggaaggaaagtaacagccagagagaggtgactgaaacaaggttttgcttcaagagggaatccataaatggcttttgctattgttaaaagaataactacaggatacaggggcactgacagccggaatggatgctgggagcttatttgcctgcggaaggtccttggtttctgccttggtgtccagggtgtttttgacgtcctgagctttatctgctccggcatggccccgctgggctgggcacccatggcctggcaccagcccttgtctaagcacctcttagaacttctggtatctgctctcttagctgtggcaccacctgccagacccaccaccctgggccccccaggtggctacagccttctcttttcccagagatgtggggagcccccgtcccaccccgagagcagactgaagctcaatacagggcttttgtttgtagaagcttattctctttttttttttttttttttttttttggaggtggggggcacagttgagacagggtctcgctcgtgtcgtccaggctggagtgcagtggtgccatctcaattcactgcaacctctgcctcccaggttcaaccaattctcctgactcagcctcccgagtagctgggattataggcacccactaccacacccggctaatttttatatcatggggtttcgccatgttgaccaggctggtctcgaactcctgacctgaaatgatctgcccaccttggcctcccaaagtgctgggattacaggcatgagccaccgagcctggcctgtcttttttcaaggagaggctgtatatggatggtgtgcagggacactgtcttctgacgatgttgggaaggggaaaagaggaatcagtccttgtcccacggaggtagccagcaaggatgaaggggaagaccaaggacttctctctacggctgcggacgctggtccaaggcacagggtgccagccccagtggtgggcggctctgtaagttggtgccaggtggccgtgcatagtggcccgtggtgagcgtcacttggggaggaggtgggcctggagggaagccggcagcagcagtgtgtgggtctctcccaggcgcaccttccccaggggcaggtgcatggagtgaagtcgcctcctcccagtggccctgatgaggaggcctagagcctggttcctgctgcaagcacgcaggctgcccgagcacgacttctgtgacacaatggtgagttctcatgagatctggttgtttaaaagtgtgtggcaccttctctcactctgttgctcaggctttcaccatgtgacatgcctgttcccgcttcactctccgtcacaattataggtttcctgaggcctccctagaagcctagcagacgccgcaaaaagcttcttgtgctgtctgcaaaacaacgagccaattaaagcccttttcttaataaattacccagtcttaggtatttctttatccaacgcaagaagaccctaacacacacacacacacacacacacacacacacacacacacacacacaacctcttacgtgaatacggtgaatctgataaagaagggtacaaatgccagaagttgatctccaagatgcaggggacagggtggtcaagagaaagtgcagagccgggcatggtggctcacacctataagcccaacactttgggaggctgaggcaggaggatcacttaagaccaggagttcaagaccagcctgggcaataaagcaacaccccatctctacaaaaaataaatgaaataaaataaaataaaataaagccaagcatggtgatgcacacctatagtcccagctcctcaagaggctgaggcaggaggatcatttgagcctaggacttggaggctacagtaagccatgatcatgccactgcattccagcctgggtgactgagcaaaaccttgtctcttaaaaaataaaaaaaaaaacagagaaagtggagggagccaggaggctggatgttaagccctgctgcttatgtttttatgcctcaatttcttcatctgtaaaatggggataataattgaatctacatcacagagttcatatgagaattgaagaaattaaaatagtaagcactcagcaaaagcattacctatcactataatttaacacaaatttaaggtaaaagcaagaagacaaggggaaagaaggggcaaccacgggctgccagcagcaagaagcactggctctgctaagccagggttcagaaaactttctctgcaaagggccggatggtaaatatttcaggccttcctggccataaggtctgtgtcacacgcactcaactccaccactggcacatgaaacgagccacgggtaatacatacgtgaatgggtgtggctacattccaataaaattttattcgtggatgctgacatttgaatttcatataactttcccatatcacaaagtattcttcttatgatgtttttcccaaccatttattttattatttttattttattttattttattttattgagatggaggctctctgtgtcacccaggctggagtgcagtggcacgatctcagcttactgcaacctccgcctcccgggtccaagcaattctcagcctcccgagtagctgtgattacaggtgccttccaccacacccagctaattttagtatttttagtagagacagggtttcgccatgttggccaggctggtctggaactcctgaccccaggtgatctgcctgcctcggcctcccaaagtgctaggattacaggcgagagccaccgcccccaggcttcccaaccatttaaaaccataaagtctattcttagcctaagcaacaaaacaaggcagtggccggctaggttgctgagccacatgctacaacacactaggcatacacaggctgcccaactacatttatattcatttgaacagactggtcggctagacaatcaaagtcccatgcgttggatactaccatttaatctcttattttcaacctctagagagagaaagattttaaccaatatttgatgaactgtctaacctacttagtgagaacaagcttcaatttatctatcttagccctggtatttttctatataaatcaattcctaaagcacatatttataactataaatgtcaagcctccactctgagttttgggctcttcattctgcactccaccacacattatgtccaacatgacaaatttatttcattacattcagtaatcaggaatatttccagtggtgggaaaaagccttggaacatatcacttttcagtatggcttcctcattttaaagatatatttttaaaaaatctattaagaggaattttttagaaagcacaaagactttcttaagcaagaatgagggaacgtgagagatttttggagaatttatacttactcattcctcagtacccactttgtggatgcagtattatggacataatgttttcagttttgattaaataattaatgatgtaaaaacaaggtattatttagattctctccaatcaccaggagaacagaacctcaggactccaactttcttgtttttctatattctctaaagcaatttgagaatctcactaatggacaagttgtaaaacttttgtattactgttatcaaaaatgacaagtgatttaccagtatacacgttcacttcactattgtaccctttaagataatatcttccaatttaaacttgatcttggctttgccttttcctatgtattgaaattacattagctcttctcatcagcatccccccgaaagtaagaattaagaatgcaggagcacctatacaatcacagatgttatgagcaggaagaaggtcatcagacaagattccaggaggtgaaacattgtatcagctcagaagagaaccatgatccgtgcaaccaaagactgaaatttttaagcaaaacttcattatggttcttgaaaagtaaagtctaaaaacaacaacaaaccaccttgtataaatgtatattttgctgtttgatcgagcccagagctttttaaatgaacctatgccaggaaacactgatgttcacccattaaaaacaactttttaattgcatgctgctgaattctaatacattccaaatggaggctcctcattctcctttcttcatgcagaaagtgacgactagcttttccaggatcaaaaccagaccagtattcaaagattcgtagtaggacctgggcacgcacatcaaagggacttctctggccttctaccagccacgcctcttcttaaaggcagacaggcagatacctttctagatgataccagggcaccctggacccaatgcccacgtccaggccttctaggggctctttcttagttctgacctggcaaggtagaggacgatgctacgtgtgcactcataggcccgagggcagctcttggtggggattttaaagggggcttctttgtgtacgctgttgtgtccataaaacctttcattgtccaagatggagccaggggtgggaggataaggaaaggtcatggctggggctggcttttccctaccttacgttcccacatggtattccaaggagtctgacaattgtaactctgaatccagctttccaagtcgttatgaaagtctaggccgggcgcaatggctcacccctgtaatcctagcactttgggaggccgagacaggcagatcacctgaggtcaggagttcgagaccagcctggccaacacggcaaaaccccggctctactaaaaatacaaaaattagctgggcgtggtggcaggcgcctataatcccagctactcgggaggctgaggcaggagaatcgcttgaacccaggacgtggaggttgcagtgagctaagatcgcaccattgcactccagcctgggtgacagagcaagactctgtcttaaaaaaaacaaaacaaaacaacggaaagtctatttgtcaaggtgggagaatatattttattttacaatttgttacctggacttacaacttttacatatccagacaaaggttatatgtgcctccatttgtattcttgcccgcaggcctgcttccttccaccaaaaagagaccatgaatacctaactttttttaaaattaaaagctgctagacatataaagagagtccctgatttaggacggttagacttacagtttttgacttgacaatggcacaaaagcaataagcattcagtagaaatcatactttaagtacccatacgcccatgctgtttttcactttcagtacagtacttaatacattacatgagatattcaacactttattataaaataggctttgtgttagataattctgcctaactgtaggctaatgtaagtgttttgagcacatttaaggtaggctaggctaagctaggatgttcggtagattaggtgtattaaatgtattttcaacttaaggtattttcaacttacgatgggtttactgagtcatattctcattgtaagttgatgagcatctgtactcccattctcagaagccatgaaaacacggtattttaaggttaacttggtattgtctgccttgttaaaaagtcgaaaatgaggctgggcgcggtggctcacgcctgtaatcccagcactttgggaggcagaggcgggtagatcacctgaggtcaggagttcaagaccagcctgaccaacgtgatgaaaccccgtctctactaaaaattcaaaattagccgggcatggtggcaggcgcctgtaatctcagctactcaagaggctgaggcaggagaatcgcttgaacccgggaggcaaaggttgtggtgagctgagatcgcgccatcgcactccagcctgggcaacaagagcaaaactctgtctcaaaaaaaaaaaaaaaaaaaaaaagtcgaaaatgatcttcaatacctgatatagtgttgtcatttgtcccctccaaatcccatactgaaatgtgacctccaatattggaggtggggccaggtaggaggtgttctggtcaaggcaagggcagatcccttggcttggtgccatccttgcagtcatgagtgagttcttgctctgttagttcaagtgagagtgggttaagagagactggcaccgcctactctctctcttgttccctttcgccatgtgacatgcttgccccttcatcttctgccatgagtaaaagcttcttgcagcctcacagaagccaagcagatgctggtgccttgcttatacagaaccgtgagccaaataaacctgtcttctttttttttttttttgagactgagtctcactctgttgcccgggctagagtgcagtggtgcgatgtcagctcacagcaacttccccctcctgggcgcaagcaattctcatgcctcagcctcccaagtagctgggactacaggtgcccaccaccatgtccggctaatttttgtatttttagttaggacagggtttcaccatgctggccaggctggtctcgaactcctgacctcaagtgatccgcccactttggcctcccaaagttctgggattacaggcatgagttactgtgcccagccctcgctttaaaaattaccaagcctcaggtattgctttacagcaatgaaaaaccgattaacacagtactttgccagaattattaaaaatgaaaaacgaatgcaacaggctgtccactgacgtccacttctgaggctgcttttgaggcattactattccatgagctcaacaccaccctgtcctccccagcagcatcctctgcctctgcacccagaacacgcccaagagacatggaggctcccagagctgaatgcagtcacatcgagccttataaaacctgtgtgtgtccaaactgctggattccacatgaatgtcgggaatcctctccaccaccactgagaaccatggctaaagtatatctgaattttttaagagaagaatttcagtacctccttggacttcagttgtttgtgaggactgctaaatagccattttctaaagctgagagtgtctgtttgaatgtggagtatcataaaaagtcacttaaggagtggttttaatggaaacagaaccagcactcagaatgccctaaatctttcctgtctttaccactgactgttatactatataataaccatatggcctgcatttccaggagagttccaatttcatgtatcttattacattaaattaataaataggcttatactgattcttaaagattttctttttttaatattttccaaatgttatacaataaagcacgttttttcataatcagaaacaaataaatttcatttatatattatgtgaatatacatttatatttatattctgtgcatacaaaaacccgcatgtgaatgcttatagcaattttattcataattgctaaaactaggaagcagccacaatgtccttcagcaggtgaagggataaataatcaatggtatatcacacaaaggaatattatccggcactgagaagaaatgagctagcaagccacagaaaaatatggaagaaccttgaagacatattactaagtgaaagaagcccatctgaaaaagctacacactgtatgactccaactacacgacatcctggaaaaggtgaagctatagagacagtaacaagagcagtggctgccaggagatgggggaaaggagggatgaacaggcagagcacaaaagatttttagggcagtgaaactaattctgtgggatactatgtggtgaacacacgtaattatacattggtccaaacgcacagaaggtacaacactgagagtgaagcctggtgtaaactatgaactctgggtggtgatgacagttgaatgttggttttctgtttgtaagaaatgcaccagtctggggcaggatgttggtggtgggagaggtgggccaggagtgagagaggaaggggcgtacaggaactctgcgctttccacccaatttggctggcaacctaaaactcctctaaaaatgaaaatctactcattctctctctctctctctctcgctctctctctctctctctctcacacacacacacacacacacacacacacacacacacacacacacactgccagaggagccagggcaaacacacagggctcctgtttatggccacttgcctgaagcagtgggcaatcattccctccacctccttgcccacagccttggtttcttcttccttccatagtataaagtgattctagttgctacccatgagctacaggcattattataaaactagtaagtggggccaggcatgatggctcatacctgtaaccccagcactttgggaggccaaggtgggtggatcacttgaggtcagaagttcaagaccagcctggccaacacagtgaaaccccgtatctaccaaaaatacaaacattagccaggcatggtggcgcgtgcctgtagtcccagctacttgggaggctgcggcaccagaattgcttgagcctgggaggcagaggttgcagtaagctgagatcgcgccaccacactccagcctgggcaacagagtgagactctgtctcaaaaaaaaaaaagaggaggtggggggagaacaaaactagtaattggagctctctggagatgtcactacgtctcagggggctacttctagagaagtgacaaatggccccacacacagatcactgcttgcctccagagagaagcagtccactggggacacggtgccgctgcagccatgtgacaataaggatggctttcacaccagagcagcagggaaaattggacaagaggggccctcggagaccgaggtcatctaaacacagccaatcaccagatacgccacagaggcgaagagaagggccaaccctgcattttctgccacaggagaatgtattgttctctccaactgagaaagcagattgcgttacatttctccacataaatgaacttacacagagggcatgggggtagtaaaaggtgctggacgagagaataaatattgactaaaacatctatcttggggagggggcgcatgcgttcccctggctgtcgcgtgaaaatttttgctttataaattggggaggttattaaaaggacgtgagatgcatggaattaatgaacaactatctgtgaaaatctatcctaattaggaaacaacatgtacatgcctgaaacagcaggccagtagggagggcctgaacagaaagaaaacaaggagcgaaaacaaaataaggctgtctagcaaatgagggcatcattcttcctctagatttaaaattcaacaggaacatggcttttttcctccgtaatggctgtgaaattgattgggatataggctaacagaggtccccagagtgctaaactaaattagaggaagtcttataattacagctagcagttaattattatatgatgggaattgtaatcaaagtaacagatacactattattttccatcttctctgcaaaacacatctaacaaagtctcttaagaggagtagaggggcttgtttgtggttcaacttatgccgattcctactgcccaaaatccaaacaagaacctcgctcctgcaggtgacttgggctgtgacctcggcgcctgccccattcctgcctttcccacgcatgcctcctgccaatcttcaatacattcgcgggtccctctgcctggaatgctctttctctagatttccacggggtctctccctccacgcagacctcaggatcacacctcctgggagaagtatccactgaccaccctgtctaaaatagatacctatcaccccctccatgtttattctcctacctgccccactgtagctcccgaaacactgtctggctctgagttggtcctcaataaatataaaaaataataataataaatgtaaaatgtttaaaattaatataataatatgaaatattatataatatcaattatattatcaattataacaatattatatttaataatattaatataaaacaaaatattgggccaggcgcggtggctcatgcctgtaatgccagcactttgggaggccaaggtgggcggatcacttgaggtcaggagctcaagaccagcctggcttcacatggtgaaaccccacctttactaaaaatacaaaaattagccgggcctggtagcagatgcctgtaatccgagctactcaggaggctgagacaggagaatcacttgaacctggggtggaggttgcagtgaaccgagatcgcgccactgcactccagcctgggcgacagagtgagactccgtcacacacacaaaaaaaatttaaataatattttatgcccttccacttttctaatagtggaaagaaaccaaagcaaagggatccttcgatcgctgtgatatgattgtatttaagcgaacaacattctagcaagacctatattcagaccagcctggaagtgataaagtctgtgttcaacttagcagcagatctttagatgtaacatcaaagaggtaatgaaagggaattaggattttttaggtatcttttatattctaagcactatgtttggctctgaagagatatgatctcttaacaaagaactatcatgcccgtttgtaagtgtcattttataaacagcaaaaaactgaggcagagaagttgttcaaagtcacatatacagcaagtgccaaattcctatacagatctttttgcatccaaaagctctaagggtccatgtttcaaaccgcttccttcctcttttcctttctctcctcttttcctcccattttaattcctttgaaaaaaattcagaagtagaaaccaatatacaaaaatcttgatacctgccacccaaaatgaacatttctaatttaaatcatgaaaatcacattgaccaaatcagctcctggtttaagttgcccaatatccccgcgccagaaatgagataacaggacaaagagctggtgaaacctcattcaaattacaatttatggccatccttcctggcttggtgccaacacgttatgatccaaatctgttagggggagtcttcccagtcaaaggcagctctgtgtaaaacaaacctctctatacagaaagaaacgctttcattccattccagaagtcagaatgtgaagatgctgggctgctttctgccagggcaaaacgaaagacatggaaaacagggaaatgagaagggacagaggcaacaggtctcacactaaccatttacagataacaaaggaacttcagaattcttccctgctaccttgtagaatggatgaaccatggaatacctgataaacttctaagcaagcttcagcctgcccctgtgcagatctgcacagactccaagtacctcccactgccatgggatgtacatggaccaatgtgttggcttccctttgacctcccccctacaacctcccccaacctcccctctgcaccagcagaatgggacccaggggcacaggaagtgcctaatctctgcaagcaaatgtcaatcttcagggcaaaaaaaaaaaaaaaaaaaaaagctttgttctttagaaccagagttgaaactaggttgaaatgaccacatcaattcactaacttgaattcacaaaggaagcacctgttttcagaaaggcgtgtaaaattgtaaaacaatcttactttttatgccatccttctgaatgaagaactgtggataagctgggcctgggggagacctggtcagttttcccacacagtggtaatggtttgtgttactgaagaaaatgtcaaaaattttttcttaaataaaccaccacataattttactccactaaaaatgagaaataacatagccatgggaagtagcccacatcttttgtattctccatcacacttcaaatatctaaacacctgaccaagcacataaagaaatggtggatgtgctatcactgcaaaattccaactgtaggcagaagtttgccatcctcatagcacagtacacagttcccagacaggaaaattctttgtgctccctcagtaaaggagaaaaattatgaccaattacaataacaagggcattagccactttgataaatatctaagcaggcttccgtctgtgcctgggcagatatggagaacgatttagtgtgatatgagaatacagagttgatcacttatcttgtgaaactgaagaagaaagagaaatgtaaacgtcagcatctcttatcacccaggctctgactcttctcaaactattaaaaatagcctttgggatgggcccggtggctcacgcctataatcccagcactttgggaggctgaggctggcagctcacctgaggccaggagttcgagaccagcttagccaacatggagaaaccccatctccactaaaaacataaaataaatagataaataaaataaaataaaaatagcctttgccagaaactaaaaagaaacagcaaagccaaaattaattccacaaggcggaattggttgctttactcatttatactatgtataataaagagtaataaatttctattattataaatcttactttgacattttagatataacatcaatgccccctgagatatactaaaatttgtctataaagcaaggaaattatttttttttaatattggcttggataagttctctctttaaaatttatatgagaatatccttaaatacttcgtgccatttcaaaccgattttgatttaagatatattacaatctattaaagttttaaaaataataaattaacgtttaggtcaactaaattaaataattatatacaatacattattgctttaaatcccaaggcaaagaaaggaaattgcttcttcaggctgacagaatgaattgtatgcatccactgtggggggaaataccttcttcatctaaaagagcttgccccaaaagtttctattgctcacagcaaaggttgcaaaatgtgaacatttctaaaatggaggattttgtgtcttgagatatatgttatagcccaagagatgagtaaaccatagctgttacaaagaggtgttatctgaaattttccaagcttaaattcaatatgacatttagcattattaaaacccattaagatttttgactttgagttgatacaagcgaaatgagtggccccctgcacaaatagacatgcctttccctggatcatcaaagccaatataccagctcataaatgtctctcacaagttttctttattcccctaactcaaataaagctaacttcatggttgccttggaaaacagacctttttcagagaatgttgacactttcattgatttctaagggctcctgatagcgtatgggcacacacatacactcactcacacatataagtcagagaagcctgactgtcagctgtatatgatcctatctaccaaaaaaaacaaacaaaaaaacaaaagctaaaccagaattttaaagaattggaaggaaatataaggggaaatataaggacaacactctttttttttttccttttctttttttgagacggagtctagctctgccacccaggctagagtgcagtggcgtgatcttggctcactgcaacctccaccccctgggttcaagcaattctcctacctcagctcccgagtagctgggactacaggcacccaccaccacacccggcaaattatttttgtatttttagtagagacaggatttcaccatgttagccaagctggtctcaaactcctgacctcaggtgatctgcccacctcagcctctcaaagtgctgggattgcaggcatgagccaccgcacccggccagacaccacactttctgatttataaattagagcagtggcagcacatgctgaaatatacactccaggagagcaagatctttgtggattttctgcactcctatatcccaactgcctagtaaagtgcctttgaatggattttagctcatggaatcctctcaacgacatgatgagacaggtactattcctaccccattttacagataaggaactgaaattcaaagaacttcgttaccaaagtgacacagctggttagtggggcatagaagcctttaggtcttgcccagtcctcttctctgtctttaccatttggttactgtattcctgtcatccagtgacttcaacacacatcagaagtccttgactattaaagtggaatcccggccgggcacagtggctcatgcctgtaatcccagcactttgggaggccgaggtgggtggatcacctgaggtcggcagttcgagaccagcctgaccaacatggagaaaccccggctctactaaaaatacaaaaattagctgggcatggtggcaggctcctgtaatcccagctactcaggaggctgggcaacaagagcaaaactactcttgcctgggctactccagcctgggcaacaagagcaaacttcatctcaaaataaataaataaatgaataaataaataaataaagtggaatcactgcagggtgagtctgcattttttaagtcgaagttaggaactcaaaaagtaaacaagtgcatatgaaaagatgaattcatatgcactaagttaattcaaaagcatgaatgaaagtattttttaaactaaatattcattggtgatgtcatgtatccaatgacctctgcccctagtcagtgttagtaaccagctcttcatcagctacagatagactccagcacttctgtacctcttcctcattctactgtctagacctgaaattttaactgggaaaagctggaagctaacactaggcaagaaaaaatgggccctgccctcctattgtagcctagagccgaatataaacaatggtaaactgttcctctattgggatatggcagccatgtcaatcattgcttcccaacaatcccaccttttggagagcctgcctgggcaagtctgagaccacccatcatacatacacccttgcatcccagcagaagctaagtgaatacatgactcagtattggccaaacagactctcacttaaaaatttggaattaagattgggctcatgcctgtaatcccagcactttgaaaggctgaggctaaaggatcgcttgagcccaggagttcgagaccagcgagaccccatctctacaaaaaatataaaaattagctggtcatggtggtatgcacgcctggaaccctagctactcagggggctgaggcaagaggattgcttgaacccagaagttcgaggttgcagttagctagaaccgcactactgccctccagcctgggaaacaaggcaagactctatctcttaaaaaaaaaaaaaaattggagcccgggcatggtggctcacacctgtaatcccagcactttgggaggccgatgcgggtggatcaggaagtcaggagatcgacatcatcctggccaacatggtgaaaccccgtctctactaaaatacaaaaaattagccgggcgtggtggtgcgcacctgcaattccagctacttgggaggctgaggcaggagaatcgcttgaacccaggaggcggagattgcagtgagccgagattgagccactgcactgcagcctggcgacagagtgagactctgtctcaaaaaaaacaacaacaacaaaaaattggaattgagacactgtgagactaagacagttacctagaggaaaggtcaggtagtattggactagagcaacattgcaccaaatcaaagccatttggtaagcagtaaatctgagatgtcgtcagagaccaaccaagaaagtcagtctgcaagtaggaacaagaaaatggcaaaaccttgcagagaaaagcaaaaattgacactatgggggcctctgagagatgcaggaccaacgtctcttcctgattttcctgctttacaaggcccgcacaaccctggccgtccacgacatttcccatatcccttcagtaacaccatttttgcatgagttcacttgagagagcttcttcacatttcatcataaccaaaagatcccaagaacatagtatttcccccctcagtttctccccgttagaaaaactgactaaaggccgggcgtggtggctcacgcctgtaatcccagcagcacttttgagaggccgaggcgggggtatcatgaggtcaggagagcgagaccatcctggctaccatggtgaaaccccgtctctactaaaaacacacaaaaaaattagccgggcgtggtagcaggcacctgtagtcccagctactcggaaggctgaggcaggagaatggcgtgaacctgggaggcagagcttgcagtaagccaagatcatgccactgcactccagcctgggcgacagagtgagactccgtctcaaaaagaaaaagtgactaaacaatgtatcttcctgtacgtctccaagaagacaggggctcacagcaccacggctaatgtgcagggctcataatcacagaccactgccaacatccctgaaatgccgaatcccaaaaggcagcatgactcagaagaatttgaattatcccaaggttaacagttaagtataaagatgatatacttttttatttttttaagacagagtcttgctctgtcatccaggctggagtgcagtggcacagtcttggctcactgcaacctccgcctctccggttcaagtgattctcctgcctcagactcctaagtagctgggactacagacgcgtgccaccacacccggctaattttttgtatttttagtagagacggggtttcaccatgttagccaggatggtctcgatctcttgacctcgtgatccgcccgcctaggcctcccaaagtgctgggattacaggcgtgagccactgctcccggccgatgacatacttttttaagaaaaaattccatagtacagagaaaacaaaaacaactccccgctgctttttttgaagaaaatctaccaagctctcaggctgtttttcagctattcaggtagcgctacagaacaaggccagtctgactcatgatagctcaaaattataaaataatctaccatggattcagccttactggtttcaaatacacataacatacaaacagatgcccagataaatacataaagaagtgaagctagaataaggaatagtctaaaaattgctgggggctggagaatagagagatcccttctgcttgatgcatcttgcttgatactggaagaaagaacgaggagaaaagtcaaaaaatgaattagacagtccctgccctcaaagacttcctagtctagctgagaagacagtcaccctcacaaatagctcaaatccagggcagatagtgacagaggctaattggaagtctcagcaaagcgtgatgggatcacggaggcaggagcaattaatcacaggcaagccaagcaggcgacacttagccgcaactcacacagggctgtcattgtaaaaggaaatccactctaacagttatcatgaaattgcatccatgatctttgagtcttatcagtccataccttttatctgattaatcgaaatcccacccttttccaggaaaaacaacatttgtttatcattccctccaagagctcttaagatgacacaatgaccttgaattatccttttatctttagaaaatatcctccctctgaaaaggcaacaaaaaagtgaagataataaccccaaggagttcaagaccataaatgaaaataaccaaattgcttggtctctatcccataactgagctgctggacttcacagtccactcaactgtttgccgtgttaaaaatacttaagcaaacagagctatgctaaaaagccatgtgtctatacaacatttattacagttttagacagaggttctgtccctcatcaaaaaacactggtcaaatcctacactaagtcctattttaaagaggaaaaaaaaaagtgtatgccaagctaatgaaattccagtatggtctttttttttttttttaagagatgggtctctttatattgcccagtctggtctggaattcctaactcaagtggtcctcctacctcagcctcctgagtagctgggattacagacttgagctaccacttccacctatttattgtctgcaattctgtgacttgcattgtgccaatttcaatttcctggttttgataatgcagtatagctaagtaagatgtcaccactggggaaagctgggtggtgggtacccaggacctctctattatctttcaacttcttgtaagtaagtccacaattatttaaaaataaagtttaaaaaaacactcatgacatttatcattttgcagagctctaccaatatccaacagctccctgttcctcctagatcctaatattttgatattggcccttaaaacttgcagatacaggccaggcatagtgggcatgcctgtaatctcagcactttgggaggccgaggcaggaggaatgcttgagcccaggagtttgagaccaacctgggcgagagagtgagaccccctcatctctacacagaaataaaaaaattagccagatatggtggtgcacaaactgtggtcccaagtactcggaaggctaaaggcaggaggatcacttgatcctaggaggtcaaggttacagtgagccatgatcatgccactgcactccaacctgggtgacagggcaagaccgtgtctcaaaaataaataaatgaataaatcacaataacaaaaaacttgcaggtacaattcagcaaacacatgaccctgctcctgggaggggcagccagaaagggcatttccagcacagttcactctcttcaagagtccaagaaagtcaatgtcctcagcctatccccaccctggaccggttcctttgctttgctctgccactaatcccccttcccgagcccacttcccctgtattagtccactttcacactgctgataaagacataactgagactgggcaatgtacaaaagaaaggtttattggacttaacagttccacatggctggggaggcctcacaatcatggtggaagacaaggaggagcaagtcacatctttcatagattgcagcaggcaaaaaaaagagcttgtgcagagaaagtcccatttttaaaaccatcagatctcatgagacccattcactatcacaggaacagcacgggaaagccccgcccccatgatttaatcatctcccactgggtccctcccacaacacatgggaattatgggagccataagatgagatttgggtaggcgacacagagccaaaccatatcacctcccaacacacacaacacagatgggagacatttaaaagtgatattaagaaaagcaaaaccaagtcagagtctccaaccacaaaactcacctccaccttcctaagccttaactctaataaacctcaaccatatttgctttaaaagtataaaagactgggctcctatggaattcaaaacacaagacatactcaaagagattgccgtcatcctaaattcttctcaaagatacacaaacgtgcaagccctgctggtgatcactggcttagcagtgattaatatggctcaacacccacccccaccccactcaacacaaattgagtcccatggcttaaatgttatcttaaaaaaaaaaaaaaatcactcctaacattgtcactcttgagcaggttcccaagataaaatccagacatcattataatttattaaacttttgagaactttaatactaggcctatagagcaatgattaagagaaggaatttgatgctaaagaggtcaaatccctttagctggatgcatatagaacccaccctttaagacctgaataatcttaagcaagttacttaaactttctctataaaatggagaggatgataggattagttagaatcctgcttcattataattctcgggaagattaaataattaatacaaaaaagctttagaacagggcctgccctacagcagcatgtgttgtctattattattactaatgcaataaactttcatcaagcacctgggtcccaaactctacgaatgcaagataaaagaaggcacagccatgattctggaagaatctgcatgttactaaatattcagacagagaaaagtcagaccatgctggtgccaccagcccatcagagctctcagccctgtaggtagaacttacgagtcacaaataaaactccaacaaagcagacatgaaatgtcagtggtatgtgtcactctacccctcctcattcaattttcaccttaaaaaaaatcaacaaactcccaaatacactgccctgtttcacacaaagtttgtgccattagatgagttttttaagttctgcagatcactctattaaaacaccagacataccaataacactgcaactactggccaaaaccattctcctcccttcttgtccttctttcccaggacacttttaaggtcatacaccaatgacatccccaacattcccatgagcaagggaaggattcccgggaaagtgacagctctcactaggaggcagagctccgtgccatattgatgaggttctctcgaaacatctcaaaagcagggatccttgtggtttctgaagtgttgccaatcacacaaagaaagcctaatgcatggttttcaagtcagttttataaaacgattccaaacctctaagtgtgtgaagccaaaattgtaaacgctgctaaaatccctggagttgtttaatattgtttattacgattcctcttggcacctccaaagtctctcatcctgggctcatggagcattttattaatttacacaccatcagtggagttcacagatggtgggaccgaaacacgaagaagcggctcaagcacctcggcaaagatcccaacaacttgtaaataaacatagctctaaaagacccagaagtctcaacctcctctcccaagcactactgctaccactggtgctgaggtgagccactggataccctggttaaaaccaaaagaaagtccgtggctcgacccatcgggagcaggctccagttctaaggttaaggatttcaatactgtccttttcaaatgagtcatttgctcttaatttttttttttttttttttttttttggacagagtctcgctctgtcacccaggctggagtgcagtggtgcaatcttggcttgctgcaacctccacctccctggtttacgcagttctcctgcctcagcctccagagtagctgatattacaggcgcccgccaccacgcctgggtaatttttttgtattttcagtagagacggggtttcaccatgttggccaggctggttttgaactcctgacctcaggtgatcggccagcctcagcctcccaaaatgctaggataacaggcgtcagccaccgggcccagcctaaatcaatccttttaaggatatttaaggaatcagtgaatggctgacctgtccaatgtgcccacagaaggaagtaagagctctttggaaatttgcatgcttgcaattgaaaaggctccttgaaattttgctgtatctcacattgcagaaaacaaatccaaacttagggcaaagacatcagttctgttaaaaacctaggatttacttctacattattcagggtattcttgaagcacctggttatactgtttactatgtgtctgtctatccttcttttgtttatattttagttatttttacatttgtggccaaaatcttacacttgtaaagaaaagagaaagacaaagagaagaaatgagagtctgtcaactgaaaatttaggtcactgacatcaagtggtcatcctgatatcaaggggacaagccaggatggtgaaagatgggaaccactcaggcccttgaattctcttcttttataaagaaaagttcaaattacggactctctttcccgagtcagctaaaaggattcaaaattacaaagagccaaaactccagttttgaaacactcttcctgtttatagtgaataaattccccaaatgcagaggaattagattttaatgaaagtctccactatcatgctattgctcaataacattttggctaaactggcttaacccttcccacaacttagaaaattctgacactctcatcaacgtgaatggggagcaaattcctattcttaatatctaatcacttttatttttcatcttctccccatgtcttagattagttctattttgaggacactgatgagctctgtttactgttctcacacgaagacaatggttctctaagtatggtccccacaagagcgtcagcatcactcaggaactgttagacatgcacattttcgggcctgacctgagacctaataaatcggaaacctagaagtggggcaatctatggtttacaaagcttccaggtggctgtgatgcaacacactttgagtgccaccgctctcagccaccgaaacaccatcacctgtgtcacccacatgcccccccctccaggcttcatcagtgcggtgggtcctaagaatgtctctgtaaacacattgctcccacactcatgctcctcactcccctaaatggcagcaactcagaccttctccttttcttttttttttttttttgagacgaagtctcgcactgtcacccaggctggagtgcaatggtgccatctcagctcactgcaaccaccacctcctgggttcaaggattctcctgcctcagcctctccagtagctggaattacaggcatccgccaccacacccagctaatttttgtatttttagtagagacggggtttcactatgttggccaggctggtcttgaactcctgacctcgtgatccacccgcctcggcctcccaaagtgtcgggattacaggcgtgagccaccacacccagccagaccttctcctttcttagatctgacagtctcaaagttgagttttctcacagactgcccctccaccccacctcctgctccccacatctctctaggttgaggttccacagcccacagtcactccgcacaccgacttcctgctccttggatgccaagcacacaggactccatgctcagctccacacaccagcatcaccacccctctcaaagccccattcagacctccgcaccacaggcccgcttcccttgcagccatggcttgtcccccaagttctgcaaatacacctctgcccctctccatctctcctccagtgccttgcggccttctctgggctggaggaaaaaaatccatgctctcccaaaggcctccctccctggtggggggcaggggacagctggctttttttggctaaaagttctaaccctgtccccaaaagcaatgagagctaggtgaagggcaaagggttaaggaggccttttttttttttatttgggggcttggggttttcttttaagcaggatttataaaggctggctgttgattcctttgagagaaaaaaggagatccaagttttctctggcactacacgagacagccagggaaacgcagcaacatcctgtcctgggaactgactgaagcagttattaaagtcaatggaggcagcactgagggcgtagcagtgtgtgtgtgtgtgtgaggttgtgtgtgtgacagtgtggagagtgtgagtgtacatgtgaaagagcatatatgtgtgtgaaaaagggtgtatgtgtgagtgtgaaacagtgattgtgagtgtgtgtgagactgcattatgtgattgtgagcatgtgtgtgacagtgtatatatttgtgtgggtgtgtcagactgtgtgtctgatagtgtgtgtaatgagacagtgtgtgtgtgagtatatgtaggagactgcgagtgtgtgtgtgtatgtgtgagcaactgtgtgtaagagtgtgtgtgacggtacgtaaatgagacagtgagagtatgtgagtgcgtaagtgtatgagactgtgtgagggtgttacgtatgtgagcatgtgtgagcgactgtgtaagagtgtgtgtgatagtgtgtatgtgtatgtgagagtgcatgagactgagtttatgtataagtgtgagcatgtgtgagcaactgtgtaagaatgtgtgcatatgtgtatgagactgtgtgagagtgaattgagtgttagtgtgtgtcagtgactatgtgtaagtgtgtgtgctgatatgtatatgtacgagacagggcgtgagagtgtgtgtgagtgtgtatgtgagagagacacagagagaaagaaagggaggagagagaggcagagggaggggagagaaaagagagagaccaacagagacagaaagggagagtctgaatccagtcaacgtgagtcctcccactggcaggcagataaattacctggtggtttcctgtgtctgacggcaactaaaataaggcatacaaaagcatgaactcagctgaagtgagagcattaggggcccgctcctcactggacgatgttacaaagagcccctgaaaaacattccatgttacatcacggccacaaggcaagtggctccaagggtgagtgggctcctgacattgaggacaggactgtcctgcccactggggatgatttagaacctctctctgcctcccacctcaatcataaaagcacccccacccccatgatcctaaatgtcctcaaaagggaagtagcaccccacagaaaatgaaactcctgaaataatccaagggcaaagaggagagtaagaagctggggctgtgccttgaacttaaaataataataataacaaaatgcagcaaatattaaaagctagagattttaaatacaggggatgtcctagatttcactgtctggataaaggtgactacagagcagaagttagcaaacttcttgtaagaggccagcaaagaagtatctcaaactccaggagccattcagcatgtctcaaccctgccacagaggtgcaaaagcagccgtggaagataaatgtatacatgtggccatttcccaagaaactttttttttttttttttttttggagatagggtctcactcccttgcccaggctggagtgcaatggcgccatctcggctcactgcaacctctgcctcccaggttcaagcaattctcctgcctcagcctcctcaatagctgggattacaggtgcctgccaccatgcccagctaatttttgtatttttaatagagatgaggtttcaccatgttggctaggctagtctcaaactcctggcctcaagtgatccatccgtcttggcctcccaaagggctgggattacaggcatgagctaccatgcccagccccaataaatgttatttacaaaaacagatgacaggcgggatctggcctgcaggcgggctatggtttgccgactgctgggtatcaagtgtaagaacgtatgtaatgggcaatcggacagcactagaaagtgcatttcgtcagctcttttaaagaaacaagacggctacccaaaggaaaagaaatcgttatatcagaaagacacctgcattttatatttattgcagcaggattcacagtagcaacgatacagaatccacctcggtgtctatcaacagatgactggataaaggaaatgtgatatatatacacaatggaatagtattcagttgtgcaaatgaatgaaatcatgtcttctgcagcaacctagatggaactggacgccgttatcttaagtcagacacagaaagacaagtattgcaagtgctcacttctaagtcggagctaaataatgtgtactcatggctgtagagtgtggaacgatagacaacgaagacttgaaaggatggcggggtgcaaagagggtagatgatgagaaattacttatgggcacaatgtatgttatttgggccattggtactccataacagcagtccccagcctttttggcaccagggaccggtttcatggaagacagtttttccatggatgagggggtgggggatggtttcgggatgaaactgctccacctcagatcatcaggcattagattcttataaggtgcacgaagccaggcacagtggctcacgcctataatcccagcactttgggaggctgaggcaggtggatcacctggggtcaggagttcgagaccaacctggccaacatggtgaaaccccatctctactaaaaatacaaaaattagccgggcatgatagtgcatgcctggaatcccagctacttgggaggctgaggaaggagaatcacttgaacctgggagggagaggttgcagtgagctgggatcacgccactgcactccagcctgggaaagagagcaagactgtctcaggttaaaaaaaaaaaaaaaaaaaaaaaagggagcacgcaacctagatccctcgctcgcatgtgcagttcacaatagggctcatgctcctatgagaatctcatgctgatctgacaggaggcagagctcaggtggtaatgctcactcacaggccgcatacctcctgctgcgtggcctggttcctaacagaccatagacaggtactggtccatggcctggggattggggacccctcccctaaaagccctgacttcaccactatgctgcaatctatgcatgtaacaaaatcggacatgtattccataaatttggaccactaaactaaaatataaagaaacaaaataatatcgtaattctcctttctcagatgcttctgttcctggatgggaagatctccccacatccactaatttgtatctcccttactcctggcttgtgcatgtcttcctctttctgcgtatttcttttttcttttcttttcttttctttttttttttttttttttttttgagacggagtctcactctgttgcccaggctggagtgcagtggcacgatctcagctcactgcaacctccgcctcccgggttcacgccattctcctgcctcagcctcccaagtagctgggactacaggcacatgccaacatgcccggctaatttttttgtatttgcagtagagacggggtttcaccgtgttagccaggatggtctcgatttcctgacgtcgtgatccacccgccccggcctcccaaagtgctgggattataggcatgagccaccacgcccggccctctttctgcatatttcattgcactccattctcccctcagttttgctcctgtctttgtcccctgcgaaaggaatacgattaaattgattatcattctgctccattaaaaaacaatgggtaaaatgtattatctagcattcgccaggcccctcatcacagatatgctgtttcttgataccagctccagatcagatttgaagtcccaggcaaagaacgtgcaaacagaccaaccagatgccatctccttccacagggttccagtgctgctaaatgagatgaagacccagtcccaaagctgtgagtgtgactcagccagtccccccgcaacacgagctggggttacgtcacctgcacaaggtcaacatctggaaagcagcagagcaaccgtcgtgatgggagtggtgcattcttccaagttcaaggcaactgcaaacatgacatttggcggatgacaaaggcctaaaaggagacttaggatttggttcaactctgtacttcattccctaccgcctcaggctctcaggagcccatggattttgccactctgaaagcacaagagagagaattccagagttgcggagaaaaatctttggcaagcctcgaaaatggccagaactcattttctttgtgacagcggaacatacaagctaagggtccccatgtaaaagttcccgtcctcttgtgaatctccttaacaacaaggagcagtcaagtgtccgtaagaaaagcataaatatacagcttatgtacacatgtcttctgcaggtggttttcatcagactcaaaagcgaagctgtcctttttcttctcgaatctaacagtgaagaatcccaaaggatatgaaaagctctcagaatgaatcagccaccactgggaaaagcttactaacagggctaattccaggggccagtggcagatggaggtgggagcaacggcccctttctatgtgtccagtgaacaatcaaaaaagcatcccaggtcagctgaggaccctccaccatttcctcctgtctcttgtccaacttgatgacttccagaactaaaatattaaagagtgtctacgtcaggaagtgacatcaaccagaacaatatgagcctctgaaggacaggtgtctgggcagttggacccgaaccatagaaaaaagaaattctctcttctgttgccactggtgcagatggatgagatctgagaatcatttcctcagcgggcaaaaacccagggaagaggaactggaaaaaggtcacgtccaaacaaatatgtcaaccaaacgaagagagtcccaaaaggcatgggcggacacacaccgcccacaataggagaaagccaccactgatttgaaatcatcacgcactccaaggaacattctcacaaatggcccctgggaaagtttgtgtggtcaggtggttagatggccctaggaggcaggaagtcacagaaagggtgtacccctgagggatggggaatgttctgtgactcttccaacactgagtgtctccttacacctataaaactaaagctagggcaaaatcagcagtccacgtaaaacaaatgggagagcctcagctatagaatgtcttcttacccaacggccccaaagcgtaagagaaaatcccactatcccatataagatgtctctacaaagtgcttagcacaaggtcaggaatcctcagtaaatttaacctaaatttataatgttattggttatcttattaacaacaacaataatattcatagctgccaatgaagcaggtgttccctccagagattaaaaactcagttaccgtctaagcaaacccattgagttcgctaatgaaccactttctggaaatcatagctattcaaaatattctttcaaagtccagtatcccccatgtgcaaacacttgcagtgtctgccccttcttcccctcccatttctaacccagcaatcagggatatgggtgatcagttactgatgctaggacccaatgtcctcattccaactaaaatacaacacactaccttcacccagcttgcttttctctgtcgccacaatttttctctcctttacttctccactatatgaagaaatggtaggattgttgtggcctcttctggttttaccattctcagcttctacacccttttcttcacattgctttgtttccaagggctccatgactccgttttactggtcagggaagataatttgaacgtttgagctcctgggtgatgtggggacaaaactggcctctcattcatttttggccatgacccaacagaatgccttccccacactgtctcctccatgtctctgtctcggccacctcccaggtcaagctcatctttatcctagtttatgaccacaggctcctaacagacatcctgccttctaggcctcctcccaccaaccagccttcccaatgctacccaagggatttctctccaaggcaggacatagatttcattcttccctaatgagaagctttcagtggctttaactttctgttagtaaaattcaagctctttggggttacctttaaaaaggcctccataacgtgacgccagtggggctctctcttctcccctctcgccaaatcctcacaaatcctatataccagccccataggacaactcctctcctattgtgccctgcaccttcaacactccaccatttccctgcatgcctctgccacccgatgcctcccaactctggctagtcttcgaagcaccctgcaagatatgcctcaaatactgtggattccacatagtgaaatttttttaattttaatagttttgggagtacaggtggtttctggttacatggataagttcttcagtgttgattgctgagattttggtgcagccatcacccaaacagtatacactgtaccccatatgtagtcttttatcccttacccccttcccaacctttccccctgagtccccagaatccattatatcactcttatgcctttgcatcctcatagcctagtgcccacttataagtgagaacatacaatatttggttttccattcctgagttacttcacctagaataatggcctccagctccatccaagttgcgcaacagacatgatttcattcctttttgtggctgttccaaggcaaatatatgccacattttctttatctactcattggctaatgtgcacacaaagtgaagtttaatatccagataaaagtgatcacttgctcagcgctctcaaccactttgcttacatgacacatattaagggggactccttaaactatgttgggacatcatgtagtgggccctaaagtgaatcaaattaacatctgatatgatccaagcaaagatcttggtgtgggaccgaatcaacaagtcaaaggaatgtctttaatggggatgctgcctgtattcatctgttttgacgctgctgataaagacatatccaagattcagtaattattttattttattgtatttcattttattttatttttttgagacagagtttcactcttgttgcccaggctggagcgcaatggcacaatctcggctcactgcaacctctgcctcctgggttcaagcaattctcctgcctcagcctcccaagtagctgggactacaggcatgcgccaccacgtctggctaattttttgtatttagtagagatgtggtttcactatgtttgtcaggctagtcttgaactcctgacctcaggtgatctgcccaccttggcctcccaaagtgctgggattacagttgtgagccactgtgcctggccaactgagtaatttataaacaaaaagagatttaaatggactcatagttccacatggctggggaggcctcacagtcacagcagaaggcaaaaggcacgccttacatggtggcaggcaaaaggaaaaaatgagaatcaagcaaaaggggaaatcccttataaaaacatcagatctcatgagacttactaccatgagaacagtacgggggaaaccacccccatgattcaattatctcccactgggtccctcccacaatacgtgagaattatgggagctacaattcaagatgagatttgggtggggacacagccaaactatatcagtgtcctaacaagcaaaaagcaagcacttgccatcagggacagaagagaacagatgtacacctgcaggtcaattcctgccacactctacctgtgcagtcagggacatggaggttttcaacaggatgaccagggacagtctcgctgaaaaagaaacatgacagaacccacacctgaagggggtacattatgtaactacctggggaagagtgctccaggtagagagacacaggacaagaggcttgaggctggcacttgccatatgaatgagcaacagctgagtggagagagagagaaattgaagatgggaaggggcagctcaagtcagccaggaaccactgtgagcccttcagtttttatttcggggcaattggaaaggcccaaaaggtactgagcagagtgacactatctgacttttaaaaaggtgccctctaggccaggtgcggtggctcatacctgtaatcccagcactttggcagatcacttgaggtcaggagtttgagaccagcctggccaacatggcgaaaccccatctctactgaaagtacaaaaattagcagggcgtggtggcacacgcctgtaatcccagctactcgggaggctgagacaggagaatcacttgaacccggcaggcggaagttgaggtgagccgagatcacgccactgcactccagcctgggcgacagagcgagactctgtctcaaaaaaaaaaaaaaaaaaaaaaaaaaagttgccctctggctactgtttagacacagggtggtgggaaggcaagagaaaaagcagcatccaaatgcaaattaaacagctgctgttttcaggcagggactgaaaacaccagctaccaacttggatttaagaaaatggccaagggtgtccactctcccctaccccggtggctgcagatacaaagacctgcagcatcctggcgagggatgaaaggagagctctctgtagtttttcaggccaactccacagaagctattagaaaggttagcagtaagtgcagcccagctttaaacacaggagttagaggggtcacctcaaatgaaaaggagactgagagacaaccttctcttgggagctcccctggaaacagaggaaaacacaccgccagagaagaaagtcgccctgaaaataccagcgacactggactttgcacagaatcagcttcagagagaggccttttgctgcaagcagggtggcgaggcctcttagaactaccgtttcttttactgcagttgaaggaaagaaaaaggagtcaaggtcacacactcaggtggctttgaagcccagcccccaccgagcggtctagcccagtaatcctaggttgaagatgtgtgcaaattactcttctctgcacctcccatggtctccacgagatctgccgggcacaccagggctggccagtgaccctcctgaaggagcttcagctctggaatcaactcagcctgagaccctggtaactaaactcctccaacctcctcgcttctcctccaaaaatcggtattcagtgagattcacgtatgaagagcactcagcacaaggatggtactcagcaaaggggagttattattgggatcattattgctaattctcttcagctgcacatgaatgcgtgagaaattcatgttaagtaaagtaaaataatggaaacattcactggtaccataagcaatagatgcatcatcattaaacaatagagtgataaaaacaggacagtgacgcaccttgtagagcgatgtgtcatctaaaacatctattcaaggaacagaagactcaccttcagttaaatgccatcctccccaagatcttgatccttcggagatacaaaatcttcagcaacacttacaagtgagctgttaatactagtatgtccagacgctgatgacagcatttaaaaccctctttctggacactaattcagcaataatatgcattagatgcgtttaacagtttaaactctttttccagtaaatctgtgtttaaaatttttaatctaaggatggaataaaagatacaaagatttacacacaaagaagttaatacaccccacaagtagaaaaacaaaagtggaaaacaaaatgatgagcaaaaagaagcaattaaataaactacataacatcctagactgagcgtggtggcttacacctgtaatcccagcactttgggaggtcaaggcgggtggatcacctgaggtcaggagttcaagaccagcctagccaacatggtgaaaccccgtctctactaaaaatacaaaaattatccaagcgtggtggcgcgtctgtggtcccagctacttgggaggctgaggcaggagaatcgcttgaacccgagaggtggaggctgcagcgagccaagatcgtgctattgcactccagcctgggcaacaaaagcaaaactccgtctcaaaaactaaaaataaaaaataaataaactatataacatccttataagaaacttctctgcaatttttgaaaaagcgactttaggaaaaatatctgtcaggagaacctgagctacctgagaacctagcaaatgggcaaggttggatgagatgcaatttcctgactttgccacataataataatgatatgtcatggtatagaaaacaagccttgaaagggacaaaacagctcatagcccaggacagccacatcagcctccatgtctgtaaaaaatacccatgcaccagagccttctcctcttctgttgcatctcctctggacatcagtgaacacaagctccacagaaattccaggaactaatagaaagaaccagttgacctttccagggaggcttacttaagggaaatttgtgaaaaacttttccagtatcccagaccctaaagagtctaaaggtgagtacatgcaataaagcctcgaagcaaagcatatcagattgtccaaaatgatgcaaccatttagaattcattgaattgaccacctgacttgttttactgtggtctacatcactgttagtgttggatgtggttttaaccaagtgtgtattttccaaactttgtccagcagagtagaattgctttcagaactcaaacttctatctagggggtcaaatagggtctccctcaaaatagtgggtcaaatagggtctccccaaaaaattcacatccactcagaacttcagaatgtgacgttgcttggaaatagggtctttgcaggtgtaattaagatgaagtcggccaggtgcggtgactcacgtctgtaatcccagcactttgggaggccaaggtgggtggaccacctgaggtcaggagttcgagaccagcctggccaacatggtgaagccccgtctctactaaaaatacaaaaattagccgggtatggtggcgggtgcctgtaatcccagctacttcggaggctgaggcaggggaatcgcttgaacctgggaggtagaggttgcagtgagtgcagtgagccgagatcatgccactacactccagcctgggcaacagagtgagacttcctcttaaaaaaaaaaaagaaaagaaaagaaaaaaaaagatgaggtcatactgaattagaatggcccctaaatccaatgactagtggcctttaaagaagagaggacatacagagaaggccaagtgaagagggaggcagtgactggacgttgcagctacaagccaagaaatgctaaagattgctaggagccaccagaagaagagtcgggaagaattcctccatagagcaggggtccctaaccctcgggctgctgaccgataccagtctatggcctgttaggagctgggccacacagcaggaggtgggcagtgggcaagcgggtgagcattaccacctgagctccgcctcctgtcagatcagcggtgacatcagattctcataggagcatgaaccctgttgtgaacggcgcacgcgagggatctaggttgcgcactccttatgagaatcgaatgccgatgatctgagatggaacagtttcattctgaaaccttgggtccgtgggaaaaactgtcttccatgaaacttgtccctggtgataaaaagcttggggaacactgccccagagcattcagaaggagcatgccagccggctgcagtggccacgcctataatcccaacgttgtggaaggccatggcaggaggacggcttgaggccagacttttaagactagcctgagcaacacagtgagaccctatctctacaaaagaaaaaaaaattagtcaggcatggtagtgcacgccagtactcctagctactcgcgaggctgaagcaggaggatctcttgagcccaggaggtcgagactgcagtgagttataatcacaccactgcactccagtcgagttgctgcaggtaaacaagagttccataggcctagataggtgacagaatgaccctgtctctaaaaaaaacaaaaaacaacaacaaaaaaaggtagcatgccttgccaacaccttgacttcaggcttctggcttccagagaactgcgagagaatatattcctgttttcgtaagccaccaagttggtggcaatatgtgatggcagccctagaaaactaatacaacctacatacaaaagtctcaaagtaaagacaagaaaatcacacaaaagagggattattgagaggagagaatattaagaacacatgttactttacagctccgtctcaggatacgtatcaaggatggaagatactcctgaagaaatgctgaaagctaaaattaagattttataagcagttttcttgttcctctgagcagtggttccgaagcattggtgtgcataagcgttacgtggcaagagcattagagtgcagactcccaagcccccacccaagatcctgatgcaacagatggtatttttaacaaggaaccctagattccagtgacactggcctcctgatcacatttacgagaagtctgttgggagctgaacatacatataacaaaaacatcctctggggatgttcatcaaactccctatccagcaacccaaaaccagatgaccccttgatgcctgcgctcacaccatccacgactgccaccagcaatgtcctgtgcctccacctgcactccacctttgcaccaatgagcacctctcatgaacacattgagtatctttgtacctttgctcatgatctctactcaggggttcctctccctgccatggacatattggctttctaaagaaagtttgttcaccttccaaaatcccaattaagcatcattgctccgtaaagattccctagcatgcttaagggagaatcatccattgctcctgcagcacactggaccagcctgcagcatagacagctgtctgccccatgacatggggcgctccctacaggcccagtctctctctctctttactgtatcactgtatcactgtcacacagagtcacttaaaagtcacttaatacacactgattgagggggttcctgataagagaactgtgaacagcactatcttttttttttttttttttttttttttgagacggagtctggctctgtcacccaggctggagtgcagtggcatgatctccgctcactgcaagctccgcctcccgggttcacgccattctcctgcctcagtctcccgagtagctgggactacaggcgcccgccaccacacctggctaattttttgtatttttagtagagacagggtttcaccatgttagccaggatagtctcgatctcctgacctcatgatcccctcgcctcggcctcccaaagcgctgggattacaggcgtgagccaccgcgcccagcctggcactatcttgaagatgtgaaataaaagtcaagagtagcctaccctcgctgtccctgccccatcattatacacattcagagaatccacagtttctccattatagaaactagcacacttgtgattaatatcagcatactaattcacttaatgtccatcttccccacaagcctgtgagctctctgcagccaggggctgtgtctgctatttactgctgtacctctaggccctagccctataacgaactcatggtgataaatgaatccttcacatgtgagatcatttggcatcctagaaagttgtaaaaaaaaaaaaaaaaaaaaaaaaaaaaaccttgaaaacattatgctacgtgaaagaagccagtcacaaaagaccacacattttatgatcccatttatatgaaacgtccggaataggcaaggccacagagaaagaaagtaaattaatgattatcggggggggcggggggggggtcaagggagttggggagaaatagggaatgatttggggcatgatgagagtgttctgaagttgattgtagtgatgattgcacaacactgagaatatactaaaaaaccactgaattatacactttacgtgcatgaattgcacggtgtgtgaattatatctcaataaagctgttaaagttatagaagttctgctgttacagatacttgaaaattaagtttgctcagaaaaggaaaatggtctaattgggagaaaccatggaaatcttttagaagacgcatggtcttctttctttttcatttttaatagatgcagattcggttttatttagtatcctgtaactagagcttaaatgcttgtgaacatctggtctgagctgctcatttctaaagaaataaaaactgagactcagaagttcagtgatttgtctacgatctcacagccagtgtgaggaagcttaagattcaaactcaatcacagctattcacagaagaaaaagggtggatttgtggatgccatccaagtacccaccaacaggtgtgtggataaacgaaatgcggtgtagacgttccatggaatattattcagccttaaaaggaaaaatattctgacacatgctacaatatggatgaaccttgaagacattatgctaactgaaataaaccagttgcaaaaagagaaatcctgtgtgcttccacttatatgaggtacctagagtaccaaattcatagagaaggaaggaaaatggtggttgccaggggctgggggagcagagggagaatgtggagtgattatttattaaacacagagtttccgtttcgcaagatgaaaagagttctggagactgcacaggaatgtaaattaactgtactgaactgtacacatcaaaagtgctaagatgggctggcgcagtggctcacgcctataatcccagcacttttggaggccaaggcaggcggatcacttgaggtcaggagttcgagaccagcctgaccaatatggtaaaatcctgtctccacttaaaaaatacaaaaatgagctgggtgtggtggtgcaggcctgtaatcccagctactacagaggctgaggcaggagaatcgcttgaactggggaggcagaggttgcagtgagccaagatcataccactgcactccagtccaggcaacagagcaggactccgtctcaaacaaaaaaaaaaaaagaaaacaaaacaaaatagctaagatggtgaattttatattattttaccgtaattaaaaataaacaatttttttaaatccaaagtcaagtctcctaactctcatcctgaactctcttccacggtggcccttcccggacccagtggaatgcacagatggaaaggaaagcaggctgcttgctcagacttcacaacggagaaatcagagaggcccaagtcactgcttccaaggaatttcgagaattttaacaaatctcagcaggagcaatcagtacacagatcaataaaatggaggccactccacaggtctgagtcttcccaaaacgcagccctgccaagaggtaaatggatggcagcaaaagataatctggtattgagtgccaagcaggttagacagcttctcagacttaaatgagtttaagtcaactagggatcttgagattctgtgattctggtttagttggtctgcaattacgcatttctaacaaactcctacatgatgctggtccagggactgctttttttttttttttacatttttatttcaattccctccctccctccctccctccctctctccctctttctttctttctctctctctttctttctctctctctctttctttctctctctctcttcctttttgagacagagtctcgctctgtcgcccaggctgggttgcaatggcgagatctcagctcattgcaacctccgcctcgcaggttcaagcaattctcctgcctcatcttcccgagtagctgggattacaagcacatgccaccacacccacctaattttttgtacttttaatagagatagggttttgctaatttttgtatttttagtagagatgaggtctcgtcatgttggccaggctggtctcaaactcctgacctcaggtgatccacctgcctgggcttcccaaagtgctgggattacaggcgtaaaccaccgcgcccagaccattttaatagtttttggggatcaggcggtttttggttacatggataagtcctttagtggtgatttctgagattttggtgcacccatcacccaagcagtgtacactgtacccagtatgtggtcttttatccctcacccacctcccacccttcctcctgagtccccaaagtccattgtatcactcttatgtctttgcataagggcccgctttttaacactttgagtagctggcgtagcaatgaaactacatcacattccttaccccaaatgagaagccaccttctcagacttggggctccatgggatcattctattttcagtagatctaagcacacgatgacaagccaacacatttcagctcactttaggttgagttagaaaacatacatatttcacttccacggtttgtgaaaatgaaatcttcattatgttaaaatcaggccagtggattggttgcttgattgcaggggaaggaaagaaaccaactgtggtctgtttctaaaggaaatataaaataggacttaaaactcagaagtcagtggaatgtggtctaataactgattcagaaactcactcaggtcccttggtaagccacaatgtcaggagctacaactgaaagagagcccaaacattccactttgcagagagtcatagcacggtttttttcaactttggttttcatgaagtctggggtttcatgccagttcttagtgaaaattaacttgaaagaaaagtcatcagaacagcaagaaaaagcaatttgtaaggcccagagcctcatcaaccaacaagacagatgctataaagacaagcacttgagggaaattagaatatttaataacatgctatgtttttgaggggcttggggtgggtgtttttagtttttatttttattttattattacttttttatacatagtgtttgttgcccaggctgaagtgcagtggcacaatcatatctcattgcagcctccaactcctgggctcaagcaatcctcccacctcagcctcctgagtagctaagactacaggtgtgtgccaccatgcctggctcatgtcttattttctgtaatgacaagatctcgcaatattgcccaggttggacaaattcctggcctcaagcaatcctcccgccttggcaatatactatgtctttaagattaaaggtcatcgaccgggcacagtggctcacacctgtaatcccagcactttgggaggccaaggtgggcggatcacgaggtcaggggatcgagaccatcctggctaatatggtgaaaccctgtctctactaaaatatgcaaaaaattggccgggcgtggtggtgggcgcctgtagtcccagctactcgggaggctgaggcaggagaatggcgtgaacctggaaggcgggggttgcagtgagccgagattatgccactgcactccagcctgggggacagagcgagactctgtctcaaaaaaataataataaattaaaataaattttaaaaaagattaaagatcaccaattaaaattaaaaacatggagccagacgcagtggctaatgcctataagcccagtattttaggaggccgaggtcaggagttcaagaccagactgggcatcataacgagacctcatatctatgaaaaattttttttaaaaaattaaaaatagctaggtgtggtggtgtgcacctatagtcccagctactcaggaggctgaggcgggaggattgcttgagcccaggagattgaggctgcagtgagctgtgatcacaccagtgcactccagcctggacaacagagcaataccccgtctcaaaaacaataaataaatttaaatacattaaattaaaagcagtcttcttgtagaaagggaacgaaaaactttttaaaaagagaaagcaaataatcaattccttgcaaccaaaaaccatcccaaaaatcctctatagaaactgaacgcggccaggcgcagtggctcatgcctgtaatcccagcactttgggaggccgaagcgggtggatcacctgaggtaagaagttcgataccagcctgatcaacatggtgaaaccctgtctctactaaaaatacaaaattagccaggcctagtggcctgtaatttcagctacttgggaggctgaggcagcagaatcgcttgaacccaggaggcagaggttgcagtgagccgagatcacaccattgcactctagcctgggtaacaggagtgaaatcccatctcaacaaaaaaaagaaagaaagaaactgaatgtggcaaactaactctgcaccaaataagcttctaatttccactgcacttgttaataccccttcctatatatgtgtcagctaatttaccttctggttttattgttattatgattagtaagtccccaggacaggagagggtggtatacctattactcatgatatacattaagcgattctctcgaggttcaaagccactaatgtttacttgttgcaaagtcaatttaattaaatatatatacacaaaatacacacaactcttccctttaaaggctggaaataaacaattcaaatggaaacctcaagatgtaaaaggagagacctggcacagtggctcatgcctgtaattccagcactttgggaggtcgaggcaggcaaatggcttgaggccaggagttcgagaccagcctgggaaacatggcaaaaccccacctctacaaaaaatacaaaaattagccaggcataatggcacatgcctgtagtctcagctactggggaggctgaggtgggaggccttcttgagcccaggaggccaaggctgcagtgagctgagatcacgccactgtactccagcctgggtgacagagccagaccctgtctcaaaaaaaaaaaaaagtaaaagtaaagcagatacagtgctcagcactatccaaggtgaggtaagataacatgcttcatatcctactctggtggcagaattgatacaacctaactttgtttgtttgtttgtttgtttaaggcagggtctcactctgtcccccaggctggagtgcagtggtgcgatcatgcctcactgcaacctctgcctcctgggctcacaccatcctcccacctcagcctccccagttgctgggaccacaggtgtgcacatgaccaggcccagctgggttttgtattttttgtagagacagggtttcattatgttgccgagcctggtctcgaactcctgggctcaagtgatccgcctgccttggcctcccgaagtgttgggattgcatgggattgcagacgtaagccacagcactggccaacctacctttgtggaaagtaaattggcaacatctaaagactcaaaaatattcagaccctttgacccattaattctttttctgaggatctgtcccaaggaaatgatccaagatttagaaaacgttgcacatggaaaaaaaagacatccactgcagtatttcctaagaagagaataaaaattggaaatacaccccggggaggcggaggggtgtgccctgccactgtagctaagtgggacctcatttcccagaattccctctcctggacggcagggagtgagtggcagccatgggggagtttgcacagtatgtgaaggcaggaggggagaagcaggtcaagcagagttaggcgtgggcgcaccacctgtggctgcagcctcccacagtcccttgggctcctgggtcaggcactgtgcagtccaacagccagggcgtggagtcttctgtgcaccgctcccagtcatccagatgggaagtggaagaaacagacatgggctccaccgcgaactggctccgctactccacatgttacttttcttctggactcctggcccagccagaggcagagacaacagtcttccacagacttctttcagctcccaaagttgcacagggggagccgggagtggtggcacacgcctgtcctagcactttgggaggcctaggcaggtggatcacttgaggtcaggagttcaagaccagcctggccaacatggtgaaaccccgtctctactaaaaatacaaaaaattagccaggcgtgttggcgggtacctgtaatccggctactccggaggctgaggcaggagaatcgcttgaacccgggagatggaggttgcagtgagccgaggtcgcgccattgcactccagcctgggcaacaagagcgaaactccatctcaaagaaaaaaaaaaaaaaaatatatatatatatatatatatacacacacacacacacacacacacacatatatatatatattgcacagtggggaatccccatgataaatccctctgccatgcgcctcaccgaacccaaactgataattaccatacatgcaaacaagagctaagtaaaccccagtgcagcacccatggaataggaaacacttgttaaatgaatatttacaaatgatttaaggccacctgcaacacaaccatttttaccactaaatgggaaaaacatcaagctagcgtttatacttatgtattatgtataataaacaaagaccagacaaagggggaaaaaagatgaaatcaaagtatacctgcaaaataaaaatagtttcagtctaggctgaactgagttagcttttgattcttccgttcttaaagttttctgtagattttctgcatggatttgttttagaattaaaattctctgaagattttgtatgaatttctaagaattaggttctaaattctttattgttttcttcatttaaattccttattgttctgtatcttttcctccactctcaccttagattttgagtctatcataaagtaatttttctaatttaaaaaagcctctattttttgtatatatgtaacagaattgcaaatatgattacttcatttcactgctaaaaacatctttggttgttttccagaagaaaagccaaacttcttggcatgatctggccactgatcttgccagcttagctcatcttataaccctgacttaagaatatgtaatagtaataataagaacataatgacaataataataattctcatccccagaggtgaccaggccctttgattgttctgtacttctgcatgtatgggtctcctggcttgaaaatgctttccttctcccccttatccactggaagaacaaccactcatcatctaagacttaacttgaacttggctcatctgaagacctacctaattctgcaccgccttcaacttcacctcccaaactactctgagatgcactccacgtatgttcagtagctcttaccagactgtactgaatgtgtccatctctccagctgtagggcttgttaaacctctagttgttgggctatacccctagaatttctgattcagtagattgggggtggatgggggtgggcaagaatgtgcatttctagcaagttcccagatgatgctgatgttgctggtctgggaaccacagtgggagaaccactgagctagactctgagactcttgaaggtggggacttttattcaatgttgcatcctaaggcccaagaacagtacctgacacttactgcaagattggtcagaaatcattttatttattttactttttaaaatacagtcatatatagtcacacatcacttaacaacagatacatgttctgagaaatgccgttaggcaattacgtcactttacgaacactagagagtgtacttagacaaacccagatggtacagccttttgcttgtaggccaaagcctgtacagtatggtactgtcctgaatactgcaggcaacagtaatacaatggtattcgtgtatctaaacatatcccaataaagaaaaaaatacagtcaaaatatgagatcaccgtcatatatgcaatcttatgggaccaccatcatgtatgtgatcccttaaccgaaatgcaacatgcactgcaaaatgactgtaaacaaaatcctttcccatacacatggctgccatcactagaatgccacatcgcatgctatgcagagttacatgccatcttacaactaattccttgatcatatctttgtgaaatctggaaaccttaataaatatggggtgaacatgtcaaaaatctaagattccttttttttttttttttttttttttttttgagacggagtctcgctctgacaccaggctggagggcagtggcgtaatctcaactcactgcaacctccacctcccgggttcaagcgattctcctgcctcagcctcctgagtagctgggactacaggcacatgccaccatgcccagctaatttttgtatttttagtggagacaggatttcactatgttggccagcatggtctcgatctcctgacctcatgatctgcccgcctcaggctcccaaagtgctgggattacaggcgtgagccaccacgccctgcccttccatactctttattctgccactgcgtttctacctctataatgatgacaggctggcagtaccaaagcgaggagccagagttgggtgatctggcctgctttctaaattaccttcctggtaatagtgaccatggccttcccagacacactctccggccagtttgtgaaaaagccataggaatgcagagaagaaaagcaactccacttgtaaagactggaaagatgcggcaacatgcatgaagtgggaggggaaggcacagtaagaaagattttccagggaaacagtagaaacaaacacaggggtgttaaaataaatgacatgcccctgcagtgtcaggaaatgtgccttgtggatgaaatagaatgtgtgatgggagacgggagcagaaaataatttggggccagactgtggaaggtctgaagtgccgtatcacaaagatcagactttaatctgtatgtggtcgctcccgtcaaaggggagtggcaatgatcagaattacatgtcggaaaacaactctaatggctggatgaatgataaaaggggcattggaggggacattctgtgcattacagataaagaaatgccaaatgaaactgcaagggaaacatgtaacaaatttaaatgtatgtgggtatgtctttatccaacattgaagtaatggccttttgtgttctcttttcagtctctctcatttcatttccaaaacaacataaggtagataaataaccaattgaagcaataggtactagagaaattgaaagccagagctcttcagagcaggggagtcacccaagccttcctagatttgatcctagcctttaaaaagtaagaaagacttcaccagtatgaatgatgccatttatagttattggtatcatttagagctatgcagaagagctaagtttgccttgctctttacagccaaaatcttctgaaatgtgccttaaacccaaattaacatcattcaggtgattaggttgagcaaactgggtagaaggagaatgaaaacgaatacatcagttatgccatttgcagatacaacctctgaaagtaaatggaataattagatttatacttcaactgcaataatgctttatggtccattcttttagttggaagctagggcaatgcataccaaactctggaaactcaaatcattccttttagaacaatttctcagaatataagaagaaaaggaagcaaattaaaaaaaggattgatcccttggaggctgagagattttaattatcctttaagatgagggtggtaattgacttatactctgaaacatcttaactcagcgctcatacacagacacaacttaatgatcagattgtcagggaatacgttattccacacatgtgaatttaccacataactgaaccttaatatttctaaatgtccttttttttttttgagacgaagtctcgctctgtctcccaggctggagtgcagtggtttgatctcggctcactgcaaccttcacctcccaggctccagcgatcctcgcacctcagcctcctgagtagctgggaccacaggcatgtaccaccacacccggctaatttttgtatttttgttagagacagggttttgccacgttgcccaggctggtctcaaactcctgagctcaagcgatccacccacctcggcctcccaaagtgctaggattatagcaaccgtgcctggcctaaatgtccaaatatttgtttaaatgtgtttaaatccctatttttaaagaaaaaaaaaggcattgtaaaatatattgcagaacttctacatccagctaagatgcagtaacaaggaccagatttatactcccacctgaaacaatttaaaaattggacaaaatctatgaaacaatggttttcagacactgaacaacaggtagcacaggacactgatctctaacagactaaataccaaacagatgagcattacgatctgccccagtgtcccggctgctaggccttagcacagggagagggaactcgagcagaatctgtggtgccctggagttgagaagttgaagctgaaatagataaccatgccaccatttgaaatgggcatgctaaagcgtttgcttcttgatggcaaatggtcacttgtatactatgttatgctcgaatattgtgaagaccatggttaagagctggaaagatctcttctcaatactgttaaacttttaaaaattcagacatgctcttataatgaatttttacttcctcacttcctaacaggccatcactgcaactaaccacaaccgtgttttaattgcagttatagttaattgcaccttccatcttttgagtcccaaacgcgatagctcagagtgtgtggacaggctctaggtgagacacacagtgaccctccagagtgaagcactactacaaggactgtggtgagctctgtgttaacagcttggccgtcccagttctctgtaatgtcccacggagacttttgccaacaagtgacctctggcctggcactcagtaggcatgcaatgaataaccactgaactaattaattacttagtaaacgaatgaagtattatggttaaaagtctcaggcagcatgtatcctctttgctaaattcatatgctgttcatatttagatcagtctgaacagactacggagatgtctttggtactgagcagattcttggcttccttccctaagagtgatccccaacattcttgccaagaacttcggggccactggccacaccacccctttgcctgaactgaacctgtttgtaaaagaacactggaacccacattgcacaccagcagtctcagccttcatgtctttaaaactaacatcctgcttcattcaagttagtctttaaaatgctcttcgtcttcaagtttaaggcaagaagataaaaagggtttactttatgcacccaggaattactctaaagatacatgcttatagagtaactttaaagttactctaaagatacatgcttataaggtcacaagatgccttgtcaattgttgtaaacaagattttaattaattccaggaaattgatgaatctaattttcatataaaaaggcccagtggaatttgagccctgaatcattcatacacgtttgctgcatgtagtactaatgacaatagtactaattttcattcacacagcaacttatagattatgggatgaaactaagtaggcagctcccattcacattacagaaagcaaatgaaaaattggcctagtgtttcttggccccactttggttcataaacttctacactgccatcaagatctgccatggtttgaatgtgttccccaacattcaagggttagaaatttaatctccaatgcaacaatgttgagaggtgggacctttaagaggtaactaggtcaagagggttctgctctcatgaatggattaatgtcactgtcttggaagtgggttcgttataaaaacaagctcggccctttcttgttctctctcactctctctcaccatgtgatgctttgcatcagggcagcaagaaggccctcaccagatgcagccccttgatcttggacttcccagcctccagaatcatgagccaaataaccttatattgtttataaattatgcagtctgtggtattttgttatagcagcccaaaactaagacaagatccttcacatatgccacctcctccataaagcctcattttatatctgtgaagaaacttggctattcaacctctattgtcccatagaactttgttctcatccctacagcaacacttactgcactatggtgggatctatctattcatttatcagcctccactatagactgcaggctcccccaaggacaagcaccacgtaatatacacgtcattcaatcaccagtgtccaccactgcctctggcacatggcagccacttaataagcaaaggactcttgttcccaaaagataaattcatttatctaaagtatacgccagagccaggtgcggtggctcatgcctgtaatctcagcactttgggagactaaggcaggcagtcagcagtttgagaccaacctggccaatatggtgaaaccccatctcaactaaaaatgcaaaaattagccaggcatggttacgcatgcctgtaatcccagctactcaggagactgaggcacaagaatcacttgaacctgggaggtagaggttgcagtgagctgagatggagatcacaccactgcactccaccctgggtgacagagcgagactcggtctcaaataaaaataaataaattaattaattaatttaaaaaaatataggccaggagcagtggctcacacctgtaattccagcactttgggaggccaatgcaggcagatcgtctgaggttaggagtttgagaccagcctagccaacatggtgaaaccccatctttactaaaaatacaaaaatttgctgggtgtggtggtgcatgcctgtgatcccagctactcaggaggctgacacaggagaatcgcttgcacccaggaggtggaggttgcactgagctgagatcactccactgtactccagcctgggtgacacagtgagattccatctcaacaataaaaataaaaataaaaaacgatacaatataaaaccttcgccactgtagcaaactctgaaatatttacatttttcttatctcaaaagtaatgtctttgtaaaagaaaaaatttggtaaaatatcacattatggagaaaatagttctccactgttcaaactataggtttccggtctatttttaatgtaaatatatcaaagttaagctcatattatacatagttattgatctaatttattttatatccaatatcttaaacatactcccatgtcactaaaatattatggctgggcacactggtgcacgcttgtaatcctaaggattgcttgagcccagttcaaaaccagcctgtgcaacatggtgaaacccatctctactaaaagtacaaaaattagctggacgtggtggcaggcacctgtaatcccagctactcagtggggctgaggtaggaggatcaattgaccctgggaggttgaggctggagtgaatcatgattgtgtcactgcactctatccttggtgacagagagagaccctgtctcaaaaaaaaaaaaaagcaactacataatagggtggtatggtttggatttgtgttcccacccaaatctcatgttgaattataatccccaatgttggagaaagggcctgtgggaggtgactggatcacgagggtggacatcccccttgttgttctcatgacagtgagtgagttctcacaagatctggttgtttgaaagtgtatagcacctccaccctctctctctcttccacctgctctggccacgtaagagttgcctgcttcaccttctgccatgaaagtaagtttcccgagatcccccagccatgcttccagtatagcctggagcaccataagccaattaaacctcttctctttataaattaccaaatttcagatatttctttatagcagtgtgagaacagactaatacgtatggatattccataacttacttaaccatttctttctttttggacagttagatcacctctggtagttgaacattcaaaaaattatctcagcttgctttcttaataagaggttaacccttccaagatgatgctgcaggaattcatgaatggagcagctaccctcatcaactactttttactaaccccttaagcacaagacaacaaaaggtcccaagacgtgaccatgttactaggccacacatacatatgtaattgcgtatttgtgatcttttttttttttttttttttttttttttttgagacagagtctcactgtgttgcccagactggagtgcagtggcatgatctgggcccaccacaacctccacctcccaggttcaagtgattctcctgtctcagcctcccaagtagctgggattacaggcgcctgccaccatgcccagctaatttttgtatttttagtagagacagggttttgccatgttggacaggctggtctcgaactcctgacctcaagtgacccacccacctcagtctcccaaagtgatgggattacaagtgtgagccactgcacccagcatatttgtgatcttttccatgagctgacagtctgtgctgtgtttgtcaaatagggcactggagagaatgaaaagatctgtgcacaaacgtaccatcagctcacctgtcatgatgtaacccttttccctctttttcttgcatgtgtcctgctctctcccccaagtcctcttttgtatcccacttcttactaccaactacctgttaagaaaccctccaaaggtcaaaagtctctgtctcagtgctattggcattttgggctgaataattcattgtcacagggaaagagagaagttctgtgcattgtaggatgtttggcagcatccctggcctccatccactgggatgccagtagcaacccacaacaaccccactatgacaaccaaaaccaactctagacattgccaactgtctatctcctagaaggcagtttcatccccagttgagaaataataatctaaattgatcatttacttatttgataataaacgcaagaaagagatccactagagctgtgagaattcagtttcaattacattaacatgctgactataatcactaggtagcgattacctgatgtcatgcaggggaaagtgctatcgttgattggggatgtctgccacaggttggggaagggcagcctgccatccccaccacctcaccagaggcagctgaacaggaacagggggtagccacagtgattaaaactagacttggccccaagagacccagacccaataccatctttccttgaacccacagaagaataacagaaaccttaaaagcattgtattctttgtttttgttcgtctgtttgtttgagatggcatcttactctgtcgcccaggctggagtgcagtggcacgatctcggctcactgcaacctctgtttcctgggttcaagcgactcttgtgcctcagcctcccgggtagctgggattacaggcatgcaccaccatgtccagctaatttttgtatttttactagagacagtgtttcaccatgttggccaggctggtcttgaactcctgacctcaagtaattcacccgcgttggcctcccaaagtgctggcattacaggcatgggccaccacacccatacagtattgtattctttaacatgcatttgattataacatcctacgaaatgatccccagaagaaactacagttgaccagtcattaatatgtataagcttcctattctatccaagcacgctgtacgccatcaaaggctggtaagaaatagaacttactttacccgcatcctcaaaaagttggcagcactgagtgctaacccagaaaccataattatcgtgaaaagaaatagaaccactttctgctgaaccatgtaatctatgtttaaaaaagagggaggggtctctcgaagaaccactggttgtctaagaatataacagctagtgtagaacaaaccagactgagatggaacaaaaccatggatggctgatgcttccgattgtcaatagggtcttgatcaccggcaatgtaaccttgcagttacctaacctctctgtgtctcagtttccctcgtttggtaaaacagggaaaaaatagtactcatacctcctagtgttgttaagatgaagaaataagagaataacaaaagccatatgcagtaagtattctacaaacgttagctaatattgtgtgatgtcagaactatattcaatcgagaaagcatccaacagcttgtgtcatatttgccagcagcgtagcaactgaaggtgttaagaaatgagaaactcagaaaaagtctcactcaaaggctgtattcacaatctagctttcccttataatttcagtgtgctcaaactacatctcatgcaggtccaaatatttcttcttacctagtccttagtggaattaagaaaatctgatcaccacactgctgactcccccagtccccaaatatctgattatagcctaattcctgacacaaaataaacctaaattcttggcctttaaaaaaaagtcacaacacaaatgaccaagttaatacagatgctatcagggttgtcctggtcccagatcagtgattcttagcagaataggttaagaaaacctttagatttccaatggattgaaagacaaatggctgggcatggtggctcatgcctgtaatcccagcactttgggaggccgaggcaggcggatcatgaggtcagagcatcgagaccatcctggccaacatggtgaaaccccgtctctactaaaaatacaaaaattagctgggtgtggtggcgtgtgcctgtaatcccagctactggggaggctgaggtgggagaatcacttgaaccagggaggcagaggttgcagtgagcagagatcatgccattgcactccagcctggcaacagagtgagactgtttcaaaaaaaaagaaaaaaagacaaatgaagtggtaaactgtccactttaattagttgcaaaggaaaacatgcatttacattttctgtgttccccattctagttcccagcaccccatcgtggaaggaaacacataaggtaatatctcagtgggttcccagagcagaagagtcacagcaagatgattatggtgcctatttaatcagctggtcttaacaggtcaccatgcttttatgaactcaggatatgggaagaatcctttgtgattttgctggttcaatttctctcttcatcttagagggaaatgcttgcctttttccatgtgaaagctcacagcacaacagaatcatggcccattagggttggaaggaacttagcaaatattataaacagcatttaccaaggtgtggcccaagcatccccctgcataagaatcacatgtgacacttgtttaaaatgcagattcatgtgttggtattcaacaaactcattccttcttaaatgtggctgcatggcttgactctagccaataaggaatgtgagtgggaaagatgtgtctgcccctctcacaaacctgcaagcactttccccttctaggacttgagtcccaggaatatggcaatgttggaaggcacaagttggcgatagcagagccacaatatggaaggagcctgggtcctggaatcaccatttggtaaagaacttttatgtggacaagaaataaccttttgttgggttaagccactgtaatttcagactttgttccaggattgagccttccctacctaacatacaggcttcctatcttagacatagcaagtaagatctggaggtcactgaagaaaaaaattgacacttgttaaaagagtaatgaagacttaattcaaaactattgctgagcatggtggctcatgcctgtaatcccagcactttgggaggccaaggtgggtggatcacttgagcccaggagttcgagactagcctgggcagcatggtgaaaccccatgtttacaaaaaaaaaaaaatacaaaaattagccaggcagggtggcacatgcctggagtctcagctactcaggaggctgaggtgggaggatcatttgagctcaagaggtgggaattatagtgagctgagacagtgccattgcactccagcctgagcaatgaaatgagaccctatctcagaacaaataaataaatatatatatatatatagaacaataagggtattgtaacagggaaaagagatcaagctcaactccaaacacagcaaggacaagtgagaacttacagccaaggagtgaagctgagagggtcagtcaatggacaattactaagacgtaacgtcaggagtagggagttttttttttttttttttgaaacagagtctccctctgttgcctaggctggagtgcagtggcacgatcttggctcgctgcaacctccacctcctgggctcaagtgattctcccacctcagcctcctgagtagctgaggctacaggtgcacgccaccatgcctgggtaatttttggattgttagtggagacagggtttcaccatgttggccaggctggtatggaacgtctgacttcaagttatctgcctgcctccgcctcccaaggcactgggattacaggcatgagctaccacgcccagccgggagattcttgcaatcttgcaaaactggcctaacagaattcttgctaaagacaggccaaggacttacacatcaaaggtggaaaatgaggaacttgatcagattatcaagggtggtcagatatcaagaatgaaaggataacctagcaggattctttgcgaagactggaatggataagccaaagagaggatggggccagggtcacagcctagtcaaaaagagggctcagaggagcctgactacagtttcatcaaggagggaattattgtcaaggtagggctctggaattctgtatttaacaagctcattaagatttagaaagaaaaataagctgaggaaggagaaagaccatgcaccaggtcacatatgcaaatatgagacggccaggacctgaagaagtccccagggactggtcaggttggatccagtgtttcaatgaactagtgtattaaatagcaaattgcaatgcggctcctatgtacatgttacccaggattgaaagcaactttgaactgccttggagcaatttccacagaaagcgtatctgcctgagaagtagaaaccttggactgtggagtttcattttacaactttaactctgaaaaaacaaagggaaaagaggatggaaaggaatgggttacaaaagtgcccaacatgggacaaggccagggctgttggactccccagctgcttttggtcattgggaataattaaaccccctagtaacagacaagaaataatgaacagacatatcagggccagctccccagatattataaaagcatgggaagtaggggaggcaacatcttcccacaagacaattacagtagagatgcgtccataacccagagtctatggaccacgctgctgtatgtcagtggtttaattcttttccttttaaggaaagatctgatattttaatggttttttaaacgttatcatgcagagctaagtgttaatattctttcaatgcattctcctgctttttagcctctcttgccttccttgcaaatctgcctgttgaagccctccttgaccatcaaggaccagtttaaatgccctcatgtaagaagtctcacctgacccacaaccaccaccacccaccactggaagaaaatcccctgatatcagactcctgtggtccatcagtggtgaatctcttttagcttctgaaatataatttctgatgtttattagaggcaaaaagaatcatattttatagccatggtttctacaatgagccctgaactattgtggttttccaagttttcattctcaaataagctcagagcatccctatccctcctgcaaatccctaaaaactggaatttgaaattcattgtatgcaacataaatctgactggttacataatataaaacatcagacagagctggcttccattcaagtcatttagaacatgtttcataaaagctgaacctcatgggaggcagcctctcaaagccaaagcaaagctgcagttcatccttagaccctccttggtctcaaattaaaatatccaggaggatagaaattgatgagatttcattaagtaaaaaatttcatgaaaatcaatcctaacctctgtagctcccagcagcgggatctgtgtttatatgaacagcattaaagataagctgtcccacggaaattacagcagcagttatcaaacaactttaatgcactcttaagtagaggcactaaaatttagaattcgcactggcttttctgtcgttcacggcgtggcgctgagtcagcctgcaaccacacaagaaaacagctgttgagaaatacagcttcctgatttaaaaataaaatcagtaaatttctactaaaagtttctgctaaattccttattgcattctatttcaaaggaggggtgaaatatctagaatgccacgatggtttttaagcataaggggttggatctgatgaatttcatgtttgtgctctgggactttactagaaaaaaatgagggatagatgactaattgctacaatattaatttcatacttacattccccataaggcatgaagcaaaatttgtcagcttgagggaaatgagactggactaattatcaggacctcagcaaataatgatccaatatccaaagaactgcagtctgccatgaaatatttgacaattcttttaaaaagtcagcaaacttttctaagaagagaacgcaggccaggcgcggtggctcacgcctgtaatgccagcactttgggaggccaaggtgggcggaacacctgaggtcgggagcttgagaccagcctgaccaacatggtgaaaccccatctatactaaaaatacaaaattagcaatgcatggtcgcacatgcctgtaatcccaagtacttgggaagctgaggcaggagaactgcttgaacctgggaggcggaggttgcagtgagctgagatcacgccattgcacttcagcctgggcaacaagagcgaaattacatctaaaaaaaaaaggaaaacaaagaacagaagagaagagaaaagaaagaacagaatgcaaagacaactactgcttttgatacaggcaattttatgaccagtaacaagtagatgtttctgtgggaaatgtctcctagcatatgagatacaacatcaaatgtcgcaggctaatgtgagaaacagtctatgatgatgagtgaatcttgactttgagcaacacacggaaactccaaggcctcaggttttgtttttaaatctattaaataaagaatctaggctcattgtattactgtgcccctgctggcttcaaccttctgtaatgctaagaccagcctcactctgtttaatacgtgtgtcttccagaatgttctttaaccacagttcttctgtatgacatttcctctggttttgctgaaagaggggcaatggctactccaaaagactcctttatgtaagttccaaactttgtggaaaataatctggtaaatccaggagatgttatattcccacttgccattctggatgtcgtctattaattccaattaatagggacacagctcattggtgactacatggaattctatcaccccaaatgctcacctctcactgcctaccctgcagaaatctcaggcactcaaactgcaggcagtatccaaagacctgttctcttcatcaggagacccaggagatccccaatccttgtaaaattcaagagtttattcaagactatcaaccattgtttcctggatcggactatacccattacattttaacagccctctctgactcagggacatgagtacagccagggggaggaggggaggagagacgctaaaggagagattggggttttgttggttgtattttaacgtttgagttttgggaaggttggtttcatggttttacttttggttttttgaggactatgtttgtttttatttttattttttatttttttatttttgagacagaattttgctattgttgcccaggctggagtgcagtggcacgatctcagctcactgcaatctcggcctcccaggttcaaactattctcctgcctcagcctcccaagtagctggcattacaggcacccgccaccacacctggctaatttttgtacttggggtagaggcagggtttcaccatgttggccaggctggtcttgaactcctgacctcaggtgatccacctgcctcagcctcccaaagttctgggattacaggtgtgagccacctcgccctgccactgtgtttgttttttaacttaccctaccattggctgaaatttctgcagctgaaaaatagaagcaagctctagttgctttctacttaagataggtatgtaagtcctggctacatcatgcctcatgacccaaacagccattctaggggcacaggcagcaggcagcatgcataattccatctgtctcatgctaagattcacgggtgatcactttcaaagagcatgctgaacttctagtgaaactttacacactgaaaacttacacaccacactttcatggtggactgcaaggtcagtgtttatggacactactgagagaaggccagggagagtgatgaagtatgaatatgaaagatgcagagaaggcaaagaaaacagaaaagaaacacaaagcttatgtccctgacataacgatgggagacagtcactcaccacaaacaggaaatagaacaagaaagacctctagccacagtggcaggcaccatagcagcagccgggccacgctcagccaacccaccagagcgttttcgtgcaaaatgttatcgatgtgctgcacatcttcagtgaaaacaaatgctaagcacagaaaagttgcaaatcttgcagtaaaagcaaaacagtaaagttcacatagaaatactttattcatcttaaagaaaagatttactttgaagaaagtagggtagctggagacattcttggaaattctggtttgcaaaaccattggttttgtttactatcagggattttgtgttaagacaaatgatatcagtatcattcttacccctatgaaccacaattattacggccattgtgggccttaaggtaggacaggatagggtaggataataagaaagatagaaaagtaggccagacacagtggctcacacctgtaatcccagcactctgggaggctgaggaagggggatcacttgagcccaggagttccagaccagcctgaccaacaaagggaaaccccaactctacaaaatttttctttctttattttactatagctggtagcaactgggaaaaaaatttttttttaattagcagggtgtagtggtgtgcacctgtagtcccagctctcaggaggctgaggtgggaagactgcttgagcataggaggtcaagcctgcagtgagctgtgttcatgccactgcactccagcctgggcaacagagcaagactctatctcaagaagatttaaaaaaggaagaaaagcaaggagaaggaaaaaaggaaagaaaaatggagaaagcagagaaataggaaagaaattctctgaagatcaataaattagaataaaggaggaaaaatatgagagtgatctgaatgtgttaaaaactgaactgtgagttcggagataagaggagcaaaagcaaatggaagtgaagagactgtggctcacgtgtttccctgaagcatctgcaggaatgttggtcagatgcctgctggcctgagaaatgaggaggtggacagtgaccagggatgagtgcttgtactagtcagggttctcatgataaacagaatctatacatatgcacatatatgcacaacacacatgtatatatctgcatgaagagatttattataaggaattggctcgtgtgattatggaggttaacatatctgaagatctgcagttggcaaactggagaactaggagagcaatggtggagttccagtccaaggctgaaagcaggagggaaaaaatgatgtcctagctccaaagaaagtcaggcaggagaaattccccctcactcaggggtagggcccgagttttgttccattcaggccttcaactgaaaggagaggaggagagacgaggccaatatctttcactcagtctactgatttcaaggttcatctcatccaaaaacaccctcatagaaacaaccagaatatctgaccacgtatctgggcaccttgtggcccagtcaagctgacacacaaaattaaccatcacagcagtcattgtgtaataggccccaagaaaaacacatgaggaacactggttactcctaaaacatctacattgaccaagattagaggacagaatctaaattagaagtgcaacttggaggccaggcgcggtggctcatgcctgtaatcccagtattttgagaggaggaggcgggcggatcacctgaggccaggagttcgagaccagtctggccaacatggcaaaaccccatctctattaaaatacaaaagaattagctaggcgtggtaatgcgtgcctgtagtcccagctactcaggaggctgagggacgagaattgctcgagcctaggcagtagagattgcagtgagccaagattgtgccactgcactccagcctgggtgacagagagagactccatctcaattaaaaaaaaaaaaaaaaacaagaagtgcaaattggagaagcccaaggaaggtgctgagcatggaggtgtcttgcaaatattcctttccagctccaccacagacctcaggctgcaacttccctgtcactcaagactccacaatcagaactgtggcagctctcagaacctctacaagacaggatggcaaatcctcaaattataggcatgggtttcgggtcagaaagtccagctctgccaagtggagatccctggcatctacttctgaaagtccctgtggcctaggtacttgacctctcccaacctcagtttccccatttgcaacagcaaatataacagtgcccacctgctaggattggcttgttttggtttttttttctgagacagggtcactctgtcacccaggctggagtgccatggtaccatcatggctcactgcagcctcaacttcccaggccaggtgatcctcccacctcagcctcccgagtagctgggactacaggcacacaccaccacatccagctaatttttgtattttttgtaaagatggggtttcaccatgttgcccaggctggtcttgaactcctgggctcaagtgatcgtcacactgttgtttcccaaagtgctgggatcacaggtgtgagccaccgtggctggtcaggattgttatgagatgagaaagaagcaacagatactaaggaattagcccaataccagacacatactaggtgctcaaaaaaacagtcatagttctttttgttttgtttcttattttatttatttatttatttgagacagagtcttgctctgtctcccaggctggagtacagtggcacaatctcactgcactgcaacctccaattcccaggttcaagcgattctcctgcctcggcctcctgagtagctgggattacagtcatgcgccaccacacccagctaattttttatttttagtaaagacggggtttcaccatgttggtcaggctggtctcgaactcctgacctcagatgatctgcccgcctcggcctcccaaagtgctggcattacaggtgggagccactgcgcctggtctgttttttaattaaatgcttgttccctccacaaagtttctgcccagaaaaacaccagccacttccacagagaaatcttcctggcaactgtcacaactcccttttctttctatccagggtaggcctggtttgtagtcaggcaactgactatgtcaagtaccaagagaggtccctgcagattgaccaagcctaggcagaaaatgttcacactgaggcataactgaattaggcagaaaagcaaatgcctggcaggttggttgagaggaaggccagaggggcctgggggacttcctttgggcagccaggccgataatcaggcagcaaccacgtaactggccttgcctcttccctccccacagaatataagggataatggaaggagctgctcgtgaatcgtgcagctgcagcaaacaggcctcctgggccccgaaagcattgctacccttttccccactgcctgttatcggacaaaggcaggatgcaatttcccttcttcccagaatatacaagacaactctgtatcctatcataactggaatcctgcaaattacctcttttcagagaggccccatccaacttccctacagaaacaacagtgcctctctcctactccaaggagaagcacgtccgagatgttttcttggaatgtttccttgactttctgcaagaagcaggtcgtgcttattaacggtgccagctcctcctgtagctctattgttaggaagtgtcactcttgcccctgggcaccctgcctcccacccagatccgagattcttcaaggcagaacaggtgctttctctctgcacattgctttcctgggcctgggaaaatgcagagcacatacccaaaggacctcagtgaagggcagcattgacccacagaggcaccagggggacagggggactctcttccctccttgagagttgtgttagtctgttttcatgctgctgataaagacatacccgagactgagtaatttataagaacaaagtgtaatggactcacagttccacatggctggggaggcctcacaatcgtggcagaaggcgaaacgcgtgccttacattggtgtcaggcaagagagagaatgagagccaagcggaaagggtttccccttttaaaaccatcagatctcatgagacttattcactaccatgagaacagtatggaggaagccacctccatgattcaattacctcccactgggtcccttccacaacatgtgggaattacgggagctacacttcaagatgagatttgggtggggacacagccaaaccatatcaagagtctatcaaaacagtccttgtgggcttcagacatcattaagcagctcctaatccatctagtggtcaattaagctaagaagctaaactgagattctcagaggaaaaaaaaaaaaaaggttcgctctggatggatatggctgaggtcccacatgctaggataggccccggcatctgcgtcatcccgtggagcaatatgcggctccgaggccagcataaatcaggcccagagccacaggtgcggccagcccacctggccacaggcatgccacagcaccatccatcacactgtggctgcccagccatcagcagagtcggccacggggacaggagggcttggtgactggctgccaaacagcagcatgtttgattaatattatcatatttttctcatgaatttttaaattcagataattcaccccgcattacttttatagatgtatatatacacactgcatacagggaagttagccaagtctacacatgactgagtaatccaatttcaatgaccttgatgattctaacataaagaaagtcactgggcctaagtggaccagagtctgtagttcagagaaagagcaaatgcggtggcttgggaggggtaatgggaaatgtggccaaggacatcccaggaaggacagacaagctccaaaccaacacagcagaaatgtggaagtgaagcaatttgttcatagagaaaaggatggacaattaagccaacaccaggcaccaggctgagtgaaagcatgtgtgtgcgtgtgtgtgtgtgtgtgtgtgtgtgtgtgtgtgtgtgtgtgtgagacacagagagagagagagagagagagataaagagagagtgagagatacaaaaactagtgtttaggaagatggtttacaaaggacatgtccaggaaagtttgagagtacttcgtaagtgcaaggatactgaaaatgacaaagaaaaagaagggtcagtgctaacacccagactaaaaatctggtggctggaacactggaggtgatgctaatagagatgaagaagttggaagagggaaaacagtaagtttgggtttcaggttaaacttccaagattggcagaccaccttacagagggcacatcctaaggtgatcgatcccaaatgatccatgttcttgtataacccctccccttgaatgtgggcaggacatgacaaaatgatgaggtgtcactcctctgattatatttcattatgtaagatttcatctaagcaggctgggccttgaaaaagcaaactgccgagctcaggagttcaagaccagccgagccaacatgatgaaatcctgtctctactaaaaatacaaaatgttggccaggcatggtggcacacacctatagtcccagctactcgggaggctgaggcatgagaatcacttgagcccgggaggcagagattgcagtgagccaagatcgcactccggcctgggccacagagcaagaccctatttcgaaacaacaacaacaaaagaaaggttataagcgccatggctatgactagtgtcaaattgcttgccattgttttaagaaagccagatacctggattggactctggggtgttctccgagggacaccttcgtcacacaaactctgtacttcctggaatcgatatagcactaagttatgtgcaccaaattataaaagacttatccataatattttctcactgaaattctcagggcttttaatatctccagaatatatttttccattttccataagactcaaaagtaataaaagctctaataaatctactacaaagtcactgcaaaaagtagaagatgaagaggactctgaggaagacagcaatcatgatgagatgagtgagcaggaagaggagcttgaggatgaccctacgatagtcaaagactatcaagacctggaaaaagcagtgcagtctttttggtatgacgatgtcctgaagacaggcctagatattgggagaaacaaagtggaagatgcgttctacaaaggtgaactcaggctgaatggggaaaagttatggaagaaaaacagaacggtcaaagtgggagatacactggatcttctcattggagatcttctggatccaatgtatctgggagatatattggatcttctgtttggagaggataaagaaggaggaaccgagacagtgatgaggattctcctgaaaaaagtgtttgaagactgaaagtgaaaaacacagtggtgttacggcggtggaaaaacttaaagttgcctaggaagagaatgtctaaataaacggattgctttttgcaatacagctgctttctagtggtagaggaagcagtcaaagaaaaaagaaaaaaagaaaattgccatgttggaactgcctatgaaggggctgtgtggcaggaactgtgggtgtctataggtagggagaacggcctctaagcactgaggtggcctccagctgacagccattaagaaaccagggggcagggcatggtggctcacgtctgtaatcccagcactttgggaggtcaaggtgacccgagctcgggagttcgagaccagcctgaccaacatggcgaaactccatgtctacaaaaatgcaaaaattagccgggtgtggtggcgcacgcctgtagtcccagctactcgggaggctgaggcaggagaattgcttgaacccaggaggcagaggttgcagtgagattgcgccactgcactccaacctgggcaatagagcgagactccatctccagtaaataaataaataaataaataaataaataaataaataaataaattttaaaaaataaaaaaaaagaaagtgcagtagaatgaatacatttccatgggttaaaaaggaaatggccaaaagaggggggaaataattgtgctacaaagaccaacatgacctggcctgcttgacctcgctgaaccttctatacgctccttcttgctcagcctggtccaggcacactggccacctttctgttgctcccactccagcacgagctgttattacttcttcccagaatgctcttcctccatagacacatttccttccattgtttgcccaaagcctttcctataaatgcctaccctgaccaatgtatttttaattgcactccagttacctcatgagctgctgtacttttatccagaccatttatcaccttctgccatgctctaagatttactatttgttatgttgattgtttttgtctccccctgctagaatgcaagctccacaaagaccgatttttgtctgtatttttttgctgataaattccaagatttcagaacaatacatagtacaaaacacatgctcaggaaaatatttactgaatggttcaaggcagtcattaagcaatgagattggtctacatgtattactgttgtaagatgtccatgagatctcataaggttaaaaattttaagagcatgtcagaaaacaacatgtgtactatgatcctttcttatatatgtaaaaaacaaaaactttcctttccaagcaatccattcctgaagtcttaacacgggccagagcaaggtaggcgttcacacaggaaggggaggccatgatgtcactgagtggggtgtccaacccaacccagcagggtgaggaaggggccatgtggaacagcagcccagcacgcgtgtccaagccaagcatgacaaggagggcatccacgtgggaggaggtagagccaggacatagagattggttacaaacatgccagttgaccaaataagtaaagatatgaaggataatgggcaccagagttttgcttgttggagaagccatttaaatgtggaaaaagagaaaactagaatgaaccttgtggagctgaatcagaattgaaggcatcagtgtgaattcatgtgtgtgaagatgtaactccctagtgagcgtctggggacagcgactccccaataagcagggagcacaccttaagcccagattttggtttctacgtcctggtgtccactaaaagaaaccacgactccttagagaaatggctggttcccctgctggggcaagcaaagaataagatgagcctagagtccaggcacggtggctcacacctgtaatcctagcactttgggaggctgagaggggtagatcacctgaggtcaggagttcgagaccagcctgaccaacgtggagaaacccgtttctactaaaaatacaaaatcagccaggcatggtggcacacgcctgtaatcccagatacttgggtggctgaggcaggagaactgcttgaatccaagaggcagaggttgcagtgaggtgagatcataccattgcactccagcctgggcaacaagagtgaaactctgcctcaaaaaaaaaaaaaaaaaaaaagaccctagaacataggctagaaagtaaggaagtacttaaagaatgatagcacagagaaacaagctcctctcagccagatgagtggcaatatgagtatcaaaataatttaattttaatttttttttttttgagacggagtctcactcttgtcgcccacactggagtgcagtggtatgatctcagctcacttcaacctccacctcccaggctcaagctattctcctacctcagcctcctgagtagctgggattacaggcacctgccatgacgcccagctaatttttgtacttttagtagaatgagagtaatgaaatataggccactgaacaagacacagtaaactatgagttaatagtagaacagctcaaaatctggaccaccagatgggaagcgctagaacacagcgattctgtgacgctgctgccaaaaatgcagaaccagattctaattgtggaaaaattatcaggcaaaccaaaattgaggaatcttctagaaaacaatagcctgccatcctcaaaagtgttaaggaaaatcatggctgtcaaggaaaaactgaggaactgatctcaactgaaggaaaccactaaatgtgatgcatgattctgaactagatccttttgcttacaaaggacattccaggaacaaggggagaaatctgactggggtctgaggactagagggtggcaatgtgtccgtgttaatttccggatatcaacggctatcttgagattacacaggagaatgttcctggttgtgggaagcacacactgagaattccagggtagcagaacatcaatatgtcactacactcaagtggttccagaagggggttgttggaaaagaaatctcttttgcattatattcttatctttctgtgactgtttaaaatttgtatattatctaaagaataaaacatttgcaaaaaaaggtaggctggtccacagatcatttctggaagggtgcaggagagatggaggaggctcaggaaggaagactctcctatcagctctgcagggacactgtggcacagagagggtcatacctggcggaacccaggaccaggtgcgtgaggatcagtagcctccctgccgccctggcaagggtgagcttcctcgagctcctgttcccatatccgcctgtcactcagggcaaagggcctttgccagggaaactgggaaacgtctgctgcatttggaagattttttaagataagatgaaaaagttggcaaatttctcacactgcttctttcattattattttaggctgcaaagaggtttgtgatgtgctacagttgatcaactttcatgtttttaaaactttttacttggaaatgttttatggtaggtacataatccccatgtactcacgatatagcttcaactattcaatcctagtttgctatactcccccaacactggcttatttattttgaagaaaataagcatcctattctatcatccattaatacctcaacacttatttctaaaagagaaggaccttttacttaaacatcatcccacccaccacccaaaaatccttaccaccaccaattaaccattccctgtttaaatgtccctgattctgtctgcctctctctccttctctcacagttgttgtgttcaaatcaggatccatacaagacccaacattgcacttggttgatttgattcttccacagattccttctatttcttttccttttgcaatgtttttcacagttttccttttccagttcaacatctttgcagtttaagatgctcctctctccccctttttactgactccccatgtctcctccctgatcatttttttagaaaatttcttattaacaaatcttccatgagcccagaatacgggcactttatgttcaggctccggcagggagctcagaggaggaggtagagagctctgctaatcccagcacgaacttcacagaaaacaaaagtgcaagtaaattccacagaaacacccagacggtcattgctctaccattagccaagatttgggtgcaccactgtccccttagcttcctcatctttaaattaaaggcattgaaaaagatcatgataatgacagcaatgacaacgacattaacaggacatttaatatttgtccaaaggtccctcaagattccttccagtcaagactttctctgtgattttaaccatcaaacacacttcaatatattagtgaagagcaacattctggttaggggggagatatttcataaatgacaaatgaaaagtaagacaatgataacaaaggaacggagaccacaaatgtagatgacaaaagaaaactacggtcattgtcatatctaaatttgaataacatgctatgtttcaaagcactttcttatacattagcaaatctcagccacactaataggtaaatgataaagaatggtataaaaggttaataatggtggaaccttgggtatgcaggtgtttcactaagccagtggatctcaaccagggtaatcttgtgtccccccacctcctgcctccaggggtcatttagcaatgtctggggacattttggttgtcccagctaggaaggtgtcctgacctctactgggcagaggccaaggctgcactgaaatatccttcgatacttggcacagactgcaccacaaagtatccagcccacaatgtcagtagttcagaaactgagagatcctgagataggcaagtccccttgttacccaactaaaactgtactagaccaggggactagggaggctactgaggcctgaaggcacaggaagtcagacaccttgtattacaaccctccacactgtgggctaccctaacacatgaggttcgataaaacaatcggccgggtgcgggggctcacgcctgtaatcccaacactttgggaggccaaggtgggtagatcacctaaggtcaggagttcaagaccagcctagccaacatagtgaaatccgtccctactaaaaatacaaaaattagctgggcatagggggcgggcgcctgtaatcccagctactcaggaggctgtggcaggagaatcgcttgaacccgggagacggaggttgcagtgagccaagatcacaccattgcactccagcctgggcaacaagagcgaaactccatctcaaaaaaaaaagaaaaagaaaaagaaaaaagaaaactgtcctggtttggttttgttaccgagatagatcacaatatatatttctaagtctgaactattccctcaatgtattcttcttgggaaactgtacttaccagacactgtccaactgaagaatttacctgcttagcagacctgtctctgaatgacagcacctgcgctgatttagacaatgggcacctgcatccttgggaaccctttactctaatgggagcgactgacaatgaatacgtccatgagaaagagtcaggtggccatgagtgccatgacgagaacagagccggaacaggaaggggaggggagggaggggtctggggagagggctgctacttcagcttaggttctcagggaagcctgtccggggaggcgatatttgagccaagacctgaaggaagtgaatggctagccaggcagagcttggaaggagagtattgggggcatgcagtgggaaggcctgtagcaggggcacgctgcgtgtattctagtcccagaagaaaggcctctgaagtgccctaaatgaggaggacaggaggtgagagagaggcggggccaaatcccttgaggcctcctagtcccagcagaaagtctagctttcaaacaaactataatgggaagccattggaagttcaaccggaggagtaaggagacttgattgctattgattgattgattgattgactgagacagggtcttgttctgtcacccaggctgactgcagatcaaagctcactgtggcctcaacctcccaggctcacacgatcctcccacctcagcctcctgagtaactaggactacaggcacgtgccaccatgcccagttaattttttttattttttcatagagattgtctggctatgttgcccaggctggtcttgaacttctggatgcaaactattcagatccctctagctattctgtggagaatggacattatgcaggcaagaaggaagaagaaaaccaactgagaggcaactgcattaagaattttactgaaaatcaaaaccacccaaaaagagaaatatctgccattgataaagatattccaaagaagaattcactcctaaaagctatttcaaaagaagagaaaaggccccagatgtttaattattagtggtctctttccagtaagggtgctgggcagtgttgcctccccaccctagatggcgtccgcaaccagaaactctggtgtgaagctattaataactttctccaacaggctgggactctgggattttaccatcagggggtggtgaagagcacccaccacctgggagaagcctggccagagggagcaatgcacaaggaacttttggaccagagtaagagtgaatataagctcagatctgcgtggtatactctctctcatattttatttgtgttcttgagtgttctggtctcccagtcttcaaagagccaactggagccggatggtgcatgggaaaaacggaggctgagactctcagcctgaggttccattatcttcccctctttttcctcagggtgcttttcctcatacttattattcccagccagcatggcaacaaggtccatgggggacccacacccagattacagtgtggatctagaaaatgcaccaaggaagctcctctgcaggttttaaacaagccccaggtcagtctagcacgtggtagactccaactccccaggaagttagcctgagacctgaagctgaagccactgcccattttaaggagtttgtcctctcctccctgacaaaccccaggcagtagtgggtgggtggtcaagcatcagaggatgatcccctgtccctgcctttcttctaccatctccttcgaccacacacacataaaggcaggtagcaaaaccccacaatctgtgcaccactccggaagtgccactgttcaaggttgggcgtggtggctcacacctgtaatcccagcactttgcgaagctgaggcgggtggatcacttgaggtcaggagttcgagatcagcctggccaacatagtgaaaccccatctctactaaaaatacaaaaattagccaggtgtggtggtgggcacctgtaatcccagctactcgagaggctgaggccacagaatcacttgaactgagaggcagaggttgcagtgagccaagacggtgccactgcattcctgcctgggcaacagagcgagactctgtctcaaaaacaaaaatgaaaaaggaagtgctactgttgaagaacaagtatagacatccccgcatcctaagaggtccttcatccacccaaacttaagcttcacacttcaaagactgttaattacacattatgacaccaattatatctgaatgcattataaaacagaatctttggtaagctattttactgttttaattcttttcttccaccatttttaataattaaactcctgtttttatattaagatgcaattaaaaaagaaaagtcctttaaattttcaatctatttcattttttttacataaagaattcaatagccatccattataatgtagcacacaatatagccaaaggaaaaatgaataacttagataaaacaagatgaattccatttagggggaaaaaatacaagtctacgtattttgaaagcccttagcatgaaatagtcaattaaaatatggggaactcccgaccaaacacagataaaacaaaccacatggtagcatactcctatgaaagagaaagctttactctgtaaaagaagagggcacagcgaatcgggtctcaaaatgctgaatttgaggccaggtgcagtggctcatacctgtaatcccagcactttgcgaggccgaggcgggcagatcactggaggtcaggagttcgaaatcagcctggtcaacatggtgtaaccccgtctctactaaaaatgcaaaaaattagctgggcgtgatgtgcatgtctgtaatcccagctactcaggaggctgaggcaaaagaattgtttgaacccgggaggcggaggttggagtaaactgagatcacgccactgtactgcagcctgggcaacagagagaggccctctctcaaaaaaataaaaatttaaaaaatttaaaatgctgaatttggggactgccagcattcaattatcgatgaagtaaaaggacaccattatttagtgtgagcctacccatgctgaattacatttcaaatataaggataatgtctcacatgtacaagagtaaacaaggaaaattaaataattttgatccttttgtgtgtgtgtgagagacctgatcttgctctattgcccaagctggagtgcagtagtgtgatcatggctcactgcagcctcaacttcccagactcaggtgattttcccacctcagcctcccggccagctgggaccacaggcatgcgctactatgcctggctaatttttctatatttttgtagagacggggtctctccgtgttgcccaggctggtctcgaactcctgggctcaagcgatcctcccgcctcagcctcccaaagtgccgggattacaggcatgggccaccatgtgcagccagttttgatactttaaagccacagtttgtgagctacaaacttcacattcacatgtactaagactgaacaatgtgtcggggacgagaagtattcctgtgtgatccatctactacagccttattcatcctttgtttctcttctaacccaaagatcagcaaacttttttttaaaataaagggccaaatagtaacgatctcaggctttataggccatatttcacaactactcaactctgctgttgtaacaagaaagcgcagctataaataacaggtacacaaaggagtatggctgtgttccaaataaaactttatttacaaaaacaggcccatgggctgtgatttgctgacccctgttctagttctcagggtgctagaaaggaggagtgaagcagagatacacttaagacactcctgaaagaacacagtaggaataagcaaagagatccagttgatcctaatgtatccaccaggcatagccgattacacccaggagtattcttgtaagacaaaaaccaagtcgagagatattaggttggtgcaaaagtaactgtggtttttgcccctgaaagtaatggaaaaactgcaattacttctgcaccaatctaataccagggaggcatcatttctcaacaaccacaactctcaagacacgagggcctctccctcacagaagcagcaacattccatcatggggtttgtcccctgaactgcatatccactggagattctatagtgacctctccgaactgcctacctaaccccacttttttgttttttttttttgtttttttttttgagaccaagtctcactctattgaccaggctggagggcagtgatgcaatcttcgctcactgcaacctccgcctcccaggttcaagccattctcctgcctcagcctcccaagtagctgggattacaggcacctgccaccatgcccaactaatttttgtatttggagtagagatagggtttcaccatgttggccaggctggtctccaactcctgacgtcaggtgatccacccacctcggcctcccaaagtgctgggattacaggggcatgagccaccgcgcccagccagcctgcctcttcttatgtctagcagcacaccagggctggggacgcaggctgtggtcaccaattcaaaagaggtaactgctctaccagggagtgaccttacccaggaactaatcaacaactcgatgagagctcaagacataagcctttcgactccagctttgaactcttacctgccgaagggccgagaagagcccactgagcccagagcagccgtgatcaaccactgtcacttcacaaaccccaaatacatgggttcttccttctcgtggacacatcttcctctcacacttcacactccgcccggagcaaaccctgtcaattcaaccctcaaagggttccagaatctgctgcatctccatcgccagcagcccattgccagtaccagctacatcgccagcaccctcatcactgtcacctcctaattggtctccctgactttgctcttgcctcacttccaacagaatattgtcatgttaaaaaagaagtaagaggccgggtgcagtggctcatgcctgtaatcccagcactttgggaggccgaggcagacggatcacctgaggtaaggagttcgagaccagcctggccaacatgacgagacctcatctctactaaaaatacaaaaatcagccaggcattgtggcgggcacctgtaatcccagctactcaggaggccgaggcaggggaatggcttaaacccaggaggcggaggttgcagtgagccaagatagcgccattgcactccagcaacagactaaggctccgtctccaaaaaaaaaaaaaagaatagggggtgaaaatcaacaaacagcaggcacagatttggggctagataatagacaaataagtgaaaaagcaaatttattcacatacccttgatgcccctagaaagtccttcaaagcacatgacagggcgtatatgaaagtgtaaactgctcaccatatgaccgtcaggcttctgaagctgtttacatctggaatgcgaccatcaacctggaaggtaagaaaaacaaacaaacaaaaaaacttctgagtgacaaacagcttccacaaagcccatccattttattccacagaagaaaaagaagtgcgtcatttataaaactctaccagaggaggcaacagccatcgctaataacagaggaaagaaacaaaggccgtaaaattagaagcagaggagcagaaccatccaggaccttgaaataaagatggagtccacacagagtcaaccccggcacatcaccctaacagccttctacagtaacaatattcctaggtcggcaacacaggctcaaccaggctcagaatcctgttcaaggacacaagatgagtaatacgtttttattctatttttatttttattttcttaagatggttaaaattgcaccaggcgcagtggttcacaccctaatcccagcatcttgagaggctgaggctggcagatcacttgaccccaggagttcaagaccagtctcggcaacacggcaaaacgctgtctctacaaaaaataaaaatacaggccgggtgcggtggctcacgcctgtaatcctagcactttggaaggccgaggtgggtggatcactcgaggtcagaagttcaagaccagcctggccaacatggtgaaaccctgtctctactaaagatacaaaaattagccaggcgtgggggcatgcacctgtaatcccaactacttgggtggctgaggcaggagactcccttgaactcgggaggcggagattgcagtgagccaagatcgagtcactgcactccagcctgggtgatagagcaagcttccgtctcgggaaaaaaaaaaaaaaaaaagccagatgcggtggctcacacctgtaatcccagcactttgagaggctgagacacgagaattgattgaacccaggaggcggaggttgcaataagctgagatggcaccgccgcactccagcttgggggacagagtgagactctgcctaaaaaaataaaaataaatttaaaaataaaaatgaaaaatatcagcctggtgcagtggtatgcaactgtagtcccagcgactaggaaggctgcggtgagaggattccctcaacctgggaggtcaaggctgcagtgaacggtgattgcgtgattgcaccacagcactccagcctgggcgacagagcaagaacctgtctcaaaaaaaaatttttcttttcaaagctaatatattcttattttattttattatttttatttatttatttatttttagtgcagagtgcagtggcaagatctgtagtcttgaactccaaagctcaaacgatcctcccaccgcagcctcccaagtagctgggactacaggcatgtgccactatgcttggttaaaagctaatatattctcttaataagggagggaacagctttcaaagaaagacagaattaagatgaatgagtaaaagctgaggcagatttcagcccttgcttgagaccaaggcagggcttcttaacaaggagaaccagcctataagggcagtgactgggcccctggcagtgagtagtgatcttctttttttttttttgagacggagtctcgccctgttacccaggctggagtgcagtggtgcgatcttggctcactgcaagccccgcctcccgggttcacgccattctcctgcctcagcctccggagtagctgggactacaggcgcccgccaccatgcccagcgaattttttgtatttttagtagagacggggtttcaccgtgttagcctggatggtctcaatctcctgacctcatgatccgccctccttggcctcccaaaagtgctgggtttaccggcgtgagccaccgcacctggctaatttttttgtatttttagtagagacggggtttcaccgtgttggcctggctggactcgatctcctgaccttgtgatccgcccgcctcggcctcccaaagtgctgggattacaggcgtgagccacggcgcccggccttcttacaggtcttgatattcaggcgaggttgaactagaggtccttgaggatcccaatcaattccaaggttttatgatgggtcatgtcaaagcaaaaaattattctgacattttttacaaatggtaaggcagactttatttaggattacaacaacaggtgtcaaggtcattgcaatagggagaaagattgggctcaactccaaatacagcaaagacgtctggagatcagtagccaatgagccggggaggcgtctgtggaggggaaattactaagaagagatattaaagtcagggggattcttgctaaatcaacttaacaggattcctgctgaaggcaggttgacttagacaacaaggatagggacaaggaacttgatcaggtgtgatcagatatccagaataaaggatatctctctaaactcatctagcagctctctaactttagcaggattcttgctaaaactaactgggaaggcctggaaggtgggggtgggctaacggcctagctgagaagggggctcagagaagccggattcaagtttggtcaaggagcaagtcttcatcagtaatagtaactccagggaacagaggtcctgatacctcgaggtggtgcccaaggcaacagggaagtactagccagagcaaagagcagaatccagacgtcctggcccgaagctcagtggggtgagttgtagctggtgcccagtaatacctgacaccacataacaccttctagtttctccatttcttcccgcgtataattgcgcttttttgcaaaatctagaaatggccgtttctaaacatcaagctaccgtacaataaggggaaactacctttgcacataatgccatgtgagcaatttatatacaattccctgtgatattgaggcagattgattcatcatcatgaagacaatgaggcttttcaaagtggccttgtaatgacaggcatataaataaaataggccaaaaaaaaaaaaaaactgaaactaaaagactggatttaaaagcctctggcaaaaaccaggaagcttgcgatcactaacagaattactaaactaccctagcaaagttaaacaaagttccataatccccaaatccaaaggagagcatttaaagctgaccccagcctggtcaacatagcaagaccccatctccataaaaacttcttttaaagattaagtgggcgtggtggcacatgcctgttgccctggctacttcagaggctgaggcaagaggatcatttgagtccgggagttccaggctgcaatgaactacgttcacaacactgcactccagcctgagtggcagagtgagagtccctgtttcttaaaaaataaaaataaggccgggcgcagtggctcacacctgtaatcccggcactctgggaggccgaggtgggcaggtaatgaggagttcgagaccagcctagccaatatggtgaaaccccgtgtctactaaaaatacaaaaattagctgggcgtggcgacacatgcctataatcccagctacttgggaggctgaggcagaagaatcctttgaacccaggaggcagaggttgcagtgagccaagattgggccactgcactccagcttgggcaacaaagtgaggctccatctcaaaaaaaaaaagaataaataaataaaaataaaataaataaataaataaaattagccaggcatggtggcatgcctgtagtcccagctacttgagacactgatgtgggaggattgctcgagtccagggttcaaggttacagaatatccgtttctaaaataataataaaagtaaaaacaggccaggtgcggcagctcatgcctgtaatcctagcactttaggaggccaaggcaggtggggggatcacgaggtcaggagtttgagaccagcctggccaacatggtgaaaccctgtctatgctaaaaatatgaaaattagctggacgtggtggtgggcacctgtaatcccagctactcaggagactgaggcaggagaattgcttgaacctgggaggtggaggttgcagtgagccaggatcatcacaccattgcactccaccctgggcgacaagagcgaaactcttaaaaaaaaaaaaaaagtagaaataaataaaacgacacagctgcctttcttgatctcaaaagtgcgatctacttgctgggcagaggttatttaagaatccagaagggttggtcacacacagtggctcacgcatgtaatcccagtactttgggaggccaaggcaggcggatcactggaggtgaggagttcaagactagcctagccaacatggtgaaaccctgactctactgaaaaaatagaaaaaaaaaattagccgggtgtggtggtgcatgcctgtaatcccagctacttgggaggctgaggcaggagaatcgcttgagcccgcaaggtggaggtttcagtgagcgaagatcacaccactgcactccagcctggacaacaaagtgagactacctctcaaaaaaaaaaaagaccgggcacggtgactcagggctgtaatcccagcactttgggagaccaaagcgggcggatcacgaggtcaggaggtggagaccatcctagctaacacggtgaaacccgtctctactaaaaatacaaaaaaattagccaggcgtggtgtcgggtgcctgttgtcccagtgacttgggaggctgaggcaggagaatggcgtgaacccgggaggcggaacttgcagtgagccgagatggtgccactgcactccagcctgggtgacagagcgagactccatctcaaaaaaaacgaacctagaagggcgacgtgctaaatactctcagattgcccttcagatgacttttcctctttttcctctgggatctgtgcctgggaggctgcccttccacactttctggccctggggaggcaccacgggcagggatgactgtcggaagagggtcaagacagtaggaacactgaccccctgcttcctccccacagcagcacctggaggtctctcgatcacaagtccctttttctctcaggcttcagttctagggaacaaaggggcttcctcctgctgccccagtggaaccaatccctttttttttttttttttttttgagacagggtctcattctgtcacccaggctggagtacagtggcacgatcatagttcactgcagccttgaactcccgtgctgagcttacatgatcttgcccctcagcctcccaagtagctgggactacaggcacacgccaccacaccatacctggctaatctgggaagcagcaggggggttggtagagaaagggtctcattatgttgcccaggctggtctcaaactccagggctcaagcaatcctcctgcctcagcctcccaaagtgctgagattagaggtgtgagccactgcacccagcctgtctgcttttcttaactccgtgaaaacactttctctcgtgactctcttctgtcacctgtgagtgtgcgatatactttcctgccaagcctctgactgacaacagtagaagaagaagaggggcagagaatttaacattcaattttctggccaggcacggtggctcacgcctgtaatcccagcactttgggaggccaaggcaggcagatcacgaggtcaggagatggagaccatcctggctaacacggtgaaaccccatttctactaaaaaaagtacaaaaaaattagccgggtgtggtggcgggcgcctgtagtcccagctactcagaaggctgaggcagaagaatggtgtgaacccgggaggcagagcttgcagtgagccaagatcgcgccactgccctccagcctgggtgacagagcgagactccatctcaaaaaacaaacaaacaaaaaaaaaatcaattttctatctttgccctcaatggagagggaagaaacagagaacctgatttttaagctagatttccaggcatgggtaggggcaggtgtggcgcactgtctgaggaggctccgagtgttacgagtgtcagtgaaaaccttgaattttttttttttttttttctgagacacagtctggctctgtcacccaggctggagtgcagtggcgcgatctcagctcactgcaacccctggccccctaggttcaagtgattctcctgcctcagcctctcaagtagctgggactacaggtgtgtgccaccacacctggccaatttttatatttttggtagagacagggtttcaccatattggccaggctgggctcaaactcctaacctcaggcgatctgcccacctcagcctcccatagtgctgggattacaggtgtgagctcccacgccaggctgaaaacttcaaatgttatttatttatttacttatttatatttccttgagacagagtttcactcttgttgcccaggctggagtgcagtggcacgatctcggctcactgcaacttctacctccagggttcaagcgatgctcctgcctcagcctcccaagtagctgagattacaggcatatgccaccaggcctggctaattttgtatttttagtagagacagggtttcaccatgttggtcaggctcgtctcgaactcttgacctcaggtgatccacccgcctcagcctcccaaagtgctgggattacaggtgtgagccaccacacctggctaaaacctcgaattttctacacaaaattgtgtgtatgtgtgcatttttctgaaaagagaaatccagaaaggaaaaggtcaaaatgtttctatatcctcaaaaggtgaccaaaaattttaagagacaatgctgccgggaaaaccatgtagaaacagccactgtctccccaggagaagagagaggaaccggcaggtggtgggtacccaggtcagctccatgagcaggaatgccacctcttcccttgccaaggggagctgggctggaggaaggaccagcaccacccctccagccgccacccacccccgagggggcagctgggatggtgcgttcctgcaaatctctcacagctccctctcaacactcagtgacatttgcaaagctcatcagcccagcaggtgtcggatgcacaagcaacagcaaaagcagttccggggctggggaaaatctcatcgtgttgttctgaaaacctccgggctgctgagagtctccaggcagcaaaccaggagggaaaaaatactcaggagacaagagaacagcagagcggaccacacaggaaatgcccaggtgggcacaacgaagcccggagctgtctgcagattcctgccccggtgggcatcggtcagcccttccggagcccagatccgcccctcaggagctgtgtggggaggatcagcggccccctcccactaggctcggttcccccctttaccacacagacacgatcattcagaatgaacctcatagggctgttgtggggtcaaggagaaaatgtgctttgcatgtcaccaagacccagtaaatgccttcagatgtgtgttgggattagtatcagagctcttctctgttttcttccctgcaggggtgatcacgggtacaaacaaacagcaggtgacaagggaggttgatggaatcaacttcccagttccacagggcccttgcccaaagggagtggcaagggctaggtaaggtggcttatacctgtaatcccagcactttgggaggctgagacgggtggatcacctgaggtcaggagttagagaccagcctgaccaacatggagaaaccctatctctactaaaaatacaaaattagccaggcatggtggtgcgtgcctgtaatcccagctgctcgggaggctgaggcaggagaatcacttaaacccaggaggcagaggttgcagtaagctgagattgcgccattgcattccagcctgggcaacaagagcgaaactccatctcaaataataataataataataataataataataaagggagtggcaagccagccaggcaatgccacctgagaggggcgggagccttgagtccacagggagccctacaatgatctccatctcccatgctgtggtcccttttccagctgtgtcagtgtcctcagctcagaggcacaaggctgttgtggttaagagcctggatggggagcctcggtggacacttggtcttgccatgaactgactggacggccgtgtgcaagttatatcatctctctgtgacttagtttcctcatccataaatcaggatgatcataatcatagtacctgtgtttctgtgaggtttaaataaattcaaacaaagttatcagaatagtgtctgggccaggctcaatgtctcacgcttgtaatcccagcactttgggaggctgaggcgggcagatcacttgaaggcaggagtttgagaccggcctggccaacatggctaaaccccatctctactaaaaatacaaaaatcaactgggtgtggtagcacatgcctgtagtcccagctactcgggaggctgagagaggagaatcgcttaaacacagggggcagaggtttcagtgagccgagatcgtgccactgcactccagcctgagcaacaaagcaagactgtctgaaaaaaaataaataaataaaaatagtgtctggtgtgcagcaataactcaatagatgctggctgtcacatgccccgcatgtttcagtgagtttccaaggaccattaacaaagaggcctctgtgctccagatactggcaccaccagcccatgagcctactactacatggccttgatcctaagatgggttctgtaatttaatgttcctaaacttacaatagacatgcacatttcacatagattttctcatctgttaaatggggataataacagcatctagctaacaagattagtggaggattaaggattaatataagcagaatgctttgaacagagcttggcatggcgtacgcatcagaaattgtcctctgcaggtattttcaccgtcattacagtaattgatctgatctgctgcaagtcttcgcactccagtcaaatgtggaaattcttcctcacccctcactcaatccaggcatcacctgaccctggtaccaaagatgcacggtctggagctggcaagggaatggcctcggtaaacagaaagatgctgtggagtttcaggcattttctggggttttcccactctgttgtcttcccagaattagttacttacaaaaagaacatggcagccaggcacggtggctcacgcctgtaatcccagcactttgggaggccaagcgggcagatcacgaggccaggagatcgagaccatcctggctaacacggtgaaaccccatctctactaaaaaatacaaaaaattagctgggcgtggtggcgggtgcctgtagtcccagctactcgggaggctgaggcaggagaatagcgtgagcctgggaggcagagcttgcagtgagccgtgatcgtgccactgcactctaggctgggggacagatcaagactccatctcaaaaaaaaaaaaaaaaaaaaaaaaaaaaaaaaaaaaacatggcttagaagttgctgagttgcatattagatcccaggttgatttaaggttaattttgtttttttttgctgttggagtaattttcaggtcactatgttggcttcttggtggcccctggagcacagctggcctcccgtcagtctgagggcctcatggaaaataaacctttagcaggggcacacaaggaaaacaaccggaagtggagagaaaaagtagcaggaaaggggtcccagtacagtcaaagatcagcgagtgagccagggattgagacaatcactaaatcagtggcctccactgtccgtaacaaagtctgaaataagttccataaaatcactattttcccctcctctgtcaccttagctggtgccgccctgcactggagacttgcagaatcattagtctgttcctgcactgctataaaaaaacaccagagactgggtaacttacaaagaaaagaggtttatttggcgcacagttctgcaggctgcacaagaagcatggcaccagcatctgtttctggtgaggcctcaagaagcttccactcatggcagaggcaaagggggagcagacatgtcacaaggcgagagagagcgcaagagagagaaggaagtgccaagctcttcaaacaatcagctctcccatgaactaacagagtgagagctcactcatcaccatggggatggcaccaagccgtctgtgagggatccacccccatgacccaaacacctcctgccaggccccacctccaatactggagatcacatttcaacatgagatttggagggaacaagcatccaaatcgtattagagaatattaaaccaattagggtacagtcaatgaaaggcagaatcctaacagcacagactctgggtcaggacacctggattcaaatcctggttccctcaacatttagccatgtgaccatggtccagccccaggcactctgtgcctcagtttcctcatctgtaagatgaggatggcagcagctaacaggcaagtgaggtgtaaatgaattaatatatatgaagctcttagaaaagtggcagacacacaacaagcactcacaaacctttagtcttttttttttttttttgagatggagtttcactcttgttgcccaggctgaagtgcaatgacgtgatctcggctcaccgcaacctccgcctcccgggttcaagcgattctcctgcctcagcctcccgagtagctgggactacaggcatgcaccaccatgcccggctaattttgtatttttagtagagacggggtttcctccatgttggtcaggctggtctcgaactcccgacctcagttgatccgcctgccttggcctctcaaagtgctgggattacaggccaccgctcccagccaacctttagcctttattattcttcagttcctgcaccctgggagccctacagggaaaacctgtttagggtaaggaagggaacttttccagcttcctgcagccggtgaaatgggaagataattggagacccacagaacaggatttgaattgcagccgctccacatataagttgctgtgagctagttttttattattattattattattattattattattattatttagttttagacaaggtcttactctgtctcccaggctggagtgcagtggtttgatcacagctcactgcagcatcgacctccccaggttcaggtgattctcccacctcagccctgcaagtagctgggactacaggtgcacattatcacatccaggtgatttttgtattcctttgtagagacagggtttctccatgttgcccaggctggtctcaaactcctgggctcaagtgatccaccctcctcagcctcccaaagtgttaggattacggattactgattacaggagtaagccactgcatccggcactgtgagctattctagttatgaagttctctgaaactcgtcctcttcatcagctacatagggtttggcgacttcctggaattgttgtaagaaatgagactacaccatgtaggtattaaataaatgttattttcttcatctcttccccttccttggggtgcaaaggaggcaatcaaagcaaacgctacattcttgcaactctcagaaagcttgtcacccacccagatcaaggcctcagggtgccctgatacatcatggccagctgggtctagtgatgttttcttgccaagaaaccaagaatcagtgcacttcaccaaggcacacccatgtggcctgtcctccagtgctgagatgtcagccattttccacccatggcccagagagcaggaatcaggaaacgcagagaaaacagcgaaacgatcttggcctggagttctcctgagcaaatcctaattctaaccaaaagttatgggaacaacttgacaactacttcatgaggtgatgtccgaatcattagcaagaaagggtagggcaggtcatttttatataaacatctgaaggataaagagtgtagataaatgtcaaaaacaatgcctaaaacggctgcctactgcctgcttacacagctttttccttctttagacaaatgataaaacatcagcacttctgaatataaatcatcttcaattaagacatttctgttggaaaagcacttttggcaggacaaacgaaatatctgccactgttctccaacttgggtctttcaaggttggcagggcgatttatttttgttgattaaacaaaatacaaatggaaagggcctaaaaattgattagccaattaaactcaatgattctcaacaatgaaatgtgcattattagctttgccagagttataaaaatgtctcctagctttactgccattttcacgatttacaccattgatatttgtgctgacagaaagattaaggactggctgatgcaaaatttgtcttctcttttgctggaacggaaggaagagaaacgattaagggcttgggccatttcaggaagaacatctgcactgcattggtaattcttgaaagaacgatctgggttgagcgagggagctgttgtcactcattttgtgtgtacttgttctttagtaaattacagattcactaataggggccaatttgttgagatgacaacaatcataaatatccagattcttcattttctcttctcattttccgtggggatgagtgtccagacaggcagccaaccaaatgatgggtgtcagatgcttttgcaaaatcgatccatgcacggagggacgccatgagcctatttcagtcccgaacagtttttcttaattgccaccatgaggtcaagatcacaactgcaataaatttacttacaatagcccaaaacccagggcagtagaatgctgatgcttcctggtggtcagagcagaaatgttgccggctgctatgaatttttaaacttgattgtatataattgttaatcactgacccattctgcaacccttctgggctggaacatgttgctaggcaaccagttttgctctagatactttctgaaagctagtgaggcaacaaccaagtgtcaactaagtaaacactaaccattagagacaggttcaaataaaaaagggatgcctgacttccttagagcacatgcatctcatgtcctttcttaatgtagacatgtatttcctgcgcttacgacttagcaaataagcaatcttaggttgaactgggggaaattgcccttttggtagctcaatttggcaattcatatgggtcaacctaatcagagggaggtttccacagtctgtgaaatagaagaactattttcctccacaagcgtaatcataattgggctttgcatcaataacacatcacttacctaagtcacatatttcctgaaattctttttataagaaagagttgggagaggcaatctgctggcaaatgcctgaataagaaatcacagttatttttccattttagactaacacaatctgatttgaccgattcttgtacaatatccacgcattccccaccttttcaaatgttcagcgactcaggaaagggaactaaatgcattttttttttttttttttgagacggaatctggctttgtcacccaggctgcagtgcagtggcgcaatctcggctcactgcaacctccacttcccaggttcaagcaattcttctgcctcagcctcccaagtagctaggagtataggtgcacgccaccacgcccagctgatttttgtatttttaggagagacgggggtttcaccatgttggccaggctagtctcaaactctaaatgcatttttttaaaattgagatcaggaaccccagaggacatcctgaagatgaggacagaactgccaactgcatgaaagaagttcatttaggaggaaagaggaaggaaggcagcatgttggtatcatggcatgatgctatccttgggaagcaagtgaagtctaatgactctccgtgtcccaggcagctgagagcctcacagtcaagaaatgctaaagaaacagaatggccctatgttagtttacagaatatctccaggaggttcttagaatgaattaccactgggagtacagaataacaaccagcttaggcagtgcatgcgcacaggtgattaacctcattaggaaagaattgggaaaaaattatgaggtgaagggagaactcgcagtgaagtttaaggttagattgctggccttattgagcaggtgtgaacagctatgcaattttaatttttagcaagcaaaatcaattatttctaggattactacataacaatttataaactagacacatgtaaactttttattgggcaaatggcaaattgccttaaaaggacaatagaaagtttgtcatccattcccagatgagtcctcttaaaatagaaccaagctttctgtttagtctggatttgctttactacctacttgtaattaaaaagtttaaaaaaatcaatccatacagaaacatgtagagtaaaaagtgaacaaattatatcctcattgtcactccccagaggtaactgccaatttgtttgcctacttttcacaaaagtcacatcgtaatacatatcctggcgacttgctttttcactcaacattatagcacagaaactacttttaaatggagtcctctggaacatttcagtattcaccagccaacgtgtccacaatttcaaaataaagcttctttttgtttttctttttttgtcttttttgttcaaaataaagcttctaagttggtaagaatcatcccctacccatgagtttacaacaatttaaagaccaccaaaacaatgatcaattattcatctttccaaaagctccaaagcacgctgtcagaagccaaagtgtttcaactccatagatgtgtcaaggaaatccagcccaacacaaatggggtggaggcagctagctgacaccccaaatgcgtggcttaagttggaatcctaaaggaaagatgactacatcacccaaaaagagataaatgaaatccagaaacatcgaagactcaagaaatattaagagccaactgctaaattagattctgaaactatctgctatgcactaggaaaagaatgtgatttctacaaggacatttttaactacctgtgaaagaaatcgtgagcctggtgggaacaagcaactattgagacaaggaacaaaaacagcttcgtgagcattaggactgtcacaactgtggtctgcacaacttagattccacattgcttcaactcaagaattgctaaaccatattctttacttgaattctggagaaaacggtcctaatagctcaatgaacagaattttaaaaagccacttcccctctctagacattagttttcttgtctataaaatgagaggacttgatttaaaaaaactctaaaatctgcaacatgatttattcctgtgattctgtctggttataattatgcatgtggatggatgattggatggatggatggatggatggatggatggacggaggggcgggcggatggacggacggacggatgaatggaaggatggatggatagatggatggatggatggatggaaggatggatgagcggcagaggtctgctggagtgggattgtataggcttgtgaccaattgttaaagttttaggaattttgtagaccagttgatatcatgctgatagcttggaattggcgatgatgggaaaatttataccatagaaatcgacaaaacactacaaatcaggcctctttattcaccttgggagccaatttactaacacgccactgaaggaagtgaaaaaggaaggataagaagaggagaagaaagacaaagaaacagtacctgtaagtgcctacaaagtcctccaagtgggctgttcccccatatctccacattgatacacttcatattttctctgcttgaaaccctattccccactgggattccctgcctgttttccctcttttagaaaagccattcccggcgtctgccctccacctgagatgcccctacacgtgctctcacagcatgcagtaattacccctctccaccctcctagggaacacctactatacagtgcggccattgtccatttagtcagccctgctaaagcatcagctaattctgcacagcagctatgcattttagctcttggtgcttaacgcccaacacaaagacaggcacatagccaccatccaatcaatcgattttaaattaaagcaatggttttagctgcaaggcagagcaaaaacatctgatgataaaaggttcagcctccaagagcagcacttctatcctggtcatcattgggtagcttaagcttttcgggtccactttcccttacattgtgatttaccattaaatcagttaacctactcttgtcacaaagcagtgtagtgtgtcactggcccactttgtttatttctttgctactcaatgacatccacatgtcactatgagttgcatttttaaacaaggaattaactgtctctgtcctggatttacccaagggaggcttgggatgcacccttgggctctattgcctaatacactaaagtgacttggagcaaactgcttaaactttctcatccttagctacccaatccactaaatgaagacagaagactagaaatagcacagacaagaaagaaaccaccacattgccgcatgccagagtaaaggcagggacaccagccagccctgaccttggcagtggctgcaaatggagccacacccttctatcacctttggaaggaaggagggaaagtgtcttagtctccctgggctgccataacaaaatagcacagactgggggattcaacaacattcattcattcattcattcgtttgttcattcatttatttttgagacagaatagtctcactctgttgcccaggctggagtgcactggcacaatcttggcttactgcaacctccgtctcccaggttcagacaattctcctgcctcaggctcccgaatagctgtgattacagacatgagcccccacgcccaactaatttttttgtatttttagtagagatggggtttcaccatgttggtcaggctggtttcgaactcctgacctcatacgatccaccacttcaggctcccaaagtgctgggattacaggcatgaaccactgcgcccagccaacagacatttattttcttacagtcctagaggctggtagtccatgattgaggtgctgtctgcattggtttctggtgaggcctttcttcttggcttgtggacagccaccttctttctgtgtcctcacatggcctttcctctgtacacacaagtgtgtacaggtcctatacactcaacaataagatttaacccagatgccaaaggtatagtcaacacttccaagttaagccatagctccttgttggggtacctgtttctatcctacatcatgaactgcttttactcacacttctgacaccaaatgtgtggggtttttcctcacaccaaccaatgctccaactctctggatgccaactgagggtcctacaattcaattcaggactgacgctaactacccacagttagcagagaacctacaggttaagggctcagtcccacaagattgcccccatttcagacaccagctacagatggagggcccacacttcggcttgaccaactacaaattctggggttcccatgatcctctccccaggctcaataatttgctacaatggctggcagaactcaggaaaacacctgacttactactactgttttatgatcaaggacacaactcagaaacagccaaatgttagagatgcacagggcaatgtgttggggagagcacccagctcccacaccctctctggaaacgccacctcacagcaccaacatgtgttcaccaacccagaagctctctgaattctgttgtttagagatcttacagcatgagtgagtaaatcattggccactgatgattaattcaatctctcgcccctctctcctctccctaaggagaggatggagctgaaagtttcaaccctctaatcacatggtttggtctttctggaaaccagccctcatcccgaagctatcaagaggtccccagtgtaccaaagaaagacattccatcgctccagagattccaagggtttggagaactgtgtgccaggaactgggacaaagtgtgtgtgtgtgtgtgtgtgtgtgtgtgtgtgtgtatacatatatatatacacacatatatatttatatacattttttttcttaccataacaaacatcctttttttttgagtcggaatcttgctctgtcgctcaggctggagtgcagcggcgcaatctcggctcactgcaacctccatctcccaggttcaagtgattctcctgcctcagcctcccgagtagctgggattacaggctcccgccaccatgcccggctaatttttgtacttatagtagagacagggtttcaccacgctgtccaggctggtctcgaactcctgacctcaggtgatccacccacctcagcctcccaaagtgctgtgattacaggcacgcacctggcccatcacacccatcttaaccagaaattctgccttgcacaccaacctaaagatggtgccctcttgtcacctgggctaaatcagcctagcatgagggaatcaagaaagggcttattttctggctctgaggcagtaccagtttgttttgtttctgtctagtgatggcttctggtgggaggtgggaggagagagcgcagagtgggagcccagaagcacaacagaagggtgatgcaatatgcaagctgacgctcaggacacgcctacctgcctgcccatgtgcatctggtaaagtgaatttgaagcttgccggtcctcagctgaaccagaagcacccctagtcaaggccaacgtaacactgaaaacagcatgggagcccttggcagtgacccagagcaatgtaaggactgtgctaatcatgagattataagaagaacagataccatttactgagtagctactgtgccaggccctgggcactgtgtatatataatcatggtcacactggtaatgaaagtgttgcgcccattttacagatgaggatacagaggctcagacactaagcagcctgccccaggtcacacagctggtaaatgaaggacaggaacccaagtgtatctggctgtaaaggccatggtcttggtatcacaccatggcgggctgtctctctggctccttcctgaagtcctcagacttatgtttagaaaaaaggagatattttataaacataagcaaacataagtaggccaaaactaacaggacttgcagcaaatggtgctgcagtccccaccaccatgggatcaagcaccctcccactcctttgttttatgaaatctgaggtcttgaaaagacacatacgcactgcaccccacgcttcaacccgagattcagtgtgtaaaagacagagtgggtctcgtgccaagaagttggagccagtttattttagtctcaatgttaagacagccagcaccaggttgaggctgagaattgctccttctaattaaaactttattttcaaacacatgtcacagtttcaacatggtgagactcattttttgctatgtggatttctaagagtagaagcagctgcttctactgacagtctcttccattcattttgggacaaccagaggatcccaaggggccaagattggttttatatgcaggacaggagcaatgtgagctctgtgagcattcaagatacctacaaaatcaagaaaaatgagacactatcatcaatctagctgatatcgcaagaggcactgcttcatgacagagtccgtgcatccagtcaaggagcagcctgacaaatctgcacataggaccagagacaatgtcccttgtccccatctggtgggaaagtaaggtccaatataagaaactcccaagcagatccaaggcagccttggaaaaagggactgaaccaagtcattatggaaccctggtcattgctggaaaaggagtgagaaaatccaatgccataggctgaaaggttgggtcccctgcagaactcacactttcaaatcctcacctgaaatgtgatggcctttgaaaggtgatcagtcataaggtgcaatcctcatgtatgggattagtgctcttataaaacagaccccaaagaacaccctcactcttctaccaggtgaggacacggcaaaagttggctgtctatgagccaggaagccagccctcaccagacacaaatctgctggctccctgatcttggacttcccagccaccagaactgtgttgtttacatgccacccagtctgtggtattctgtgacagcaacccaaacagatgaagacacccactaagaacactgtaccccaactgcctgtcactttgcgtgtcccccacaggactccacaaagaggcttctgggctggggactgtgtgtgctttgctccccggttcatctgcaggcacatacccgcaggtatgagctcaatacgtcaacacctgctggttgaattggcacaatggagctagcactgtgggtggcctccaaacccagcttgcctctgcctccggggcagggacattacttaaacagcagctcttaaccaatgtgaaaatcagggagaaacacacaaaggaaggactgaggaaggctgaaagagcaaactactatgggtttcaaatcctttagtagtaaacctactcaaggcccagctattaaagcaggccccaaagtccacagcactgtgcatcctgtaatctcagcttcctgctcctccaggaagggaggcctgagagactttctaggaccgtgaccccagccatggccatcttcacgttctgaggctcccccagtacagccagtgctgtgacctaaatgtttgtgccccacctctccaaattcctatctccctgaaatcctagccccttaggtgatggtatcaggaggtggggcctttcggaggtgactgggtaggagggcagagcccttgtgaatgggattagtgtgcttatacaagaggtctcagagtacaagccagtcccttccaccatgtaaggactcagtgagaagacagtcttctacgaaccaggaagcaggtcttcaccagacaccaaatctgccagtgccttgatcttggactttccagcctccagaaccgtgagccaaataaacttctgttctttataaattacccaatctctgaataatttcattctttcagagtagcaaaacacagactaagacaagcaccaatcgtagcataacacatccactgaggaacagagactgaagagcaagtgtagagcaacacgctgccttcccacaaaccagggcatgcctcactccatgcctcgcacacattccaactggtccccagaaaggagtcccaggggcttctcagacatgggctattctcatcctcacatcttacaacacagaacataaaataactctgaccccaagaggtggcactactgggtggacaatttttaactcactgtagcattgtccaggagcctataaaattcatgtgctcattccgagacaaaaaaatgaaaacatttaatacactgttgcctgagagtgtggagagaggaggcagagagaaagcaaaacgctaactctgggataacagatcaaaattcagacctggaatctctaatgaccatattctctctgttggactccagcagccgccattgtatcaggaacctcaataagctctcacatcctcagagacagcctgccctctagagacagcacactcctgaagggaggggcttgtacggcttgtgtcccagggaagcagcaaggtgccaacaattccaacaccaccaccaccaacagccactgggtgccaaccacggccagatactggtctaagcccccacacgtattagcacactaaagcttcgcacctacctgaggggtaggtgctactaacattcctactttgcagatgaggaaacccaggcacgaagggggtgagttccctgtacaaggtgacggtccagctccagaacctttcctcttagctctacgccctgcctaaccacatgttcgcagtgcctggttctctgattccctgattccaagcaaccatcttcacatacacgatctgctcccctgtgggctcagaacaagctgcacaccactgagtggaaaccaatagcacatctcacccctcttccacctgaggattcaccattcaaaaccagttcttgtccacaataaaatatgaactgtggggagggaggtgccataaggcactgtgaaaccagcgtccctttaggaggaatgggagtcccagccatccagcactggaacgcaggacactttccactctggatcatcctggggaaaaaatgaaaacgctcgccctctgacagccagtcagtggcccccaaggaactccccaccatccctctgaaagccagctgcaccggcgtcatcctgccctcaaatctgaggctgcatttagaacctgaagcagcagaaatgagcgtcccgctgtcctgcatcatcctacagggtcaggacgaaggggacaaagggtgcgtcagcacctccaccagcctgtccctccttgggcagcaagatttacaaagcatttaatttaggtccgacaaatattatgtgccctgaggtgctgctctgggcttggttgtgcctttttacattcatctgctcctcagtgaccactgcccaatcacccatgtcacgggcttggcagccaggctcaggtggaagcttcctgcatccgtcctctccactgaggaggggaacaggctgggccatccttcctgatgggaagcccaaggaccagtaaagcctggtggtctttgatgtggggcagtcccagggcagaagcactttgtgcaaagctgcctcgtccacagcctgagatgtaatgagagtcatatcaccactcaggcccccgcatgtcacacgagggagcactgagacctttctgctgtgtggccgctttgcccaactcctcaccggggccacaggagtctccacctagggtcaggagaggacaggcagtggtgctagctaagacttggtgacacagccacagcagttctctccttggaatgtgggatggcagatcttcaggggctgggaaaggaggcactggaggtcacgcctagcttcacaggtgcttgacaacctggctgcccatcagttttgttcagggctgggggcaatccaggtgataaatcctgactggtccagtccaggggtttaaaactcaaggagctttttccgacagggcacatttgatggtgtctgaaaacagctggaggtgggggctgttagtcatgagcagagccctacaaggcacaggacagcccccacgacaaagaatcctccagcccaaaagctcaatactgccacggttcacacgtcccagtctaagcaacttatgacatccagttttcctttgccagaaaccaggattttctttttcttttttctttttttgagaaggagtctcactctgtcgcccaggctgaagtgcagtggtgcgatctcggctcaccataacctccgcctcctgggttcaagcgattctcctgcctcagcctcccaagtagctgggattacaggtggccgccaccatgcccagctaattttttttttttttgtattttttttttttttgagacggagtctcgctctgtcgcccaggccggactgcggactgcagtggcgcaatctcggctcactgcaagctccgcttcccgggttcacgccattctcctgcctcagcctcccaagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctttttttgtatttttagtggagatgaggtttcgccatgttggccaggctggtctcaagcatctgggctcaagtgatccgtccgccttggcctcccaaagtgctaggattacaggcacgagccactgcgcccggccacttgatccttttaaaacacaaaaatgtaggaagaaatctatagtctatttgtaactcctgacctcaggtgatccacccacttcggcctcccgaagtgctgggattacaggaaaccagggttttcatccccacttcacagcagagggagggcatgtgaaagagtagtcgctgagaaggcaggagactgtcaggcaggaatgtctatgccgacgctgggcacaggactgagtactccagggagctttacaattggtcctcatagctacccttattctcgtttcacagactgggaaactgaggcacataatgaacacattctgcttagaagagctgggatttgaatccaggcagtccgaccccagtcagtgtattcagggggatggggagggagatacaaaattatatctgtattctgtgtgatcctcatatgtacagacagaaaaaagaaaaggaagaggaggaaggggaaacgggaggtgtattaatctgctctcacactgctaataaagacatacatgagactgggtaatttataaaggaaagaagtttcatggactcagttccacatggctggggaggcctcactatcacagcggaaggtgaaggaggagcaaactcatgtcttacatggtgacgggcaaaagagcatatgccagggaactgccatttataaaaccatcagatctcgtgagacttattcactaccagaacagtatgagggaaaccatccccatgattcaattatctccacctggccccatcttggcatgtggggattattataattcaaggtgagatttgggtggggacacaaatcttatccggaagggagaggaggaaagaggagaacaagggaaaaacatagatatataagagaaaaaaagacaggaaaacataagtgaaaaatgttaacagcagctattcataagtggcaaaattatggataacttttgttttcttctctatgccttcctgtattgtattctctccaaggaaaatgcatgctacaatcagaaaaaaaaaaatacttgccaagcatatatttcaagattttcgtcagcaccagccaactaaacggtaacaataataactgtgggccgggtgcagtagctcacgcctgcaattgcagcaatttgggaggctgaggcaggaggaatgcttgagtctaggagtttgagaacagcctgggcaacatagagaccttatctctacaagaatttttgcaaccttggccaggcatagtggtgcacacccacagtcccagctacttgggaggctgacggaggaggatggcttgaacccaggagttcaaggctgcaacgagctatgattacaccactgcactccagtgttggtgacagacaaggttgggggggagaggaggaggaggaggaggagagggaggggagggggagggaagaagaagaacaagagaagaacaagaagcaggaggagaagaaagaaagagaaagaaagtgagaaggagatgaaagaaagagagagagggagggagacagggagggaaggaagggagggagggagggagggagggaaaattgtgctaagggaaaagtgcagacccccccccccttggcagatgggaggggccaccctgggtctcttggacccatcatacctctacaaccatgaccttaggaagccatcctcaggaagccacgctcacagcacacctgtaaggatccggtcctgaagataaacactccctggagtctgagacagcatgtcagctcctcatccatctcagggcagacagtccccagagggagagccctggaggggaaggtcaaatccccctcccctccccatcccacttcatctggctgttcatgcccatgctcaaagcacttgaagaaacttccagaaaaacaaggtttccggatcattacaattgtctttcagcagttttattaactggcaggagtaagaggaaaaagaagacttttttatccagcccttcatatgaaagtttgttctaggaaaaaaaaggaaaagaattctagcgttcactgaaaagtgtgcctttccaatttttttcccaaaaaaacttgtacatgtgttactgttaattctgtttggagtctccttccaccataaaaacctactgtatgcagaggtgcccattatctaataaatcttttttgttattattcttgttaactcagagaggcaaattcttctattcctgccctgtgatcatgacttggggtcactgtgaggccctctctaattctactttatgtaaaataattaagtggctttataaaaaaattcttacagatatcctcaagtttaaagaagaatctctaaagtttaagataccacacccaaaaatgcagagattcaaaatacccaaatgtcaccattgattaaaacacgaaataaaatgattttttttagactgccagcaggactggacctagcctttacataataataataataaatgcctagttgccttcccaagagcaccccttggatgcctccctccctgtcaacagaacactgatcatccaagttcattctcaggccaggacagactcagggaaccgccgctgcccagccccagcctgaaataagccagatataaaccaatgagagcctcccattactccttgcctgtgattgggttagggctggccatgtgactcagctgccaccaatggaacaagacaggaagtagactggggagttccaggaaggattctttgcagatgaaaagaggccaactggtagaaatgcctgcctcttcattcaagtgttgttgcaattactggcagtgctgcaactccagctgccacccctgctattgtgtagaaataagcccaaggattggccgagcgtggtggctcacgcctgtaatcccagcactttgggaggccaaggtgggcggatcgcgaggtctggagatccagaccagcctggccaacatggtgaaaccccgtctctactaaaaatacaaaaattagccgggcgtggtggtgcgtgcctgtaatcccaactactccagaggcggaggctgaggcaggagaatcgcttgacctagggagtcggaggttgccgtgagccgggattgcgccactgcgctccaacctggctacacagtgaaattccgtcgaaagaaagaaagaacgaaagaaaggaagggaaggaagggaaggaaggaaggagcccaaggatcaagcaaagaacctgaggacagtggagtagaaaagtggaaagaactcatgattctgatgccatcactgcattaatgaactaaccttggaaccaccatgtgagatactaaaccccatattgtttaaggtatgtttggttgggtgttttgtttctagcagccaaaaccatcctaactgatagaaccctataccaaggctcattactaagagtctggaatcttacaaacatattaaagccaaaagacaatgtgtcagattgtctggagctgatccccagcaaggcacagagaagaacggagaggacaggcgaccaggaccttcacgatgacttcctgtcggtcaccaacctgttttccaaccctcctttcttcacactctgtctgtaactcatcctaacagaaggctgaccaactgatatcttttatgacatattcaagaggtagaaaattgatgctttgtggccatctgagaaggagcagtgaaagccaggattcaaaagctctctttgctttcgcaatttatagactacccactgctaaatgtcatccccaagtttagacattaaataaaactgattgatgaatctacgagactttggagaagaaaatcttccaaagcaattttttcaaggatggaggttggtgggggagacagtgctagataaatcagtacataaatcatcttgttaaagataagaatttcacgtaggactctccatgcttaggaaacagacataaacaaaagataacaccatctgactggatagaaaatttctctactatgtgcctgcaaggttattcttcaagaactaacttcctgagactacataagcattaaaaataattacttatatatgtgtgtatatatatatgtgatgtgtgtatatatgtatgtatatgtatatgcatacgtatgtgtatatgaacacacagagagagagaaagagaggaaaatgaatctcaagaccccaaaatcgttaagccaagggagaagtcaagctgggaactacatcaggtaaacctgcctcctattttattactaaataagacagctaaaaagattttaaaaagctacatacctccctcacaatttggaatttcctggtgggcctcaagatctttacccgaaaacagttctgaactgaaagctgatcttcacaggtgcaggaatgaaagtcatccctctgctcacctgagacgaaggcatatctgattgcttcctccaccacactgtttatgtaagaatgcagattcactgaaccagactgaattgtgtaaatttacacaaagaacagaaaactttaaagactgatcaaggactcaaaagaatgcaaccttttgtctcttatctacctatgacctggaagcccctcgcttagagttctcccaccttaccagaccaaaccaatgtacatcttacacatattgattgctgtctcatttctccctaaaatgtataaaagcaacctgtgccccgaccaccttgggcacaggtcatcaggacctcctgaggctgtgtcatgggcacactgttaatcttggcaaaataaactttctaaattgattgagacctgagatattttgggttacacacacacacacacacacacacacacacacacacacacacacacacgttaagtgaaaaaaatccatctatcatatatatactgattccaaaagaaggtacatacgtgctcagtgaaaagaccagaaagaatctggaggaataaataattttttaaggtgtgttttaatgaagttgcctttttaatgaagttaatagttatgtattttttttttaaatgaagtcgtttaagttgatgatgagtatctgtatgttctcagatatctccagtgcttggaactgtctgttcatcaaaaccactcactgaccttcttacctttattaagctcaatcctgcgtaatctgagggccaactacattccaggtaccatgcaggctctgcaaaggattcagttatatttcagatacagccctagtggccttgaactctttctggaaggtgagaaatgagggaaagcatgaaggaagatgaattttaccttctaagaatgcataatctaattaggagcagggaggagtaagtgaagggtaaatacagacacatataacctaagacacacaatcaatcaatgataaaaagatataaaatgatagctttaaatgaggaagagatcgcattgagaatttcaggaaaggtgtcatgagagaggtggcatcggaaatggaaaccaaaggatggaaattaggtagactggcattttcagagggtagcaacagcttaagcaaagacaaaaaaacagaaaactttaacaagaattctgggaacaatgtagagtatcaagataagctggagtgcagggtatgtataggcaagtcatgggtttagaagaaaagcagatggcaagacctgcaggaccagatgccaggctgccttggtttgagaggcaacgaagggttagaagaatagcctggcttggcagtgacacgtcggagctgtgctttagaaataaatggatccagcagcagcaggtgacctggtctggagctggagaagggaccagctggtggcgtctgcactcactcagggcagaagtagggaatgtataaccacagctggcagcacagtgggtagagcgtagacagctccacagatatttgttaaagtgagttaggtttcttatgggcaggaattagatctatttcttttttaaaaaaaaagacagagtgtcactctgtcacccgggctggagtacagtggcgcaatctcagctcactgcaacctccacctcccaggttcaagcaattctcatgcctcagcctccccagtagctgggattacaggcatgtgccactacgcccagctaatttttgtatttttatagagacagggttttgccatgttagccaggctggtctcgaactcctgatctcaagtgatccagccaccctggcctcccaaagtgctgggattacaggtgtaagtcactgtgcccggcccatctaataatttatttctgtaccctctacaggctctgaacacacataaggcactaactaatgatgccagctcctcttgcccccttcttcttccacaagtgatccaatccaaaaagcacacagatgaagcaccaagatcaagacaaaccctcccttttcctatttccaatgaagaatcctctttctcccaaagcaaacatgaggaaagcacagaagctgaacaaacactccaggaaagggctatgggtccaagaaagaataccttatcagcttgatatgaaaaagtaagatgctttccacctctctgctcctatgcaggaaaagtcagcgtagaagactgctaaaaatcagccaggcacagtggcttacgcctgtaatcccagcactttgggaggccgaggcaggtggatcacacggtcaagagatggagaccatcctggccaacacggtgaaaacctgtctctactaaaaatacaagaattagccgggtgtggtggcacatgcctgtagtcccagctactcaggaggctgaggcaggagaactgcttgaacctcggaggcagagattgcaataagccgagatcgcaccactgaactccagcctggcgacagagtgagactctgtctcaaaaaaaaggagtcctaaaaattaacagaaatgtatacccacctaactagcacaaagcaacacctgcagaaaagtgcaatagaattagaggttctctgagaacgtgcaaggatgtcctcattcttcaggccaccacactgaagtacttaggcagcaaagggacgtcatgttgccaaaatactctaaaataggtcagggaaaaaacagtgtgtgtataagtgtgcatatataaatgtgtaggaggataaatgtgttaggcgtaaaagtgtgtggatacatatttagataaatatagagagaattataaagcaaatgggatgaaatgcaaacaactggtgaattttggtaacgtgtatgtcttaatcagcttgtgcagctgcaacaaaatacctgagactaggtaatttataaagaagagaaatttattttctcacagttccggaggctgggaagtccaagatcaaggcaccggcagattcagttgtctggggagaactgctttctgcctccaagatggtaccttttgatgtggcatcctccagagaggagcagcgctgtgttctcacctggcagaaggtggaatggcaagagagccaaatgccgcgtaaagtctcctttataagggccttaatgccattcacgacagaggagcctccacggcagaggagcctccacagcctaatcgcctcttaaaggccccacctcccaacaccatcatactagaaacacctgaattttggaggggccacattcgaaccacagcaatacattcatgcactgcacgatgacatttcagtcagtgacagtggtctgaaccatatacgacagtgctcttattacaatggaggccaggcgcagtggctcacgcctgtaatcccggcactttgggaggccaaggcggggcggggggatcacctgaggtcaggagttcaagactagcttggccatagtgaaaccccgtctctactaaaaatacaaaatttagccaggtgcaggggcaggcgcctataatcccagctactcaggaggctgaggtaggagaatcacttgaacccaggggttggaggttgcagtgagccgagatcgctccactgcactccagcctgagtgacagagtgagggtctcaaaaaaaaaaaagattacaatggagctctcactgcccctgaagagtttcccaaaagacaaggacaagacgtggaggtggacaacagtgatactgctggcctgctcctgtgtaggcctaggccaatgagtatgtccgtatcttggtttttaactaaaagtttaaaaagttaaaaaaataaaataaaatgtttaaaagtagaaaaaagtgtacagaaaaaggatgtaaagaaggagaatactggccaagcacggtggctcacgcctgtaatcccaacacattgggaggctgaggcaggtggattacttgagatcaggtggtcgagaccaacctgaccaacatggtgaaaccccatctctaccaaaaatacaaaaattagctgagtgtgatggcatgcaccagtagtcccagttacttgggactgaatccaggagacgaagtttgcagtgagccaagattgcatcactgcactccagcctgggcaactctgtctcaaaaaaaaaaaaaaaaaaaaaaaatggaaactatcttttgtacagctgtgcattgagcttatgttttaaacaggttacaacagagtcaagtttttaaaaaattaaagtctgtgaagttaaaaagctacagtaagctactgttattattaaagaaaaaaaaatttttatacatttagtgtagcctaagtgtccaatatttatagtctattttagtgtccagaatgtcctaggcctttacattcactcaccactcactcactgacccactcaccgcaacttccagtcctgcaagctccactcatggcaagcaccctatacgggtgtagcactttttctctttcattctgtatttttgctgtatctttcctttgtttagatgcacaatttttccatggactggggtggggggtcggggaggatggtttcagaatgaagctgctccacctcagatcatcaagcattagttagattctcataaggagcacgcaacctacatccctcgcatgagcagttcacaataagagttcgcactcctatgagaatctaataccaccactgatctgacaaaaggtagagttcaggccgtaatgctcacccacctgccactcacctccagctgtgcggccctgttcctaacaggccattgaccggtatcggtcaggggttggggatcccctaggctatcatccagcgtaggtgtgttgtagggtataccatctaggtttaggaaaatacaccctatgttgtctgtaccatgatgcaattgcctaacaacacatttctcagaacatatcccaagcgttaagcaacgcataactgtgtatgaaagttttttacattattcttgctacttttctgtaagtctgaaattgaaataatatcaaaacaaatagttataagagtaaggaagcgttatactgatatgatctttaaaaatatgcaaaataaaaaaatgcaaaatgagatgtatggaatatcaccattcatttcagaagtggagaggaaaaggtactgatatgtatttatttggatgttatatccgtaatggcagataagaaactggtaccattactacctctttgtagaagggaacagggtagttggagatggagtggaatggagatttttcactatttacttttatatattttgaattttgaaccttgtgaacatattgtgtattcaaaatataaataaaggaaataaaattactttgaaaatatgttcaaggaaaataataaaataatagcgcgagcagacagtttggagtggcttaggccagagacacataagaaatcagctaaaagccacctggcagggtgctgcccagatgtcacctcatgagccactgtgcttggagagttgcctgtttagaaagggcgcattccagacaagtaaagctgggggcttggaaaaacatgttctatcaagtttcagcctaaattggacagaactttcacataaaataaattatgtgattgacttacaagccacaattccccatagccctgttcccccaagctgatattgctggttctgtgactgaatcatgtgacacactgcacatctgtcctccatgtgactgtcacaacctgctaaagccctcaggaggatatcccattccttggaaggacaaacccgaatgtaaacagcatccaaccctcttcagtggcagcctccctcccttggagataacagccaacaagccatttggtggtgtgtcactgaaggaaagagattcttggatctacgcaagagctttccaagatgatcacagattattccagcagcaagcaattctgaatggacaaatgaactttctcaccagcctagactcaccacgttaaacttcatgggacttgagcaagctctcagacaaccatagagaggtaagaaggtactactgtctgcagaagccagactgagaagatggtgagctcatctggctttccaattgtcagaacaccaggcaagggaccccgcagcacccccactctcccttaaggaaacccacagttgctctcccagccaagatcccggctccatgacccagtctctagtgctttggggaaggatttgattgggcacacctgtgcatgtttgtaccacatgaactgtagcctgaaatgtgattgatatttgtatttgaaaaagggtgtgggactagtgagaagtcaagacatgggatgagaaaacagggtcctggccagacacggtggctcacgcctgtactgccagcactttggaaggctgaggcaggtggatcacctgaggtcaagagttcgagaccagcctggccaacatggtgaaaccccatctctactaaaattataaaaattagccaggcgtgatggcgggtgcctggaatcccagctacttgggaggctgaggcaggagaattgcttgaacccgggaggcgggggttgcagtgagccgagatcatgccactgcactccagcctgggctacagagcgagactccatcaaaagaagaaagaaaagaaaagaaaagagcgaagagaagagaagggaggggaggggaggggaggggagggggaaaggaagaaaggaaagaaaagagggtccttttcccccagaacattaagatgatgggatctatttatttggcaaagataccttgagcattggctctgtcagtcagtgagcaaagcctggaaagacagagctgaggagctcctagtccagtggagggagacaaacaccaatcacaagggatggggaaggtcctcaccccatctccctggggtgctatgaaggagacacatttacacataaatgacatactttaacaaagatacagccaggcacagtggctcacacctgtaatctcagcactttgggaggctgaggtggacaaatcacttgagcccaggagtttgagaccagcctgggcaacacggtgaaatcgcatctctataaaaaataccaaaaattagccaggcatggcagtacacgctgcacgggggcatgaggatcacttgagaccaggagttcaaggttatggtgagcaacggtcacgctgctgctctccagcctggaccagaaagcaagaccctgtctctgaaaaaaaattaagactaaaaaaaaaaacgctgagcacggtggctcacgcctgtaatctcagcactttgggaggccgaggaagacggataacaaggtcaggagttcaaaaccagactagccaacatggtgaaaccccatctctactaaaaatacaaaaattagccaggtgtggtggtgtgcccctgtaatcccacctactcaggaggctgaggcaggagaattgcttgaacctgggaggcagaggttgcagtgagccaagatcgagctactgcactccagcctgggcaacagaacaagactccgtcttaggaaataaaaagaagaagaaaacaaaaaaaaaaacagctggatgcagtggctcacgcctgtaatcccagcactttgggaggtcaaggcggcaaatcccctgaggtcagaagttcaagaccagcctggccaacatggtgaaaccctgtctccactaaaatacaaaaattagctgggcatggtggcgggcacctgtaatcccagctactcagaggctgaggcaggagaatcacttgaacccaggagacagaggttgcagtgagccaagatcgcaccattgcactccagcctgggtgacagagcgagactccatctcaaaaaataaaataaaataaataaaaacaaagaggagtggtagcaaaggaggacaagtacacccttggaaaggccagcttgctgtcagaaagctggattcgggcccagctcttcactgacaggcagcatatgactgggtcagctacttcactcctgaaactcagttttctctggaaagaacaacagcaaccttcaaaaaggtgaagctgcaagggtctaacacagcatccgccatgcagtagacccttggccaacgaggcttttcccctttgtcagctgacatcaggccagcacacaagtcctctgttaggggtttaaccgggtctcccagaaagatatgttgaagtccttactttacatccccagtagcttggaatatgaccttatctggaaacaaggtcactgcagatgtggtcaagttaagaagaggtcacactggggcacagcagtcttttaatccagtatgtttagcatcctcaggaggaggacaaggagagacagagacacacagggatgatggaggcacaaaatggagggaggcctctacaagtcaaggaactccaaagctttcagagaaaccaccagaaactaggaagaggcatggaactgacggtcccacggagccgtcagaatgaacctacctggccgacatcttgattttggacttctggcctccagaattgtgagaggattcatttctgctgttggaagctaccagtttgtgctatgttataacggcagtccgaggaaacagctacatcctcctcccctctacaaaaaccaaattcttgacttgcctgagaaaacaggacacttttacaaaggcaactaataaataacatttcaggaaaggctatctttgctaacacgccctggcagcagaaagagaaatgtgggtgttttgttggttctttttttttccctctctcctcctccctgcccctctcatattggactcgccaccatttggggttaatgattcccccaagggataaagatacagcgaaagaaggaccttcagatgcagtccagaaggtcaggaccacacattccattactgcagaggctggttcacaccccacgtacattgcaccctccaggagccccttaccaatgctgctcagttacaacggtgaagaaccggggtgctggattttttttgtttttaaaaacggaatgggctctcagcaagccacaggtcaatcaggatggaaagaagagaagggggagagagtcaacgcaaagcagaaaatcacttttctaggcatctacacaactaggaggaaaaaaagtgacctttgggcctgattgaccaaagtgacccaagctcgacggctttctttggcctttcgtatctacctgttgttctctcaagacaaaactggtatttctcactggaacccaccaaatccatgaagtggtttttgtttgtttgtttgtttgtttgtttgttttttgagacagggtctcgctctgttgcccaggctggagtgcagtggcgcgatctcggctcgctgcaacctgcacctcccaggttcaagcgattctcctgccgcagcctccagagtagctgggattacaggcatctaccaccacgcctggctaatttttgtatttttagtagagacggagtttcaccatgttggccaggctggtctcgaactcctgacctcaggtgatctgtccacctcggcctcccaaagtgctgggattacaggcgtgagcactgcgcccagccttgtaaagtggtttttaccaacaacaaagaagccacttgcttggaaatgtgggaccaacgggctgaatgccccatccgcagccacctgggaatttaatcagggtaagactaagagcaggcactgccttgtccatcctatttattctcccccaggtttcacttagctgttttgagagctgggggaaagttccagtgtcaaggaattcaactggcagaattaatgactcaatagcttcagttctaataaggttaccaaaccagtccgccaagtaacatatcttaaagaaaaaaaaaggtaaaaggagaaataccagagaggacattttaggggcccacaaacactgtcaggaaggaagcaattttattatttgttttttatttatcttttgagacagggtctcgctctgtcgcccaggcaggagtgcagtgaggtaatctaggctcacggcagcctcgaactcctgggctcacgcaattatcccggcctcagcctcccaagtggctgggattacaggtgtaagccaccgcacccagcctggaagcaattttaagagagggctgacttccatgtccattactaccacaaccaccaccatcacctaccacttcctaccaccctcccccaaatctgggtcagcaccaagcatgaggaaaatggaactaaggacaggatttcagctaggaaaaaaaggagatcacgaagcctagataatgagtcaggtgagaggagtttctgctccattcaggacgctgccttaagatgtattatgcctagatcatccgtcttgagtttcctggttcactccggattgcaccctttaaagcatttcgtagtttccctttacaatcagatcctaatgattcaaggattgctaatccaggtggctgtactctccaattttggttgccagccatttctctgcttaggagcatctcatcaaagggagagcaaaggaagtttaaagaaagccaatcagtcaagcaaggcaccctcacattccaagctcttacttgagttaggatgatgaaattgacttggcaggggccaaatcaaaaatagaggaaaaaaaaggatgggcgcagtggctcacgcctgctgtgagagccacaccctgggctctgatgtatgttgcagtgacatggctaaatgtaccaaggtcaaaattgtccataatccgctattgtgtctcccttaggaaaatggtgaagaaggctgggtgcggtggttcacgcctgtaatcccagcactttgggaggctgcggcgggtgggtcgtttgagatcaggagttcaagaccagcttggccaacacagcaaaaccccgtctctactaaaaataaaaaaaatagccaggtgtggtggtgcgtgcccgtaatcccagctactcaggaggctgaggcacaagaatcacttgaacccgggaggtggaggttgcagtgagccgagattgtgccactgcactccagcctggccaacagagtaaactgaggaaagaaaagaaaaagaagagaagagaagaggagaaagagagaggaaggaaagaaggaaggaaggaagggagggaggaagggagggagggagggagggaaagagagaaagagaaagagaaaaaaagagaaagagaaaggaaggaaagaaggaaggaaggaagggagggaaggagggaaagaagagagaaagagaaagagaggaggggaggggaggggaggggagggacctgaaatcagcactccaaaatacacttgctttttctctgacaaaaccaaaacggcaggctgtagggatccagcactgtgcatcctgcatgaaaacagtggctgacagtgtcaggacccacaatacctcttcatcatcacagtaaagtccgccctcagaagactggagaggttgaaagaccaggagaaacaccaccatttgagacatcactagcctaaaataaataggttaatttatgtttaaaaaaaaaaagtgaggaccagactatgaccccttccacgtccaaaattctaagcacgatttgatagactaactatcctaggtattccaatggaagagttgggatcagcccatccactttcccagagcagatctctaatgcttatatggtatcattcacaaagggataaaagagtaactgtccctcctgccaatccctgcccaaccttacagtgaacaagagcctgaatcttccagatgaagcatgagcgctctccaagttaagcatgggcgtgcaaagggctggcatgctgtctgtcttgacttgctgaggactgacaggttcctgcttgctggcatatgtgttacaaggcaacccaggcctacaatgaacaacagcctgagaggggttgcctttgcaggtaaaagggagatctgatttaatcttcacagagatgcaagggtgcatccagaagagggggcatggccgctgagaagtgaggaatccaaccctttggggtaattcattccccgatacttttcaaggatgggctgccactatgtcaaaaagaaggtacaacaagttcgctacctggcaatttcagaagccaccttgagggcaatgcacccctcctccaagttcaagaatgccactgtaagaagcagaagcaatatggggagctgggatctaggtcgctcctctgttagatctgaaaagactaaaacatgaaaacttccaaagctggtaaagctcctacttcccagttagctcaacccagtggaaccaagggtagttctccaggtcaatgtctctgactgcaccaggggctgatgacttctgcagtggagggggaaatgcagaactcagtttggttttttctacgttcagatcccaagtcatccctttcttctttggatgttaaagtagtattcatcggcctgcattttttcaggatctcatgcttgctaataaccactgttactaaaaaaaagaaaaaacttctagagaaacctgacccttctcccagaagctaagaacttgacagctatggtctcctccacataatagatactcctgccctgatactgcaagacagaaatgaccacttttaaagaaattagcaagtaccttcaacaaatttgttattagcctctgacagtcccgcactggagacctcagaaacaccaaaaataaaaagatacaatccctgtcataaagggacttaggacacagaatgagtgaggaccccatgggcctaaagcagcatcccatggtgtgtagctaagaacaaaccagattcaatcacaactcagccactgattggccgggcgaccacaaggccaagcaagctacttaaccctcagtttcctcacctacaagatagagatcgtgaatccacctcacagtgttgacataggattcaatgatataactcatgcaaaaaagcttagctctctacaggagatattatcatcagcatgaataattagattctaagaccaagaagtataaatgttaaaagatatgaaaggtcaaggaaattttaaaactagaagacctggaaactggataaacaaagagcaaagagagatcaagaaaaaaaaaagtaaatgtattcttcttaagccaagctcactggtgtcattcacaaacacagggaattcttgaccaaaaagatgactaagataactacttcaaccagcacactctggagcccatggaattggaagagcactcattgagtgtagacattgcagagaattgtgggggaaaaaatcagtggatcagcattaccgtcttagatgtttaaagcctctgaagttttcttagatggaaagatcatcaaaggttactattccagctcattttaaaagctgatgccaggccgggcacggcatcagattttttttgtaatcctagcagtttgggaggctgaagcgggcggatcacctgaggtcgggagttcgagacgagcatggccaacacagtgaatgaaaccccgtctctactaaaattacaaaaattagccggacgtggtggcgggtgcctgtagtcccagctacttgggaggctgaggcaggaaaaatgcttgaacccaggaggcggaggttgcactgagccaagatcttgggccactgcactccagcctgggcgacacggtgagactctgcctcaaaaaaaaaaaaaaaaaaaaaggctgatgcgcacaacaggaaacgaccaacttgctcaaggtcccacagcttgctggagacaaagctctgattacaacccaggcactgatggctgccctcatagttttctgcccagcacgactcctcttcacagcaggaaatcagccacctacacaggctccctccccatttccatctctcttcccatccctaatagcactctctctaaactcacgcactctcacacacgtacacacacacacacacacacatatgcatctgcatctttttcctcccttccatatctttttttaaggtataagaaatacatataccataacatctatcatcttaacccttcttaagtgtacagttcagtgttattaagtacattcacattattgtgcaactatcaccaacatccatcttccgaactctttccatcttgctaaactgaaagtctatacccgtccaacacaaactcccttgaatttcactactctaggtccctcatacaagtggaatcacatagtatttctctttctgtgtctggctaattttacttaacgtaatgtcttcaagattcatccatgttgtagcatgtgtcagaatttccttcctttttggccaggcacagtggctcatgcctgtaatcccagcactttgggaggctgaggcagttgaatcactcaaggtcaggagttcaagaccagcctgggcaacatggtgaaaccccatctctattaaaaatacagaacttagccaggcatggtggcgcaagcctgtaatcctagctacctgggtggttgaggcaggagaatcactttaaccgggaggcagaggttgcagtgagccgagatcgtgccactatactccagcctgggcgacagagggagaccctgtctcaaacaaacaaacaaaaaactcccttcttaaggctaaatcatattccactgtacgtatacacattttgttgacccactcaatcaacagacacttgggttgcttcctcttttggctattgtgaataatgctgttatgtgcgtgggtatgcaaatatctctctaagtgtctgctttcaattcttttgggtagagacccagaagtgaaattgctagatcatatggtaattctatttttaattttttgaggtgcatgcacctttttaattttttttttttttttttttttttttttttttttttttttttttgagacagagtctttctctgtcgcccaggatggagtgcagtgcaaggatctcagctcatgaaacctctgcctcctgggttcaagcaattctcttgcctcagcctcctgagtagctgggattacaggcacctgccaccatgccccgctaatttttttgtattcttagtagagatggggtttcaccatgttggccaggctggtcttgaactcctgacctcaagtgatctgcccacctcagcctctcaaagtgctgggattacaggtgtgagcctgtaaaagggaccatgtctggtcccttttaaaattatatcacacttctccataactacaactaatagcaaaatatgttttcttttttattcaactaatgtttattcagcaccaattatatggtaggccttgggctatgtacctgggatacgatcaatcatgacctaaagtcatggtccccgtcctcttgggactcacagtctagcaggagggacagacaggaatcagatcacaggcagctatctggagcagacagacaacagtgaaactgacgcaggcagcagtaactctgccatcaatcatattatgggaaggtgttttagggtggtagcccaggggtgggtgtgtgctgtgggttgaattgagtgccttaaaagatatgctgaagtcctacctgtcctacctcccagaacctgtgactgtgacccaactggaaatagggtcttcgtagacataatcaagttaagatgaagtcatactggcttaaggtgggccctattctaatgaccaatgtcctaataaaaagagggagacttggacacagacagacatggggaaggaggacatggaagacacagacagggacaggaaggacgcagctgcacactgaggaagccaccagaagctggaagagggaaggacaggttcttccttagagccttcagagtgaacgtggccctgctcacacctcagtcgtggacttcgagcctcctgaactgtgggagactacatttgcattgcttgacgcttcccctccatggtactctgttagcacagccctaggaaaccctacagggtggaacgtagtcctaggttggattcttttctacctttccttggagtggggaggagagagatagagaaataaagaactaggttttcatattgaaatttcttttttttttttttttttgagacagaatttggctcttgttgcccaggatggagtgcaatggcacaatctcggctcactgcaacctccgcctcccgggttcaagcgattctcctgcctcagcctcctaagtagctgggattacaggcataagccaccaccacacccagctaattttgtattttcagtagagatggggtttctccatgttgccaggctggtctcaaactcctgacctcaggtgatctgcccgcctctgcttcccaaagtgctaggattacaggcataaaccaccgcgcccagactcatcttgaaatttctaaccaactttcgatcctggcctgtggacctgggtctcagcttctgactctgtagggtgagtgtgcccttagactatatccgagatcctagcgttgaagtggtcctaaggttcccacggagtctttttcaagctagcccacagggcagttcctgatcacccccatgggagacctatgcgcacactattggtattaagatatgacttgctgcaggacatttagcaaactgggctgtgctacgaactcacctgcccctcccccatgccttgtcatgaacaaaaatgcctccacccccatgtctagagaagccagcaagaggtgagaccccctggagggaatgagtcttaaagctgggtcatagagcaggccactgattttccatgagatctatgtttgaatacatttggagtatctgcgtgcctccgtggtggagattatggggtatggagggcaccctgcacaacggttcttcaggactacccgacaaaccctacctgctgagactgggaggtcaccccagggagactcacccatttagggaaccactactacagctgggagtgtctcaccctgttggatggatcaggcatggcatggggaagcctcctgaatatgacatggaaaaaggaagcagacatcccccggcagaggtgcaaacccagctctcctggagtcctgcaaagcccccaggacccactcaagggccatgtgagcaccaagtcacctgcctggcacaggcgccacttcccacccgctcctcgggcacccaactgttccagcactcatcactgcacctcctccgccactgtcaacacaaacacccacacccaggcaggaagtaaaaataaccagccgtttcatagcatgtctcatgcctcatctccttcccgaggcacgcctctctcagtcccctgcaggcatcaaggacccacagagaggagagagaggcagggagttaagacagttccaatgccctgtgctttgtctacactgtcagacagagatcatctctaaaagggataaaagtcagaggcccttcccttgcaacaaagacggggctgcatgtttctctctcaggggcgccccctacctggaaggacagttctttctaccagtaaattccacgtgcctggagagccgcagaacttcagggatgagtcagccaattaccgctgggcccctccccaccacgagagtgtgtttatctatctcaggcagaggtactagtgcccaggcagaaaagacatgaaaatcacaaccccagaccagaactagcatcttttatgaggcacagccatcaaaggacctcctgacagcaaagcctggtgctatggttctgaagtgcatcccccaaaaagatatgctgaagtcctaacccggggtacccgtaaatgtaactgcatcagtttgctaggcttgccataacaaaataccagagtctaggtggtttgaacaacagcaacttattatcttacagttctggagactggagtccgcgaccaaagggccagcagggtggtttctcctgaggcctctcctcggctggcagatggctgccttctttctcgctgtgtcctcacacagcctctcctctgtgcgtgcacatccctggtgcctctatgaccaaatttcctctactcataaggacaacggtcagatggattagagcccaccctaaggacctcatttgcacttcatcatctctttagaagtcctgtctccaaatacaatcacattctggcgtaatgagggttcgggattcaacatatgaagtttcaacataggaagttttgggggaacacatttcagcccataacagacctcatttgaaaactgttgggctcacacctgtaatcccagcactttgggaggccaaggcggatggattgcctgaggtcaggagtttgagaccagtctggccaacaagatgaaacctcgtctctactaaaaatacaaaaaattagccgggcgtggtgacaagcacctgtaatcccagctactcaggaggctgagacgggagaattgcttgaacccaggaggcggaggttgcagtgagttgagatcatgccactacactccagcctgggctacaagagtgaaactccatctcaaaaaaaaaaaaacaaaaaaaactgtttactttttatgatcatgtcttgcagatgtaattcattaagatgaggacatattggagtagggtggtccctgagttcctatgactggtgtctttgcaagaagaaaaaagacacaaagatacacacagtgaaggtaaccatttgaaagcagagacacataggacaacgccatgtggcaacagaagagagacaagtcaaagaatgccataggttgctgggaagcaccataagttaggaaaaggcaaagaaggattctacacagcatcacaggaggaaccaatgccgcgggcaccctgagtctgggcttgtgccctgcagaacaacgagagaataaacttgtgttgttctaagtcaccctgttggtggcactttgttagggcaaccctaggacactcagccctaggaaaccagggtgagcagttggctgggcactaaaggttcagacctcttgaggccgcttagccatacatagaaagcctccgtcaacactatttccttctaataaaattcaataattgacttgcaatacagcctagcagaggaattcttagtgcggactctgtggccagactgcctgggttcagaaccttggtctgtcccttaccagacatctgaccttggccaagacacacccccagggcctcagttttcctcatctgtaaaaagggcatgataataatagtatctagctcatcctgctaggaaaatcacatgaggcaatacttacgcagcaatcaatgcctggcaccgagtccaagctatgcatgggtttgataagtcctgacaaagagttatgtcaccgacgtatgcttctctcagttgtatgtgaaatcccgaagaatcctgggtcgggcctccccgatcctggactgatcatgtgtaaccttaaaattcaccaaagttccaggaaggcactttgcagaaagggaaaatgtaataatacaaaggaaacattcctaaatgattaaaatgtcccaaacttacacctcgttgctagggcaagggaaaaatattataacaacaaaatttaatttgagaatctatttgaaaaatcagctggaagtgacaggcagaaatagacaagagagacaccatctcagccatgggcacgaaggagagtggcaggttagggtcaagtggcaaaccacagcccgtggcaaactcctgggtatgtcacacacaaaaacgttgacaagacatttacctaagctgcctgggatgcactgaatttccttatcctactgcaatttattttatttgtttattttattttttgagatagggtctcactctgttgcccaggctggagtacagtggtacaatcttggctcactgcagccttgacctcctaggttgaagcgatcctcccacctcagcctcccaagtagctgggactacaggcacatatcaccatgcccagctaattttttttcactttttgtagaggtggggcctcccctgtgttgcccaggctggtctcaaactcctgggctcaagtcatccacccgcctcggcctcccaaagtgctggaattacaggtatgagccatctcatctggccacaattttatttttactgttgtcacaacagcactatataaatcaatgaatggcctgtgacccagtttgaaaactacggacacagccctctgcaaaatccttcctacttcattttttcagaatatttaactccagggactaaattctgaggaaaactcccgggaccttcttttcttttccagagtcaaagacagtcctgtctttttcttttttcttttcttttttttttttttttttgagacagggtctcactctgtcacccagactaaagtgcagtggcgtgatcttggctcaccgcaacctccacctcccaggctcaagcaatcctcccgcctcagactcccaagtagctgggacaaccgttgcaagccaccatgcctagttaggtgtttttttgtttgtttgtttgtttgttttgtatttttggtagagacgggatttcaccatgttgcccagactggtctcagactcctgagctcaagtgatcctcctacctcagcctcccaaagtgctgtgattacaggcacgacacacggcacccagccaaagacagtcttttctaaccatagggaaaactataatgttctaaaataaacaatatgagactggacactaaagactatgaggaaacaggcttccagagggctaactgctctatgctaaaaattcagtgaagtttaacatttactcttttttaacataattcttaacttctaaagcaatgctatttattttgtttaataaacattttcacacatgccatatatatatgttccatacatatacacgtaccatgttccagacactattttaaacccttcacaaatattaactcatttaatcctcacaatgaccctatgaaataggtaaactatatgacaccattttacaggtggggaaactgaggcccagagaagctacctgcccaaagttaagagctgggattccagtccactagtctgtgctgctctaattgatttcttcatcaattttctcactatctcaggtgcccctgttcgctattaagcgaacttcctcttgagtttcaatgctaccatgttgtgaaatgcaaactcttaaacaaacagccctgccattcaggagggtgacccacaagctctcaccctttcagcagtcatcatcccttccatgttctttagcagtagaatcagactgtcaaaattagctccttagaaaccagaatatacctatattgaaagagctaacttctggatctgttttaatggaaactcttgtacagataccatgcccttcagttgttttctttagggtcaatctagacctacttgtaaaaataaggttctggagccagatgcagtgactcatgcctgtaattccagcactttgggaagccgaggcgggtggatcacctgaggtcaggagttcaagaccagcctggccaacatagcgaaaccccatctctactaaaaatacaaaattagccgggcatggtggcatatgcctgtaatcccagctactccggaggctcaggcaggagaatcacttgaacctgggaggcagaggatgtagtgagccgagatggtgccatcgcactccagcctgagcaacaagagcgaaactccatctcaaaaaaataataataataaggttctggcacatcccccaaaggcctgcgacagagggacatttctggaaggaaaattcccttgtatttcaaaagcggctctgaccccatcctcctgcctcatcccaccctcaattgtatttcatgatctaagaggtgaaattaagaacagactccctgacttgtagaatcaaagatgtttgcccccacacataatgcaaacccaagattaaagaaagtaaaaaccgtttaagaccaaaaaggcaattatccaaccaatctcgtttaatgagagaatttacaaattctaggttcttccttctagggttctaaagattagccaccaattgctcagggccagcaaagcagctgccacaaatgttaagttcctagctggaaagttaaaaaaatcatattgatttttgaactttgggaggccaaaatgggcagatcacctggggtcaggagtttgagaccagcctgaccaagatggtaaaaccccatctctactaaaaatacaaaaaaaaaaaaaaaatagccaggtgtggtggcaggcaccacacctgtaaacccagctactcagcaggctgaggcacgagaatcgcttaaacctgggaggtggagattgcagtgagccaagattgcaccgctgttctccagcctgggtgacaaagtgagacgcttatctcaaaaaaaaaatattgatctgagttttgatacaaccacagtcctccaaacctccagcgttctgaactgcagagtgcacgcctggaggtctggagtgtggtccctgctgatgcagctgcgctgccctctctctgcaagaaaaaggcctcctgcagcccgcagctgggtggaaccacgggacaaagcagactttgttccagcggaaagccgatgttaggagttgggagagatggaaagcaagatagagtcactttatttcttgcttccaactctcattatgtctattacacaggcacacgacagctgccagacccagaagtaggcagacgggccttgcctggttcggtgactcttttgccaaaggacattgtggatttgactacacttttgcagaaacccaagtttggccctggaccaaaaaccagtcctaccctttgttatccaccttttacctttcttcgctatcgacccacaggccccaactccaaaatcatgacccaccctccccacgcagccctcatgtgcctggagggccccttcttcttttgtctctctaggaaaatctcaccatcttctaggttgagttagatactctatcctccatcctattgcacagaaatcctcaaagtgtggtccctggaccagtggcatcaatatcaaaatctgtgcactgtgccccagatctactgaaacagaagcttggggtgaaccagcaacctgtgctttcacaagccctccgggggtgttgatgcccactcaagctttgcccacttcaacagccataatcactactttacctcctccctacttagcttaggactctgtcattgtaagtccctcagagtctggcacaagctaggcaccctataaacacccaattgttgaattaagctaaataacctcttctaaaacttgaaagggcagtgtgaaatcgacaactttacaggctgctgaacctccaccaccatcttcagacatgcagcgccagcaacacccaggaatcctgcagaataaaatcctgcagaataaagccagactcggtcagaatttccatggagcaagtgatttgggaaaaattaatatgtggctcctgttcatgaccattgtctgcagtaagattctaaaacacaccagggactggacacatggctcacacctgtaatcccagaactttgagaggccaaggcaggcggatcacctgaggtcaggagttcgagaccagcctgggcaacatggcaaaaccccatctgtactaaaaatagaaaaattagctgggtgtggtggtgtgcacctgtaatcccagctactcaggaggctgaggtaggagaatcacttgaacccaggaggcggaggttgcagtgagccaagaaggcgtcaccacactccggcatgggagatacagcgagactccatctcaaaaaaaaaaaaaaaaaataggggctgggcacagtggctcacacctgtaatcccagcactctgagaggccaaggcaggcagatcacctgaggccaggagttaaagaccagcctggccaacatggtgaaaccccatctctactaaaaatacaaaaattagccgggagtggtggcatgtgcctgtaatcccagctactagtgaggctgaggcaggagaattgtttgaacccaggaggtggaggttgcactgagctgagatctcgccactgcactccagtctgggtgacaaagagagactctgtctcaaaacaataaataaaattaaaaaataaaacacactagggcaatgttgggaatgacactggtttatgtctcaaaaggagtcttcactggctccatcaggacagcagagttgaaccactccctaaggaagagaattctctaagagaaattaacccacagtatttggtataacgtcctcttgcctcattagagccactgattccaagcttccaccctgcaaaactcaacacactattggtgctcacacaactggacttaccctaaaaaaaaaaaaaagaaggagaagaaaagatagataaaaatcagaataaaattgaataacagggcagcacagcacaaaatccttagaaatataatgaattcaggctgggctcggtggctcacacctgtaatcccaacactttgggaggccgaggcagatcacgaggtcaggagttgaagaccagcctgaccaatatggtgaaaccccatctctactaaaaatacaaaaattagctgggcgtggtggcgggcgcctgtagtccacctacttgggaggctgaggcaggagaatcacttgaacacaggaggtggaagttgcagtgagccaagatcacgccggtgcactccagccttggcgacagagcaagactctgtctcaaaaaaaaaaaaaaaaaagaaaagaaaagaaaagaatacaatgaattcacatgttctaggcttctctctttgccaagcactatgtcagggtcttcaaggctcacagtgcagcggttaaggctacaactctaaaggcagaccacacaagtgttccctgctccatcacacgatctcaggagatctgtgtaaagagctttaaaacagactgagggtcatggctcgtgcctgtaatcccagcactttaggaggccagaacaggagaatcacttgaggccaggagttcaagacagcctgagcaacatgacgaaaccccgtctctgtaaataaataaattgttaaaactttaaaacggtcctataatataaaaatattaatggatgatactattactatgattactcattgtggaagactaaaactgtccccaaagttatccccaggccctaaagagggaggcagagggagagtccacgtagatctaagagaagaaaacacacgcagaagaggaaaaagctatgtgaccacagcggcagagatggagcaatacagtcacaggccaaggaatgccggtaccatggtagaatatgaaacacccaaatatgccactttggcttaaggaaagttttgaattaaagacacttaaacaacagatgcaagaagggcactctgacctcctttttcttcctgcaagccagaaataaaaccatgcaaaagatgtccttcttgtaccaggaggaaggaaactttcttatcaacagagatggcgagtcgaggccaagagaaatctgtacaaacaaaccttgttaaactaacccttatcttcctagtcactcctccatgatcaacttccttagcccaaacccctctgcctagccacgtttccacagtttaatgcacttggttcaaacaagtatatgagctctcagccctcaccgccccttcgagtcttcatttttctcatgaacttgtaaaaataactcaataaaatatgcatgcttttctcccgttaatctgtcttttgctagtctaacatataaggcctcagccagaaatcctaagatgggtagaggaaaaagatctccctctctcataccagaagctggagaggcaagggttctcccctggtgccttgggtatgagcatagccctgccaattacagttggggccagtggaactcatttgggacttctggtctcagaacttaaaaagaataaatgagtggggtttttttgtgggttttttggggtttttttttgaaatgaagtttcactcttgttgcccaggctgcagtgcaatggcatgatctcgactcaccacaacctccacctcccgggttcaagtgattctcctgcctcagcctcccaagtagctgagattacaggcatgcgccaccacgcccagctaactttgtatttttagtagacacgggatttctccatgttggtcaggctggtctcaaactcccgacctgaggtgatccacccgcctcagcctcccaaagtgctgggattacaggtgttggccactgcgcccggccctaaatgagtgttttttaagctactgaatttgtggcttaggaaatgaaataccatcatcagtcacttcatctttttcaacaataatgcaggcgagccagtatcacccccactgtaagcacaggaatgcttacactgggaaggtggggtggcagctcacatcatggagataggacaaagccaggtgcaagtaatagcaatctgatcttcccagcatgcctggccggctccagtgaatccacatgttgctttctggcctttagggatagcctggaaaacaatcaccctggtaacattgtttttacagaaaatgtagtctggatttcaaataaaagacaaatggctcacgcctgtaatcccaacactttgggaggacaaggcaagaggatcacttgaggtcaggagttcgagaccagcctggccaacatggtgaaaccccgccttggccgggcgcagtggctcacctgtaatcccagcactttgggaggctgaggcgggcagatcacctgaggtcaggagttcgagaccagcctcaacatggagaaaccccgtctctactaaaaatacaaaattagccaggcgtagtggtacatgcctgtaatctcagctactcaggaggctgaggcaggagaattgcttgaacctgggaggcggaggttgcggtgagccgagatcgcgccactgcactccagcctgggcaacaagagtgaaactctgtctcaaaaaaaaaaaaaaaaaaaaaaagaaacctcgcctctactaaaaatacaaaatattagccaggcgttgtggcccatgtttgtcatcccagctactcaggaggttgaggcatgagaattgattgaacctgggaagcagaggttgcagtgagctgagatcgcactactgcactccagcctgagccacagagcgagattctgtctcaaaaaaaaaaaaaaaaaaaaaaattaaacagaattaccacatgatccaacaaatccacttcagagtaaacacccaaaagaaagcaagaaattgaacagatatttgtacacccgttaacaacagccaaaagatagaagtaacccaagcgtgctttgacgcatgaacagataagcaaaaggtggcatatccatacaatggaatactattcagccttaaaagggaaggaaattctggcacgcactgcaacacagaaccctaaaaacatcatgctaagagaaataagccaaaaaagacaaatactgttaagattccacttacatgaggtccctagagcagtcgaatacatagagatagaaagtagaatggcggtgccagggcctggagggagggtggaaatgggagttattgttgaatgggtacggagtttcggagtttccatttgggaagatgaaaagttctggagatggctgctggtgaggcaacgttacattgtaaatgtacttaaagccactgaacttgacactttaaaatggttaaaatgggccgggcgcggtggccacgccttgaatcccagcactctgggaggctgaggcacgcggagcacctgaggtcgggagttcgagaccagcctgaccaacatggaaaaaccctatctctactaacaatacaaaaattagctgggtgtggtggcgcatgcctataatccaagctactcgggaggctgggacaggagaatcgcttgaacctgggaggcggaggttgtggcgagctgagatcgcgccattgcactccagcctgggcaacaagagctaaactctgtctcaaaaaaaaaaaaaaagaaatggttacaatgacaaacgatgttatacatattttactgtaataaaaaaaagaagtactagcaataactgtttaagaataataggtttttgagtgcggttttactttttcctttgagtcctaaattttcattcatgaaatttctcttaaaaagagaaaaggcatttgtggtataaacagcaaaaggaaagaaatgtgctgtcctaaggcaggccaactcattgaggacccacagcttcagggattaatgggattcctgtggcaatgaccttccccacttctgtaatatgaatgatcgcaaagcgaaaatccaattccctctctgtgtttatgaaagccattcctttaggacagctgaagcaacaaagccagtcaaaagcacttcccagccgtgcgattggagatttatattgcacatcaacataaagaaacattatgtaacttaagctgtgggccaggaggcgtgggtcagaagctgaattcaagacatgcttcgccctccaattcccaccactggaccaattaaaaactccccaggcttctgctgccttttccgtaaggtgaaagaacacctgcttcataaggtaaccgtaaatcctgcaaagaacccatgcctggcaaatgtcaggggtttagacacagcatgtgtgaaagaacacagcctgccacagagcaggtgcttaataaatgcccaaggcttgcttcctttcactccatccatgcaggcactcaaagctttatgcttgcttgttcctcaacttctgaagaaggaatagattgccagatttactcttaattgcctcaactccgccaccttctctaaaaagaaaccctcatcctaaaactcttaatgaggtcggctttctattttatggccagataactggaaatgaccggagagctggcaaaatgacaagctggaaggcttcatttaaattagaaaaaggtttctagagtttctcttcaagattatattctagagatccagaaaacctaaggttccagcagtcattagctgcatgaccctgggcaaagtacttatccttagagcactgatattcacatcacaaatgatgtaaaccagatatacacaattgagtctcttaaaaagttaaaagagtgcacacctgtaatcccagtgatttggtaggtggaggcgggaggatcacatgaggctaggagttgaagaccagcctgggtaatatagcaataccccatctcaacaaaaaatttaaaaacttagccagtagtggtggtgtgcacctgtagtcccagctattcaggaagctgaggtggaaggattgcttgagcccgggagttcaaggctgtagtgagccatgacttgtaccactgcatgccagcctgggcaacagagcaagaccctgcctcacacacaaacacacacacacacacacacacacacacacacaaagtaaaggacagtaagaactctaataattttttttgtttgttagagtatcactctggcccaggctagaatgcagtggtgcaatcttggctcttaataattcttttttttggagacggagtctctctctgtcgcccaggctggagtgcagttgtgccatctcggctcactgcaagctccgcctcccgggttcaggccattctccagcctcaggctcccaagtagctgggactagaggcgcctgcaaccacgcccggataattttttgtatttttagtagagacagggtttcaccatgttaaccaggatggtctcaatctcctgaccttgtgatccgcccgcctcggcctcccaaaatgctgggattacaggcgtgagccaccacgcccggccggctcttaataattcttaattattcttaataatttttaattattaagaaattattgctgggcccggtggctcatgcctgtaattccaacactttgggaggccaaggtgggcggatcacctgaggtcaaaagttcgagaccagtctgaccaacatagagaaaccccgactctactaaaaatacaaaaaaactcagccaggcatggtggcgcatgcctgtaatcccagctactcagtaggctgaggcaggagaatcgcttgaacccgggaggcagaggttgcggtgagccgagatcgcaccattgcactccagcctgggcaagaagagtgaaactccatcccaaaaaaaaaaacaaaaacaaaaacaaaaaataataataattaatcatgtccccaccatgaaactattaaacataattgtttatcgtcagggagcccttgttcctgggctgggcctcaggcttcccatcagtagtaaatgggccaaaccaccagttctctcaaaggaggcttctaacacgaatgttccacaacacttgtaaggcccatctgtccaaccgaagcagtcctttataaagttctatccaaatgggatcactggctataacatatcaagaattggaaatagtgatgaccaggaagtttcttttgatttgaccaattaaaacaacatttttttctcatatctaacacttattctcatatctaacactaccccgtatttcaatgtcataggtttttaagctacaaccacaaattctgtcgtttaaatttaggagcaatcacaataattcaccgaccagctataaaataaatttttagcacattctcaatcattctcaataaactgtcatcattcacggatttcaacagcacccaatgccatgtttttaagcagcagtaactcctctgcaaagcaatatttctctttgcaacttatcacaccttacaaaagatacctgcaaagagaggtaaatcaaacaaaacatgtaagttatgtttattttcccattacaaacggtatcaaagtacagagctacagcatcgagacataaaaaggatgccctgaaattttactgggtgcaattttcactaaatatagcctaatgaactgaatagttcaatgcttttgcagaaaaagtcctaagcagtgcaattaagaaaaatctaaaacaacacaatgattttatataagcagcagaaatcttcttcccaaatgagaacaagtcatatgcaccactcatttaagactcttcaaaatgcagaaagatgtctggattttgaaagtgaggaaggaagactaatagttcagggcagcagcatgaaatagcaaaagctcccagacatcagggatacagcctgaagcctccaggctcaacctagctgtttactaattgtgtgactgtgggcaaatctcttcatctctgaacctcagtttgctcatcaataaagtggagataatagtacgtactcagtggggcaagatggctcacccctgtgatcccagcactttgggaggccaaggcgggcagatcacccgaggtcaggagttcgagaacagcctggccaacaaggtgaaaccccatctctactaaaaatacaaaaattagccaggcatggtggcctgtaatctcagctacccgggaggctaaggcacaagaatcacttgaacccgggaggtggaggttgcagtgagctgagatcgcgccactgcactccagcctgggtgacagagccagattccatctcaaaaaaaaaaaaaaaaatagtatgtactctgcctgctctgcaggcatgataattcccaatgctcactccagcctgggtgacgaagccagaccccaactcaaaaaaaaaaaatagtgtactctgcctgctctgcaggggtgataattaccaatgctcaggtgaaaaaaaagctaagactcaggatacacttccaagactagtgtgtcaggccacttttgcattgctgtaaggaaatacctaaggctgggtaatttatatagaaaagaggtttaattggctcatggttctgcagattgtacaagaagcacggcttctgggaaagcctcagggagcttttactcatggtgcaaggtgaagtgggggtaggagtctcacatggcagaggaggagcaagagagagtagagggaggtgtcacactttacaacagccagatcttgcgagaactggctcactatggcaagaactgcaccaagccaagagggatccgcccccacaacacaaacacctcccaccaggcccctcctccaacaccgggagttaatcttaacaagagatttggaggggacatccaactatattagctagtgaatcccagaacctggactcaaaagtatattctcttgctagatggcaaaaagcatttgctggtgaagggtttgatcctgagagctttgaaatagaaaaatggaaaatctaatgggaaatcaggaggaataatcagagtttactctctctctgccaagcttataagcaaaagagctgaagtgtattgaacactatgcccaagagttttatatccattttatcatgcaatgctcctttagctagataattacagcaaaaacttacatagcatttagtgtgtgccttgtaccattccaaacttctatcatgtgattcatctgctcttcccaacatctcagggaggcagacacatccttgtcttagtacatttgtgctgctacaaaggaatgcctgagactgtgtaattacaaagaaaaggggtctatttggctcatggttctgcagactgtacaagaaaaatggcagcaacatctgcttctggggaggcctcaggaagcttccactcatggtggaaggaaaagggggagcgagcatgtcacgtggcaaggaggaggaaaagagagaggggccagactctttaataatcagatctgaggctgggcgcggtggctcatacctgtaatctcagcactttgggaggccgatcacctgaggtcaagagttcaagaccagcctggccaacatggtgacacctgtctctaataaaaacacaaaaattagccaggcatggtggcgcacacctgtaatctcagctacttcggaggctgaggcaggagaatcacttgaacccaggaggtagaggttgcagtgagctgagattgcgccacgcactccaacctgggcgacagagccagactccgtctcaaaaaaaaaaaaaaaaatcagatctgacgggaactcatagagcgagaactcgctccttgtgagaatggcaccaaggcattcatgagggatccacccccaagacccaaacacctctcactaggccccacctccaacactaggaaacaaatttcagcatgagatttggaggggacaaataccccaactattaggaatcatcattttatagacaaggcacttgaggcacagagccaagtgacttccccaaagtcacactgctagcagggccagaattcaaacccaggcagtctggcaccagagtccatgctattaacccctgtaccagggactcttattatatgaagaaataaaatgagagggtgacacattaattatgtcatccgacgccaggcacgggggctcatgtctgtaaccccagcactttggaaggctgagatgggtggatcatttgaagtcaggagttcgaggccagcctggccaacatggtgaaatcccgcctttactaaaaatacaaaaattagctgggcttggtggcgggcgcctgtagtcccagctactcgagaggctgaggcaggagaatcgcttgaacccgggaggcagaggttgcagtgagccgagatcacgccactgcactcaagcctgggtggcagagcaagactccatctcaaaaaaaaaaaaaaaaaaaaattatctcatccaagtgagcacaacttgctttgaacctggtctgcagttctccctgtctgggcactcaccaccatgctgtgtgttcaggcctggcaggcaggggtgccacccccatagcagcactgagccctggggcagatgagtaagcaaacaggatgagatctgggtcttcacagcaggagactgaagagggaaggataagaaacaagtgaccagggaagatggaaggcagcgggaagcaagcagcaaaactaaaagaggtcaaaggctccactgactgtttctgctgactttgatgagtgcatgcacggcggaaacttctggaaacttctggtttccgtaactattttatctatgctcaggggctccatgagctgagttcatttagcaaattaatgaccttctaagccttttaagtcattctgaacagaaaaagaattgctcagcaaatcacttggagaggaaatctcatgaggaaactccctttttttctaagacgatatgacaatgctttcccacgacaatgcagaccctgcatggccacaggtgggaatcgtgatagtaagcctggggtcacatatctcatcatgtactttaccttcatcatatatctatgggaatctcaaaagctgtattctctttttttgttgtttgtttgtttgtttgtgacagagtctccctatgtcacccaggctggagtagaggggcatgatctcagctcactaaaacctccgcctcccaggttcgtgcgattttcctgcctcaacctcccaagtagctgggactacaggcacgcaccaccatgccaagctcattttggtatttttagtagagacggggttttgccatgttgaccaggctggtctcgaactcctgacctcaggtgatccacctgcctcagcctcccaaagtgctgggattacaggcgtgagccaccacgcctggccaaaagctgtatactctttcctgatcttccatcaagcttccaaagacttccaaagatatccgggccacacactgtggaacagacaccggagaaactgggctccaacacagagactagatttaactcctgcttggcaacagctggagcctagaagctctgcacaccaatacagagcctgcaaaactctccatgcctcctgcctctgttaacccagcttcctccccctgtcttaagctgaaactcctccgtgggacttactcatgctgacacacaagcattttctaaatagaaaattttggtagagaatgagtagggtaaactcaggttatcagaatcttagaggaggcccagagacacaaaaagaccacatttaggtgcctctcaactttgcaggaaagttctaaaaatagagggcctgatttcaagtggaagtgattttaaactacaatctattatttaaatagcaaacacgttgagtatctaaaagatcaagacaaagatgagtgagacattcgaagagcatggggacctagcacacatttttgccagctctccatctgccctgatggattactaaattcacagctgactctccagttttaaccattttcttctgattgggtgttaagacattcccagagggaagggatggagctaaaatcacccatctatcagccacctgccccaccccattccaccctgtcacttatcacaaaatcctaaaatacagatatgatcttaaaggccaccagtcccaacccaatgcttagaatctcctcagtgtgtcccagtctccactcacctgggccacttgtggtcaacagtctctcaatgttgatcacattgagtcccctgatcaagcccatcactacccttcagaaacagatttgctcccaaggaaatgtcttgcttctccctacacaaacaggaacagagtgggagcaccatgtgtgttaattccaacaggatgctagactgttgttgatacaagtgttacagtgttaatatagctgagatgggaagccctaaactagtgattctaggctttccagcgtacaagattgatgagacttcagtgtttaaacaacattcactgacagagagaaagagataactagggagattaagggagcagggaggggggatgccgatcaatgaaaatatttcttccagggaagaggcagcactatcaatgcactaagtatgtgacctctatttaaaatacttcccaaagccaggcacagtggctcatccctatactcccagcactttgggaggccaaggcaggaagattgcttgaggccaggagtccaagaccagcctgagcaacataccaagaccctgtctctacaaaaaatttgaaaattagctgggcatagtggtgcatctagctactcagtcctagctactcaggaggcggaggcaggaagctccctgagcacaagagatggaggctgcagtgagctaggatcgcgcctccatactccagcctgggcaacagaaataaaaattaaaataaataggcaggtcacggtggctcacacctgtaatcccagcactttgggaggccgaggcgggcggatcacatggtcaggagtttgagaccagcctgggcaacatggtgaaaccctgtctctactaaaaaaataaaaaaattagccaggcatggtgtggtgtgcctgtaatcccagctactcgggaggctgaggcaggagaattgcttgaacccgggaggcggaggttgcagtgagtggagattgtaccactgaactccagcctgggcaacagagcaagactctaaataaataaataaataaacaaacaaattaaaaaaaaaaaactctcaagattaaaattcagttctatttatcatatcctttcaggaaactggaagaataggtattatgaaaatgaaatgtctttttattcttttttttttttttgagacagagtctcagtcgcccaggctggagtgcagtggcgcgatctcagctcactacaagctccgcctcccgggttcacgccattctcccacctcagcctcccgagtagccgggactacaggcgcccaccatgcccagctaatttttttgtatttttagtagagacggggtttcaccgtgttagccaggatggtctcgatctcctgacctcctgatctgcccacctcggcctcccaaagtgctgggattacaggtgtgagccaccgcgcccagccgaaatgtctttttattctttcaaacagatacttgagtccaatggggaaaggtggaaaaaaaaagtcacaaaacctgtcctcaaaaagccctccatcctattaggttggggagagaaaattaatgcagataaaacaattagaaaacaataactaatgtaattatgggttgttactactgtaacaattactagtgtaattttgagttccaagcataagatttcagaaacgaggagtatgttcccttcagtagctcttgaataccttgagtaaacagagaaggaagcaggaaaccaaacattctcttctttatctcttcaatgtatcttctttatcagcaaatggatttcctttcagggagtttaagaccttgtgggtcagggctacctgcccagttcaggccagaaggaaacaaaggaaataaattaggtcacccatccagcattgctccttcccaaatacctgctcctcaaatgcagagagcaactgtcattgcaagacagctgtgcagacatgtgtttataaacttaaagtccatgaactccaacctggtatcatctctcctaactccagagaaaattcacctcatgcccccttcctctcgagggaaggtccgcagagacaatgtaagatgttctcaccagggaagattccaccttgcttggcctcctgtcagtttctgtcatctccgcggaagtgtcatggacattacagcattctcttgttgccacctttgctggagccaggacctagcactgcttttgcgacccccctgcaaatgtttatttctactaacacgttggaaggcaagaagacaacctggcattcacacaaccatatgaggaaactcaaggaggaacttaactcctttcttagagcctgatgtcaccactattctcccagttccaggctaccgtcaatgccatctcccagggcaacctcatctgggaaggtctcctctgaattcatactgaaaaggttttgaagatgacctccacatatttcaagaatagctatcatcgatctacctgaaagtttgctgccaagcaaagttatctctacacaacatttctttaaccctctcaccaccactttttagacaaggcaattgaggctgagacattcagcaacttggccaagaggcctgaacactgtccagaggcctgaacagtgatggaattccaaaaatcccaaaatccccaaatgcctgctcttcaccgtcaatgctattctgtctcccttcacaacagtgtagcttttcagtctggcaaatggaaaccagctcaacgtactaaagcatatttgtgtggctatgaaactcctagaggaagcagagccacgaagatgaatggagatctacaaataaaactgtggggcaccccagtgcccgactgtatgagcccccctggtgggcacacacctggacgcctcctggtggaagcaaggcgccttctgatccacactgagccatcagctgtccccaccagctggtcagccgcacttcgcatccccagaaccaacctccaagaccccggacccctggcctggaaatgtaagtgggcaggcaatgtttctggaagacactctcctatctgttcactcgtatacccaagccttataatccccagaatacagtaggattggcttcattcctgagtaataaatttagaggttaaaaaaaaatgattcctagtatcaagaacaagaaacaggactgaacagtcctggctccaagtcaatcacagcgccactgacttacgccccacagagtagcaaccatggctaatttctctccagatggcggcttgtacttttccaagcagaatctcatctccccaagccttgcctcacctttctacagctctttgtgttttcccaacgtcctctctgtgcacagagggctttgcaacacctccaaatttactgccacccacagatttaattagcagactgtttactccccccttctctgattggaatatcttaagtaaaaccaggcctccactgagcccgtgggtactccaccctgggcctctgtccaatcggctccccagtgaaaaacagtgtttgctcagctccaactgtagggttggcccaggtccaaggcaggtctatgctgtgagccagccaccggtgccacacaagggccgcaacccctgggggctgcctagtgagaggagactgtatggaaggaagggcagaggtgaccaaataaaaagaaacaaaacgacaccctggtaagcaaggcattagtagtaaaagttagggtacagagacaaactggctaaacacatatttctcttgacttctccatgtgatcgctatagtgaaagaaaaaagaagaggaagaaacagtagcatacattatagaagggaatgagatggtgaaagaaatggaaaaaggaggatcaaagaggacccagagaagaaaggagggcaggagagaagggaagggaataatctgcttttttttactcaccattaagtaaactaattaaaaaccactaaactgaatatccattttacattcaactatacaggagttaaaaaaaaaaaaaagatgcctccttgggagaaacaaaatcaacagcaagagaaacaaatatgaaaccaacagaaggccaggcacggtggctcatgcttataatcccagcactttgggaggccgaggcaggcagattgctcgagtccaggagtttgagaccagcctgggcaacagaggggaaccccatctctatgaaaaattaaaaaattaaccaggcatggtggcgtgtgcctgcagtcccagctacttagggagctgaggtaggaggattccttgagcctgggagttccaggctgcaatgagccatgattgtgccactgcattccagcctgggtgacagagcaagaccctgtctcaaaaagaaaaaaagaaaccaacagcaagcaatgcaaacaggcctacagttcactctcctacagagccatttaatgatgcaaggactgacatgctatctctggctgtggagtaagagtggaggagattacacagaagcacctccttggtccaactaaaactaggcacagccttggctgcacacaccaaaacagcccagtgctgatggtaattacacacatgaccaaccaacacacaaaatctcttcttgataggctgagcctccccctccgatgctatgctgcttgcttttatgtccttcattaatttttcctaaactattttaaggttttatgactactcttacttctttattcttagacttttaaaggggagtcaagcaattaaatacacagagctattgttactcacaataggcactgatataatgtctacctaatcttttaaatgtgcctacattaattttgctgcagagaaaattcctatctttccaatatgctagtgatgaaaattcatttttggaaaccacttagccttgtactttttaatctccccgcactctagcttcaaacacgctttgtggggtgaaggggcccattaaaattaagaaattcctgaaataagagaaatttccccatcctatccagcatgggcaacgtggccaaatcccatctctacaaaaaattagcccgtgtggtggcgcatgcctgcagtcccagctgctcaggacggggaggtaaaaggatccttgtgtcctgtaggtcgaggccacagtgagttgtggttacaccactacactccagcctgggcaacaaagagaaaaaaataaataaatatacctaccctagcaggttatcccagcaagataggtggacagcctttctctaggccaggggaaaacataattttaaattttcaggccaggcgtatctcaacataatcatgcctgtaatctcagcactctgggaggctgaggtgggcaggtcacttgaggccaagagttcaaggccagcctggccaacatggtgaaaccctgtctctactaaaaccacaaaaattagccaggcatggtggcacgcacctgtaatcccagctactcgggaggctgaggcaggagaatcgcttgaacatgggaggcagaaggtgcagtgagctgagatagtaccactgcactccagcttaggcaacagagtgagactctgtctcaaaaacagtaataataaaataaattttctagtagccacatgtttttaaaagttaaaaggttaaacagaatttcataacctattttattcaaccaggtatatcacggatactatcatttcaacatataatcaacacaaaaaattattcacgtggctgggtgtagtggctcacacctgtcatcccagcacttaggaaggccaacccaggaggctcacttgaggtcgggagttcaagacaagcccacttacaaaaattatttttaattagccaggggtggtggtacacacctgtagtctcagctaccagggaggctgaggtggcaggatcacttaagcccagaagtttgaggctgcacgagctgtgttcatgccactgctctccggcctgggtgacagagcaagaccctgtctctaaaaaaataaaataaaaaattattactgagatagcaaacattcttctccttcttcctgtgtctttgaaatctggtttgtagtttatgctgacagtacttcccaattcagactagccacatgtcaacatagtgggcagtacagctacagaccctctgatggaaatgtgcggacaggagggaatagggttagataaagaagtacctaagcacgagggattcgggatctcttaagtgctcaattacaggatgtgcttagctttcctttcacacagcccctccaaaggacacacatgccctgtggtctttcggaaatacccgcctggcatccagagaatctctctagggctctgagttgcagttccaaaacctcacccactccatataatggaaaacacaatgaagagaaagcgagtacctccaaggtacaaaaaccacgctaggcgctgacactaagcatattcaaactcaccattaacatctaagcctaacatgctggccaggagacattgtcttctatggatctccatgccttattaaaaagtcattaaatccagtgcctacatcgagaacaaccagacttaacaacaggaaactgagctccctggcctaatggcctgtcttgttctaagttccaggacaaaccaaagaagcacttaagaatccaaaatcaactgggttcatgcctgtaatcccagcactttgggaggccgaggtgggtggatcacccaaggtcaggagttcaagaccagcctggccaacatagtgaaacccatctcttttaaaaatacaaaaattagctgggcatggtggtgtgtatctgtaatcccagctactcgggaagctgagatagaagaattgttgaacccgggaggcagaggttgcagtgagtcgagatcacgccattgtactccagcctgggcaacagagcaagactctctctcaaaaacagaatccaaaatcagcacttaagaatcttaatttctacctgcctggtcaaaaccactgcccatcactgaatcttgactgcccccaaaatcctaaaagagtaatcattgtgagcatttgacatattttctcagtatctttgttgtcataaaattaatccagggccaggcatggtgcaaacactttgggagaccaagctgggaggattactgagcccaggagttcgagaacagcttgggcaacatgacgaaaccccatctctacaaaaaattaggcaggtgtggtggcaccagccctggctacttgggaagctgaggtgagaggatcacctgaacccaggaggtcaaagctgcagtgagccatgactgtgccactgcactccagcctgggtgacagaggaagaccctgtctcaaaaaaaaaaaggctgagcgcagtggctcacgcctgtaatcccagcactttgggaggccaaggcaggcgaatcacaaggtcaggagttcgagaccagcctggccaatatggtgaaaccctgtctctactaaaaatacaaaaattagctgggcatggtggcaggcgcctgtagtcccagctgctcaggaggctgaggcagaagaatcgcttgaccttgggaggaggagattgcagtgagccaggattgtgccactgcactccagcctgggcgacagaggaaggctccatctcaaaaaaaaaaaaaaaaaaaaaaaaaaaaaagtttatccagaaagttcttgttccaattttttctcttatcactttaaaactaaagcacatgcaaatgggctctgattccttaaattaattgaaaaacatggaccccaacctttacagagcttcatgcacaagcttatcaatgagtatggcctgcccatctaaagattttctaagaggctgcccacgtaaaggggatgtcagagctcctggagctttgggacagccacaagccctctacctggttctctatctaggtcttttcctccttcccattgccccagtctctcccagagctcagacacactctataccttcccatgggaacaaaaaagcccccaggtgagtgttttttggctgatgtgtgagtttgacatccagcactggcacatccaccgtgtgacacttgggacatcactcaactcatcacttgctcttttcccaagcaagtaccaaactgaaggcccatcaggtgccagcagccatgccagggacagggatgacaaaacaccagaatgagcctgctctcaagaattagaggcacgccaacagatgaatggaagacgatgggttactatgccagcagaaaaggtcctgggaggctttctagaggcgatggtgcctgtgttgggcctttaaaaataagcaagaatggaccagaaggggagaaaatgcggcacaggcagagaggccgggggttgatgcttcctgggcccacaccaggcaccaggcctgttcaaagcatctacaggaatcggctcattcactcctcacaaccatccctatgaaataggttctattattttccccatgtgatagacgaggaaactgaggcataaggcaaattgcatcgtccgaggtcattctattcataagtggctaagcaatgcagtctggctcagattgggggtttcccctatggtctgtgagatgactgcccttacccactgcacaccatggcacctgcccatgcaagcgcatgctgtgcttgtgaactgcaagcaaatggtgcaatctggaccaccccggataccccaaaggtcacctaaatgcaggaagctgaaggaagggagtcttcaggacagccgggacccactagagattcaaactctcacccgatactcttcaatccaaacatattaggttggttaaaagtaatggcaaacatcacaattacttttgcaccaacctaaaaacctatagtcaccccacaggtatctgctgacgtgtgtcccccagcagagctgagtgggcagggctggggtgagcaaggagtgaggagaaacgggtggaacagggcatgggcacgagccctatggcctcagacctcatctcaagccacggggaagatgatgaattctaaaccccaacactcagacacatactagggagacagctgacctcccatggaagtcacattgaaaggttaggacaagatggcagggaccaggaggccatgttcaggagagagggcaagaagagggcattagcttcctaggcctgccatgacagagacgttgattgtcacagttctggacactagaagtccaaaatccaaagtgttggcaggactgcactccctcaagagactctggggaaggatccttccttgcctcttccaacttctggtagctccgggcggcttcttggcttgtggctgcattgctgcaattctgcctctgtcttcgtgtggcattctctgtgtgcccacacctctgtatctgaaccattggatctggggtccactataatccagtaggaccccttcttatctgatgacaactgcaaagaccctatgtccaaaggcggccacattctgaagttccagtgacatgagtgtttggagggatagtattcaactcacccgcatagggctgaacataggtcaagggtcttgggactgaagaggagcaagcaaaggaaaaaaatatagcaaggtgtatgacagtaaagaagatgtgctatctttttggttgggggggatgcaaaaattagcacgcctgtgcttatataaaccaatactgcaagaaatcgcaaaaaaaaaaaaaaaaagtattaatagggccgagagcagtggctcatgcctgttatcccagcactttgggaggctaaggtgggtggatcgctcgaggccaggagttcaagaccagcctggacaacatgatgaaaccctgtctctactaaaaatacaaaaattgcccaggcatggtggtggatgcgtgtattcccagctacttgaaaggctgagacacaagaattgctcgaacctggaaggcggaggttgccatgatccaagatcgcaccactgcactccagcctgggcaacagagcaagtctatctccaaaagaaaaaaaaaaagagagaaaagtattaatatttacccaagaggatagaaaactagggtattaagggatggggtgagcacaagactgctctatgtgtacttcattataatctttttaatcttgaaaccatgtaaaggcattatttatccaaacaaagaaaacttaaaaacaatgttttggaagtgaaaattacaaatggatgaatctcacaaacataacagtgaacgaaagacaccaaatacaatcaagtacatcctgtgcgattccttactatcaagtacaaaaatacatctatggggttagaaatcaggattggggttgccctgaagggggcgcaacaggaaagtttctggggtctcagcatgttctgtttctagatctatgtgctggttacatggttttatcccatttgtaagaattcatcaagctgtacaaatacaataacgtacacttttctgtatgtatgttatatttaatttcaataattttttaattaaatacatatgtggccaggtgcggttactcacgcctataatcccagtactttgggaggttgagacagaaggaatgcatgaggccagaagtttgagaccagcctgggcaacacagtgagaccctgtctctataaaaaattttttaaatagccgggtgtcatggcatgcgcctgtagtctcagctactcaggaggctgagatgggagaagaccgtatctctatataaattaaaaagtatttttaaaataagtaaatatatacataatgttagtgcatagcttcctatctgtaaaatggggatgatatcaccccgtttacagcaaagctctcctgcctgaggacgcccagaattccaaggaagaacacagaatgctgtcatcattcaagcccaatgtcatgcacgtccatgtcacatgctctaaaagatttttccaaaagaaatatggacatgacaatgttttcattaatgctgccttggtttcgaaagagatttggccccttattgtcaaagcctgaaattttagctgcaaagcaagcggggaggggtccctgaaaacgtttttatgcatttctcgctgaaacaaaagaccaaaaatggactttccccaagaagtggtgggaggaggggcagcctgcacgcatcgtccctgcacggccgctcattccagccacctaccatgcctcccgtaatggaaacaccacatttaaacaggtgccgtaacagtaaaggggccccataaatgggaaacccaggaggcctctcagagctggacagctggtgcgaaagggagggttacagacctaagtggtccccagacttccggagtctgctatccttcacctcacacactcttaaacatccatttgcctccaagagcacacacacaccacatacattaaatctctcaacaggaaatttcttccattcttaaatggtctcgactaaataaaatacctttgacagagtattctgaggcactggattgtattaaatgacaggggaagagagggaatgggttactctttttttttttttgagacagagtcccgctctgtggcccaggctggagtgcagtggcacgatctcggctcactgcaagctccacctcccgggttcacgccattctcctgcctcagcctcccgagtagctgggactacaggcgcccaccaccacacccggctaattttttgtatttttagtagagacggggtttcaccgtgttagccaggatggtcttgatctcctgacctcgtgatccgcccgtctcagccgcccaaagtgctgggattacaggcgtgagccaccgcgcccggccggaatgggctagttattctgtactaaaccttctgctcagtttagcagagtcacatggacactccggactgcttcacagagggacacgaaatgagaagggggagggcaatgtggtggccctggcagacgcagaattcaggggagggtgagaatcagtgaatcccagccacataagcacccaagtgctgctagcagttgatgagagtggatttcatcgcacccaggttgtgtggcctgtcacggatctaatctctttgcttctccaatttttcatctgtaaaatgggatggcagtactcaccttttgaggacttcttaatgataacatgtaaagtatcaaaaaggcccagtgcaagctgtggtacgcacctgtaatatcagctacttgggaggctgaggcacaaggatcacttgagcccaggagttcaagaccagcctaggcaacatagtgaaacctcgtctcaaaaaaacataaaaaaaaaagaaaaaaaaaattaaggcctagcacaagggaaaggatcaataaaaggtaggaagtacaggccgggcgcagtggctcacgcctataatcccagcactttgggaggccaaggcaggtggattactggaggtcgggagttcaagtctaccttggccaacgtggtgaaacctcatctttactaaaaatacaaaattagctgggtgtcgtggcatgcgcctgtaatcccagctacttgggaggctgaggcaggagaatcacttgaacccaggagaaggaggttgcagtgagccaagatcacgccattgcactccagcctaggcaaaaagagcaatactccatctcaaaaaaaaaaaaaaaaaggtagcgagtacaatggttatagtcctaaacaccacttataaaagtattcaagtggccggaagaggtggctcacgcctataatcccggcactttgggaagctgaggcaggaggatcgcttaagcctgggagtttgtgaccagcttgggcaacatacggggacccccatctctgcagatgaggctctcttatgtccagcctgctcacttcttaaacttctggttcataaaatcaaagactcaagacactggaagctagaaaggacctcagaaacaacatctcacagatgaggaatccaaagacagttgttcatagttttcttttgtttgttttttttgctctgaggcgtaagaaagatttaagtgataagataatgatagtgttttgtaaacacttaaaacaatgtttaaagtaataaacacgaaaagtaaagtctacctgaaaagtaaagaaatggagaaagagagagagccggagatattgttcaattaacagcaacaaaataaagtgaaatgattaagattccgttgctagttaggctgtggtgagtccaatatacttattattgataaattcatatatggatatatacatcaactgatgaagaccaatcaagcttctggaaggcagtttggcaattcaaatcaagagctattttttacagtgtcatatttaatacatattgaatacagaacccacatcctgggaatttatcctgagaaaagtatgtttagaaaagaaagcaagcaaacaatatatacttaaagaatgtcaggctgggcatggtggctcatgccttaatcccatcactttgggaggctgaggcgggcagatcacttgaggctaggagtctgaggctagattgggcaacatggcaaaaccccttctctacaaaaaatacaaaagttagccaggtgtggtggtgcccgcctgtagtcccagctacccggaagactgaggtgggaggatcgcttcagccccagaggttgaggctgcactgagccaagatcatgccactgcactccagcctgggcaacagagtgagaccctgtctcaaaaagaaggaaaaagaaagaaaagaaaaaggtcaaaaaagattattaaaatagtgatgaaaataatactacataaatgttcaattacaggagaatagttaagtaaattatgagctcactgaaatgtatgaccattataaatgagaaatatgaggataaagtggctacaatatgcaggctgatggtgtaacactacctgaaaagaaacaaaatacaaagctgtatctatttaagagttacaattatataaaaagtacatccaaaatatggataagaaaaaacagagaaaaccaaaagcaaccaatgtgttcctatcctaggaatgcagaagaatgtctccttttaaatgcattttattgttcttacaaaaatcatgcagtcaataaaaacacattttaaaagagtaagctgatccatgtgcagcacaaaatccctttcgaagctaagtgcttgcccaactgcctagaaaaataggttgggaaagtcaagcaaaggcctgaatccttatcagatctcaattagcaatttcctcactttccctaaaaccagtgccctcacccctccctctgtggtcattcgaaatgaagactatgccctcaacccttgacccaaccacaggcattcaagccaggctcctcccatgaagatctccttcattcttctgaatgcttagtaatgggtacagcaggccaggtgcggtggctcacgcctgtaatcccagcactttgggaggccgaggcgggaggatgacaaagtcaggagaacgagaccatcctggctaacacggtgaaactccgtctctactaaaaataaaaaaaaaattagccgggcgtggtggtgtgtgcctgtattcccagcttctggggaggctgaggcaggagaatggcgtgaacccaggaggaggagcttacagtgagccgagaccgcgccactgcactccagcctgggggatagagcgagactccgtctcaaaaaaaaagaaaaaaaaaagtaataggtacagcattgtgggatcatctcacctctgaggcaaaatgttttctccttgaggttagggaactcagcttctctctatttctacttgccccccaacccttactactccctcaaggatcatccatgattttctacacataggctcagtatccaggtacaaattcttccgcaaccatttgcaggttaggtcctgggctgctcagtccctgtgacactttttaaaaacccaggtccacggttgggcacagtaatgcctgtaatcccagcactttgggagactgagcagggcagatcacttgaggtcaggggttcaagaccaaggcctggtcaacatggcaaaaccctgtctctactaaaaacacaaaaattagccaggatggtggtgcgcacctgtagtcccagatactcgggaggctgaggtagaagaatcactcaaactcgggaggcggaggttgcagtgagccgagactgcgccacggaactccagcctgggtgacagagcaagactccatctcaaaataaataaaaaataaataaaaataaaaacaggtccagaagggctcaccttggaatcaaaggcatatcggtgcgatgtttttcttggttttctggtttctgtttatctgctggttccaaactgcttgcctaccctgcttccccctcagagtacatgctgcctcatgttgcctcttcctatacatcagtttcaccctggctggaaactgctcatcagcaactaagagaaactttcttctccaatgggcccatagggaagttgccctctctgatctctcctgagtaaaatccccttttcactttgggcttctcgtcccacagccgccaccattccaagctcgcgctcttggcaatgacctgcgcgtcatgcgtgcgtacagactgctgagttacaaatcggggcaagtttatccaaacacaggccaagctcctccacagcagcgccgtgggagatgaatgtggctgagaccttgccatctaagagtttgcggtctggcaagtgtccacagagacccaagctagactataacaacacacagaaaagaaacattgtaacgattcagaagggaagggacgacttcaagtcacggaggaagcagaacatcgaggaaaactgtaagaagatggctgatttcaaccacacctagaagaggaggtagattttgacgtgcagaaatagaaatgtcccagatctggaaacagtgtgagcaaaagaataagaaaacaggatatatccccgaggagaagtaactcctgtttcactggctcaaaggatttgaacaaggagtcctgtcagacaagattgaaaaacaaggtctggaccagtagggctagccatagccaccgaaagtttaaaacacaggtggcgtatcagagctaagctttcagaaaatcaagcttcttagcactgaggacatatccatattacacgtccttaaccaatttaaataggcagtctaagacccagcacagtggctcacgcctgtaattccaggactttgggaggccaaggtgggcagatcgttcaagtcaggagttcaagaccaacctggcgaacacagcgaaaacccatctgtattaaaaatataaaaattagctgggcatggtggcaagtgcctgtaatcccagctactcaggaggctgagacaggagaatcgcttgaacctgggaggcggaggttgcagtgccaagatcatatcactgcactccagccaggggggcagagggagatggtctcaaaaaataaataataaataaataaataaaaataggccacttgtggtggctcacgcctgtaatcccagcactttgggaggcccaggtaggcagattacatgaggtcaggatgaaaagcccatttctttctcaaaagggccacgatccctcttgctgtcccagaccaccagagctaacatttggttccggtgaaatggaaacctcgaaatgacgaaggagttcaagagcagcctggccaacatggtgaaaccccacccctacaaaaatacaaaaattagccaggcacgatggtgggcgcctgtaatcccagctactcaggaggctgaggcaggagaatcacttgaaccccggtggcaaaggttgcagtcagctgagatcacgccattgcactccagcctgggtaacagagcaagactccgtctcaaaataaataaataaacaagcaaacaaacaggcagtctaacagagcagctgggcatggttatgggttgaactgtagccctcaaaaaaagatatgtcaaaatcctggccaggcacggtggctcacgcctgtaatcccagcactttgggaggccgaggcaggtggatcacaaggtcaggagatcgagaccatcctggctaacatggtgaaaccccatctctactaaaaatacaaaaaattagccaggcgtggcagcatgcgcctgtattcccagcttctggggaggctgaggcaggagaatggcgtgaacccgggaggcggagcttgcagtaagccaagatcacgccactgtactccagcctgggtgacagagtgagactccgtctcaaaaaaaaaagatatgtcaaaaccttaatccctggtacctgtgaatgtgagcttctttggaaacagggtctttgcagatataatcaagttaagaagaggtcatactgaattaggctgggccctacagccaatagctgataaccttataagagaaagggggagatgtggaaacagacacacagacacacatggagaatgcagccatgtgataatgtcagagattggaatgataatgtgacaagccaaggattgcctggagccaccaaaagctggaagaggcaagaaaagaattttccctagggccctcagagggagtgtggccctgttgacaccttgattacagacttctagcctccagttctgtgaaagaataaacttctgttgtcttaagtcaccagattgaggtaccttgttaccgggaggaaactaacaaagacatgaattaaatgtcttggaaatcatcaatgctttgggacattcagagaagatgggatcattcatgaaccaggaggcaatcctagagaaaagctgaagtcatgagacacaaccatgattgggactgtggatataagactagtgtctaaggagaaaggggaaaaaaggggaggcactcaaccctccaaggtcaacaatgttctgatgactgagggtcttggttcaatcccagcctgaaaggatccattaatagcgctaatccttccattgagatttaatcactgggctcctctgtggcccccactggctttctcatctttgttcactctgacagagcccacatattctttattcttcccaaggtccttgttgttaagaggaacactttgtgattaatctccatgtgtaaagtggattacaaaacgagaaaatatgactttggggggcttaagtgtccactagtcacacccattcaaagatgaaggtgtatattcattaatgtgatttttctgattatacaagtaactactactcatcacaaaatctttcaaagttagagaaaatcatacagaagaaaataagttgcttttatacaggaagagaaaaaaattgttttaatttattttaaaaaaaatttttaataaaagaaaataacaaccacccttaatctcaacactaaagaatatttataatgggtattctggcacactttatgtaatgaaaagaggtatttgtaatttaaaaaaaaaaaaaaactgtgatggaatcttccagaagaattacccaggtagaaggaaaaaaaaatgttaaaaagaaaccagaggccaggctcagtggctcacacctgtaatctcagcactttgggaggtccaggcaggcagatcacgaggtcaggagttcgagaccagcctggccaacatggcgaaaccccatgtctactaaaaatacaaaaatgagccaggcatggtggcgcatgcctgtaatcccagctactcaggaggctgaggaaggagaatcgcttgaaaccaggaggtggaggttgcagtgagatgagatcgcaccattgcactccagcctgggtgacagagcaagactccatctcaaaaaaaaaagaaagaaagaaagaaagaaagaaagaaaccagagcatgcctgagaaaaatggagaagggtgggcccatgtaatcaaaggctattaaccattttaacactgctagaggtcagaaatattttattcatggcaaaggaaaaaattcaaggatatgcatgtcacagcatctacagtgggagtaaaaactattaaacctgactctcctctgctccagaattccacgaagtaacttgttgaagcttgaaaaaccttgagttttcaagtttttcccaaattaaagttctctagcaaccataatgcagcaaccaagaccatatcttatacccttgaaacaactttccccaaagccctgttactactgtctcagctgtctcagctgcagggctgtgccccaaaatagtgggggggggctggctcctatgttgtaataaagataaggtccaggcattccagcttactagttgctagttgctaggaggctcataaattcacttttcctgacttggatgagattcagaactgctgtatcacaggctgagaagacatggatcactacaattaaaattcagtctgtccaaaaggaacaattttagcccttcccactctaataagctacattaactggtcctgttttaaagaatgggcagttaactgggatctctaaagtctttgtcatgaagactgcaggttcctcatgctaaccggcaacttttagaaacaaagtatatctggttttgagcccatcttccaagaaagagactgtcatttgtgtattcttacttgaagtccactgaaattgtggcaacagactcccacaaacttttaagataatttgaattgtttgatacaattggtgaggtttcacagggccaaggttgcaggcagatccaaccctcaaaattaaagcaattagctgtccgtcagcagggggaaaaaaggaaaaaaactacagggtgaggattttcaatctacttttaaggaattcgattgctaaattgtttagttaactaagaaccacagttacaaggttttaatttttataattacaatgaaatgttaaagttcaattgatataattgtggcactgaaattgtaacttctaatcacagagatttcaagatgagataattatttgaacattcacacatcttttctaaaatgtcatggtagaccatgcaccacacttggaacgttttctgaaaatattttcaatgctcgataaactgcttaagaggagtaattttgtaataatcacccagcaatatattaaccataacagatttgagggttaaggatgagctttgcatgacacagttattagcaatatccagaagacattaattgaaagaacttgctcaagcacacaaaagcccaaaacacctgaaattattatctagctttaaagaactttctactgtataaaaggaagatacactttcttaatttaattccagctaaaataataaccaaaagctgatgcctcaagatagctcagttccaaatatctagaaagtacaagattctttcctaagacatttcaacatgtgatctcgaatagtatttgttatttgtgtcttttttttttttttttttttttttgctgagagagtcccgctgtgtcacccaggctggagtacagtggcgagatctcagctcactgcaacctccgcctcctgggttcaagcaattctcatgtgcctcagtctcctcagtagctgagattacaggtgtgtgccaccacacccagccaatttttgtatttttagtagggacgggtttcgccatgttggccaggctggtctcgaactcctgacctcaagtgatctgaccacctcagcctctcaaagtgttgggattacaggcgtgacccaccgtgccaggccatctgtgtcttttaaatgtggggtttctcaaccttaaccttttgttgttgtttttttttttttttgagacgagagcctcgttctgtcactcaggctggagtgcaatggcacaatctcagctcactgcaaactctgctcctgggctcaaacaatcctcctgcctcagcctcccaagtagctgggactacaggcatgcaccaccatgcccagctaatttttgtatttttttctagagatgggtcttcaccatgttggccaggctggtctcgaactcctggccacaagcgatccacccacctcagcctccccaagtgccagcattgcaggcatgagccaccgtgccaggccaagctgaacattattgactatggacctgatcactgtcctggtgggctgttctatgcactggaggatgttcagcagcatcattggcctttacccactagatgccactagaacctctctagccatgacaaccaaaaatatctccagacattgccaaatgtttggaggcaaggctgcccccagttgagagcctctgtattaataaaacacaacaaaaactaccacccagcaaaagtttaacacccaaaagctgataccaaaggtagttcacttccaaatctcattgcaaatatttccttcaagaagctctgataaataaaataactgagtgattcagagtttttttaagtaaacaaagttttgctttttttaagtgtgaaattggtgttttaaaacaaaatgtttcctgtgttccttttcttgatctataacttaattagtcatgccagaagtgtagaaaaggaaatgtaaattagcataccacctacatatgtagtgaaaagtattggcagaatcatgactaagtaaacattttttattgactttcagcttttaaaaataaatatgcatagggcatcatcaagaaaattaaatgacaacgcacagaatggagaaaatgtttgcaaatcatatatttgataagggacttataactagaatagataaagaattcttacaacttattaataaaaaaaaattaaaaatgagcaacacgtctgaagatacatttcttcaaagaaaatatacgattagcctacaagcacatgaaacgatgttctgttcaatgacattatttattggagaaatgcatatcaaaaccatgaggagatacagccgctcatccaataggatggctataatcaaaaagacagacaataacaagtgttgacaaagatgtgggaaaattggactctttatgcactgctggtgggatgtaaaatggtgcacccactttgggaaataatctggtagttcctcaatacgttaaacatagaattacgtatgacgtagcaactccattcttaggtttacatccaaaagaatatttttttaaaaggccgggcgtggtggctcacgcctgtaatctcagcactttgggaggccaaggcaggcaggtggcctgaggtcaggagttcgagaccagcctggccaacatggtgaaactctgtctctactaaaaacacaaaaattagccaggcatggtggcatgcatctgtggtctcagctactcaggaggcagaggcaggaaaattgcttgaacctgggaggtggaggctacagtgagccgaaatcgtgcctctgcactccagcctgggcgacagagagagattccgtctcaaaagaaaaaaaaaaagaatttaaaaaaaaaagatattcaaacaaatacttgtgccatattcattcataacagtaactacacacaaaggccaaaaggtggaaataacccaatgtctatcaactgatacatggataaacaaaatgtagtatacccatacaatggaatattattcagccagaaaaaggagtaaaatactgatacacgtcacactacagatgaaccttgaaaacatgatgctaaatgaaagaagccggtcacaaaagaccacatattataggattctatttctcggtaatgtccagactaagcaaatccatggtgacagaaagtagattagtggtagccaagtgctgggaggaagggtagagaaaggaagtgactgtgaatgggtacagggtttcttttggggtgatgaaagtgtcctaaaatcgactgtggtgatggttgtacaactctgtaaatttatcaaaaaccactgaaatgtctactttaaaaagaggtggaagtatatcttaataatactgtcataaaaataaaaacaatctatagagaaaacctagaagacttaatcatgattacagaaatacaatgtaccaacacaacattaccactcctgactgctgacggagctgggggtagagccaggaagaaagttaaggagaaaaagagaagatcaggacatccatttctaatttcacaagggcagggagggattaaaagtcactgtcattggttgatgtaactaaattaaaggtctatgtcagtaatataaagactgaagaataatcaattcaagaaccataaggccaggcgcagtggctcacgcctgtaatcccagcactttgggaggcttggaggagagtggatcatgaggtcaggagttcaagaccagcctggccaagatggtgaaacctagtctctactaaaaatacaaaaaaaattagccaggcacagtggcaggtgcctgtaatcccagccacttgggaggctgaggcaagagaatcgcttgaacctgggaggcagaggttgcagtgagccaagatcatgccactgcactccagcctgggcaacagagtgagactccatctcaaaacaaaaacaaaaacaagaataaaagaaaaaagaaaaagaaccacggctggacgtggtggctcacacctgtaatcccagctacttgggaggttgagacaggagaactgcttgaacctgggaggtggagagattgcaccaagccgcgatcatgccattgcactccagcctggggaacagagcgaggctctgtctcaaaaaagaaaaaaagaaaagaaaaagaaagaaagaaaaagaaccattaaaaaaaatgccatggctcacacctgtaatccagaactttgggaggctgaggcaggaggatcgcttgagtccaggagttcaagaccagcctgagcactatagtagaacccctatctctatagcaaaaaattaaaaaattagccggccatactggcatgcacctgtagtcccagctactccaaaggctgaggcaggaggatcgcttgagcctgggtgcttgaggctgcagtgagccgtgactgcactacagtctaggcagcagagcgagaccctatctcaaagaaaagaaaaaaagaaccataagtataattatcaaaaaatgtggagaatgaaggaagtaggtgagatgcaattgccactcattataacaggaagctgagaattaaatcatatattcatactatttagagatataaagataatcactagaagcactaaaaacaaaaatgaacaaatgtaattgtttccagagaatatcaggctggatgggaataaaacaggaccggggcagaagactgttacaatacttttcaagagaagcgcatctgttctgagtctcttaatgctatatggaatttttactctgcactactttttttttttttttttttttttttttgagacggaggctcactctgtcacccaggctggagtgcagtggcgtgatctcggctcactgcaacctccacctcccaggttcaagcaattctcctgcctcagcctcctgagtagctgggattacaggtgtgcgccaccacacccagctaatttttgtatttttagtagagacagcacccagcctgcacattatttttacaatcaaatcgaactttgcattacttgagtcgaagtatctgcatgaaataaaaatataatttatgtcagaaaaaatattaaactagatcattactactgagtaaaattgtgaattaagtgtgatttaagcaaaaccaactcaagtttgatagacaaaaactgcgtccctactacaaaggtagctgagagatgtaggctggatccttaacaagaaacctccgccaggcgcggtggctcacacctgtaatcccagcactttgggaggccggggcaggcagatcacctgaggtcaggagttcgagaccagcctggtcaacatggtgaaaccctgcctctcctaaaaatacagaaattagccaggcatggtggtaggcgcctgtacagctactagggaggctgaggcacaagaattgcttgaacctgggagatggaggttgcagtgagccgagattgtgccactgcactccagcctgggtgacaagagtaagactctatctccaaaaagaaaaaaagagagagaataagaaacctgttgaaagtccctaccacaccacatgtagggcagacagtaagaatcatcataaaaaggtcaaaactctgccatggcaagaatgagcatccaaataccttaataactctggaatccaaagaaaatttcaggtgaaaggaagtgcacgtggcaccgccttcatctctccaccaacaagcacagccgaccccagttagaacacactttgaaaccaaaaggcagatgctgctaaccactagaacaaagcagaatctgccatcagaacagtactagatagagttatttaaaacatactcagagttacagctgggacacttgggacacaggattctgagagaccaaagtgggtcatttttgagcatgtcaggtggtagaattaataatgacaccaggcaacaggcatgaggaggagtgtcctggggtaccccacggagcttggggccttagcagtgtggagatgcaccctgtggttatcagtacccaggtagcccatattatgctaaagaacttgccctccaaattatcactttccaaagatatcctgtgtcctgtgaggagatggagatgcacattctgcaagaaggaaagaacttacactttactccagttggttgggtgagggtcctgttaagtttcaaacaaaacaaaacccacagaaggtcatggcaagaataaaccccgtggttctgagcctctgaaaacactgcccaaagagtgagtgggaacgagctcatgagaccctcctggactttcctgcaagaaattatcatttgcctggaatgcggccacccagcccaggtgatggccaaaagagggttgggttgatagagatcttgccccaggatctgaagaagccctggaaggtgaggcctggggctgcaatctttcccaacagacaatggaggcctccaacaaggctcagaggagaggttttgcaggtcagaccctcacccctacctcaaggcccctcaacaagcagacgtcactattgtcccgatcccaccttccctcctgagcaagcaatgggtagcaaatcctgttcaccccatttccatggtcctgacatctccccttcccctagcgaagaggattccaagacccactcctcatcgtgacctccccctgcccccagatgacgcggtggctttctggggctcattattacccctgcagagtgggcagaggaaaccaagagcaggaactaggattgatggattgacctatgtttacaaggttagcagctctcaggcaaggtgggagggacagtggaagggaggcaggagaacgctcctttggaaacaggctttgcaaagccaggattttttggcaggatatcctgtcttcctcatggtcacagagaagcgtgttttgggtctttaaggaaaagcaactgaatcctcatagcccaatctccaatcagtttctccacccattccaagcttggacactcagccccactgcctcccaattatatctttttcccagcacaactgcattagagtcctttgctctttaataaaatcatactctagcggggcagaagctggaataaataatacaggtgttattttcttaaaaccaaagacacttccccctccctttcatctttctttcatgaattcaaagtggtcccaaacagaaaacatccatattatacttcagttttgctaggttccaaaaggctaggatgcccccactccaactacacccaagtcttcctttaaggaaagaaatacttggtgacaggaccaagcctcaaagggccctgggcccattctgaaactgagattgtgctcagctgaaagaaacttcctcccacagagttcttcgatgaatcatcactctttgtttaacatcctctgaaagcagacaattgatcggctctcagatcatgcctgcgtagtacccccaccccctccacctctgcaatcctttcagtgagctgagaccccactccagggctccgtggtaggatgcagtctcccagctctgcctcagcccagagggagaagaacctcttcacctagtgaaagagcttcaaggtcttctagaagaatctcacacacgcactggaggaatctctgcggcttcccatgcccacagtctaggcccttatgaatttcttaatgaggtccctggagaccacaggaacagggaaggtcttatgctggagggtgtggaggacggtgccagaggctgggaagggaatggaaggggaaaactccacctaactattaatatcgtgtacccttttacactagaacattgttttattttaaaaaacactctgttccttgctgagtactgctttatttctgaatgtctcttttattatttttttaataaatgatttggcctacaatgatgatgagagagaatttgttctttttttttttttttacacaggagttatagcttatataaaatggagtacttagagatgaaaagacctgaagtttggaattgggaaaaacagaaacgtttactagagccctgctaatctgatttttctggtccagaattgagggaaaaacaaaaggagagttacccttagaaacataccttctacctgtttgcttaatttagaaagaaaatgtacatgtaaatatacatgtgtgtatataacatacacacacacatccccagtgaaagtgtgtttttgatacagaagaccaaatgactggagatcgtaaaacgaggctctttcttaaccacgagcctgagtccgtggtgttcagcactttcatgagaatctgtaacctggcccagaggaacagaattttcttcctggcttctcactcccactcctctgccctcctcaagcagacagaagccccctctcccggcacagatttctaggcaaggctttgatgtggttcccatgctctcacctgccttcctcatttggaaaaaccagaggcttctactgcacatctatgaaagtgttgtctcacaaaacgtgtttctcctttagacagtatgatccttgcagaaatcgcagaagtgttaatacatgcacctagtaggccctcagcaaactctcccaaggaattcctgctcagggctccagggtttcagtcggcacactagaactgcaggaatctggggggaaggagacaggcccaacgctgcttttcctttctggtttagagggggaggggagaagagaggagcaaggagaaagaactgcaaagggaaaggagaggaagtctttgtccgggctctttggacgagcattagagtggagttaaattgtcagctaatgagatttcctaaccacgtgctcccttttaagtctaggcccccaactgatttgatccccacacaacagcaggggggaaagaggccttcagcatccctaagggcgcgagaattcccagaacaagtacaagaaggatgagaatcatttctgagagttcaactttaaataggttatcatatttattaattgacatctagcaacaatgctactggccgcgttccacatcaacagccgaataggggttcacgggagtcagattccactcggggtaactgaggcaggcccaggggaacggaagagacagagcgcaatcctgagggcttctccaaccactggacagcctacaagtcgagtttatgtttgtttgtttgcctgttttggctggcaaaggcccctggggcctacattcaaagaatgtgttgttggacccaataatttattccaacaggcaaaagggtgttaaaacaggaagtttttttttttcaataaaatctttgtcgttaagcctgagatcatctgatctgattatggactgttattattttgtgttgtttatttctatatgaaactgatttctctttttgcctaaagaaaagtagcagtgcagagctagtggaggaaaaacaactcaaaacacattcacaacattttgaagatattcaatgaaattgattctcttctaccttccctgcttagtcaacagcctcttccttaagttttatttctcctctattcaaagataattacttagcaacgtcggtgtttaccacgcaaaggcatccaccctccctagcccagctttttaccttgagatacaaaaaagcatatgctggaaaccaacaatttaccaaacttcttcagctacaaggcatagcttaaatttcatctctcctagaaagtgttccctcctaacctccagacatctctttgttcaaacctccctccttcctggacttaatcactttccacagcagtccttggttcactggcaactgctttccacctggaagggtttttccttctccaaacccaggtctgggtcccagcagaatcttgaagaagaaagaagaaacaactaaaacctaatggaaattcaaacacatttttaaaagggctgcaagcgattagataaatctaattaaacctaaggccaagtaaaacaagtcctgtttgaagctgagaacagcagtccttcatgccttttataataaaaagaaattggggctgggggagtgaagaacgcagaaaaggaaagcgacaaggggccatcctctattacagatttcctctaacacagaatcaacaggactctaatatttcatacgtggctgtcactgtgctttgaggttaatctatatggtcgtttaagccccgcccccctagaggttattccttatccccactttacagatgcgcaaactgagacacaggaagatagaatagctcggccgggatcacccagcttgtgagtgacaccgagcaggtactggaacccgggtttgtttgacctcagcgcacaggctctaaacctctgctccaactcaaagtatgcgccaagtcagcgtgcatgggtaacccgatccggacggctctgactcgggatgcggcacagctgccctgcggggccgcgcgggtgtcaccgaggcgggcacagactgcacagtgtccccaagggctcgcgcacgtccttcaagacctgccagcgcgcgggaaaaggcaggctccgagtcaaccagggctgacccgggggcaagaccaggagacgcgacgactggaaccgggtgagtgtggccgagtcggcgccccgagggccgccagcctggaccccaggctgggacacgggcgcccccgggtgcaggggacctagaggcgccgtgcgcggcgggggctgggcgcgaaggcgccgagacggcatctttcccctgcagcatcccgccccgcggccggggggagggggcgtcacctgacagcgcgcaacaacttctccaggtttcgagggggcaagcggcagccgccggggctggggggcgcacggcgcgctgctctcgcccaatggcgaggtctgtaaacaaaagcgggccccacgcgggtccccagccgggtggcgaggggcgcggcgcagcagcatcgcagcggcagagctggtgagagggcgaggcggggacgggatagggcgcggggacccagggcacagtccccgggacccgaccgcccggatgaggcattgtctgcgcacccgcaggattccgcttttaatgcccccctccgggggttcgtcgcgggtccccagctccgtgcgccggcccccgggctttccgcccggtgagcccggccccgagggcggcacggatcgccaaggtgagcgcccaggacgcgtcgccgaaaagccaggcccggaggtgcctaagtcagggaccgagacgcaaacatagacacaaggatgcacaagcacgccctccccgaagttgacaaaaatcagccgataaaatacaaagtgccgcggccgccgcaggtcagcgctgacctcctgctgccgagaggaccgaatgccgacgtccggacgctgtcatttccatccagcgaaggcacctgggctgcacggtctcgtctccctccttcgcgcgagggatgcctcctcctgcctctcctccccgcatctccccacctcccaagtgtgtgaacacgaaaacaatacgtggaaagcccgatcggggggagctaggacccgccgggagccccagtgtgcgggagacgggggtcagaacgtgcccggcacgggcaccgaggctccgggcatcctcgccgccgtctcccggggcggctccggccggacgcccgcgcaccccaggcccgcggtactcacccgcgacggtcgtccgggatctccgcgacggggccgggcacgatgcggggcagccgtgcccctggggctgcgggcgccaaggcgtccgcggagctgcagagctgcgcgcccgacggcggcggcgctgctctgccggccgcgctcgaacccgctcgtggtctgccaatcggagctgtcagggcccctccgcctgcggcctcgggggccgggccgcgggagcccgtgggaaaccgagctccgattgggccgcctgacaatcgctccgcctccggccagccaatccgaggcggtggatgcaggagcggggcgttcggagttgggctgtagagcgactatgggcgcacgccgggtatccgcgccgcagccaggctcggagcgcgcggctggaggggcgcgggcggcgcgcgctccagagatgccttcctgcgaggctccgtcagcgcggcccggggagatcgcccgcaggcagcggaggcgcggcgggccgggggacgaccagggagcccctaacaaagcagctttgggagggccggaggcctctgcctccctcggcgataggtccgcgaagctgcctgtcatctcgcataggtggaggtggccaatggcgtgcacagacggagctctagttggcgcgcgcgcgcggctcggcatcggtgggattggtcggaggtaaaggattttcctgccacctaaggcggagaggaagggggatcgaaacgggggaggcgaagagtcaaaaaatgttgtgcctgggacaagtggtctggcgcgggaggcgtgtgcctggctctagggggagacaggaacttttttacgagagaaaaaaatcctaacgcaatcccttcccgtggatgctagaggatgttagaccctgagcagcctccaggtagggcatggtggccttcaccagagtccaggactcccagggttcacttaccgtgcccagcaagcgaacttggaataacagcgtggggtttgggccttacgcttacctgctgggcagagtaagtgactcgggcagggttcacgcagacctcctgggctcctctgtaaaatccggaaactacagttgcagtttacctctcgcaaggttgtggagaacgcggaaacggagacgctggcggtacagcctcgagcgaaacctttccctacacgaggccggagcttcctcctctcctgaagagctctagacttccccatttacaacaaaggctgggatgtatgttccttacaccttgattccatacacacgtgttcgccccgggagctgggaaggtctgcgctcccggggtgatcttgttgaaaacaaaaagaattgcccacgctgtggaagataaacctaaaccggaaaattgaaagtcatccctgattcctccttcttcttaaccctctcccatccatttttgttaacctcccaaacccattcctcccatcctgtctcacctggacctcagtaaagggctcccatcgtccttctgtcccaggccttgccccctgaaatctgttctccactttgcagaatgatccttctaagcagaaaaatctcattttgcgctcccaactctgggtctcttttctttccccagaacacgtcaacccccagcccctcccttcacttcactaattcctacccttcttcagatcccagcttggccgccaaggcatccatgcagtaggcattgctgaactactgctcttacagaccccgggaagcctcctgtaccctgtcaaggttagatgccacatttccacttccagtgcttccaccccctgtgctcccctcacaggcctgtatgacacggggctgaagttgcctgttgcactgcagccttccatggaagccggaatcttatctatcttccctgctggatcccagtcctagcacagtgtttggcacatttggggcactgaaaaaacatggaatccatgaattatagaggagctataattataggcaagagctttaaggatttgaagtgcttctaaaacatcagtttgagaagaatgggtagcatggtagctcttgaacggatgcgtccaccaggttccatgatcagtattacagggaggtttttgagtcaagtttgagagattttccaaagacaccccttccaaaaccagcctcgtttcagccaacagcttggaatggagaataattcccttgagaagcttttcatcccaggacaaagagccatttctttacctgttacaagccaccatctaggggaaatacatatatttgaaaatgagtagagggtttttccctaaggaagtttagaagtacatctggccatccttaaaagaacagaccctggagtgaggctgcctaatttcaggcccggttcctttctagctgttacctagggcaagttacttcaggcctccgtgcctcggtttccccatttatataaatgagataacaatagtgcttcataccacatacagttggtacgaggatgaatgagttaatattaacaatgtgctggccaggcgcggtggctcactcctgtaatcctagcactttgggaggccaagatgggcagattgcctgagctcaggagtttgagaccagcctgggcaacacggtgaaaccccgtctctactaaaaatacaaaaaattagccgggcatggcggtgtactcctgtggtcccagctactcaggaggctgagggcaggagaattgcttgaacccagaaggcagtggttgcagtaagccgagattgcgccactgcactccagcctgggcaacagaacgagactccgtctccaaaaaaaaaataaataaaaaacaacaatttaaaaaaaaaatgtgtttagaagagtacctggcacatagtagcatttaataatgtttactgaataaataaacagcttccactggacatgtgtgtgatgggtagggagtcctcatgagtgagtggcgggttactagaggcttccctgaaggtgagtaatgggatctctcttccctgcctcatctgagggctgctgccttagggtctcctgttaaggaggtgacattattgtaaggagaacctcagatgaatcatcacagcagccatctgattgccttgtgcctaagacgtctgaaaagcactttgagatgcagaatcctggcggtaggttggctgggttgaatctcagctctaccacctaccagctctgtagccttgagaaggttacttaatctttcttaagcctcagtttattgatctctgaaataagggtagtaacacctaacccgtaaggatacggagacagttaaaaagaggtcacgcgtagcatatggtacaaactcatcaaagttggtgatcgggttcagctaagttagtgaaaaacaggataataacattccattaaatggttgaaaaacctggatgaggccgggtgtggtggctcacccctgtaatctcagcactttttgaggccaaggcatgtggatcacttgaggccaggagttagagataagcctggccaacatggtgaaatcccttctctactaaaaatacaaaaattagccaggcgtgatggtgcatacctgtaatcccagctactcgggaggctggaggcagcagatgcagtgagccgagatccagccacggcactccaacctgggcaacagagtgagactgtctcaaaaaaaaaaaaaagaaagaaagaaaaacctggatgagacaatgcaggagaaatactcactgcccataggggagatagatacatagggaaccactgtttgggccctttctctcattcactttctccctgaaccccacttacttcaacatgtcagtactttggctctcagaatctgctcacagctgactgtgggaggctttgttcccacaatcatggtgctgggttctgccactgaagttgacagaattaagccaatccagcctttgggtacctttatttttattgtatttatttatttatttatttattttttgagacggagtcttaccctgtcgcccaggctggagtgcaatggcacaatctcagctcaccacaacctccacctcccgagttcaagcaattctcctgcctcagcctcccgagtagctggtattacaggcgcgtgccaccaggcctggctaattttttgtatctttagtagagacggggtttcaccatgttggccaggctggtctcgaactcctgaccttgtgatctgcccaccttggcctcccagagtgctgggattacaggtgtgagccaccgcacctggcctgggtatctttcttgacctcgcaaacctaaaaagctactgcaggcttcagtgctgtttcttgtctccgccctacacggtacatcgctacttcacactggcaaagagaatggggcattttgattaaaatacagacaaatgccatctggccgagtattctgacatcttatctcctgagggcactgttgacatctaaagagaacatggaattggcattaaaggaaaaaatggggtggtcaaaggcagaatcaaggtttagggcaggagaatgagcacaagttacatttctagtacatgaccctagctgcaactaagagtcaacattttcttccccactggttattgaaaggctgactaaacaatcgtagctgagttacaacaaatggtcttccccagtacgaagatacctacacatgcgctctgggcagccctgcctcacttgtgttcctgagctggtctttctctctaacagatgctccctcagggttagactttggcctgtttaattcactgctctattcataaagtgtctcgaacagtgccaagcacatagtatgtgctcaataaatatctattggatgaatgaagtttagccttccgcactctacgaggagtttggcactgaattattttcttttctgtcatctatttgtggatgccctctttaaagaaaggacaggaggcagcttatacaaaaatagatcttgggctaggcgtggtggctcacacctgtaatcccagcactttgggaggccgaggcagatggatcacctgaggtcaggagttcgagaccagcctggccaacaaggcaaaactccatctctactaaaaatacaaaagtcagccaggcgtggtggcaggtgcctgtattcccagcttcttgggggtctgaggcaggagaatcacttgaacctgggaggcggaggttgcagtgagccatgatcacaccactgcactccagcctggcaacaaagcaagactgcatctctatatatatatatttttttatatgcatatatatatttttatatatgcatatatatttttatatatgcatatatatatttttatatatataaatatatatatgcatgccaggcatggtggcttatgcctgtaatcccagcactttgggaggctgaggtgggtggatcacctgaggtcaggagttcaagaccagcctggccaacgtggtgaaaccccatctctcttaaaaatacaaaaaaaaagtagccaggcgtggtggcgggtgcctgtaatcccagctactcggaaggctaaggcaggagaatcgcttgaacccaggaggcggagcttgcagtgagccgagagagcgccactgcactccagtctgggcaatggagtaacataacactgtctcaaaaaaaaaaaaaaaaaaaaatacacaggcagccaaattaaccttccttcggagggtcttgtgatgcctggcaacgtcttttccctgggtaaagaaccttgtcgcgagttcctcagattgttgatgtgctgattaatgcataccccactgacactgaaaagtatgctgacttctttctgagtcataaactttcactgactgtctttcaggggtacattttagccggtatgttgcagtctgtagccagttcttacaacctctgtattgcaccctctaatgaaaaaggacaaccccagtataaggagtctccctcccttctcccaaacaccttgtaacagactccagaacactcccaactttgttgatgtgacttcccccatcatcagtcttcacatttggcttccaagaagcctttatcaaattatttcagtcttaattttggttgacattttatatatatatatatacgtacgtgtatgtcttctgttggttctgtttttttttttttttttttggagaaccctaatgcacatcccaatagtttttcccataaccattcaatattcctctgcagacttgctacccaaagtgtagtctgcggatcagcagcagtggcatcgcctggtgtcagaaacacaatcccagacaccaagccagacacttaactcaaatctacgtcttaacactcaggtgatatatctgtgtataaagtttgagaagtacctcataacttctttggggtttatttatttatttatttatattgaaacagggtcttgctctgccacccaggctagagtacaatggtggaactcgactcactgcaacttctgcctcccggattcaagcggttctcctgcctcagcctctcaagtagctgggattccaggcgcatgccaccatgcccagctaattttttgtacttttagtagagacgaggtttcaccatgtggcccaggctggtcttgaactcctgagctcagctgatccgcccgcctcagcctcccaaagtgctaggattactggtgtgagccaccgtgcccagacactttggggttttttgtttgtttgtttttgtttttgagacaaggtctcactctgttgcccaggctggagtacagtggcgtgatctcagctcactgcaacctccacctcctgggttcaagcgattctcctgcctcagcctcccaagtagcagcgactacaggcacgcgccatcatgcccggataatttttttgtattttttttggtagggatagcgtttcactgtgttggccaggctggtctcaaactcgtggcctcaagtgatctgcccacctcggccccccaaagtgctgggattacaggcattagccaccgcaccaggccacgtcatcacttctttgaaaatgcaaaaccacctgggaagaataacaatattaaaaacaactgcttggtaaaggaatttgtttaatcaaggctttcttacctgaggacagatttttgggagtcgggtgaaaggacctagaaaagaaatcaagaagtcaggatattttcccagcaatgataggtcttcaattataaagaagagagcaaggaagcctcaatatgcaaactagcatatccaactaatacagataaactcaaggtcagagaggcaggactgggcaaatcaggccacactacattcacagagctaagcagtgccccctctttgtaatttgctttattgcattttattttctgtgttttcactgaaatggcagtttatggagaaactctcccacttggctgtgaacaggctctaagcaacagcaacacttctgcagaattggcagggacagtgctatggaatatttcacaaacttcaaggcaaagggacaaacaaacaaccaaaaaaaaaaaaaaaaaacaccctcaaaatgtattttcagaggaaagaactttcactgggaagggacccatggatctccaaaagaaaaccaatttggtttcatttttttctgcttctgcactccagcctgatgattaattcatcagcatgggacagaacaaaagctcctcttaaactgtaactactacatggggtgggtttctatgatgatgttgcagatcttggcctaatgggctttctcttcactgacacacaaggttcaatattcctgccccacccaccatgaggtgagagttgaagctgccccctttcccacctcctccagcgcccggacaaggcacgatgcagggacacgcagggcacgtgcctgcaactccacctgcctcaaaccatgtgtttactctctatcctgtagaagtgtcatcgctcccccagcctaacagaatgacatggaaaaggctggaatgtagccacactgcctcagcaaaacaatccctaggcttagagacgctgctgtccacaggcaagcaaactgggacagtggagccacagaaatgtgcctctcttcttgggggtagggtgacagcttcagtttctatctatatggagttattgccctttctctgtctctctctctctctcccccacctctctccttctctccctctccctaaagaggcagtagttaaaggcaaagagcctggtgattaaaaagcagactctgccctaaatcagacctttcttctgtcccttaccagctgtgtgaccttggcaagttagttaacatctctgtgcttcattgccctcatctgtaaaatgaggcttataggccgggcacggtggctcacgcctgtaatcccagtactttgggaggccgaggcgggcagatcacaaggtcaggagatcgagaccatcctggctaccatggtgaaaccccatctctactaaaaatacataaaaaaaaaaaattagctgggcgtggtggtgggctcctgtagtcccagctactcgggaggttgaggcaggagaatggcgtgaacccaggaggcagcgcttgcagtgagccaggatcacgctcactgcactccagcctgggagacagagcgagactccgtttcaaaaaaaaaaaaatgaggcttataatagtagtgtacttctgatagggatgttatagggatggaatgagttgatgcagtaaagaacttagtacctggcctgtgttagagacactatggatccctggctcatctacaaaaagccagactcactatccaaaggcatagtaaggccaggtgtagtggcctcccaaatcctagcactttgggaggccaaggtgggcaggtcacttgaggtcaggagcttgagaccagcctgaccaacatagtgaaacctcatctctacaaaaaatacaaaaattagcagggcatggtgatggacacttgtggtcctggctactcaggaggctgaggcaggagaatcgcttgaacctgggaggcagaggttgcagtgagccgagattgcaccactgcactccagcctgggcgacagagtaagactcagtctcaaaaaaataaaataaatgcgtactaggttcctctctctagagcccccaaaagtctcctgaaatcaacctgtccataatctcatcatattcaccccaccccattccccaaacaagaataaacaaatcccactgatctcttcttccatttttcagacaggcagttcttagccttaccatctaatggaggtactgcccaggctggaagaatgggaggcagctttgacttaacctccccctttacctttcatctgataaatgctgaagcagtttctggatctctcttcagaatgactctggaccccatttctccacaggcctctgctgctccctgagcctcctttattttagattttagatttaggacagggtctcgctctgtcacccaggctggagtgtggtggcacgatcacggctcactgcagccttaacttcccaggttcaagtgatcctcccgcctcaacctcctgagtagctgggactacaggcaggagctaccaagcctggccaattttttaatttttttgtagaaagggaggtcacattaggctccccaggctggtcttgaactcctgtgctcaagcagtcctcccacctccatctcccaaagtgctgggatgacaggtgtgacacaccgcgccccgagccttctttagaaggtacagaatgtgcactgattagagatgtgtggtgatttaacaaacatttaaaactgcctgttttgtgcaatgtaacagaccggggctgaaggaaaggagaaatacagagacacactacagacacacatagtgatagaggagggtcagcagggaaagcaagaaccaacatactgccaggccaggcagctcagcgctgtgcaggggctgatgtggtgagcacttgcttcagtttcccacatcagcaatgtcctcccgatgatggtgcccaacagcagggtccttagatagtaaggctaagaactgcctgcctgggaaaccaaagaagagatcagtgggatttgtttgtt

SEQ ID NO: 560 - DNA, 43602 bp, Homo sapiens
ggctggagttgaagcagctgggacacagggcaccatgtcccgaggttgcatagagcaggggggccctgggctgtgcccagaaaaccatccttcctttccaggcctcagagcctgtgatgggaggggctgccacgaaggtctccgacatgccctggagacattttctccattgtcttggtgattaatacttggttcctcattacttaagcaaattcctgcagccagcttgaatttctccccagaaaatgggttttcctttctgtcacattgtccggctgcaaatttttcaaacttttatgctctgcttcctcttgaatgctttgcagcttagaaatttcctctgccagatactctaaatcacctctctcaagttcaaagttccacagatctctagagcaaggccaaaatgctgccagtctctttgcatagcaagagtgacctttactccaggtcccaatgagttcctcatctccatctgagaccacctcagtcgggactttattttccatatcactatccgcattttgatcaaagccattcaacaagtctctaggaaattccaaacttttccacattttcctgtcttctgagccctccaaactgttccaacctctacctgttacccagttccaaagtaacttccacattttcatgtatctttacagtagcaccccactctctgtggtaccagtttactgtattagtccattctcatgctgctataaagaactgcccgagactaggtaatttatagaggaaagaggtttaactggctcacagttctgcagggctggggaggcattgggaaacttacaatggtggcaggggaagcaaacgtgtccttcttcacatggcagcagcaagaagtgcagaatgaagggggaaaagttctttatgaaacctcagatctcatgagaactcactcagtatcagaacagcatgggagaaccacccccatgatctaatcacttcccacgagatcccaccccagactacaagatgagatttgggtggggacacagagccaaaccatatcaattgctgtctcattgttttctgtgggggaatgaaagctggtatctcatacactgccatatggccaatgtcacttctatagaattttcaataatgaaacaaaaagctacagggctagcacctcatacagattatacagtctgtcccacttggtaataatgtaaaaaataccacttatcttaatcatctatcttgtaaacctacagactttcatctttctttactccttttagagtctcttacgtctttgttttctgtgaagtaagatcctatcgggcagggactgtggtttctacaagtggtaattaaaaattattaaataccttgaaaatgtcataatctgtgacccgtggttggtgttttgtttaatcctcaaaacaatcctatgagataatttgtatgatggcagagcagggaaggcagtgatcagtagacctacaattaagtaaaaccagaggatacagctgataagtggtggtaaaatctcaacttgaacacaagcctccattgattctaaatcttgagtgctttagaccaaccatattattctagtgtctttctatttctctcagattccccagaacacctaacacagtggcaggtactttataaaagaatttttaacaaatatttgtttaaataaattaattttgttataggccctcaaatttaataaatctctagtgtaaatctacattcttgaaaggctcttatattatccattccttgatttttttctctatgcctactttatttttgctttctcctcacttgtactccctcattccttccctgatgctatcaggccccctgaaaaggaagcttttgtttagaaagttatagcacaacttgtgctgccacttagccacttgagaatttctggcagaagtcttatgaagagcatgacttactgtaatttgagaggctcttgttttatttaacattatgggaaaaacaatcatcaggtcagaccagcacttcttatgtaatggggatttaggctcaactgtctacatgtctagactaagcttgggaccctatttttccccaggctccttagctaggtttattcctcttccagaaagacttttgttggcgcatacatgagttccattttcaattgacactaaactaacagagcagtctaccaagacaggaggaagtcatggttttttgtttttttgtgttttttttcctaatctaagaccagctggctgatgcttcctctcacaaatgtcttgtgtttgtaagtacatggctggggcgtagactcaaaatgaatgctacagcttccttatatcctatacaaagtatcttgttctgtgtatcaaaaagttgtggacaggtaattagtagtggtgtaattgctttttttgtgggtacataattataatttatgaagcttgcctaacaaatcatatccgtaaaaactaactaccttcagaaaacagtaaaaatatgggcccttcgataattatttccatgctaccagtatggacaaaaaaaaattaaccaagggaagaacctgaacttacagaaggaatatttcactatttaatgaggagatattattaatgaggatactctatccctcagatgttgtgtcactttgggaaagaaaaaatatggactctgaaatcaaaaccgcagtgagagatcatctcacacgagtcagaatggctagtattaaaaagtaaaataataacagatgttggcaaggttgtggagaaaagagaatgcttatacgctgctggagggaatgtaaattagttcagtcactatggaaatcataagtttggtgagttctcaaagttctgaaaacagaactatcattcaacccagcaaaactattattgggtatatacacaaagaaatataaatcattgtaccataaagacacatagatacatatgttcatcacagcactattcacaatagcaaagacatggaatcaacctaaatgcccatcaacagtaaactggattaaaaaatgtgattcatatataccatggactactacacagccataaaaagaactagataatgtcctttgcagcaacacggatggaactggagatcattatcctaagcaaactaatccaggaaaagaaagccaaataccacatgttatcacttataagtgggagctaaacaacaaaaacatgtggacacagagaggggaacaatagacactggggcctacttgagggtggaggatgggggttaggagaggataaaaaactacctatcgagtactgtgcttattacttgggtgatgaaataacttgtgcaccaaacacccatgacacacagattacctatgtaacaaacccacacatgtagccctgaacctaaaataaaagttttaaaaatggttgaaaaggtaaattttatgcttgcatattttaccactgaatttttagactagaaaatattataattttaccttaaagaaagaaaatgtggtatatatacacaatggaatactatttggctgtaaaaaagaacaagatcatgtcctctgcagcaacatggatggagctggaagccattatactaagcaaactaatgcaggaacagaaagcaaaatgcctcatgttcttactcataagtgggacctaaacattgagtacaaatggacacaaagaaggaaacaacagacaccggggcctacttgagggtagagtgtgcgaggaggctgaggatggaaaagctacctatcgggttcttacatgggtgacgaaaaaatctgtataccaaacttccatgacacacaatttacctatataacaaacctgtgtgtgtacccctgaacctaaaataaattttttttaaaataaaaaatgcagattctatatgggaattttgttagcaattgcagttttcagtctctgtccctgctaagtttcttcaaggtaaatcatttagtcattcacaaacaaatatttactggccaactttatgggcatagcactttgttaagtagagaaacttgttattatggaacttaaaaaaacaacttgcatcaaatcactataatgcaaaatagaaagtaataagtgccattaaagaattatatgttacaggaattcaaaaaaagtaaaagatatattcttcctagtgacattaaagaagttctcatggaggagcatgtttgagctgagccttgaatgatggttacacatctacttttcatattataaataacacagtttcagaatagaaaaactagccaccattaatatcattagtaagaacagtttaaaacacattttaataccctctccttattatcctacctattttttagacttatacccacattaccagaggatatacccattatatatcataatcttttccttttaagccttatttttgtaaaaatcacatgtttcatagtcaccacaagtcccgaagtcaatgtctctttagttactttagctgtctggagctctttttctaatagatcctttaggaagggctcataggaacaacattccctgaattcttaaaagttgaatatcaggtcaggcgcggtggctcacccctgtaatcccagcactttgggaggccgaggcaggcggatcacgaggttaggagatccaggctgtcctggctaaacgatgaaaccctgtttctattaaaaatacaaaaaattagccaggcgtggtagctggcgcctgtagtcccagctactggggaggctgaggcaggagaatggcgggaacccgggaagcagagctttcagggagctgagatggcgccactgcactccagcctgggcgacagagacagactccgtctcaaaataaaaaaatttaaaaattaaaaaaataagttgaatatcagttttgctggatataaaattcttggcttctattttcttttctcatgtatttaaaatatgttattctgtttccttctggcttaaaatatttccggtaggttgaataatgacccccaaaaatatgtatgctctaatgcctgaagcctgtgaatgttacctcctggcaaaacagactttgcagacaccattaagttaaagatcttgagatgaggagattatcctgaattttccagggggttcctaaatgtaaccattttttataagagagagacagtggcagacttgactgtagaaaggaaagaaagcaatgtaactattgaagcaatgggagaaaatgtgatatgatacaggactattaaccaaagagtgagaaatgcctctagaatctggaactagcaaggagatgagttctcccgagagtctcaaaaaggaaccagctctgctaacaacatgcttttagcccctccaagactcatttcagacttctggccttcagaactctcagagaataaattttgttgttttaagccacttcgttcgtggtaattttttacagcagatatagaaaactaatagagtgttagtctcaaagagtctgatgataatatttttgcccagatgcaaacagaactggagaagctgaagctccacagcaacacgatgagccagaagatcaggagcaatgggcatgagttgcacagcacctggcactgtactccaaactttagagtagaaaaatggctgtcccttcactttcaccttctaaatctcatgcgaactttgccttgttgctacacaggaagaggaattctggggactatacttctagcttggctaacttgtgttagtacaaacccaccacatttcaccccttgtcgacttgacatctatacacacccctttaatcatacctaacatccaaataaagacaatagtaaaatgatgcttctacccaatgatgctgatatccgttgtataatcaaaaacatgttagctctctcctgcaaataagatacaagtttttttatccatctttggatgatgttcattcttcttctagttgagtcatactccctctttgatattctctaacttaagtgataagatataaaatgaattaccattaacactgttaaattagaatgaagaggaatgggagagtggaaggaaagcactggctaatacatagacaaatatattcataccaaaataagaaagaagctaataaccattcgccttcatttctaaaattggtcatatagtcttggatggtatttttaacttccttttaccactctttacccccagccattgacccttgccaacagttcacagagctggtttcttccaattttcagaccttaacttaaatgtcatctccccagagagaccttgcctctttccaatttcaagtagaccatcccatttttttctcatagcattctgattttttctttcaaattatacgtgttcactgtttcttatttcttcatgcctctcaaaataacaatacttttgaatgaatgaacaaattaattccttcctttctttaccacccatatgtaccaatcccaaagtgctattagttttttattcctgatatatttcagatccattcatttctttccagtcgtcagcactcagcttcttatctgatatcctggctcctagcttctcttcaatccaattcataccactcactatattcaacgcttggtgagaagaaatgatttcatatttgtctttacatttctagtacctagcactgtagacacacaatacatacagtagaaattcaatcggtatctgtggatgaatggataaagtatcattaattatataagtaatgtattataaaatctactgctctgtctcaggtctccttatgttacaaattgacaccctagaaatgaaaattcatagataaaattattttagactttcaaatgtctgccttttcaaaaactactatttatttgaccactaataaaatgagatttaaccatgcatgcaatgagaattgtttattacttacctagaagaagtgtgtttgcgtcagtgttcaagagtttaaaatagtatgaacatgattaaagggatagaaatagtattaatttaaataattaaaataatttggtatattttatcaatgctacttactgatgcaacagtattttgaagtgcatctaggtaatgcatgtgtgttagggatacgatgaacaatagacatgatagcaacaagtatttgggagagcaaaagagatcaagctcagctaatttttacttctctcaaggaaacagatgattactaagtacctagcacaatgcctggcatagcatatagtagaagcagaaaaaatttatttcaaactggctgagtgttgatggttttataatagtaagtgagattttcataaatttaaaaggccatgttgccttaaggaatgatcataggattatagaatgttataccttgaaactgattataaggggagaatacagattgtcatatcctaaaaattacttaaagggtgtatgtccttgttaataaatagttcatcctaaatgacaatagagcactggactgaaatgacctttagagattaccttctgctaatatttctacaactttgggtcttcctgttaattacttttgtattttgttgttattgttctttgtttttaacctcaagcctcaaataccaaagaaggccaagatcgtataaatcaggagaaaaatcaggtcttatgtccacagcaataaagagctgtattttctcagcattggcaggactccagggaaatccaaatgctaaaagtctgtgtttccgctcctaacatccctctgttccctcagtagataagccacaaggatatgatcaaagtcaatcagttccattgaccaaaatttgatcaaagcccattttaaaatcatgccccatgagaccatggcaccagatttctcaagggctctggcataatggtaggatactctgagcgctcaatctcctcttcctaaggcagttccctccctgaatgctactccagttgttccccaggcccttagtcggaactagagggccttacattccatgactcagggccatctgaccagctttaggggatggagggaaggtaaggcattaaaagtgttcatgtgccaattctgctaggtaatattgacatttacattttaacaacatctttccgtgctttgatcccgtggagtgaatgagtggctacaacagctacaatggctagttacaaggtatgctgctaaggaaggctccaaaccatccacatactccgtaaggaaggctgctgcaggaataaaattccaaagggctgccaaaaaatatatttaagtaataaaaaatacatgtatagagtggttgaaatccgcagggactacttcttggtgctcctaacattccatttgatattttaaaatgctactgaaaaccaccccagtatggtctttattaaacattcacttctgaacttaataagctctgtgcataccttttgcaaaaagtattataaacttggttcttatgttcttacaacatttctttttcttattctcttctagtaaaagtaattcaaagcttttgttcaactgatagaaaaaataaggtatttttatgaattgggccaaaagggaaaacggaaaaatgtttatgcatttacccaacatcatgaaccaggaggagggacttgccaaagaggatagaatgttctattttgagcatactaagtagaagagcccattacatccatacagagctgcccagaagcagagtagcagtggttgaaagtgtggtcttgggtgttaactacccttgatcttgaatctaagccccaccacttagtagctgcatgcgtttagacaagttcacctctcagagtctcaagttttcagacgtaaaataggaattataccacttacctcaaagaattgttgagacaatggaaataacaatttatataaatggctaatacgatgcctggcacagggaaagaactcactaaatggtattttattactaataacacaagtgattacaacaaatgaggcactggagtagaagacatctgggctgaaaaacggtcttaggtattgctgatgtgggagcattgattgaaggcacaagaatcaatgagattggcaagggtatagagcagagaccacaactcaaatgcctgagggacttcagcagtgagtttgtgtaagtgcatttgcacattgtgtgggtgaggagaactcttgggaaatggagttcatggagtctccttaaagagggaagctgccactctgtttgggaaggttgctgccatgccaaaattgggcccagcatcaccagatctcctgtttctgtttttggttttgttttcaaaaaagatcagaaatttcccgatatttaaatatcagctactaaattcaacttaataaacagatgaaacacagacataggctagactgcggctcattggctgccagattgcagtttctgctgtagagaaagaatagggctgagagtagagtcctgaagtacaccagcattaaaggggtggcagagaaagaggaggggtgatgaagactaagaaaggcagagaacagaaagagaagtccagaaaagggtgaggtcaaaaaagctggggaacagaagtgttttaaggaggacaacgtcatcagcaccatcaaaagtagcacagggatcactgtggccagactatgctacacaaacccattaatagttgtgaccttttattgagacagcagatgtaattaccacttaggagaggggacataagaaatcatccagggttagaaataaggttctgaggaaaggaaaaacagtacatggtagaactctatttaaatcagtctctcttgaaccatgaagagggactctaaggacctccagtgagcatcttttcaaaagcaaagatgggctttgccacctcaaccatccctcagatgtgtctttgatggctaaaactggaggcaagtaggaaactggaaagcttgccccgtcctcccctcttcagaggatgagctactcagaacatggagaagacaaggataaatgaacactccaacactctcaccagtagtgaattctgagatcttttatttgtttccatgtaaatagcaatattactattaactatattattaatatcaatattaatactctctgagagccaggaaagcactaaatacaaaattatgacttaaaataggggacctgcccagtatacttaagaacaaattatgatttggatcgggattggaatcccttaagcattctctaaatagaaaatatctaactaacaattgataactgctcttgaaggactcacaaagatggctgaggaagatgtaagcttgtccagaaaaaaatacattcaacatagtaaaggagaaggttacactccttgactcatagcaacaagaacatagacatttaatatgtgcattcacagataacactgtaagcataagattctaaactgttagatatttaacattcctctcatttaacagaaagaaaagcaagacccagaaatgggaaatgactttcccaaggttacatggctagttagtggctaagtcaaatttaaaattctgatctcctgacttttcattcaattcttttcccacaaaactctgccatgtatatcgaagggttaattctccctgtgaaggacatgacttacagggactgagacacacacacatatttttgatggaaggaaggtggagtgaggctggtgcatagcagaaatatccctgtgtggttgcagaggccaacatgggaagagcaggccaggtgcacccaaagcgagtgagcacctaagagaggggaccatgacatcaaagacaaacaacacacacaacatatacttaggcctgcatgtgcactgcacatctgtgagaaatatagataaaaattccaaacttaaaaatgaaccatgcattttcttaaatattacctatagtcataaacgtttactttttcggatatcactcactgagtaactgcaattttgcagaacatggtcaataacaaaaagtgaaatacacacacacacacacacacaaacacacacacaatcttctgagtagtgaagccagatatcattgaatatctgtctcagaatgattcttgtaaatgtaagtatttagcccagtgcctggtccacagtaggccctccataaatatttagccatgattatgattctgtgagtgccttggcagccactcagaacttgattcctcttaccttacctacaatttcttctatttagcatttttatttaccttccttcataacagattaaaatagagggatgggaatatagttgaaggtgtacttaagaggaaatagaaaacaggaaaaaaaaatccaactgagaccatttagtgtaagggcgaacagccctccacctttctggagattctagagataattgtagcacagtacaattccttgataacacagaatcatccagaaagattctgtgatgttgtatcctctattgaaaatgtcagggaaacatgtgctacaattttaaaatacatatctcaaaaatttatgtttataaaaggtttggcacagagaagttacaaatcatctggaaagttgacatgaaaaatcagattgtccacagcgccataagcataacacattatatcaagttaaggggacatttcaactaaacataaggggatactattccattgaagccctggcataggctgattatagacccttctagtttcaattatcaatgtgagactatatatggtctatggtatttctagacagagatcattatttttcataaggcacaataacttcttagtgctatttgacatcagattgaatttgataataggatcacctcatttcttgaaaccagcaatgtttctgtgtgtacaagacatggagctgagtgcgtatctcagcataggcaggaggatgagcatgtgttgctttgcctgtctgtggcaaagaatgtgttttcctccccaggctattaaaatccgtactgacttttaccctgagatgtccagttccctgctatcctgtacagtaaagctaacccttcacaataagttatctcactctccctgtatacaagaaaatctctcttaagtcactgattagatttttcaaagcatcacatccccagacagttctttgaagggaaatttctattaactatgtttggaggctgggaaagcaaaatggtaaagaaaaaaagcacgtggtatttcttagacggctctcttcaagtcctgatttttcacaagctgattcttcttttgaacccccaccaaatgagaaagtttaaatttaggcaatatgcaaactgcaatcaatttaaccttggagaggccgctttggcttccaggggttggttcataccacctttggcagattcataaccccactccttcactccttgctcctcttcattttgataatgccacacacatgtcaaatttccagcaaatggtagtcaggtaccgttttcaatgacataagtttattatgacaattgcctgaccaatagaaacaatgcatcttgaagaagaggcatctattttttctttctcacaaaggtgcctagtaggctcaaggcaatcttggggtgtgacggctaggcaatttagaaaatataaggataaataagattaactggtatataaaataagttttaaatatccctgaggggtgggggcgggagggccaggatctgcttcttgtcacatcccacgtggctgagctgggaggctccttcacttgcaatgaagaatccatgccctgtccacccccagcttggtgttcatgctggtgcctggttttagatattgccatcagcccctcaaaggacacagaattcaccaggattttgatggataagaatcagttctccgccattcacatggaagtcatccagggaggtattgtcagtggtcacattcaagtagactttgtctttgtaagtcagagaggccaccatcaaggagttgacagacctgaccttcttcagttggaagaggggctcctcatccttctggtaatgaaggctaatgttgacttcctgggagaagtagcccttcagggagatgagataaaacccatcacagttgatgatgactgagttgttctgcaccttcatgatttcatcctccttttgggaagtgaggatgaaacctttctccttcttatattctagggaggataggggaaaatttgtttaattaattcctaagcatagaattgggcaacaaccttccaatacatctggaatcagatgaagagaaagtgatagggagagattttgaaaagagtaaaagcagtgagccaagatcccgccactgcactccagcctgggtaacagagtaagactctgtctcaaacaaaaaaaaaaaagaaaaaggagtaaaagcaagagagcactgtgtttctacctgcagggtggaaactgctttacctgtggaatggaagaagaggcaatgttaacactaatgcccaacagagtctcagatggggctgagattcaggagctgagagattacagaaattgtcacaaagcacctatagcaggacaggtggtttcagggtttccccaatttttcagaacaaggatggattggcaacttcagtgcctcctttcttgctcagtggatgaactatgggcaaagggtggcagtggtgccccatgccttagccctgcacactacccatactctgaagcttgacttaaagcaattgttttcaactcttgcctttctgtcatctgaccatgaaatgcaaattttccacatgccccaggcattggacctatccacagcagttactagtggcctttgttagcggtcacttaagtttaataatgcagctgtgcacaccgtatctgtggattcagggtgggctctcaaagctgcaggtggaagagctcaagggcatatacttgcttctcttctctacctcctgttgctagtttttcccggaaggtactttgggaagagtcactgccacaggagaaagaaaaggaggaagtggagtaggaggcagtgatagacttggttgttttgtgcagggccatcccaagtgcaagccaaaaagcctgaacttcttttatttccttattagcattaaaatcatcctgaatagccaagtaaccacatcttggacacaccctgttctggcccatgttcctttgttaggcaaaagaataggtccccaccgctagccacaattcagtaattcttgctttgtaccagtccagagggacatacttttgaactgaaaaagaggaccacttatggaggacaagaaatacttcccttccctcaggctcaggagaacttaactaaaaaatgaatattcgtgtggaaaccactaggggttgtgctagcactaatcatggacccaaacaatcctctctctggagtcgaagtttttattctatcaagggcttcccccaactttcattaaggtaaactcttgccccagaatacaattagcaggcaataatgtgtcttatagtcagacagacttgtaagaagtaaagccttagtttccctaactaagaaatggaaataatttctacccagaaggttccttggaggattaaatgaggaacataaagtgattagtacagagacaagcacatatttgatgaataattaatccccttttctctttatacatctgtatccctaatgaaaataatatgcaggctacaacaattctgggatttaattggaatttaattccttcccttaggaaaagaagagatcttgtgttctagaggaaattaagagactgaagagaagattctttcaaaaatatgaatcaattaaacttttgacaatacttaccggtaaattgtactttgatactttgaattcgaggataccgatgtgatacctgagggaggaagaaagacatattcttaggaaaaaaacatgaacaaatgaaattcgcaagtcatatttaatggaacagtgaagcagaaatgcagtagcctgtagagaaaacaaaaacaacagaagacttgacttttttgttgttgttgttgttgttgttttgagtcagggtctcactctgacacccaggctggagtgcagtgacacaatcacggctccctgcagcctccgcctccctgggctcagtgattcccccacctcagcctcctgagtagctgggactataggcacgcaccaccacacctgattaatttttgttttttggggtttttgagggggtagagatggggttctgccatattgcccaggctggtctcaaactcttgacctcaagcaatcctctcacccagcctcccaaagtgctgggattacaggcatgagtcgccatgcccggccctgactttttctatgaagattggacctagacttccaccttcccccttgcttttccataatatctcttaagataaattaggactattgtgctccttcatgcaagcgtctgagatctgtccgcatttctgccaaactcttctttggtatactgttttgtctcactgtgccccaatttcccattttggataacgtagcactatagtcatattgttaagaaacctattcagtcatagagattccctcatggagaatgctggttcaatcaatccatcatggccacagactcccagaatgcactgggagggagttctggaagcttcctgcatgtctggtctttcactttaacgcaggagtaaaagcatcctattttcaggggacaaaggcaataaaaactgtcccaatcctacagagctcaatatatttggtgtagcttttttaaacattggatctttctcttcaacagctttaaaaacctaacttgaattaagtcagtattcaattgctaaaagagaagtaaaacagtgaagacaggaaacctgatagataaaacttttacagtacttttgtggttaaaagaacaaataagctcaatatggaaccaactccgagatctcttaagtaaaaaaaagttggggggggtgcagaattatacataaaatatattgccatttgtgttaaataataataataacacctgtgtgggcattgaaagaatatacaatacattaatgtatctgaaagaatacacaagacactagttgcaaatgttgtccctggagaaaaaaattggaagcctgaggtcaggagtaggattgacctctacttttcatggtctaattttttaaaaagttttgtgccatttgtttgtcttatctactaaaaaagaaagtagaaaaaaatgtctgctgggcacggtggctcatgcctgtaatcccagcactttgggaggctgaggcaggcagatcagctgaggtcaggagttcgagatcagcctggccaacatggtgaaaccccatctctgcttaaaaaaaaaaaaaaaaaattatccaggcatggtggcacatgcctgtaatcccagcttcttgggaggttgaggcaggagaatcactgaaacctgggagggggccaagatcgccccactacgctccatcctgagggacatagggagactccatctcaaaaaaataaaagcctattatgcctgccaagaacaacggctcttcccacaagcttattttggcatgacgtcctaatcaaaaatgtgaagacggatttgtttttatgccctgggtaggggaattcctgtttcccactctcctggcacactggtagcttcagtcaagcatattccattggcacctgcccacacagacgaggaattccctacttctattacaagtataatcacaagccttaccagctaaaaccaacaggcagcataggaagaatggagagtcattctgagccctgccagggactgggctgcaggaacaatatgagttcaatgtgctgagcacatggagagaggcactgacttgggtagaagcaggagtctttagctctcccccttctctgtactcttcgtggtgtgatagctaattagtgcccttcgtgcttaagggcaatgctctggaagaaaacctgtcagaaggcaaatgacccaatgaccatagtttcctgggtaaataaatgtttccactgctctctgggctaagtgccagcatgaattgccacgtgctaaagttagaaagaagccctctgtggagtagcacaaacagcacaggcctcagcgtgcagtgacagagtgctaatgccaggcaggcaggcactgtgccaacttaagcaagtttcataatctccttagatggcagtttctcatctttaaaagtcactagaagatcaggggcattcctttcagcactagctttccatgatttagattttagaagttgtgactttaagtttaatttaataaaagagaaaaaaacataaagcttcctcattcccaaatttactttcactccctgatctaaaagcccttgtgatttgattattttgactgactttgcaaagatctccaaaaatatcctgcaacttaaggaatgttccaactttttgaggtgccctgatgaagtaagggtggcagtgaccaaacagacattctctgggacgatgatgctgacaggcagtgagtgagtaaagcacatgtgacttcctccgtgttggagtctagacttccagtagatcaacctggaggaagctgacctactggaactccagactcaggtatcctgttccttctcctgaaggtcacataggggtagaagtttgcatatcctcagaagtctcttactaacatcaagtttaggcaatgttgtgaagtagaaaaagatggtccttcttcttatttgttggccttccaaccatcttccccctcatcctccatacctgatgacctcatgctgactaccccagtgcccagagacacccccacagtgcccaagtcaaagctctgaagagcctggctccaacctcattgtcaagctttattgccacatatatcctttctgtgtctaatgatccagccaactatttgttctgatctccttgcacttgggtaggcagcctggtaggatggcacaaagagcatagactttggagtcagatttagttcaaactgtgacttctctggttctttgaatttggaaaagttatagcatttcttcgctttagcctttatacatgtgaaaataagacataatactgtgagcggaactttccagaagatgaacaccaagtttagataggataacttaaagcatccagcagtttgccagcacatggtacgtggtaagcattttaaaaatgtaggccagatgcagtggctgacgcttgtaatcccagcactttgggaggccgaggcaggcagatcacatgagatcaggagtttgagaccagcctggccaacatggcaaaagcctgtctctacaaaaaatacaaaaattagcaaggcgtggtggtatgcacctgtaatcttagccactggggaggctgaagcacaagaatcgcttgaacccaggagacagaggttgcagtgagccaagatcacaccactgcctccagcatgtccctccatctgtctctgcccattaaaatcttaccatcttcaaggcctaaatcaaatccttgagtttcagtctctgtattcccatacaagtatttaaagtcactcattcacaaagatgtttatagcagctttgttcataattgtcaaaacttggaagcagccaaaacgtccttcagtaggtgaatggataaataaactgatacaaccatacaatggaacattatgcagcactaaaaagaaatgaactatcaagctatgaaaagacatggaggaatattaaatgcatattattatacaagagaagccaatctgaaaacggtatatactgaatgacctaactatatgacattctggaaaaagcaaaactatggagattaaaaagatcagtgggtgccaggggttaggaatgggggaggaataaacaggtagagcacagggtgtttttagggtagtgaaagcatcctgtatgattctgtaatggtgaatacatgtcattatatacacttgtcaaaacccacagaatgtacagttaaccccaacattaaaaaacactctattgactgattatactgccagtgaatacaagtcttatctcctctactcaagactacttagctgtgtgaccttgggaaaattgcatttatcttgctgattttgttccttaatctgtaaaatggagatagtaaaaatctgtatatcagagagttgtaaagtttgaatgaaataatatatgtcagtgatcaggacctgtcatggaacattgcaagaagttaataaacatcagcaattattcttggatgcacacggaaaacaatatccatgtcatgttcataatttattctacataatactatataaactatatgacaacagaatgaaggaatggattaaagaaaaaaacaaagactaacaaagttatcatatcagtgctctgactccctgtacctcagagaaacaatacaaaagaatttgggtttcatgagaaaggttgacagaaaacaatcagaagacatttggtctacccccacacatagacttagtgttttgtatatcaagaaaagcaaaatccccagatcttctccacatactcaaagaaaatagaaaatatcaaagggccagggggcttccatctaagcacagtctatagactaaagcttcttcaatctggaaggtctgaagagtccacaccatactcaaggatgaaatgcaaatgctcctaagtatccatgccagaattgaagtatagccgtgaattttgaatgtaatggtcttagaagcatgaaaaaaatgcaaaagaagtcatattttagttgaacattatattttgcatatgaagaaattaaggctcacagaagtgaagagatttgatgcatgcccttcaatttcagtaatttttattataccacacaagtactatttttctcccacgcgaatttgaagaaaaaaattctatgaagattttaatattccattccttatgtccactttaatagcaagcttagagaaaagaagaagttgccgtacagatgattggcaatgacctcatcatgagaaagaaaagggagagcccacactccaggcttccctcttgggtttcagggctcccataagtgaagcaaaaaaaaaaaaaaaaaggaacaatcaagtacccacttggcaaatatgggctctttgaccaaatgactgaataatgtaatgtacaagcgtcatgtctggcagcagctgataatgcaacaggaaggttaccagcccagtggttcttaaactctaaatgtgcattagaatcaccaccaaaatatgttgttgttgttgttttaagtgcagatggtcagattattcacaaagactctaattcaaaaggtctgggtagatcaaggaatcttcatttttacaagtaaccaaggttcagatttaaaaatcactgctgttaactatgaacttccaaaagtctaaatccagagaatttatcttcaaccacaccctgtgcaaaaagcatgcctgtccaaaagctggtgctcaagaaattttttctctgctgtaagtgttattcagtagttgaatgaatagtatggttgtcatattatttggtagtttggttaaaaataacatcagcaattattgagtacttgctatgcagcagttattacactcaactcttggaacacaaggagatagaacatacaatccttacttttgatgaacttctatgccagttgggaaaatagtccctgtacataaaacctttagtaaatacctacaggcaatgtaagtcataacatttcaaagaacagaaaaatcactgtaggctttgacagcacaaggaggaaagacctggacttaggccttgaaagacagagaagagctggatgagcaaaagacattctataattattaatagttggaagaaaagtctagaaatgaggccatcctttgtgcattcaagaaaaagggcctggtgcggtagctcacacctgtaatcccagcactttgggaggtcaaagcaggccgatcacttgcactcaggagtccaggaccagcctggacaacatggtgaaaccctatttctacaaaaaaataaaaaaataataaaaaaaatagctggacatggtggtacacctctgtggtcccaactgcttgggaagctaaggtgggaggatcgcttgagcccaggagattgaggctgcagggagccacaatcatgccactgcatgacagagagaacttgtctcaaaaaaaaaaaaaaaaaaaggcaaagaataaataaaaccttattgagtacttacaatatgctatgcactgtttcaaatgtattatcccatttgctgctcaaaataacattgtgatgtagaaagaataactacccatattttacagatagggaaataaaaattagtgctgctaagaacttggtcgggaataaatatttattcatttgagttcaggtgaatcccaagttcatgataacatcccttctctttatcctacactatcataagagtaaataacaccaaaaaaaagcatttatctgagggtcctaaattaacttgaattgttttcatcatcaatactgaataagattaaatattaatttttgaatagttgtcaaaatacacagatatacatcaaaatatccagaaaccctgctctagaaagagctcctcaaccaatgttgcagggttgcctatgtagttcaggttgccagaattattagctcagctctgattaggtaaaactgtcctggcaaggaactgcaggcccatggacaagtacaaagcaggctccccatgcaggtgtagcaaagaagagtcagaattaggttctttcttggcctccttcagtgcttttagcactgggctgtccaaaaacaaaggtggaaagtgtctgatatctggcatttattcagcaggctgtgctgtgttcccaagaaagtgacacttgtttcaagagctcatctttggagagtgtgtacctctaattctgactcactaggatgtggtatggggctgtcgaccttaaacccatttgacatttgtcctggtgaagggtatctgtggcaggagcaaatgatactcaccaagcatgaaaccaggaagtgggctctgcactcactataccggccttgccattccttgcttggtacaaggccacaatgtcaaggccttggtggtgggcagcagtgggacgtgggctagtagagggtggtagtagtgggctagtagagggaaacacatctggagtggggactccccagttcaccaaaccactgccactggacgtgaacctctcctccccgcaccttgggcttcatgccaaccagtggagatctgagagatcatgaaagcatgacctcacaagctctcagggtgtgtctcaaggggcctcagaagagaaagggagaatttttcactcttagccaccacagtagactgagaggatagatccttatctgacagacatggtctattctcagtggaagcagcccccttacaaaaagatgagccctgacttctgatcacggaagttcagaattccacctagagagaggagtaggaaaaatgggaaaaactgattctttggtgaaggagtttctcatattcagaaagacttatcccaaaagttacatttcttagagacaaagatgtgtggctttgaaaaccttgttggataacgagtttattgggacttaatgaacacaaagaaaagccattttaactgccatccaaagccttctctttctccatgccaaacccttaccatctctgccagcatattttcccagtcatctctctcttaacctccaccttcctccccactgtatatcctgcgtgatatcctcatagccacctctctctctaaccacttccactcttctcatcgagtctactaagtaacggctatgagttttcccgcagagaagcctctctcctctctgtttcagagagagcatgaactgtggttttattgtccctaatacaattagcaactgacagattcccaagagaaatgtcctatatttaggtaaacaatcaaatcaaccaaaagtatccatgtgacatgaaatctatgtgattgacctaatgcaccaactcttcatatcgtcagagggaagattttcttgtatcttggtttcccttcccacatacaactgaggaagcactcaaagtacactgacagagggatttactaaaacatttctgagaactcctgtccccacctcaatgattggttaagtctctactgtaatattctcagatcagcttagtctctaagctactggaagggtaggtttacaaggtacccactgccttgccatacctcctaccatgtctcaaacataatggcacttagtaaataaatgttgaactaaggtggaacttagcccctcaggacatccctggaccttcatcagctacaagatcatgtaatatctaacactggctctagtcaacactatacattgctcaaggttttagaaattggcctattctagtcagaatggccattattaaaaagtcaagaagcaacagatgctggtgaggttggagagaaaaaggaacacttttacactgttggtgggaatgtaaattagttcaaccattgtagaggactgtggaagacagtgtggcaattccccaaagatctaaaagcagaaacaccatttgacccagcaaccccattactgggtatatacccaaaggaatataaatcattctattacaaaggtacatgcacacatatgttcattgcagcactattcacaataacaaagacatggaatcaacccaaatgcccatcagtgatagactggagaaagaaaatgtggtacatatacaccatggaatggaatactgtgcagccatcaaaaggaacaagatcatgtccttggcagggacgtggatggatctagaagccattatcctcagcaaactaacacaggaacagaaaaacaccgcatgttctcacttataagtgggagctgaacaatgagaacacatggacatgtgggagaacaacactggcgcctgttgcaggggcaaggggagggagggcatcaggaaaaatagctaatggatgctgagcttaacacctaggtgatggtttgatctgtgcagcaagccaccatggcacacgtttacctatgtaacaaacctgcacatcctgcacatgtaccctggaacttaaaataaaagttaaagaaaaaaaaaagaaaagaaagtcaattgaccataaatgtgcagctttagttttggattctaaattccaaacgttgatctgtctattcttatgccagtaccaaatcaaattatataagaactcttttcagtcacggtgcacattaccagttgcatattgtcataataaaagttcaatgtagagaagaaaaaaaaagaaattggcccattcatccttgaatacaaagacagtagcagaattactgcagtcagtctctttatttgaaatcactcattcccttatctgatttgctatataacaaggagggaatatagtcttgagaaggcaacctggtagactgaacaagacattgcactgggactaggcacacctgagttcttctcccggaccagaaaatgttctttcccttcctcagcttctaatattctcatttcaatgtctaaactcaatttagattattggaataaagtgtctaatgaaaaatttccatttcaaagattaggcaaatcacaatattcaaaagcgagatagatttcaaaggattgtgtgataagaagaccttctgaacagaagatcactttcaacacaatagacccctctgctgtaacaaaagcagcaggcctctttttccccaagtggctccctccgatagtaaatgagcaactaagattattcctgtactagaatggcgtgaacgcaggaggcggagcttgcagtgagccgagatcgtgccactgcactccagcctgggtgacagagcaagactccatctcaaaaaacaaacaaacaaaaagattattcctgtactatgcttattaccccagtgatgaaacaatctgtaccccaaacccctatgacacacagtttacctgtataacaagcttgcacatgtacccctgaacctaaaataaaagttaaaaaaagatgatccctagtgttgtgcatgcagtgaagctcttcacctcatctgtggggggctaaataatcctcaacctgtgctctgatacaaactgagactggcgaatggtaacatcatcacagaatagcagtgggatgaggattatggtggtgacaatgatgaccatgtcattttaaactaaacccttcctgttaattaatggcagtgaaaccaagtacctaatgcaaaaaacaagtatgcccactttataatcccaatcaagatactaggtattaaagctggtaggtagctttctgtgaaacttcttactgaagaaccgtaccctctttggttatccagtgcttatcatacgctattgcttgtttaactgccttgttttcctactgggttgcaaactctgggagggcagggaggaccacgtctatttcactcacctttgtgtcctcagtgcctgacaggtaactgatgctccataaacattgctgaataagttgatgaataagtgctttatagcggcttgaatagtgtccctccaaacttcatgtccatgtggaacctcagaatgtgactttatttggaaatagggtctttgtagatagatgtaattagttaacatgcagtcaactggattagggtgggccctaaatctaatatgactggtgtccttgaagagaaggagaagacacacaagatacacatttgaaagaaggccatgtgaatatagaggcagagcttggagcaatacagctacaagtcaaacaacactgaggattgctgggagccactagaagctagaaagaagcaaggaaggattcttctctagagccttcagaggagcgtggccttccgacatctggatttcacatttctattctccggtactgtgagagactaaatttctgtagttataatttacccagattgtagtaatctgttccaatagccctaagaaacttcttcatggttgaataggtatttgtatagagtgtgcaaattacactatcacttaagtaattctttgaatcagtctgatggaactagaaaggccttgggagattatatagcttaatctcattatcatttaaaaaaaatgcagaggaaagtaagactcagagagaataaattactgaattagtactagaattcaggtcctctttctcttgtacaaatatatcatacatacaatgctttgaccattttataaaaataatccataagttattatgtgattgttaaagctttgttgattatgttatctacatttgtgtaagtatatttaaatctttttttaaaaagagtctttcttccctttatgatggcataaatccttcctccaatttttcttcaaaaaacactaatgccaaaaaagaaaatgaattttaaaaacagctagccaacattcttaaagctcagactcgtggcctcgtggccaggcataacagaagataggactggaatttagactgagtcttaatttctaaccctgacctttctgtgcaaacctagtcaagtctctatacctcatatttcctcagtgtaaaactgcacaccatctttctccaaggtcttagtgaagaaatgaggtcagaagtaggaaaaagctctgcaaagatgagagactgttactgcaagtagtacattgaataataccattcaacctccctgctacccgtccattctaaaaaacggtttgagtttaggttttattgcaccatatacagggccagattaatatgcatgggggtcttagaagctaaaaattgtcatcacccaacacacaagtaattcaaaatatgttttacattactaaactgtaaaatacatgttttatgacttattttatatctcattaagatgctttcctttgatgcatgttttgatgttctttatcatttttgtaatattgtcattccatcttgatctttgacactgtttcactggctttctaggatgaaggtctggctgccgctggggagcccagccctgaggctacatcacttaaactcactggagccctcacttccccacctgtacaatatagtactttgggaatgaaggctctctaaccacaagatcttattaaattagtataagaagaattaaagttcagatttgtttgtccatctttctgtcaagaagcatgtgttcttaaatagcatttgcatgttatcaagctaggcaaacttataaaaattaaggtgcatttcagaatgaaaggcctactgaaaaaagattttagttatgccaggaatattccccaatgtttctagattagtgaaccagatgatatgcctcttataaatctaatttcctgccttatttggtagccaagtcattggagaattggatgaaatatatcaaaataagaagaaacggaaatagcctaagccatgtgctctgagtacgtaattttagatctctgaaccacgtgcagacactgaacctaatcacacttcataacctcataaattctccccttcattcttttgctctctaatgcacccatgaaatcttaattagaaatctatgtttaaaaataataggactcttccaaggtggattttttaatcctaaaaattacattggggaaatcaaggttcatgaagttatggttaacattaactttgatatgctttctgagatttgagttacagtgtgtgtgtatgtgtgcacacacatactataaagtcaacattttagtagcagtatgttaacggaagcatgttcatggataatgataataataatcttagcatttacaaagctgtgtatcaattaatcctcaccacaaccaaattccagtcttggaaatgattaaactgatgcccagggaatttcaagaaatttacttggggtcaagaggtaaaagcctggactgaaaaattctggttcctggcccagggcactccctttatacttcaatgagtcctccaaaatctgagatgatgttttatagctttgtataagcaaatgttttaattcctttgtttgaaaagattggttatcaaaagcatgggtgattacaaacgaaatatacaaagcataggatggtagaaaattcagtttcaatccaactctaccatgtatttcattagtgactatggaaacataaacctttccacctacaactcagctgggttatttttccctcattaaacagtaataacaacactgtatgtagctcctctaacccaaatgatgcaaaaggattaactttcattttccatgaatggagaatccctgaagtggggtaagctgtcatttgagagagaagtaattgctatatatatatacatatatatatatacacacacacatacacatatatataaaagaagaagaagaagtggaaggccaaggtggccagcccctaaacaaggctgggtctactcagtactagtaaccagcagctgaggtcagagaagaggaacagagagattgtatccctagatctatacctagagccttttggcttgtttcccaactctcctctgtgtgtgtatatttggatctatatgtgcatacacgtgcaatattttccagcatcatccccatccaaattattctgtcctattttgaatacccagatcaaaacatatatctaaacacttcatttagaaaatatcatcactctgcaaatagtgaataatattagctgcccctgatattgttcattctcttatttgtggatgagcacttgactgcctgagaagttttctaatcaactcttcaggaaaagaggataagctgtcttcagacacaagagaatcgttacttttactgtggtgccccctagtgctgttcagattagactcactttctatatttgccaaaatacagactacacaagagaagcaaaatttggagaggtaacaatgttggtaatttttcctgtatttcctttggcgtaggagagaatgaagcgtgttcctttagcatgattcacaagatcctttgtgaactgctccccacctccccagcttttcagcttcatctccaccactttcccacaggaacactcaacttgagctattcagaaaaacttgctgttctgcctagtaagccttctacccctacccaccaattcccatccgcttgtctgcttaaataatttatcctcctccttctagtattagctgaagcattatctcctcctgcaggttttcctgactccccagaaggctgaggcagccctccctcctccctcctctcatcttcccattgtcccttgagcatgtcactcttttgtccccaccctgcatcttgactgtgagtgtaaatagttcaaaaaccttctccaatggatgtttatatcgccagtgcctcaaatggtacctagcacaagtaaacactcaatggaaaaaaatctgtgtaaggatggtttcattgataataagaagaaccatagtgtaggaatcaggagttctggtgaattaaccagctaagtggtcacgaatggttcacctaccctctctaggtttctgttttcttatctgtaaatagactatatctaatacctgcccccaaattcaatgattctatatgtttaatacctcctttagaagcctcaaaatgccttatgacaagccaagtcaacttcagatgttaattttttaattctcaaagatttgcttatgaaaagcaaattcaaatgcctttgaaattatcttatttgcaggtctattgttaaaaaagaacttctaaaaactttctaaatgacatggagacatttaaattaagctaatctgaaacaatatttttttcaggcaaactcctctttctcttattaaatgatacaaagaaaggtccaagttgtagcccgaaacttcattaagaaactgtgaattctaattccagctttcactgatacagaactggtcaactcactttctaagtatctctacttctgttgttcccagctgaaaaaaaagtgataagaactgaaaaaaagtgataagtaggaattgctgaaaaaaatcactaaaagccttcaggtctttgagcatgatgataaaggtgatatgaatcttggaaaagccaagtttcaatggtttcagtgaggtttctcacaccttataggtcagctttttctgcctttgttccatagctgaagttccaggtaagactggaagcctgacaatttaagtggatgtcccaatgtaatatccaaacagtgtgtattggttttggtgacagaagcactgaattatataccttatgtcatgaatattcttacagggcattcacttctttcccttttctaaacagtgtgttttgctaatccagaataggttatttagatatgtacagaatatataacttaagtatagaaaagtacatatgtgcaaatttgattcccctcaatcccttcttaggagccaggaaatccataagcttaaacacaaatatactaactcacattttgtatttctcaaatccttatatccattctatgaatatataaactatatactcataagatattgagctggaagacatcttattgatcatttgatcctactttctcataatacagattataaaaatcaaggctcaaagaggaaagtaaattagatgaggagtgggtagggtctaactttttttctagcatcttaaaaacaaaatattctgcatttcctgcatgtagatagacctaacccagtgatgagaaaacagaggctactaaataaacttgattgaaaggaaagctgacggccaaatggagcttggtagctatatctgtatttacagagccattcatgtaggcaattattttataaggctaaaaaattaaatctaagaaataaaagggaaaatcacaattatttcccaaaaacctttctctcacaataaaagaggtccaatttaactgggtaaatggtgagcatttcagctctatttcacctccaatacacatcactgtaacattatgtcttataaaatagaggtttgacttgcctcatcactaccaacaccaccaccaccaccaccacccgatccctcaatcaaacttccaaacagtattgtagatgagttttaaatggctactagtctatgtctctttgtcagcagctgctctacaatgttctctctcaatctctctgtctctgtttctctctctctctcaaacacacagaaacacacacacacacacacacaaacacacacacacacacactgctgctatcactgccaccaacattatttggtaaactatcaggttctagggaaaacacacacaacccatctatgctatccttctcataatgaagtgtaaataataaatataagattaaatgtaaggacccattgtgctgtcccagatcctataacaatataagaaattacattagctaattagaaataaaaaaattataattaacatcaagtgaagaacttcaaatatcctgagcaaaaaaaagaaatctattttcagagtagacagggcatgtttcttaagcaaacaactcaaatataccacctatgtcttgcttccatctctgtgccaggactatagaagctaattctcccctagagatcactcaccatgaggtttagtgtcctagaaaccagcaccctgcttttcttcccacagctttccttctgtcccagagttgctggatgacttgttggaaaggatcccctctttttctcaacatctcctggatattgatagtccaatgtgaccccaaccaccagcaagctgtacaactgtggttcaccttttgctctctcctgctcagagccgttgtgcaatcagttagccttgaatggagccatgtgtcctgtgttttatcatcccatggtgtaaggaaatatgtaacactgtggttgttagaaaaagcactctcagggctcccagactggtgaatgcactcagctgttctatatttggttactctctttgttttcttctcaaaagagcctaattccggttgatgtcttgggcatccggtcgatgtcttgggcatcctgccatggacaccttactcttcccccacaccctctccccgagtcgcctactttaatttcacccaaagagttctgcgagaagacataagagtgtggtgtgatgaggagaggatcaatgtgttgttgtgctcactgttctgcagacctgagcatgacactagctacacttctggaatttggagacacaagcactgtctgtggtacagtgatcataaccacacacactcttaccagcctccatgcactgaaaaccctatttcctgtaggcagaaacaagcccaggcatttgccaagactgctcatctcattctggtttcattggaggtgcttaatctcagacaagaccatcagaaatcagtttgtattacctgaactttatcagggagaaacatttctaacccaaagcaaccacctagaaaacaagattatcagactagctcaacaaaggaacacgaagagagtatagatttatttttctccagtggcatcttctgcagtgaagaacatccttaaatacctaataatgtttgtatatctgaactactgaataagaaaaaataatgcaaaagagagaagtgtggaacaagaataaagtgaaagaaaaatggaaatattttaactatatggggaaaatactagaaggataatctcctactacatgatgtatttaataaggtagggaaaaggtgaaatgatgtctttaaattatgactggaagagatagattgtgagaaacaatatctgattaaatcattggggtgaatgagtgagcacataggcacacacacatgcacgcacacattgctccgctattaatattgataccttcagcattctttacaaagaaaatcaccttgcaggtctatagggtatatgaatattatgggaaagtggaactggtctctttcctatttccttttaatattaattgcctgatcaaacacattactatcacaatgggtagaccaggtatatcagtgactcaaagcttcaaagtgacagcttataaagggatacaaggaatcttgcattgcaaagaaaaagaaaaagatctagaagctgtgcctctgccctacctccactctgccctaccactgccactgctgaaaagaaggaaggaaaggagagacagaagggcgtttaaccacactttacgattgctgtggggagagggaaaaaaaactcaacacttttggcataagattatttccaagcgactgtttgcagctgttgcagctgccatcagcatgagctggtgggaaaacagcgcccagtggtgcatcttacctgaagagcagagaagtgcaggcagatgtaggtgaagcacaggagcagccccagtccctgaattacagaggccaccagcaatagcttgttcctctcgaatcttggcctggctgcatttcccacattctcttccaggggttggaccctttccatcttcacaatctgggtagagggaagatgaagatatggaaaaggggaacgtgcgataaaactgaagttttccccagaaagaaggaggtaaagacaaaacaaagcctatcaatcagaaaataggcaaaggtcccagggccagagataaaaggcgattgaaagagcaaagcggactctctcagttttaacgctgcaacttttgcaggcaggcgggggaacttctttgtgactaatctgaatttcccctttactttctttctttttttttttcctctgggctaacagggagttgtttttgtgacattccagttctgatttgagtgactgtgaaatgacagtcataaaagtatgctattttcttaacttattgcaccagtaacaaattgtgggtcacttggtaaagataaaaatcatcatccgttaatgtagcagctcatatatcccttccccaaggtgtcttaaatcatagaaaagatttaggggaaatgctggcccaaggttcttatctgcactttactatgtaactaaacattgaacccctctcacagattcagaaagaaagcacacacagatcattcttgaatgaaaaagacaaaacaagaaaataggacactgggtcatgcagaagtaaaggagagatccttggttgtagtctattgcataaaaataaactaccttttggaagcatttactatgtgtcagacactgtgttagatggacttgcaatctttctctcatttaaccctttgaggcaaattcaataaacaattatatgattaattttctgcataccagaaaagaagcagaagggtatccttgtctcctttccttccacttcacatttttcccgtacataatttttccatgaatgaacaaatgaatagatgtaaataagctttgaagattatttctttctttgaggtcgtggctggcctcagaacttggaaagtaagagtattctatcaatagacaccaggtaccctttaccactaaaataaacaatgaaatgaaataaatgataaaattacttataatgtaaagttcaaatgggcaaatatttactgagtacatcacatgagcctggcactgtactggacaacataaggatgctggggaaaagctgtttaagacggaattgtctctctttgtggccaagtatgtctctctcagctccccatgaggcacccagcagatatgtaaagaaaggagggagaaatattttggatattgacagtatgagttgttataccacttcacagaaaaaatggaaatgaggcatacttaaaagagaaagtttgtgggaaatgtaaagtacatttatgactacagtattaatcaattaaaatatgaattaataccttcactacaataattatgccttgcattaggagaacatactggtgttgagaaatttaagttttatctgaaagataaggtaactaaggcacaatatcatagactccaagccaaaactagaaatcaaattgtatccaaacatatttgtcatagttattcccttgaacaaagcttgtgttacatacagggtgtggagaaaaaagctgaaggaaaaatcagtgtgtaaagcccaattcttgtgtaatagttcttcataaaagagtattaaaatcagtaactatttactcgtcaattttcaaaaaatgactaagagtcacagcaaaaaaaaaaaaagccataaatactattggaaactagaaataagctgaaaaagtagtaaaaactattcatgctgaaaatcgtagataacatttttaaattactgtcaaaagaatgaaaaaaataaacatttaccatgcacatacttgtaccttaagcagcatttcttctcagtgttaatatcatggctccgagaaagaaaaatctttgcacagagtcatctctacccacatttaggctaacacttggatgacacacctctcatttttattgtcttgtcgtcctactaccatattttgcctagttgtaatttttgttgatgtttaagtgatattttacacttaattgtctctttttttattgaacacgttttcacagctcttcacattctttgtgggaagagatacacacacaccaggctggaagtttcaggcacagatttctgatagactatctaggcattccaaagttcatcactgggctagtctagcatttgaacaaatgaaatcactattagagttatcattgctgacctttcagtctcaggcacataagcagagtcctccatcttcaaaacgtttttcaaaaaataaagcttaattgtttttaaaggggtcaaatacgttactaaatctatgggcaatttttttcatttgcatttatttatttattttagagacagggtctcactctgttgcccaggctggagtagagtagcacaatcatagctcactgtaatccggaactcctgggcttgagcgatcctcctgcctcagcctcccaagtagctaggactatagacacgcaacaccaggtctggctaatttcttttaaaatttcttgtagagactccctatgtttcccaggctggtcacaaatgcctagcctcaagcaatcctcctgccttggcctcccaaagcactgggtttataggcatcagccaccaagcctggtggcaatttttcttaaagtatctcacaaatattaaatacataagcacaccagagcaaatcagccttaaaataaagccacaggatgtaaaataaaccaaagtaattatcttcccatagactattaacctcctaaatgaatagccatttcaagactacagaaaatatggaaaagaaaagggctttgaccactcacaagatacctcatgttcagaaagaagcaaaaaacatttgggttttttttttttctttggtttgagggttttgttgttgtttggattttttggtgtctgggttttggttttggggttttttggtgataaaaaaaatctacatttttcatttatctctaagtcagattttcatttgtccattcaacaagactgagccaaatactagaggaaaagacacaaacaaaacacatttttagtcctcagggaggtcacagacaggaaagcggaatctccacaacctggaaagttctgggtcctaggtatcagtgcagaagggaagggtgcagggggacaggtgctaatctacactggaattaggacaggaacagcttccttgatctgggagaaacgagaagcagtctggccatctggggcactggggaggggcagtgcctgttgggccaggagtgagggcagtggagcctgtttgtgcagtgtcagttcagggaactacagctgaagaggaagatggtgaaggagagtggctgctggagaagaggctcagaagaatctgtcgtaaatggacttttgttacaagttaaggactttggacttcatgctgcagctactggagaaacatggagaggtttgaagcagaatgtgatatgatatgatatgattacattttagaattacaaaaaaaatcactctgactgagggaaatagaaatggcaggtacttcaggaaataattctaggggggggaaaagagacagatatggcaaggcaggatcaagttggccaactgggagacatttccagggtgctctgtgccagctgagggaatgagtgagatctaaaattccacctctgcagtcagctctctaagccctccatcctggtacaggaagtttcctcctgcaggaagggatatgtttatcatcccacaaaggtgaactttgcttcctaagccctgaacaaagggctgtactcatttaaatgcaggctctttttctaatttataaacccgcagggggtgccttgttctaaaacacacaaagacagtggtataagctagggaccttgagtctgcaatgattcaagtgagaaataaggtcctaaactaaagcagggaggacacaaatggagaagacacttacagtggctcttcattcaccagacattctgagagtgtactcagtgccaatctctgagcatacacagggagtcatagataaactctgccctgggacaagtgatagagtgatgtcggaggtgacagaaacaaatgcattttcaaatgtcaaaatctgatttgtaatctgccttttcaacctattcctgatcctaatgtcactgtcctggttaatgtttttgtactccaggacctcaaaatccaagaatcaactttgaatcatcctcgttcccagtcatcaagctttgtaggctagccctgcaatgcagttttttctttcctcctctttgccattcctattgcttctaatccaaactcttattactcctcacttgagctcctgcagtcagctctccaagcccttcatcctggcacaggtttcctcctgcaggagttccaagttttccttccaaacttatctccctctattttctgattatttctaatattcactctgcctcaaacacccttaccctccacctctgactatcaaaaccctacacgttacacattccccatgaagggctgtcctgtgaggtagtgagcttgctgtgttctagaagtactaaacaaaaccttgaagaaattctgttcagagaattctagcattgagtagattgttgataggatcagtggctcccaaagcctagtttatcatctgaatcactaggagaactttttaatgattctgactcctaataccttcactctagaaattctgattccttgggtgtcttagtctattttgtgttgctgtaaaggaatacacaaggctgggtaacttgtaaggaaaaaaaggtttatttggctcacaattctgacggctgcaacattcaaggttgaacatttgcatcttgtgagggcctcatggtgcttctactcatagtggaaggtaaaagagagctagagtgtggagatatcacatggtaagagagaaagcaagatacaagagagaggtgccaggctctctttaacaaccagctcttgcaggaacaaatacagtgagaactcactcaccccaaaaggagggcattaatctattcatgagagacctgctttcatgacccaaacacttcccattaggccccacttccaacactggagctcaaatttcaacataaggcttggaggggacaaacatcgaaaccatagcagtaggtttggagtgatgccttttgaagccatatttctaaaatagtccataagagccagacttgtgaatctccctaaacaaccactgaaggtctctttcaccattactttctatgataggaagcctcacccggatttcccagaagaatgcagctgttttcacctctgtgttgagagcatttattatgctctgtttcatcttgtaattctttaaatctatttcacggggaggagggaggaggtggggatggttagtgggtacaaaaaaaaaaaaaagaaagaatcaaaagacctactatttggtagcacaatagggtgactatagtcaataataacttaattgtatatttttaaataagttaaagaatgtaattggattgcttgtaactcaaaggataaatgcttgaggggatggatatcccattctccatgatggacttatttcacattacatgcctgtatcaaaatatcttacataccccataaatacatatacctactatgtattcacaattttttaattaatttaaaacttttttaaataaaaaataaaataaaaataaaatttcaaaaatatacataaataaataaatctatttcagtctcccccatgatgctgcaagttcctgaggttaggagtcctatattgtactctcagagggccaaattgaatttgcctgcaatagagctgaaacacactgttcacaggaccagaaataatgagagtctaaacaatactgaaaacagcactattaaatacagaagtctcctggtagctggactttgatcttagaggtgaaagattagcaaacctgaaatgtacacttttcattgaaaccggatgcacaccattagttcaaatacaaatgtgaactcctgtgatgatattccatttgggtttcagactcactagtctctcacttgtcaaccccttttgttctgatgccaattttccctttcattcttcatgttgcttagttttgtttttttttaaatcttgaccactggcagttattttagggcatgatgacagattctaaaacttagtggcacaaaacagctactgaaatttttctctgaatggaactgtacccatgatgtgccacaccattatagaaagcaaatatctagacagacttttgacacacaaaaaattacattttaaattgcgtatttaaaatatgtgtgcaacgacaagaacatgtaaaaatctataagtacatttttcaactcacaataggatataagcaattttctttttcaaaaaaatcaactttattaaaatataattttagacaataaattgcattatttaaagtgtacaattagatgagctttcacaattgtatacactcacaaaaccaccaacacaatcaagataaacttaattcatcttcaaaagataattttctttaaatagaaatcattccaaaaggaaatctatactgaatatatgagacattaatcccctcttcttttcagaataaatccaactgagtataaattagaattagcataaacctatgtttctcaactaagggtagatttgccccctaggggtcatttgaaaatatttagagacatttttgtttatctggattgggggtagggtgccactagtatctagtggatagaggctggagatgttaataaacattccactcagacaatacctcaccgccatcaacaacaaaggactatcagcctaaaatgtcaagagtgctgaggtggagaaaccctgatgtggatacatccatgctcataattgattaggaatgaggcaatacaatattcactctctgagtttttgcatatgtttattgtcctgtctgaaacacctctccactcctcagcaaccaccctatgaagcgggtactattttctccccattttacagttgagacgaactgaggcttagagagatgaactaacttggccaaggtcacacacttagtacatggcagagctggtatccgaatccagctttgtttactctggagcctgttcttaaactgtgtgtgatactactgatctttttaaatgaaatataagttctgcatctggcctagatgcccagtaaagtttatctaagcagatattaatacaccaaatgcacacagctactaatccagtaagaaaaaaataacttcttcctgtcaattcgatcaagggtgttcaatcttttggcttctctggcaacactggaagaagaagaattatcttgggctaccatacaatacaataacactaatgatagctaatgagctaaaaaaaagaattgcaaaaatgtctcataatgttttaagaaagtttataagtttgtgttgggctgcactgaaagccgtcctgggccacatgtggaccacaggccacgggttgaacaaacttaaattagatcttttcttttcagattattgatgaatgggagtacatcttccatttattgtgtgctttctctgtgtcaggcacaaaagctttctttcattcaatcctcctgcgaacactctgcctggttattactaacacatctttaacacaaggaaccagaatctcagggtaacctaagcacaacagcattgggagttaaaccaagatcatctgggtttgcctgcttgtttaactgtaccagaccactcaattgctggtgttatggcctgaatgtttgtgttcctgcaacccccgaccccaaattcatatgttgaagccctacctccaatgtgattgtatttggagatggagcctttggaaagtagtcgagtcatgagggcagggccctggtctgatggaatttagggcctttagaagaaaagacaccagagaccttgagccatctctctctccaccaagtgaggacacagcaagaaggtggccgtctgcaagccaagaaaagaaccctcaccagaacccaaccatgttggcacactgatccagagttccagcctccagaactgtgagaaaataaattattgttgtttaagcacccacattatgggtgtcttatggcagcccaagcagactaagatggctggaaattataaaattgtaccaaaagagcattgcttcttgaagtttctctaacttcttctgtgataacatgaattttatcctctgtggtaacaagaattttacctatcattctctatgataacaagaattttatcctgttaccttcgatgtccttataagaatattcttaaatgtctttcctattttggagctagaataaaatagtctacgtaatacactaagcagcatgtctagacagagtaggcctatgcaaatgttatggtgttgcaaaacaaacaaacaaaaaacctgtaagcctttttagtgtttattgtttcactgacatatgttgcattaaacatctcttaaagctttcttcaggtgcaatcagcaatcatcaacatctttatcccaatcatagcatgagacactgaaccccagtaagctctagttttaaaattgcctcaaatcctcaatgggatttacctcttggggttgctatagggtttacatgggacaatgtttacacccattagcactgtcttacaaatagaaggtgcacaataattgcgataagtgtggtctgtggtctgtgtccacaaatggctgcatccacgtcactcaggagcttgttagaaaagcagaatcccaggccccaccccagacctatcaaatcaaaatccagattttaaaaagatttgcatccacatgaaatttgaaaagcacttagttaaattattaacagaaagagtgagttcataaagactcagaagactaagcgcagatccctgacaagacactagaaacttccttccataacaacatcttacatcttaaaacatacatgagttttggctgagccccatccccaccctaggcatcagcagggtaggaatccccttacatgggcatctaccctcatctatgcacccaattcatccccttaattcccttctttctccagcccagggatctttacaccatcagggggccagaaagctttccacttactcatcgaacattttctgctcccctttgggacagagcttttgaaactctaaagtcaagagaatctttttttctgctttgtgccaccacattccttcccccaaaggtaatgaacataggcaagctaactaaatggggccaggaaataaaaggaaatagccagggaaaaaaataaattattaatttcaaaatagtgccctgccacataaagaaccaaatgaatggttccttatgatcagagactgagggtggatggagagaagtatagcaatgagccatgattttctctctctctctttttggaggtagtattccctatctccacactcattaccactgtatacagtttgttcacccctttctgcctccttaagctgtgctcagaagtctttggggtatgtcctttctgcaaatctcacacatacacaaacacacacatgaaaaacaaacaaacaaacaaaaacctcttcagctttctacaaattggctcagggaattactgtagacctttccttcctactgtctgccatgttccctggtgttttctgctgttcttacccttattcttcctatgttggctcaaattcgccctggttatatttggaagagatctcaactttctgcttcatcactgacccagaagtcccaaaggatgtccttataggaattgcccaagctccaggtcccaaaaatccctctccccagtgttcaaccctgtttcttaccacaccacctcccgtctgctccggactcagtttggggaagaataattacactcttctcttagcacagaccatagtctgccctgtgtcagggttatgcatgtatgtgcttgtctcccctgggtggagaaactccaagacccattcatcttcatattcccctgcttattccagcactaatccatagctgtgctcaacacatgaacagaatagactggattgtggggtgaagttttattcagagttccttctttccttctgccccttcagctccccactg

SEQ ID NO: 561 - DNA, 29090 bp, Homo sapiens
taatgatggaattcctagcaccggtggagaagagatcctgaggcagaaaggccttgctatcactcttcagtcatgttgataggcaatgctacaaagggcttaagaacgtggcactgaggctgggcactgtggctcatgcctgtaatcctaacactttgggaggcccaggcaggaggattgcttgagcccaggagctcaagaccaacataggcaatatagggagaccccgtctctatacacaacaacagcaacaaaaattagacaggcatggtggtgcatgcatgtagtcccagctaatggggaggcagaggtggaaggattgcttgagcccaggaggttgaggcttcagtgagctgtgattgcaccaccgcactccagcctgggcaacagagtgagacctcatcttaaaaaaaaaaaaaaaaggccaggcccagtggctcacgcctgtaatcccagcactttgggaggccaatgtgggcagatcacaaggtcaggagattgagaccatcctggctaacatggtgaaaccccgtctctactaaaaatacaaaaaaattagctgggtgtggcggcgtgcacctgtagtcccagctgctgcagaggctgagacaggagaatggcatgaacccagggccaagaccgcaccactgcactccagcctgggtgacagagcaggactccgtctcaaaaaaaaaaaaaaaaaaaagaatgtgggcactggagccaggctgcaggctgacagattcgtatctgtcacttagcagctgttgaacctttgacaaataacctgtctgtgcctcagtttccaaatctgcaagatggagataagagtagctcctttataggactgttgtgaggctgtaatgagatattacatgaaaagcctgtagtcccagctactcaagaggctgaggctggagtaccacttgagcccaggagttcaagtccagcctgggcaacatagtgagaccctcatctctaattaaagaaaaaaaaagagatttaatctctctgtaatccccatcactttgggagtctgagacaattggatctctggagcctgggagtttgagaccagcctgggcaacatggtgaaaccccatctctactaaaaatacaaaaattagccgggcatggtggcttatgcccatagtcccatatactcagcaggctgaggaacaaagaattgctcgggcccaggaggcagaggttgcagtgagccgagattgcacttgggtaacacagcaagactctttctcaaaaaaaaaaaaaaaaaaaaaaaaaaaaatcggccgggcgcggtggctcacacctgtaatcccagcactttgggaggccgaggcaggcggatcacgaggtcaggagattgagaccatcctggctaacatggtgaaaccccgtttctactaaaaatgccaaaaaaaattagcaggtcgtggtggcggccggcgcctgcagtcccagctactccggaggctgaggcagaatggcgtgaacccgagaggcggagcttgcagtgagccgagatcgcgccactgcactccagcctgggcgacagagcgagactccgtctcaaaaaaaaaaaaaaaaaaaatcaaagggcctccgatctatgccaaccactccttaagatccctttggttctcaccaatctctcatatcccaccactgcctttcagtggccttcactcaccaaacctgttactcttcatcaaaaactgtacccctaggccctttccctcaggcctcgctttttttctttttttcctctcacctctccatcctgtccctgttaccctgttatctcagttccatatctcaaaagcctagaaaggcagacaagacagagctctccttaaaaagtgatgggcaggccagctgtggtggcttacgcctataatcctagcactttgggagatcaaggcaggaagatcacttgagaccaggaattgggcaacatagtgagacgcggtctgtacacaaaattttaaaaattagctgggcatggaggtgtgtgctgtagtcccagctactcaggaggctgaggcaggaagattgcttgagcccaggagttcgaggctgcagtgagccacgattacaccactgcactctagcctgggtgtcagagaccccatctctaaaaaataaaaaaagtgaaggccaggtgcagtggctcacacccgtaatcccagcacttcaggaggccaaagtgggaggactgcttgagcccaggaattcaagaccagcctgagcaacaaagagagagagagagagagagagagagagagagagagagagagagagagaaaggaagggagggagggggagagagagagagagagaaagaaaaataaattagccaggcatggtggcacaggcttggataattttttaaaaactatttgtatagaaggggtcccactatgttgtccaggctggtcttgaattcctggcctcaaacaatcctcctaccttgacttcccaaagttctgggattacaggcgtgaagcctgcgtgtatcgattttctattgctgtgtaacaaacaaaacctccacagacctaggggctcatgacagcacctgtttattagctcacaattctctaagtcagaagtctaggcacatctgggttctctgcttgggatcccacaagtctgaaatcaaggtgttggccaggtgtgtcctcatatggaggcttgactagagaaagatcaacttccaagctccctctggatgttggaagaattcattttcttgtgaccatattagcaaggccctgttttctcactttctgttggcaggggaccactctcaactctcagcttgtagaggtccctcttgggtcctcctcttgtggccctctccacacatagcatttggtccttcatgggagcaccagctgctggaaaaaatgattctgttaggtaaaaatactatacatttttgaaacatgcaccaattatttagctctgtgattgtgggcaatttcttcaagcagcctgagcctcaatttccttatttgtaaagctgggaaaacaacgatgcccatcttggagggttacaggcacatagaaaaacaatcaataaatataagctgctgtttacatttgttctttttttaaaaatttttaaattttatttatttatttattttgagacagagtcttgctctgtcatccaggctggagtgcagtggcgtgatctcggctcactacaacctctgcctcccaggttcaagtgattgtcctgcctcagcctcccaagtagctgggattacaggtgcacaccaccacgcccagctaatttttgtgtttttagtagagacgggttttcaccatgttggccaggctagtctcgaactcctgaccccagggcatccactgcctcccaaagtgctgggattccaggtttgagccaccacaccaagcctacattagttctaacgaatagacagggtctagacacagtgagattagatgagtgagggacagggttccctacatggagaaaactgcaagagccaaatcttggaagcaggaaagctggtggtttatttgtgaagggtgtgtgtgtgcgtgtgtacagagaacgctgaaagagtaggtgaacacagttttgcttatccctccagtcagaatttactggatgcttactgtgtacccagtaccatgaaagggtgcccggccagcagtgtgaattcagcctggaagtgggagggagccaaggaagagctctgagttggagagggaagtggtctaagcttcgggaaatttatctgctcctagtagagtggttgactcagcaggagagaacccccttctcttctgcaccctctcctccctagcctcaaagcctgctaaggacccagttcccaagcagagacccaggagggagttgcagaatctggccctgtctggacaagacagacagggtgcgactccagatgccagttcctttctttctgctcctgaatggccccaaagctatcccttctcaccacaatggtcaaggagggatacagcaatttctcttttaaatgttacacatagggctgggcacggtggcctctaatcccagcacttcaggaggccgaggtaggaggattgcttgagcccaggagttggagaccagcctgggcaacataggaagacccctgtctctaaaaaaaaaattagaaaaataaagttctaaatgtgggaaatcatgctgggcactcaactacagcagctcacttgggtacttgtccacactcacaaatatagccctgggaccccaaagtcactgtcccaccctcacaccatgggcagatggactcaaactaagccaggcttttggctttctgccacttgcctcttctctctgaagtgaatcctgtcctgatcatcacctccttgctgacagggccattaagcgcagttcacacaaacaaaccacgatgccttgaggttgagactgggaggtatgttaagggagcatggagccagccattctgcagatggggaaactgaggcaaagaaaaaggaagtgacttgcccaggctcaggcagtgagcccaggacagaccaagactgaaatctgacaatcagcccagggtttatacacacacacacacacacacacacacacacacaccccacaatttgagttacgctcaaattcagacatcgtgggttgaacaacaaagctttttttttttttttttttttttttttttgccagagtcttgctctgttgcccaggctggagtgcagtggtgcgatctcagcttactgcaacctccacctcttgggttcaagtgattcgcctgcctcagcctcccgagtagctgggattaaaagcacctgccatcactcctggctaatttttgtatttttagtttcaccatgttggccaagctggtcttgaactcctgagctcaagttgtgtgccggccttagcctcccaaagtgctggcattacaggtgtaagccaccacacctgggccacaacaaagctttttgaatagaagttcttggaatatggcctcttgttaatgtgtaggcccatctgttgggggaatttggggattatgcctgctctagctggctttaccaattaaatgttttcccctctctgtctcagttttttcaccggtaagataggaagaatttattatctatgtcagagggattcctctcagcctcactctctatctcaggtcggggggcaggggagggtggggaaggaaaggagtggtgggccagtcctccagctaagcacacagactggcccatacctgcaagtacacacaaggtcccttgagcgacacacccaggctgacacatcactttaagggggcacggaggggggcaggcagtgggagtggcaagccagtggggagcccccaggtgagggcaagcccgaggaatagaagggtggcctctttttttttatttttgtttttgagatggagtcttgctctgttgcacaggctggagttcagtggcgtgatctctgctcactggcaacctctgccgcccggattcaagcaattctcctgcctcagcctcccaagtagctgggaccacaagtgcatgccaccacgcctggctagttttttggtattttttagtagagacagggtttcactatgttggccaggctggtctcgaactcctgacctcaggtgatctgcctggctcggcctcccaaagtgctgggattataggcgtgagccactgcgcccggcctgaagggtggcctcttgacctccagtcctgcagcccatgaaattgggcaggtactcacacctgggcatgggttagatgggcgtgggtccctagtaactctgagtatgagctcatgtgcatgtgtgtatatgtttatatatggatgccttcattgtatgcacagatacccatgattatccatgtgtgtgcataggaatggcaccctctgtctgattggaaatgagactccagagttaccccagcatgatgttcactgccttttttttttttttttttttttttttttgagacagtgtctccctatgttgcctaggctgaagtgcaaccacccaggctcaattgatcctcccacctcagcctcctgagtagctgggtcttcaggtgcaggccaccacacctagctaatttttgtatttttaatagagacaggattttgccatgttggccaggctggtatcgaactcctgggcttaagcaatcctcctgccttggcctcccaaagtgctatgattactggcctgcactgccgcgcccagctctgctgcctctttttacagcctgccggcccagaccagagtctcagaatactaagcccactttctggggccagggtcagtagatagctttgctgctgtatgattctaagcaagtatcttgacctgcatgtgtctcagtgcacctcagtttcctcacctataaaatgaggggtttggatgagttgaggtctgaagcctcctccagcccaggtaataaatctttgtagtggacaggaggaataggtcctaggggtttcaggaggggacttccatgggtacctctgactctacagagaaatggaagactgagatctgacttagcagcctagaaagacttagcagcctagaaatggggttcagctaattctgggaacagagtccggtcacttaaggtaccagagtgtagccaagagcccccttttctgggcttggggaaccagaaccatgtgttcaacagaccattgcctgtacacagggtagagagtgcaggtgtatactcctgaaccagccacccttcttttttttttttttttttttttgagatggagtctcactctgtcgcccaggctggagtgcagtggcacgatctctgctcactgcaagctccgcctccccggttcacgccattctcctgcctcagcctcccgagtagctgggactacaggcgcccgccaccacgcctggctaattttttgtatttttagtagaggcggggtttcaccgtgttagccagaatggtttcaatctcctgacctcgtgatccgcccgcctcagcctcccaaagtgctgggattacaggcgtgagccaccgtgcccagcccccagccacccttcttaagcttcaagctataactactgagcctgtgatgaaagtctactctatgccagacccccacaagctgggtgcgggcagtatagggacaaagactctgcccttgggatgccaaccatccacttgagaagacacatacacatacaatgagtcatcatcacttactgtttatggacaaataaacgtccatcaaggtagccatcaactcgtgggtagggacaaggaaggctacctagaggaagaaagggtgagtagaatctctccctctctctctcttttttaagagacagggtctggctctgtcatccaagctggaatgcagtggcttgatcatagctcattgtaacctaaacccaagtgatcttcttatttcagcctccctaagcagctgggactacaggtgcatggcatctggctaattttctcattttttgcagataagtggtctcgctatattggccaggctggtctcaaactcctggccccaagcaatcctcctgccttggcctcccaaagtgctgggattatggctgtgagccaccacacctggccaagtagaatcttgaagacaggaaagatctggatttcagaaagttctgaagaaggcattccaggcaggggaaacagcttgagcaaaagggtggaggtgggagagtgctgtagagtcaacaaggagtttgactttagcacaagatgcgtgtaggagaaggggaggtgaagctggagagaactggggccggagcatggggggcatgagttctgtgttaggagtgtggggctttaggagccacatcaggttttagaacaaacaagtggcttgacaggagagacgtgttagggattatttaattaaagtcagcaagtaggtctgaaagggtatgaggttagcaggaagtggctgtgatgggcagaggctcagagttgcatggaatgaggacactttgggtataacactccaagggccacaatgccactcccctctccacccctcagccttgggttatttttttctggcttcttcccctgtcgctagggttaaggagtcccttgggggtttcagatgaggctgggatagagttttatcactagagtgccgggcacggtggctcacgcctgtaatcccagcactttgggaggccgaggcaggcagatcacaaggtcaggagaccgagaccatcctggctaacactaaacatacaaaaatacaaaaaatacaaaaaattagccgggcgtggtagcgggcgcctgtagtcccagctactcgggaggctgaggcaggagaatggcgtgaacccggaaggcggagcttgcagtgagccgagatcgtgccactgcactgcagcctgggcaacaagagcgagactccgtctcaaaaaaaaaaaaaaagttttatcactagatcattaacctctggcctaggtcacctccggcctccttttgggctaggtgggcagttctcggaccctcccccaccagccctgctctgctgacctagaacctctggccctggagattctgatatgtgtatttgtggtctcttctcgggcatctcccaggccactgggagagctggggcctagagcgtggggtgggtggaatcctgagggcagagagtgtggaagaatcttacaatggcagctctagagggaagcctggatatgtttgtttgacaaactgagacccagagaggtaacatgacttgaggtcacacagcaagtctagggcacagtcaggactgaaagccaggactctggggaggctaaagcgccctgaggtttagaccatctggttcatgtagagaatggagagggtcagggctgggagctatgggttcaaatcctggctctgccattgactgtacttttgtgacctaagaaagtcacttgagctctctgagtctgtttcctcaactgttaaacgggacaatatctaccttttgggttgttgtgaagataaaaaaacacacccatagcacaggtcgtggcacacagtaagtgtgccaatacatgtcagctagtggtatggtggtgcaatagtaggtgcctaataaatgttgaatgcattgttgaacatgagttcacacgctaacagtgagattgtgagactcagctttcccacgtgtaaatcaggactcataatcagtccctgtcctgccacttctttacagccccggtagcaacatagattaaataaggtatgtaaacgttcaagcgcggagccgtctcaggtcaatgtttactcagcccagggcaattcctctccaagtcctactctgcgaaatttcacgtcagcttcactaacttctctacattcccagatgctccccgggaaccgggggttggggatgtccctcttttctcaagcccgccgagctgaggaaaaacggggtgggaaagcagagtgtgtaaggctgaggaggtgagccagaggggggagggagagcaggaataagggcagtggggagaatgcaggtgcacggacgtggtgtgggtcgagaacagggtccgcatcgggggacttggatataggatgcagtgaaaggatttggggagcagtgggagaggtgagggcgctgcgatccgggaagaatcaggaaaataaggagccggtaggagggagtggagatcctcctcgcggagagctcgccgcggcgcagggctcccagctccccgcagctgcctccccgaacactcaccctcccggttccgagaacgtttcccggcccgagcgcccggcccgcaaaccgggaggggaggggaggggaggggcagggggggatccgcagcccgggattggccgccgccccgccagccggtgacgcgaggcgggcgggcccctttgtgacgtcacaatcagctgtttgaacgttccaatttgtgccgtgagccccgccgcagcggccgcacagactcaaagccccgcgggcgagctcagcagcccggagcgaccgcggccccgccgcctcccccgcgagtcccggcgatgcggcccggcctgtgagcggccggcgaccctgggacgccccgccgcacaactacctcaacgccgtgccgcccccctcccgcccccaggtgagtcccgacccgggtgggcctgggggctcccctgccacggacacgccctgcgccccccgcgcccgggcctttgtctgtctccgccggcggccgccggggccgcgttcccggctcccgattggttgccgcacgcccggtagaccatgacgtcgttctatttgcatatgacattgagacgtcaccaaggccggtaccgcccccacaggctcgggtcgcttgtcctcccgtgacccggtagccgctgtgtcggggctgggccctgggtgagacgctgcaatccaaagggggctgcagggggatcggcgatttcctaggcttatccaggggctggggtcaggcctctgatcccctactttctctttgcaacctgagaaggagtcagacggcgctgctgggcctaggttgagggggtcgtcaggagttcagggctgcatgggactccaggtggttgggacagcaccagatggtggtgggatcccctccctccggctccagactccgcccccagggactaacagaataacatcctcctaatccctgatttgtgtgcagcgccttagctgatgtcactcctagacccaaaatgaagggtcttagaccccagtgcatggaaggggcaacaggcccagagaggaggattagctctctcgaggtcacataaccaattagagtcatgctcactgagtgacagatggattattagccaggggcaaagacataataggggctcagtacaagtggtaagatacacatcctccttccactggggacccgatcttgggctcagccttatcacggtttgataggctcctaggtgtccttactcctggacccttttccagggaatctctggagattggttcaccttttgtggtcctgaccccttctgtcctcactgtaccttgaagtcctagagtccaataaaatcgctgcctcccagctgtttggatcacagagaggtgagtcattggctgcctcggggtgtctccagggctgatgttggggtggagggtggggtgagggttccctctattggccctttaccttcccaacttcctaggtcgtcagctaggaagggcctgacctggcctagtgcagacaattgcaggtgttttgctgctccctcgtcacctctgcccacagagagtataggagaagggataggataaggagagtttctgacttaacaagtggatgggcctagaggctgaaccaggaactccattcctgctgggagtttgctcaaggatgggctgggggtaggggtggcttagggcacaaatgctattctgggcagagctgctgtagttattaaagggaatggttctccctggagcagaactgggaatgtgagaaccaggaagctggcagggctgggaaaggaaatctgggaggctccccaagtggtcaggagagggggcaggcactggctggctggtgactgctttcactcctggctgtcactgacttgctgtgtgacctcaggcagggagcttttcccctgagcctccctcccctaaacctatctgaaatttggggaggcacagtgcaggctctggtacacagtgggtcttcagtaaatgcatgctaaatcttggtgccagtaaccccagacccttttgtagctaggcgaggggtggtgtggctaggtcaaggtctttttcacctccctgtacccctgcatcattgtattcttggggattgtttgctgagtctttcctgactgtgtacactctggactggatgcacagtaacgtgggactaggtctgccctgccactatctagccatgtatttttggatagatttatgtcttctttctgatcatcagattttaaaatgggctgggtgaatatgatggtccctgaaacagctcttaacttctctttcatattccatgaattagtaggttcttggaaggaggatgtgcctcatcaaggcctcgatattcccttccttcaagaggggccaaactttctgggcttttggtaatggagtcactagctccctgtggctacatatgggttgggatacatgaattgtgctgggtggacactagttgggggtggccccaccttcttaatccctgtagatctcccacccccatcccaccagagaagccagcatcttaagcctactgtgagtctgcagatgtggaaatattctcagggtatggaagtgaggtgattctgcagcaagtgtgaaaacatttctagggaatgggggaggtagcaataagcatggcaatactgcaggtggattagcagaaagaggagaaatgccttcagggaagtctggacatgcccccaggaagttctacaggaagtgtggaaacacccttagagaatggtgacaagtgtctcagcagcaaaaccgttgagcatctttagggaacaggtgtggagagtcagtcaggcttcaggtactgggggagtatggccagcagcccccagccaagctctagtcctgaggtaggctggcatggggagggggtagatctagagctaccaccttggtgtttccatttctgcagtagggggcctccctcttcatcttcacccagggaaggattggttaagggcttacctcggtctgggtccaaccctcagtgctcatccttaagggctcctgggaactgacagctccctcccttcatcatcacctcccactgacctgctgtctcactgagcccaagcaacctgatcttcctcctacccctggatgctgcccttgaacaggagcctgggaaaagggggtcagaggggggagggcctgccggcatgccatctttacacttcatatgacagacacaaccgaggtgtgccaaatcacatggtaagatggtagcagttctatgggatttctgctggccagtgcttttcaaaccacacaggctccaggagtggttcttaatctctggggtcaaagattgctgtttaggaaatcatgatgaaaaccaaggtcctttttcccagaaaaatacacatggaccatgacccctggccaccaaattgaaaatatcaaattcagacagacacccagaaaaggcaatagaatatagtgattctgggtgctgcctctggaatctgattgtgtggattcaatcccacctttgtctcctactagctctgagactttgggacagttaacttctctgagcctcaatttcttaactgtaaagtaaggacagtaattatccacttcctgtagttgttgtgaggattacatgaggtaatataggtaaagctgcttagcatagtgcctggaacataaatgttagctatatcattattattattttgagaccaagtttcgctctgtcacccaggctggagtgcagtggcacctcgcaggttccagtgattctcctgcctcagcctgggattacaggcacctgccaccacgcccagctaatttttgtattattagtagagatggggttcaccacgttggccaggctggtcttgaactcctggcctcaagtgattcacccacttctgcctcccaaagtgctgggattacaggcgtgagccactgtgcccggcctagctatattataatgataacaagcagacaatatgggcaatttcctccctgcctggagaactcctatttactcctcagagtgcagcttggatgtccaattctctggagaccttccctggcagagctgtgtcatgtgtcactctatgttcctaaagcaccctgtaataataactaatttattagtttgttgagtgcttaccatatgcccagacagttctaagcactttataagtgtttagctcatttaattcttcctcctccatctttttttctcattcaataactttggtatagctcatttaattcttattagagcctggaggaggatactattattagcttatttaattcttataagagcccggaggaaggtactattatcattgtcttttgacagatgagaaaactaaggcacagataagttaaataactttctaaaatcatacagaagataaaaaaaaaaccctggatttgaatgcagaaagcacatcttcccaaagcgtccgcacacatccccgttgtgtgtacccttctccctgctctgggggtgatatcttctggcctcttccccaggccaggagtggggtgaacctcaatcagtggtggctctcacgtccttctgattcccaggtttttgcactgccatagggcgcccccgtgaggcgcttcgccccccaccatgttccagcgcctctccagcctcttcttcagcaccccctcgccccccgaagaccccgactgcccccgcgccttcgtgtcggaggaggatgaagtggacggctggctcatcattgacctgccgggtgaggcctgggtctgtctcctgggcctgtgaagtcattctaagggcagatggcctagcagcggaggggaagggcgctgctgggggacgggggagtcccccaagcctactggaggtggggtcacggggccccttcccatgaaagccggggctctctcctggcggcccaggagaggcccgcacgtcaggtcccctagggcagcagggcgagacgcctggcccgtgggtgccccggggcgctgcggacgggctgcgggtctgactaacgatgccctttctctccccgcccccttgtccggtgtgtgtgtgtgtgtgtgtgtgtgcctcctcgctgctcccctcctctgcacggctcccatcccgcgccccgtagacagctacgcggctccacccagccccggggccgcccctgcccccgcgggccgccctccgcccgcgccctccttgatggacgagagctggtttgttacccctcccgcctgttttacggcagaggggcctggactcggtcccgcccgcctccagagcagtcccctggaggacctcctcatcgagcaccccagcatgtccgtttacgtcaccggcagcaccatagtgctagagcccgggtccccttccccgctcccggacgcggccctgcctgacggcgacctcagcgaagggtgagcgggccgggggcggagcctggaggcccagggagacggatcttggaggccagggtccaggctaggaggctggggtagtggggccaggagcccgccccgcgctcgagggggtagcggccttgggagggttgcctttgagacaaagtggggggccggtgggcctccgggcgaggctagaagcgggcctgaggacggaggggcggggcttgagagggaggggcgtggccaagaggctggggccggggttggaggcttgaggagcgtggctggagcgcctagggagtgggacttaaacagaaaggcaagggtggaatagggggtgggggtccagtctcccccgaggtccagtttacctgttaagggctagaaccgaggaggcacctccgggttggtacccacaagaagggcgtcgggcaccccaatctgaacagacacagaactgagccgaagcaagggtgggagatggcagcgccctctagaccccccgcccagcttacccggcttgaccgagcctggctctgtcctcacagggaattgacgcccgcccgccgcgagccgcgggccgcgcgccacgccgctcctctcccagcgcgggcggcgctgctggagaaggcgggccaggtgcggcggctgcagcgggcccggcagcgggcagagcgccacgcgctgagcgccaaggcggtgcagcggcagaaccgagcccgcgagagccgtccgcgccggtccaagaaccagagcagcttcatctaccagccgtgccagcgccagttcaactactgagcgtccaccggccgcgccacgaaccccttgccgatcccgatccctgtcgggctcctccgactcctcgggctggacaccgaaacctcccttcttaaagcgtgtgaggttgggtgatagccgttccttccccgacaccctcaatttccccatctctgatcctctaatctgcctctgaacccattcacccttcaccctcactcctggtccccatacccagcatctaatcatccatgccccctactcctggcccctccatcctttcttctctggtccccatccctgtctctccctttcacccttgccctccagtcctctacctctggcctgcccctatttctgaaagcttcttccagtccctgatctggctcattccccaccttcaactcccaccttacatgtctcacactatcccatggttggcattacactcactcctgttcccttattcttcattcccagtaattccctaccaaatggtggggaccctgagcccagctctgaccaggtagagcctgtgcagcctgggctgctgtcattgccctccagtaagggctcagggttttgcttttagtctccccttccttctgccttgggggcggtactctgtggagctgcttaggcctggaaaggtacagtatgtagaagaggactgtgagacgtgagttagagggagaagatggagggaatctagggaacgaggcagcctattggagatgcggacaggacagacacgttgagaagctgcagggagcagggcaccaagggagtgtgcactgtgcttgctcagagaggccaaaccctgctcccaggctgaagcctggagtctgcccccacttcccttttctataatccacccttctgcaggccctgaaatctgaagggcttagttagtaccttgccactctacccccaacacgtcacccgagtagaagctgggcaaggccctaccatcctggccgtctgttcacaagcccaaggtgctagaactagcttaggagacatgcaggccacagggcttctaggcagggaaagggcacacaccctaggtcagcgtgcagagcagtgatgctggaggacacaccatggggtgaagccatcccaaggctgacagctcagtcttcaccttgcctctggccttgtatttcacaccctgctcagtatggctagccagcagtcctgagtaggagtccaggactcccactgtctcaatctgcaaattgttcctatccaggttcagggccttcagggggcctcttttcattttctcccacaggcctctctttctttctaggttgctggggagaaatgggtaccctatgatccccctccccttctcctccagtaaatacctggaagagggaacctgaatccctgggggagacagaaggggcaggggccaccagcctccccttcttgtggtgagactgaattttgggctcagacaccagcaacagcctcttgggatgccctgagttgcttcccatttcctctttctagccgtccttttctagtgtgtgctcactcttcctaggaacttttaagacttcttggtacctatgaacataggtcctcccctcaccccaactctaggtttccaggcctcacagccaagctgaagcttggagaaaactctgcattcccatgagggcaaaggcagctgccctccctgaccctatagccccaggcctcatggggggtatgtggggaagggatggggtatccccatggatgctgggatgaggacagaggaagacctgatggggtctcctattccagggaataagccaaattaacactaaaaacggatcaaagctcccacgccagtccactagggccccagtagttgacagccttgctcctctcccaagttctccttcagaacctagttgcttttattcttccagctaccacttgggcacttcacagccagcctagggtcttcggcacctccaagagctgaatctccctccaacccttcttgcctactcctcactgccagctgggacctaggctcagtcctgtgtggtgcccatgatccttctggtgggggaagagtttaagttatagggcatttggctcaaattttaaaaggccttttgtttacctatatttctggaggctcctgtattctagaacccaatctctcacctgcttggttgcaaggctcatatttttttgtacctttcctatagattctgtagcatttgagtgtggcaatattttaattgtgtatagatttctaagaaccaacactactcagtctcctgctagtctgactcctgaagcatcagcccttgtcatactgtattgactgtgtacgtgcctttcaccttgagcatgcttcaggatttttttttaaaccacagaacttgaatacatgagggaaccagagttcaaagtcctatgcaaccttaggagggggttagagagtctgttttgattgatgttttctgaggccctagaggagtttgtatcaatttgtgagtattaatgtcagtactaccagcactttgccaaaactgtcagagggacccgtttctagagtgagtcccagttacatcaaacagtgacttccagttattccccagtaagtctgagtggttccttcaagctgggtgtctttccagcctttgccagtctagccccagcagggcaccgtgtatgaatgcagtttggtgctgttttagagtatgcctgctccccagccccctgcctggaaccctctgagcaacttgctctgacctataatgtcttaggtgcaacacggaccccaccagagctcttggatacccccctagatccatgtggctttatgtgaggggactgaatgcagacacaccatagcccccttctactactttccctctcgccctgccacctagttccacatggaaccaacaagttgagtgcatccctgttgggtgttttgtgttgagactggctgaaatgaggagactttgaccatgtgacgtgtcaacagactcaaggagacaaccacctcaactgggtcatgtggcatgcctgtgtatgtgtgtaacagaattctgattgttagactgtaatgctattcctctatgggagaaaaaaattaatataaagaaaaacaaataaaaatatatttaaagcacatgatcctttctgcctgagttgagcttaagtatgagaagcatcttgtaatcttaagcacagtagtggcataggatattatgataaagctggccttggttctggtgtgtgtgtcatatgggagaggaagaggggagataagcttactgggaacagagccagacaatggggtctgactcataaatgactactgttagaggatccttacaatgcaagacacatacatgaagacagctgaaatagagatgagaataacagcatgacagaatgaccaaactcatccttgtggtctcaggcactgggttagagcaagggcaagtagccactggaggggaaaggatgaagtctaatcctgggggagatgcagcagaaggctgaagcccaggctgagacaaggccagggccccaagcatcagagtctcctcaagttgcaggtagggtggggcagaagcagctggctttggagactacacacattttgaagaaggacagccagagtgaaatgtagtggacatctctgaaatatacagcacaaaatgacccctttaatttgggagctgctctgtctaaccacagaactaaaggtggaaacctgacctaaactggactagatttttttttttttgagacggagtttcactcattgcccaggctggagtgcaatagcgcaatctcggctcaccgcaacctccgcctactgggttctagcgattctcctgcctcagcctccccagtagctgggattacacgtgccaccatgcccagctaattttgtatttttagtagagacagggtttctccatgttggtcaggctggtctcggactcccaacctcaggtgatccacccgcctaggccctccaaagtgctgggattacaggtgtaagccaccatgcccggccctggactagattcttgatgctggcacaatcttacaggccagtttgggcttacctcctgcaaggaggagatgtcagcacaattgttttggagcaatccaccatgcaaatggaggagcagatatgtgacatggtgaaaaagtgccatctcagctgctgacagcttcctgtccctagaaaatcctgggtggccattgatctctaagttggttttgttatttgcatcaaaagaaatctgagcaatatatatcaaaatacctggcacagtgctgaacagggctagtttcttcaaagccaagaatgaggtgagggagcaagtatgtacattttcctcaacttgccaggcgggcatctcaggttcaatgaggactagataggaattccatccacaaggctgtgtctgcttagttaaggtccaaagaaagagctgatcacccaaaaatcccttaccaataacataactttatgttctatgacaatgacatttatttaacacgttatttcacattgtacaaatccttagattctctttattcactggtccatttctacaacaaatacatccaaaacactatataataaaattatttacaacatttccaaatgagaagattgcttttgcccccactactgctattcacacacagtacttccacggcacaatacatcattaggagatctaaaaatgctcaccctgtactctaggctgcttaggaaatgtgaaaactagtaacatttataatggcattagctcctttcaatacaagacaacattttagaaaccttgaacttcaactcgcaacaccaaaagggctcaacagtcctgctttccccattgcactttatgaaacaggttgcagggactaggaaaagggccacattattaaaattactaactgtacagaaattgatttaaaaaagtcacagctcaaaattgctctttgtaaaagtcacacacatttccaagtatcaagtcgcagtcctgcttgtttacttggattttcttcgcttggattgcaccgcactggttatgtctgtgggggaaagaaaggacatgttcagtggaagtaactctttacagcagtgccctttagacagtccacaacaagcagggcagacctaaggggagccctactcaactcagaatctgtctaaggggtgctctgaatggagagagtcacaggctttgcttgatgacttacgtgggaagagggtgtggtcctgcattgggcagaattggaatgtgacagaggtggtggcgatgaagcacactgactagagaaagtgcagggtggagagagcctttgtagctgggcaattcacccactgtttccctcaccagttctcatcataaaacgaagtgtaatagacagactgacaatgcttttggtgagaaatcaacgagtaatgccataagcaaatgagtaaattctgttagaatgcaaaaaaaaacctgccttgggatcccttttggagccaagctattgtttcacagtaaggaaccatttttgtcatgctatagtcaaggtctaaacaacatgaccatgggccttggtcagtgagggtctactatggcccagccagttatatcaagattgtggaaggctgggcgtggtggctcacgcctgtaatcccagcattttgggaggccgaggtgggcggattgcctgaggtgaggagtttgagactagtttggccaacatggcgaaaccccatctctactaaaaatacacgaaaaactagccgggcgtggtggcgtgtgccttaatcccagctactcaggaggctgaggcaggggaattgcttgaactacggaggtgaaggttccagtaagccgatatcccaccactgtactgtagcctggagacagcgagactccgtctcaaaaaaaaaaaaaaaaaaaaagactgtggatacatacagtcatgaatgcaattcagaataagcaacggcctgctctgagcccaagtgagcctgaaggcttcatggaggaggtgggaactgagtgatttacacacagaatgacagtgacatacagggaaatgactatgttttgattcctttagtttctcttgtactatcagtgttttaacttaatcttatgccagacttaaactgtgtttcttaaaaacgttttggccaggtgtgatggctcacccctgtaatcccaacactttggaagactgacgcaggaagctcacttgagcccagaagttttgaggccagcctgggcaagatggtgagaacccatctctacaaaaagaaaagaattagctgggtgtggtggcacatgcctgtagtcccagctactcaggagaccaagtgggaggatcacttgagcccaggagttcatggctgaaggagttcaaggctgaagtgagctatgttcatgccactgtactccagcctgggtgacagagaccccatctctatttaaaaaaaaaaaaaaaattctacacaaagttatggcagagtacagtgaatagcctgaagctctccaaaggtaaacacttctttagaatctcatattgacttcaaaaggtcacctttatttcatattctggttttaatatgaaaataatgttctaaaattacttctcatcaaggagaaaaaaaatgcttctaatatatcaatacaaaagatgaatcagatttacccatttctggtaactaggctgaattttctgatactgcatgttaggttgtattcaaggcaaattttcctttgtcttttgtatcataatattttgtgaacccagactctaataaatatgtagattgtaaggaaaaatttcactactctgttagctaaggtgactgctaagaagtgaggcctaggccaggcgtggtggctcatgcttgtaatcccagcactttgggagtctgaggcgggtggatcacctgaggtcaagagttcaagagcagcctgaccaacgtggagaaaccccatctctactaaataaagaaaattagccaggtgtggtggtgcatgcctgtaatcccagttactcgggaggctaaggcaggagaattgcttgagcctgggaggtggaggttgtggtgagccgagattgcgccattgcactccagcttgggcaacaagattgagactccgtctcaaaaaaaataaaaaaataaaaagaagtgcggtctagatgaatttccaagaggtgcccagtacagtaatttcattcaagcctctgttggtggaaatttcagtatgtttgtcttctcaaaggtcatgtttttttttgtgccatgtggtagaatcagtctttctgatttactcattagtcttttactaatcagaagacagttaatctgccaggatgttaataatggtgttctttattttaattcatgtaaattaaagagtctcacacagcccacataactccctaaaatcaactcttcaggtccaaatctcaagcgttattttcactgcagcaaatttgtcatttgcagtaaaaataggcagggtttttgtcttgacagtgttcatcctcagcaaaacattcattaactaggtcaactttggaagcttttcccttgttgtgatatgaaggatcaagtggtatgtctgagaaacatatgtggctgggaaaagaagtgggtagtggggtgtgggggagaagcaacctcaggctccccctccttccttgcttgttcccatttgtcactgctccgaagcacccaatgaactggtaggttgcctctgagcgtgaatcaatgagtggggtcaggaataaacaaatgacttgtgctagaaactgcaaaaaaacccacaaacacaccattaaaaaccctcatcttttggatactgtggttggtggggagaaggatgtaaactttcatacttccatgaggaaaaaaataaattttaaactgagtttgaagtctctatcaccttccctggataaatccagtcaatctgagacatagagcaaacctcagactcaacatgtctaaaaccaaacttgggattttcacctccaacagtgaggtcctttgccactgttccccatcatgtctgaaaaaaatctgtctgaaaaaaacatcttttgatgagtttttttgttttggtagttgattttctactccctccaaaatgttaccacttttactactctaatgaataggcaaatcacctttttttttttttgagatggagtcttgcaaattacttttttttttgagacagtctcggattgtcgcccaggctggagtgcagtggtgcgatctgaactcactgcaacctccaccccctgggttcaagcaattctcctgcctcagcctccctagtagctgggattacaggcatgcaccaccacgcccagctaatggttgtatttttagtagagatggggtttggccatgttggccaggctgatctcaaattcctcacctcaactgatctgcccgcctcagcctcccagaacgttaggattacagaagtgagccactgagcctggccacaaattactttaaggtaagaaattctaggtaagtgatgtagaggctaatgatccagtcagggtgtacctcagactgtgattggcacgctgttcctaaaggctgcctggcctgactgtgaacctaccttcagttttttaactatcagggattttacaaaattagtgtctcttaacagatagacaaatagttcaaactctagcagtgtagtcaaatcatttatatccatgtcttagaaccaactgggtggtaaagaactgggtcaataatagtcttttaagtgactgtccaactatgtcactgggggaacatttaaatttataacctaataaagggatttgtttttcagcctggttgcctcattttgaccttaagcaaatttgaccaaatctacagtacaaggctctacttaatcctctagtatgtgacctctaccatccaaggagctttagaaatggactttgaccttgctcacatcattgtgcctttcactgtactatttctatccgagacgtctaagtaattgtaaaaaattctggaaatcggcgagatgcggtggctcacacctgtaatcccagaactttgattagcagaggtcggcagatcacttgaggtcaggagttcaagaccagcctggccaacaaggcgaaaccccatctcttctaaaaatacaaaaattagccgggagtggtggtgcatgcctgtagtcccagctattcgggaggctgagccaggagaatcacttgaacccaggaggcagaggttgcagtgagttcagatcgcaccactgcactccagcctgggcgacaatccgagactgtctcaaaaaaaaaagtaatttgcaagactccatctcaaaaaaaaaaaaaggtgatttgcctattcattagagtagtaaaagtggtaacattttggagggagctctccagcctgggtgacagagcaagactctgtctcaaaacaaacaaaaacattctggaaattttccttcacaatttgcatggttggtttcaaaatgaagctactacagtttcaggtggttactcttcagggttttctcccacgacattataaatgtatgttcacttgcatatctacagtaatacttctgttttaattcagtatatctttataccctgtgtttttttagacagtttcttcactggctgtgggtagggtggggctatcacctactttgttgtcagagggacacccagggctgctgataattacagattgctctgaactttccttaaattaacatattttcctggttccaaacttaaagctttgaacttcatatttttaactaccttttaaaaaaataattacctttttcccagttgaaaatataacaacaactattctaaatggaggagtaaataatgataaagcaagctagaaaaatcatttgtgtttttgtggcaaattcatcatgtcaggaaggaaaactactcatttgcatgtttgtaaacaacacatctgatcaggtgcaattttaaaaagtgatttgtggtagctaatttttgtgtaattataagtgacccaaccaacaaaaacaatggaccaaagaatgaccaaaaaccatgtgggccttcctggacttgcccagaaatcatccatcccacctgctctgatctggcagtctggcaggccttggccagcatgatgtaagcaaactcggctctcgcagcaggagcatgattaatgtcactggttctccaacaatacaaacagcaacacttttaattacaaactgctcatagtgtttctcagcttcagagattttcatgaaaaacacagaatgtctctgattttgtttgcatatgatatatatgaccaaactcttattaaatgcaaaaagaagccctctttccccctcaaaactttacacagtgctgattctgcaggaagatacttcactcatatttcaggtacccagcactgcatatgtccccacatttgaggtgcatccattttagaaaccagcttgatatttggtgatcacattctgggtatgggtttaaatacaatcacagtaaattattttataacttggttcacatttttggatacaatatacaggccaaaaatatgcataattattctttaatttggctccaagagctttaatactgaaaaaccaaaagagctacagtactcatttctgatttaaaaggtaactgtgatactacaatatatattttttggtttttgtcccacgttcctggctcacagctcctataactcttgtaatttcctaagtgagccatcttttgttaaaatatttggccttttgcccatggttcctgaaacagctctgaggttgagttgatcacaaatggccaactcttttatcaatcatgcctatgtaatgaagccccactaaaaacccaaaagggacctatctccccttccccttcttcctctatacaaaaaaaaaaaaaaaaaaaaaaaaaaaaacaacccgcaaaacccacaaaaggactgaattcaggggcttcccagaaggtgaacgagaacacatctacctgctaagagggtggtgcaccaactccacagggatggaagcttctacacttgggatccatccagaccttgccctatgtatctcttcatctggctgttcatttctatcctttaaaagtggtccccaacctttttggcatggactgggggttgcgggggagacagtttcaggatgaaactgttccacctcagattatcaggcattagttagattcttataaggactacacaacctagatctctcgcatgcacagtttacagtagggttcacactcctatgagaatctaatgtcacctctgatttgacaggagatggagctcaggcagtaatgctcgcttgcccaccactcacctcctgctgtgcggcccagttcctaacaggccacagaccactaccaaccagtccatggcccggggattggggaccactgctttaaaatatcagggcatagtggctcacgcctgtaatcccagcactttgggaggcgaaggtgggaggatcacttgagcccaggagttctagaccagcctgggcaacatggtgagtcctgtttctacaaaaaataaagaatttagctagccatggtcatatgtgcctgcagtctcaattactcaggaggctaaggcaggaggcttgcttgagcccaagagtttgaggctgcagtgagtgatgatagtgccattgcactctagcctgggtgacacagtgagaccctgtctcaaaaaaaaaaaaaaaaaaaaaaaaaaaaagcaaaagaaaaagccggctgggcatggtggctcatgcctgtaatcccagcactttgggaggccgaggcaggtggatcatttgaggttaggagttcgagaccagcctggccaacatggtgaaaccctatctctactaaaaatataaaaattagctgggtgtggtggtacgcgcctgtaatcccagctacttgggaggctgaggcacaagaattgcttgaacctgggaggcggaggttgcaacgagccaagatcacaccattgcactccagcctgggcgatggagtgagactccgtctaaaaataaataaataaataaataaaataaaagtaaaaattaaaaaaaaactttcatatgggaggccaatgtgggaggatcacttgaggctaggagctcaagatcagcctgggcacacagggagaccccatctctacaaaaaaattaaaaaattagccaggcatggtgatgcacacctgtagttccagctacttgggaagctgaggcagaaggatcatttaaactcaggagttcaaggttacagtgagccatgatcatgccactgtactctagcctgggtgacacagtaagaacctgtctcaaatgaaaaaaaaaaaaaaaaaaatgccaagcacagtggctcacaccagtaattccagcactttgggaggccgaggcaagtgaatcacttgaggtcaggacttcgagaccagcctggccaacatggtgaaaccccatctctactaaaaaaaatacacacacacccacacacacaaattagccaggaatggtggtgcaagcctctgtaatgccagcaacctgggatgttgaggcataagaattgcttgaacctgggaggtggaggttgcagtgagccgagattgtgccactgcactctggcctgggcgacagagtgagactttgtcacaaaacaaaacaaagcaagaaaaaacgaaagaaaaagctgtataataaactggtaaacatgtttccctgagttctatgagccactctagcaaattaactggacctggttacgaggggttcatggaaactccaatttttagccagctagtcagaagcacaggtaaaacaacctggggcttgcacctggcattggaagtgggcagcagtcttgtgggactgagccctcaaacctgtggatctgatactatctccaggcagatagtgtcagaattgaattggaggacacccagctggtgtctgaggcagaactgatgacttgcttgatgtgtggggaaaaaaacaccttacatcttgtgtcagaagcgtgttgtgagagtatagcaggagaaactgagtctgtttttctactcatacacagtaacttaacc

SEQ ID NO: 562 - DNA, 110412 bp, Homo sapiens
gaattttcccccaaatgtttcttcagtgatagggtacagcatgtcaccttctactaatattttttgcctttaaaaaaattttaaaaatagtgcatgccttctgtaaaaagcctctttaaaaacttaatgaatgcatttaaaatccccccaaggttgtgtttttttttttttttttgagacggagtcttgctctgtcacccaggctggagtgcagtggcaggatcttggctcactgcaacctctgccttctgaggttcaagcgattctgcaattcttctgcctcagcctcccgagtagctgggattacaggcgcccgccaccatgccccactaatttttgtgtttttagtagagatagggtttcaccatgttgcccacgctggtcttgaactcctgggctcaagcaatccacccgccttggcttcccaaagtgttgtgattatgggcgtgagccaccgcacccagccaaccccccagggattttaagtggagtgtccctagtgtcccagtgtggtgacgcatccctggcccccttgtttggcatgtgccctgctggaacctctgcaccagcctcggagaggcccaggaacgagtcccctgctacccacacgagcctcctcagtccctgacttccccattctcagtggcctgtgccccatacccagccctctcctgaccagctctgccctcctttcccaggtaccgtatcctgaaccccagtgccatcccggatgacaccttcatggacagcaggaaggccacagagaaactgctgggctcgctggacttggatcacacccagtaccagtttggccacaccaaggtcggggcactgtgggatcagggctggccatggctgtggcggtcacactgggcagggttcatgcggatggttgggggttaccctggctgtctacctctccgcccccaggtgttcttcaaggctgggcttctaggcgtcctggaagagctccgtgaccagcgcctggccaaggtgctgacgctgctgcaggcgcggagccgtggccgcctcatgcgccttgagtaccagcgcctgctgggaggcaggtgggtgtgggaaggaggctggggacagggtgtgtcccctgcctctcagctcccagacccactggctctcccaaccctaacatgctgccctgtagtcagatcagcccctgtggctggttggggcaaggttctgttctgtgtcccccagcctccatttccccacctcaaaaaacggggtacggcacttgcctctccatttcaggacatcagcgtgtggcccggaggggtagcgatggcacccagtgtcttccaagactcttgcgggccgggccccaggcaagatactttctctgcattatcctggttaaagcgctgacggtcctgagaaacaggcgctgtgatggcctccactcagcagaagggtgcccgtgtcagagatccagagctagctggcacgtcagcccaggccgctgactccagagccccgtggcttaacagccctggtgtcttccgggaattgcagaggccaccaggacatggggggctcatgagccccttcactggaggcaggcctgtgggactgtgggcctcccctcaccctcacctataaagcagagctattaggagctactccatgaggctgctgggaaggcaaaacaagtgaactgtgctgagtgtcaccatttgtgacgggcagcactgagccaccttcacagcttggctgcccctccctagggatgcgctgttcaccatccagtggaacatccgtgccttcaatgccgtcaagaactggtcatggatgaagctctttttcaagatgaagccgctgctgcgctcggcgcaggctgaggaggagctggcggccctgcgggcagagctgcgggggttgcgaggggcgctggctgcggccgaggccaagcgccaggaactggaggagacgcacgtcagcatcacccaggagaagaatgacctggccctgcagctgcaggctgtgagtcagggttccccttgtgaccgggcgtccccagccccgagtacccctggctgctctgagggatagtacagcgagacccatggggctcaggccttatgtctctctgttccaaagatgccatgagatgaggcctccatgtcccagcctcaccaccccaaggcctcgtctggcacgtttcctggcactctcccctcgtgccaccttggcctcccgctaaagcagaggaaccccagctccccagctctcccctccctgcaatccctgaaaccaaacagacccatgctctcttctctggttaagggccatgggaacccaggtggcaggtaacagggtgatagccagagagcacagatcaaaggtctggaatctccccaggtccacagagcaagctttcctgccttcggcacatggctttgtgtatcaattgtgtgccaggctcaggctagtgcaggaggaacgttggtgggaagacagagatggccctgtggtcacaaaactcacctgctagtgcaggagactgtgacgcagctggacagtaaggaaatggggggtaaggatacctgagcccttccagggactgcctccaggagcccgtccgtggctgtgcagaggctgctgctgctcaccctgcccctcggaaggcctcagcccaacagcggggcagtgagcagcgggcttccctctcagaacccttgtttgggcctcactctgggccgccccgcacttctaactttcccctcttaatgctctggtgtgtccctctgcgctattgcccttccatgcccaagagcgagtcaagacattcctgagttctcagagcacagccaaactttgctacagaggcagtttcctctccagggcctggcctggtgtctctctgctggtttacctggccctcccccaacctggccccgttccgtgtgccctccaggagcaggacaacctggcagatgccgaggagcgctgccacttgctgatcaagtccaaggtgcagctggaggggaaggtgaaggagctgagtgagcggctggaggatgaggaggaggtgaacgctgacctggccgcccgccggcgcaagctggaggacgagtgcacggagctcaagaaggacattgatgacctgaagctgacactggccaaagctgagaaggagaagcaagccactgagaacaaggtgtgggccgggccagctgtggggaagggccctgagccaggggccagctttggggccaggtggctgcaggtcccaccccggctctgctaagcctctgctttctggccctgggcatgtcactgcctttcctgggcctcagtttctttatctgtcaagtggggttagcagcacttaccccattagggtaggtggtgatgtgtgtaattggcctttactgagcacacgctcctaggccttgcacacggtaggtgtttagcacatgctggcaatcctcatccatcccggagtgcaagccccttgagggcaggaactccatgtccccagctcggcatcccgcaggtgacttctgcccttgagccctcgtgatggcccctgtggttcccagtgctggaggagggactccattacacaggagggaaagtgaggcaggggtaggcagcttaggttctcacaggtgctcactgaggaagccgggactaggaggcagctgccctgagcacatgctaatactgcacatggctggcatctgtggatttctcaccaggccaggtgtggtgctgagcactgcgggtgcatccactcgtgaatcctcattacaaccccatgaggagggtccttccctcaggcagaagcggtggaggctcggagtcaagtgacttgcctgagtcccatagctggaaggggcacttgctctgacctggtgtggtgtggtggccgctcagagtgcggggaagggcgtccccattctggccctggccctggcacaggtgaagaacctgacggaagagatggctgcgctggacgagtcagtggcccggctgaccaaggagaagaaggcgttgcaggaggcccaccaacaggccctgggtgacctgcaggccgaggaggaccgtgtgagcgcgctgaccaaggccaagctccggctggagcaacaggtggaggacgtgagtcagggccaccccgagactgggtggcggggccggggtgccggctggcttgggccatggctgacccctgctgtgcctgctctgcagctggaatgctccctggagcaggagaagaagctgcgcatggacacggagcgggccaagcgcaagctggagggtgacctgaagctgacgcaggagtcggtggctgatgctgctcaagacaagcagcagctggaggagaagctcaagaagtaggtgtggtggggcagcaggtgggggccttctgagcctgcacctggcccttgttcccttctggattcttgtggttcctgcggcattgcagaggttaagggtgggggttgacagatggggcactggggtgcaggggtagtgtcttgccctccctgtactgagggccctagccagggtccagggctgaggcctcagggcccagtgcagcaggtgcatggggtgaggtccctcagggcctgaaggggactggggggcgttatggggtcccaggcgggtgggtgggagttaaggcctgtgctggccacccactctgtggctcccaggaaggactccgagctgagccagctgagcctgcgggtggaagacgagcagctcttgggggcccagatgcagaagaagatcaaggagctgcaggtgcgtggggatcgggtgggtgaggcctggggtcagaggcccacagaggtgacagctgccccacgtgcccaccccaggctcgggcggaggagctggaagaggagctggaggcagagcgggcagcccgggcccgcgtggagaagcagcgtgcagaggcggcgcgggagctggaggagctgagcgagcggctggaggaggcaggcggcgcatccgcggggcagcgcgagggctgccgcaagcgggaggcggagctggggaggctgcggcgggagctggaggaggcggcgctgcggcacgaggccacagtggcggcactgcggcgcaagcaggcggagggcgcggcggagctgggggagcaggtggacagcctgcagcgggtgcggcagaagctggagaaggagaagagtgagctgcgcatggaggtggacgacctggctgccaacgtggagactctgacccgcgccaaggtgtccgtgccttcctcaccccatacccaccctgactttaaaccaatcccgatcccagcagccaatactgttcccacaccagcctccacccagtaccttatcctgagccctgacctcttcacctggtacacaaccctcatttctcagcctcctaccagtcctgaccttaagccgtgactcccaagccctgttccctgactccaggtcatttctgatccagcatctacttccagcctcagacccttgaaccagcagtagttgtgaccctagcccttgactcctgaactctgacttaatacctgtcctctcttcctgtcctgaaccccagcaccctagccttaacccctgacctttctaccacataatcctgacagctgacctctgaccattgtccccaggtgactccgcagctaccatcccaactctcaccctgacccactgccctgggactggcccagccctgtcagttctgacacctgttaagcccagcagtagaatctctttccctgactttgaacttggggctctgctctccctttgattcctgggcccacatctagcttaccagtctctgatcccagatcctgccatctgatgcacaaacttgttctgacatctaactcctgacccctgactcccaacctgggatcctaggccagtgcagagaagctgtgccggacctatgaggatcagctaagcgaggccaagatcaaggtggaggagctgcagcggcagctggcggacgcaagcacgcagcgtgggcgactacagacggaaagcggtgaggctggggctcagctggccacaccaggcagggctttggtgcagccctcaccagcctgacctgtccgctcgcctctttgcctgcaggggagctgagtcgcctgctagaggagaaggagtgtctgatcagtcagctgagccgtggaaaggccctggccgcccaaagcctggaagagttgcggcgccagctagaggaggaaagcaaggtgggctggcaccggtgaccatggagtgggcaggtgggcaccagagccactgggctgcactaacgctgaggtcactggtgtccctgcaggccaagagtgccctggcccacgccgtgcaggctctgcggcacgactgtgacctcctgcgggagcaacacgaggaggaggctgaggcccaggctgagctgcagcggctgctgtccaaggccaatgccgaggtggcccagtggaggagcaagtacgaagcagatgccatccagaggaccgaggagctggaggaggccaagtgagtgctttgctggccaggccactgccatgcagagctttatgcctgtgcctgagccccgctgagggtgggtgaagggagctgctggggctgttctccctccttccatggtccacaccttgtctggttccatggcctagaaaaaagctggcactgcggctgcaggaggcagaggagggcgtggaggctgccaacgccaagtgctcatcgttggagaaggccaagctgcggctacagacagagtcagaggatgtaaccctggagctggagcgggcgacctcagcagctgctgcgctggacaagaagcagcggcacttggaacgggcactggaggaacggcggcggcaggaggaggagatgcagcgggagctggaggcggcacagagggagtcccgtggcctgggcaccgagctcttccggctgcggcacggccacgaggaggcacttgaagccctggagacgctcaagcgggagaacaagaacctgcagggtaggacctgccacacgccagggccagggtgctgccctggggtcggagcaactttgagttatgggggtgccctggtggggccaccctggaatcaggggtgagtggagtgacctgggtgggagtacaagccatgggggtggcctctcagcaccctgtccactgcagaggagatcagcgacctcacagaccaggtgagtctcagtgggaagagcatccaggaactggagaaaaccaagaaggcgctggaaggcgagaagagtgagatccaggctgcactggaggaggcagaggtcaggggctggctgcaggggtgggtggacactgacctgctgctccactggccatcccccccccccaccctaccctgcctgctctgtatccacagggggccctggagctggaggagaccaagacgctgcggatccagctggagctctcccaggtcaaagcagaagtggaccggaagctggcagagaaagacgaggagtgcgctaacctgaggtgtgtccatccttctcccgtccccacctcccgagagcagaaggggagggaagcagtgtgtactctgctctctagtctgtccctcccatgggactttgaggtccgggttgctgtctccattctagctgtgaacctcggagatgctaaaggacttgcccaaagtcacacagtgggggtggagccagtcagtccacctctgtctgcctgggcctcactcttgtccatgaacttgctctgatgggccacaggcagtcacaagagactttaaatcggggaggggtgactcatttgttctcaaaatgggttcgtttccaacggtccttgggcatttgtaaggacaggtatgcccttacgagaccccctttcatgccaccctcctcccataggcgcaaccaccagcgagctgtggagtccctgcaggcctccctggatgcagagacacgggcccgcaatgaggcgctgcggctcaagaagaagatggagggtgacctcaacgacctggagctgcagctgggccatgccacccgtcaggccacagaggcccaggctgccacgcggctgatgcaggcacagctcaaggaggagcaggcagggcgggacgaggagcagcggctggcagctgagctccacgagcaggcgcaggctctggagcgccgggcctcgctgctggctgcggagctggaggagctgcgggctgccctggagcagggcgagcgcagccggcgactggcagagcaggagcttttggaggccaccgagcgcctcaaccttctgcattcgcaggtggggacaggagtccctggggacagagcaggtgcaggcctgctggctggctggctctgagactcctcttcccctcagaacacaggcctcctaaaccagaagaagaagctggaggcggacttggcccagctgagcggggaggtggaggaggctgcacaggagaggcgggaggctgaggagaaggccaaaaaggccatcactgatgtgaggctgggcaagggctgtggggagcctgggacagaattgcagagggacttccctgaggctgggcacctgaccagctcctcctccccaacaggcggccatgatggccgaggagctgaagaaggagcaggacacaagtgcacacctggaacggatgaagaagacgctggagcagacggtgcgcgagctccaggcccgccttgaggaggcagaacaggccgccctccgtggcgggaagaagcaggtgcagaagctggaggccaaggtgtgtgcagcccctctagtccttggcgcaggcagggtgggtgacccaggggtgggcttggcatcaggctgtccccctgcctgcaggtacgggagctggaggctgagcttgatgcagagcagaagaagcacgccgaggcccttaagggcgtgcgcaagcatgagcgccgtgtcaaggagctcgcataccaggtgggcgacagggtctccctggggagtggccctggagctggcccagcccaagcaagccctgagtcccccttgcccgcccaggccgaggaggacaggaagaacctggctcgcatgcaggacctggtggacaagctgcagagcaaggtcaagagctacaagcgccagtttgaggaggcggtgagtgcgctggggcctggacacctggaccgggcaccccagctctgccccagggtctgtggccaggtgaggcatcagcagcagctccaccctccaaggtcagtgacccagagggaagagagaagcttctaacatctctggggagatcagacctagctccttctcatggaacagaccccatgtgctttcccctggccaaggctggggctgcctctgaggggtggggcaggcacaaaaaggcacatgaagttggtgcgtcccaacttccttattcccgctgtggtattggtgaggatggacagtggcaataggaacaaagttgagaaccaggaggagctagctcccttcttggactggggcagggaccagaataagcatctcagtcacccaagcggaaccaaggccctgtgtgtgcccccaggagcagcaggccaacaccaacctggccaagtatcgcaaggcccagcacgagctggatgatgcggaggagcgggcagacatggcggaaacccaggccaacaagctgcgggcacggacccgggacgccctgggccccaaggtgaggagtggcaggggcattgctctctgtgcagggggactgtgggggctgacaggtagtactgctcactcagctatccctttctcctcagcacaaggagtgacggcctgaccccctgggctctaaagaggaatgtctgctgttgcacatctggctgaggccacctgccccgatcctgccatctctgcatcgccccctgctgccttcagccttccctgggccctgaataaacaccacagccagtttccttctcattcttttctttggggttcaggaggaaaaacacagtcctagggacaaaagccaggtccacagcagtcatttttaaaataaagttatttaatagtctccatttaattggtttatttgctgttaataaattggcaacacaaggaagggccccatgtccaggctcaggcaggagcggctgcctcaggcagaggcagggcaggcacagctgccccgtgccccaagggatggagggaaaggcccctcacttctgggagaacccccttggatgaacacagcggccaatgagcaaacagaaccagaggagctacaggaaaatgaggcagaggggcaggcttgggggaaggcagcattctctggtacccaccacccctgcccagggctcagaagcctttgcctgggtccaaaggccagggacaagggaggcttggctcacagatggggggtgggggtcacccatatcttcctccccactctgggactgactgacagccaagaaaccggcaggagctcacacagagctaatgctaaatgtcctcttacctctgggtggccctgggccccagggttctgaaggaaaggtgggcatggtaccctgtcctcattatggggactgaggctctccatgacctagggccctcagacccagggggaccaagggcttctaggacttccctcccaccaagcctgtacccaaagacctggggcaggcagagagcagcagggaggaacgggaacagggcagggcgtgtggcatcgtacccacgctcacccacactggcccagcagcctcccgaggcctggcccaaggtcactcctcagtgaagtccctgtctatgtccatgtagggctcctcaatgtagctaacgagagcagagggtgactgccggtccgggttcaacaggatggacactgtctccttccagtatgagaagctgatgcaggagctctgggcaaagagggaggggctggggggcgcctggaggacccaggtcaagcccagcaccgggacacccctctgagaggccctgggtccgcggcccacccatcacccccttgagggtggggcactcacgttctctaggcaggtgctgtccttgtccttgtgcaggtagtgctgctgccagaagcgcagcaggttgtggaagttgttgagcaggaagccggggtacttcttgctgtgctccatccgctgcagcagccgcaggtacaggggcagccgctctttccgtcgggccagcatcaggatcaccaggctggtgttgaggcagctgacgttctcctgcaaggccacaggcccacagggtcaggggctggtgggagccccagtggcccctggtgaacctgggtagccatcaggcagggaggagagtggccccaggcctcgggccacccacagagctctccctgcacagaggtgagataggactgggggaagggggcccccagcagccccagtttcctgactgagcaccttcctcttccccacgcccacctcccaccccacctgaggcaacaacacctgtccctgtccagacctgggctcaagcatcactccttccggaaggtccgtcccaggcagggctgggtgcgtgtgttggggcggttatcccgcttcagaagtgccattcagcactagcctgcgcgcctcggtggggaaagagttctgccccactcaccatgcactcccacctggtgcttcacctcagaacggaaccaaagaccacctctgagaggtgctaagatcaccctcactctagaaaagaggggcaggaggctcagagaagggaaggctgcatgactattcagtgagggagttgggcagcctcaggtccgattccaaagcccagcagggcagaaggtgtgagggacgtggacatgggggaggcggggagagcactggcctgcaagtcagcctgtgacctgagggcacttgcgagccctccttccttaggccctgtctgtacaatgggacactgattcctcctgagcacagtcctcagaagagctgggtctccagagacgcacttctggagtgggggacagaaacctgctgggcaccaggacaaaggaagtggtttccaatcgaccttccctgctgtgtgtctgccggggcctctcacctgggtcagcgtctgcacgtggatgatgttgatgaggcggaagaggaaggacatctgcgtgggcacctgggatatgtaggcgagcaggcggcattcagacagtacctcggcaactgtggagggaggcaggggtgcagcaggtcaggcttaggcccagtggctgggtcgcccaggcctttcgtggagccccgcttgggtcctgactctgaagctaggagctcatcatcaaaacagcttcaacgaaagctgactgtggcagaaagaaggacctccagctgtcctgctaccaggcaaagccatgttctcagagtgcccaggagcaccccacctcatcctccagaaccaagctcagggcagctctccctcagccctccccagactggctccagacccgtgccctccatatcacacacagaagagttccctccacaggaagatggatccatgacgctgcattaagaaaaacaacgcaaaagttccactccttctgcagaggtcctagcgcaactggttttccacaccagctctcaggtgagtccggcccagtgctgagaccacaaggcacaggttctgctccgtccactagtgtcggagcaactgcttcccgcacaactgggaggcagggcaataaccgaaggtaccaaaatctgtgtggctgttcccctgaaacagaccctctggggcagaaaaaggaagcaaacggctaaattaccaacaaccgggatacttcttgctatcaatgacagtgaccgtgacaaggaacaagtgcctgactttttgggggtgtgggggggtcacaaaccctcaggagaatctgctggatgccacaagccctctcctaggaaaaaaaggaaacgcgtgcgcatacacatggaagtgcgttagcaagtccaggagggttcagatgcctgctgcaccacagggcacctgcgatgccacgcacagcacactgaggacgagggggccaactcatcgtgccaggcaataccagcccagaagaggaaggtctttttctggttttctttgcatcttgctagcaacaatggattttcaccttattaaagtgttgaacaaggcagcaaagccaattgccctggaagccgccaccttgaggccggccacgtgggcatctggtgcagctccctcagtcattcttgtctccctgctggagacagggtgtctgatgccagcattcttaccctgcatgacttgccttgacagcctgcctttcatgtacctttcatatccacctggttttcaaatcggtccagggacagagtgacacagcgcaccagcatgttggagtccaccagggagctgttgatctgcttcaggaatacctggaactatacagaaaccaagctcacagcaggcagtgggctgctggccaggtatggccatggcccggggggatagtcactacaaggggcatcagcgacctctaccagccccactgcttcagataggaagacagaggctcagataagctgagggacctcccctcaccacccaggtactaagaggcactccccggaattcagcacagatccgacactctctccagtggttttacgctcaagggtgctggattcctttaatttttacttttaattttacttcagctagcctgagctgggtttctgtcacacacactcggtgagcctaacacaccaggcccagtccctccctacagcggctcccaccgtggcacccaccatgctgcgtcacggcaggcgcacaagccacccattcccaccctcactccctacccacaagcagccccggttttcatccctgcattcccagggtctagcacaaagccagacagagcaggttccaatgaatgtttgccaaagactgcccagactcccccgtcgtctctaacgtaaaacctgtgcctaaagcctggcagaccaggactccaggtgaacttctggacaacccagcacactccacagagccctgggttaactttacctttgcatcggtgttgatatatttattgaatctcttgaatgcatcaacgttgaacttcatcagctcccccaggaggtcaaagtaactctggagcacatcccttgacttacactcgctgtccacaatgcagtaaaggatgtgctgggtgaggagggacagggtgaaggtgtcaacgtggctgcccccaccagggcctggcatggagctcagaccatgcattggctttgagcaagcatcctggggatggaactggcaacactgtctagattcttgtctgaggatgctggtggctccaaggacaggaccaggcctgacagacctcaccaggaggtggagcagactgggaatgcagcacaatctctcccctgcccagggcgtacagctgaagcctgtgacctgctctgtggtcaccaagatggccggggtgctcagctcctaggtgaggggagctgtcatcaccaggtctaaaacacaggccactgcctaagcactgaggtcattcaagtaaatgaaggacagaatttaaaagcaaaggacacattttgaccccatggtttgtctttgtgtttatgaacgaaattgtttaaatagagtttacaccaaaatactgagttttcatcaagagaataaagccaatttactcctttataaagttttctacattttcttgaagttacattgatttggatcaattcttttccacatggattttataattcgtgggtcagtttcttgtccatatgaaaaaatctgaaagaccaattataactttggccattctgctctaagttttactttttctgaagaccattattcaataaaggaaaattaacttttagtacaaaatatcttcagggtcaaaatgccttgctgggtaaccaaactgtcaccctcctgcatggcctggccaccctctaaacctgtcaccccgtaagcacccatggggaacccacagttggaaacccagggcaaaatctaaggcagcctgcacaggcatttggaagtcacgagatctgctctgctcctgatgaactgtttggggctcaggacaggacacagcaacgcgtgggctggggggagacggaacccaagacactggctgctccagatcatacctccaagaggcctcgcttcagcaggaacatctggtctgcataggaggtggtccctcggaggaaactctccacagcccgagcttgccaaaacctgcgacccaaatactggctcaggtggctaaggctgccctcttccggcccatgttcagttctccaaggggttgggagatgtttgttgccttttcatgtactcaacatttactgaacatctaccaagcatcaggcttcatcctgggcctggggacacagcagtgcccccatcctcacagagagccagctcagtggagaagtcttctatctgggtctgtctggaaggggctgtgtcacagaaagggtaacatctgggatcgaagggctggctcctgcgagcccccgtgaaacatactctaggccttgccctttcacaagaatgggaggacgtgcaattgaggggccaggaatgtgtgtgggaagcggacgaacacatgcagacaggccactgggctcacagacgatgggctggcctagggaagtagtggttgatgctgaccgagggacccagagggcacagcgggtatccacgacagggagtttggacaaggcactgaagtgacaaaggcccatgtgggcatgaagcctcctgacagctcacgcccggccctgatggaactctacctgtccactgacttcaagactcatcttagatgtatctaaggacctcagagaaggtctccctgtattcacccagcccccagccctagcagcggaagaggctttcctttgctgctatagctcctgggccaaccctggctccattccttcccacactgcattgaaacagcacagctctagggaattcatggcagggcccgtatcctagttctctcccacccataaggcaccagcacagaacaggtgcttggtgaatgctcggtcactgtgggctgcagaagaagctctcacatacctgtcgagtcaaaactacacaagatggcagtcaaaccacctctccccaacagtaattgtgcttcaggaggcatggacgctggtgactaaaggaggtattcctaacctcctgagaaacacctggctctgcagccccgcagaatcggcaggtacttttccccagactcacctgaaagacgactctgctggctccttcttcatgacctgcagcagacgagttaataagcccctcttcccatcacacaccaaactcctgaaatagaagagagatattggtgacagatctgagaggctgacaggggccctggggatgggtcattctgctggcttaggcggtgaaaaaccatggggacatttccaagtctgcaggatgccttcctgctccaactgggtccagagccccggagacccctgcagccacagaattaaactgccaagtgcattcccaccacatctcaggccagctttccttcccaggccagaaacatatccagaatcagacatggcttagaactgccagaggagagctgtttataccaaaagtgtgttgaaacaggtcatgccagtctgccagatggggaaagactctgccaatagggtgaggcccagcgtactccgtgcctgaggttcacttccagctggccttgggcaagtgtccacaactccaagcctcagcttcccagtctatgaagcaaaggcaggagatgaggaaatgactctggccccgtcatgggggaaggaagacggccaggcacgcaggggtctgggcccttcaaacagagcagctctgctgtgatccactgcagacatcagggcaggactgggtacaattttatttgaatgaagagttctgctaccttagaaaaaaaagattgggaggccaggagaggtggttcacacctgtaatccctggactttgggaggctcacttgaggccaggagttcgagaccagcctgggcaacatagtgagaccccatctctacaaaaaaaaagtaaaaacactagctgggaatggtggcgcacacctgtagtcccagctactcgggcggctgaggcaggagaatcacttgagctcagaagtttgtggctgcagtgagctataacaccactgctctgcagcctgagagaaagagcaagaccttgtgtctaaaaaacaaaacaaaacaaacaaacaaaaaaggttgggaaatcatggctcttgttggataaagtccactgtattctgacgcctgtgagactagccccccactgcctggctccaggtgaggcaaacctaacccaggtaatgcaacctaacacttggcagcaggtaagaggcttctgtctgtcctgcttggctgcagatgccaccaggcaagaaaggagcacataagcaaaggggctgaatgcacgagacaaggcggtggggcagtgcggagcacacatgacttctggcaggtgacctctctgaggctcacctcatctgtcaagtgcaggtactgatggggctcccctcctagggctgctgtgaggctccaatgagaaaatgcaggtgacatgaatacaatgcctggcacacaggagccctcaggacactgtagctgcatgtgagagaggacacgcgtgcatacctggatgtgctcaccggtgagcccccggggaacgtgggcagccgggatgggctgagggaaaagctgcacccctgcactcacctgtcggtgttgaggacagcttccacctcagggatgttggccttgagagagatggcactgagttcattcagctcctggttgttgagtaacaagtacttgttcctgaaacaaaatgggttggaggaggtaaaggacaggaactggggctgctgggtcagcaccaggctagtgtagggagtctcctgcccacttcctgtggacagaatctgagaagccaccaggcactttcctctagcacctctcactccagccagcacctgcaggagggaactctgggctctcaggcagtggaatctctccctggccccacccccatccccgacccctgcctgccacattcatcgacaaggccccttccctcagcagctctgggcctttctctttgcctacatttccacttgttttctcaaaggcaccaacacctcaacaggtccaatcacactcaagcctggccctgctgcagcagtcccaccaagcaccacggtcacacatcacacagaggcctggttaactgtgacacttcccccgacttgccatccaggcctgtcactgctgggtcctgtgttcccaggacaccagctccctttactaaaaggtatcccacaggaactgagtcatcacacggtgccaaaagtgatcttcagaatcaggactctgatcctgtcactcccggtgaaaacacttccacagcttcccactgcatttagaacagacatttcctgacttaggaggaggttatgtcctgataaacccatcgtatttgaaaatgccgttaagttgaaaacatattgaggccgggcgcggtggttcacgtctgtaatcccagcactttggaaggtccaggcgggtggatcacgaggtcaggagttcgagaccagcctggccaacgtggcgaaaccccatctctactaaaaatataaaaaattagctgggcgtggtggcacacgcctataatcctagctactcaggaggctgaggtagaattgcttgaacccagaaggtggaggttgcagtgagccaagatcatgccactgcactccagcctgggcaatagagcaagattccgtcttgaaaaaaagaaaaagaaagaaaacacatttaatatatctaacccactgaacctcctagcttagcctagcctacctggaatgtgctcagaacactgacttcagcctacagttggccataatcactggcaacacggcaggcacagcacagagtactggttgtctaccttggtgatcgtgtagctggtcaccatttttcttgaaatacattctgagctgcagctgcagctcagtgcccagcattgcaagagtattgaactgtttatcatgagcccaggaaaagatcaaaattcaaaattctacttctgtaccattgtgaagttgaaaaattctaagtggaccatctgtatataaaatccaggcctgtgactgtgacccacaacaccctgtgactgtgacccacaacgtcctgtgcagcccagcccagagccaagcccacatcactcccatcagctggccacaatggtcttccctcgttcaggggcttctggctagaacacacaccctctcacatgcctgttcactcaattcactacaagctgacacttcaggtcttggctggcaagccacttctgcaggggagagttcctgagtgtcctctggccagtcctggaccctgtcaaatgtctctcacagaccccgttcctctcctcctgaataccatctccacttatcactaatgctcaacggtggaatccttggatgaacaactgtctctgttttcagactctgcccttcatgagagcaggggccatggctgtttgcattcatcctgatatcccacagagtactcagactgaagagtctgatgaaagccagagactcacttcctcagggaaaacagcacagttccataacatatgtggtgccatttttcagaaggttaacatgcttcctggagcccttctatggctttcagccggaaaacctctcacagaggatgggtgcatatgatggaggtgccctggggccacagctgtctccaggcatgttctgttagctcaaatgcaaggtttttaaaatatttaaaccaacatttaaaatcaggacctttcacataaatcttaatttctgcctttgcttggcagaaaaaatcagaagttatgcaacagtgggcccagtttcctgtgcacacgcagctggctggagctgagctcactgaaattcttgttcactaaggtccccacatcacctccccaatgccaaggtcaagggtcagctgctagtcacccccttcctgcactgttttccttacagcagagagtaattttccttgtacattctccatcgaaggttaaaaaataaatgagcgcagaatgtctttcaagaaaaatgggagcacacctccttgtggagggaagaatcctccagctgctcagtaagcagtcggctttgcctgtctgaagttcctgccggcccctgggaatagccacgctgtccactcttgctttagaggggcagtaggttgagaaatccattgattccaaaggtagtaaggggccaacgacttccatactcagttcctggggtggctatgagggttagaagaaagcttggggcagtgcctgccataaggaagtctggaaagacgggaggtccgactgcagtgtcacacctgctaacactgaggggacagtgggcttccaccagctccagggcctcctctcgagctgaggtcagggaccagacaaggagatcgaggccttccgaagacagcccaacaactctccttgcagggacactcttgtacttactcgtggtggtcactgaagctctgaagaagcctcaaaaactgtatcttcaaggtgatgtcctgaaacacatgcacagcctcaatgttaggaccacagccacaaggttccaaaataacacaagcagacactctggtgggagcctgcttctctaagcctctgtcctcatgtaccatgaggacttttctttagttagaaaaccatctgttcacttccacatctgatcaacagcagattaagctaatgtggcccccttcctgctaaaaacatgccatcacactcaataaaaaataaggcggggcgtggtggttacacctgtaatcacagcactttgggaggccgaggcgggcagatcgcttgaggtcaggagcttgagaccagcctgggcaacatggcaaaccctgtctctactaaaaatacaaaaattagccaggcatagttgctgcgcctgtaattctggctactcaggaggctgaggcaggagaatcacttgaacctgggaggcggaagttgcagtgagccgagatcgcaccactgactgcactccagcctgggtgatggagactctgtcccaaaaatccaaccaaccaacaaacaaaacaacacgtgtggggaggagcgggggaagtccataggagttagaaatgaagaaaggaccgaggagtttggaatagtgagccaaggaactgatactcagcagctgtgggcagtgtggagaggtggagacaagacctagtcacactaaggcttgggttttaatgccctgcagggactagacagggtgtcaggtcccagtaaagcctggggagcatgtacacttggtgaaagaagggttagaaaggcctgacccaccagcccagggagcctggctctgccatggtgctgctggtgggtgaagggggccctcccaagagcagcagaaaccctgggctcatacgactggggcagtagggccaagacattaaataagaaaactggccctgggacagctgccagacaaaagcaaaagtgccctgtagaaatgcctccagggctgaggctacacaggtatccaagggggaaactaaccccactgacctcaagtgatctgcccgccttggcctctcaaagtgctgggattacgggtgtgagccaccatgcccgggagcacgtttctataggtggatgaaaattacaataggataaaacagcaaataaggaaaagcaggctgctagctcatgcagtgggcagccccctccctgcctggagtgaaatgagatccccatcacagagattacaaggggaagtggctagagggcctcaggcagaatttttttttttttttttttttgagacacagtctcactctgttgcccaggctggagtgcagtggcgtgatctcagctcactgcaacctctgcctcctgggttcaagcaattctggtggccgctccacagacattacaaaacacgaggcaacactccaccctgaggtctgaagacccaaacacaagcattagtgccccatgagcaatcgaaagagaccttaagaaagtattttaaaaatgattaaaaacagaatatgcagcagaaaaaagatattaacatcatggctaagcagtttccgaattgagccagacagaacatctagaaatgcaaaatatatttgcttgaaattaaaaactcaaatgataaagcagaagacaggtcgctgagggaagtccccagagtgcagtgaagagaagagggccccatggcaccaggccgatggctgggtggcacttttaggtcccagagcactttccttctcatgctggtaggcagggtgccgactagccggggggccaataggggaaagagtattatccttcttttgcaagaaaacagaggctcagagattcagtgattcattcaagctcttccaacaagccttccaatgtcctgttcagagctctctcaaggggactgtgagagacacaagctaaaggagagtgcttgggctcaaaaaaccaaagccacctttttttgtatgagacagtgtctttgctctgtcacccaggccggatgtgcagtggcttgatcttagttcactgcaacctctacctcccgggttcaagtgattctcccacctcagcctcctgagtagcagggattacaggtgccccaccaacatgcctggctaatttttgtatttttagtagagacggggtttcaccatgttggccaggctggtctcgaactcctgacctcaagtgatctgcccgccttggcctttcaaactgctgggattacgggtgtgaccaccacgcccgggagcacggttctataggtggatgaaaattacaataggataaaacagcaaataaggaaaagcaggctgctagctcatgcagtgggcagcccctgcctggagtgaaatgagatccctatcacagagattacaaggggaagttggctagagggcctcaggcaggaactttttttttttttttttttgagacacagtctcactttgttacgcaggctggagtccagtggcgtgatctcagctcactgcaacctctgcctcctgggttcaagcaattctggtgcctcagcctcccgaagagttgggattacaggcacccaacaccatacctggccaatttttgtatttttagtgagagacgcaagtgtctctcacactagtgagacagggtttcaccatgttggccaggctggtctgtaactcttgacctcaagtgatctgcccgctcggcctcccaaagtgctgggattacaggcctgagtcactgtgcccagcctaggaagatcttaaaagggatttctgcataggttggggtggggagtggagttcactcagatcctactccaaggtagcttccaattaggggactataagatatgattttagtttctgctctactcccaaaggaaaaaaggtcaaagggtcagcagcaggtcttgaaacaactactccaagccagtgaggccccatctgtccccgggggtctcctgcttaccgggctacagtcacagttctggttgtgaccatggaggacaagggcagatgctgaatgcttcctccaaatcagtttgtcaaacaaattattaagtccagggatcagcttgaactctgcaatcattctgtgaacctgaatgggataggaaggaaaaagtattaagacaaatgtgcttgaaaaatctagcaaaacctcgtgctcagtacacacgataatgatattcaggacaagtatcagtactgtcagtaaggagggccagggtctgaagaaaacatccgtgtatcccctatgcccagcacacacaaacccactttctaactttgctcattaatgctcacaataatcctacaaggcataatgtccggtagttcctatcacagaagcatgagtttgggattcagagagtcctgcatatgattcaagagtcctttgggatgcaagagtcctgggtttgactcttagctttaccatgtgcaaactttgtaaccttaaacaaattccttaagatttgtctcctcgtattaacatcaaaatgttcctcatgctttgcactaggataaatttcagctgaaagtaagatacaattattaaaaaactctaagatctagaaaaatctctgcaaagaaaaaaaaatgatctaagagttggaaaagcctttctgaaggattataataaacctagaagctcaaaaagaagcttgttgacatcaaccacctaaacctttaaaaattctgtatggcaaaactcaagcaaagtcacaagccaaatatgacaaacagagaacatacattggcaattcatgccacaggcaaagaaattcctctataaggagtcctacaaatgtctctgatttttcactttttcagactgggaaagatgacaaagctttataagaccgtgttggtgacttgggcattgggtacattcacacgctgttggtgggagggcacactggtatgacctgcacagggaagagtgtttggcagtagctctaaaattgcaaatccataatccctttaaaccagcaattccactttaggaatttacactcagacagatccatataaacactaaatgatatatatttacaacactactcactatagcattatttgtaataccccaaaataaattatggtatgccactcaatgggatacaaggcaccagtaaaaaagaatcaaggtattttatatgtcgtgaactgaacaattgccgagagataatactgggaaagcaagtgtgctcatgctgtattactgattgtgtaaaaaaagaggaatacaattcgcctttgtaagcataaaaatgtctctagaaggatacactaataactggtaaaattagctgcttcatggaaccattagaatagaatgtcaaggatcagaggggagagaggcttcacttatactaatttatatcttttaaaacagaactgcaggaatgatttccctgttaaaatttgtttatataacataaggctattactagcccttctcggggctgttgtaaggatcgagtcagaaagcagatgtaaagctctgcacacagcaccagtgctcgcttattgctattttacaagggggagaagttcagcaagaccagcctgggtaaggtcagtgattgcaacggcacctaactcaggtgttcagatcttaagtctgcccctttctagcccactacaggtatgcatttatcttgggagaccagaagctgacaaagacatccctggcagcctccatttccatggacctcttccttcaacatattaggttgtgtaaaagtaattgcgatttttgccactgaaagtaatagaggtgactattctcttcctactagaaatcacagcctctggccagtgttaagactcataagcagcccagaatctgttagactgaggctgatgtaaaatgacacctgttctgccactcaggcctttactaaaacccagcctggatctaccttgccctgcttaactgggggtggggaggtacggctgacatctatggtgttcaccaagccatgtgccttcctgtctcactccaaagggccctaagccaggcccaggtcacacagctataaaatgttccaacaatggcccaaaaaaattcatccagtgcaattgcctcactgcacagactagaaacccaagcttaagagattaggggtgagtcacacagctgggaagagaggggccttctaaggcagacttggacctgaccctgggtctcctaagttcaggccagtgcttaggtttgaggtttctactacatcatttcccttttctcttaacaataccagcttctcggccgggcatggtggctcacgcctgttaatcccagcactttgggaggccaaggcgggcggatcacttgaggccaggagtttcagaccatcctggccaacatgatgaaaccctgtctctactaaaaatacaaaaattagctgggtgtggtggtgtgtgcctataaccccagctacttggagggctgaggcaagaggatcgcttgagctggggaggcagaggttgcagtgagccgaggtcatgtcactgcaccactccagcctgggtggcagagcaagactgtctcaaaaaaagaaaaaaaaaaaaaaaaaaaaaagaaagaaagaaaatagcagcttcttcatgtgtaaaatttgtaaaacaaattttacttgtagaatgcattattcctactctcaggtccagccccgtagcctgctctatagcaggatggtaggcaggtgggcgagatgaagtgccactctaccagaggaggcagcgggtacaggctcaggcatttatctctgcagtcagacagccctgggttcacaagatagctctgtgaccctgggcaacattctttgaacccaagtcccttgatagaaaaggcgatgggggacgatggagctgttgaaaaggctcagtgaggtactgtagaagctactcagggggcactaaaagaaacgactgctatatggatggttttcattagcaccagagggatgaaacttgacagcacatggggagcctttccagtcctgagatttcaatttggccaagattggtctgagaacttggcccaactgctcattaacgaggaggcctctttaaggaggaagccttctgtgaggcctggccaaggaaacccttccccttgctacccagtgtaggcaggatctgggaatccagatcctcacggtgcccggcacacagcagaaacccaggaaatgctgactgtgcaaatgagaacacgctagtgaaacagtggttttggggggccaggatttcaaggtcattagtggtcccttcccaaggaaccagcactgtaatcatacagtttaactcaagaccgcaacaactcatagcaacctggcaacaagaaggctcagggaacagagaactgctgtgagagggcagaaagaggagacagggcagcagagtttaaatcctggctctatccaggcctgtcccctgagcgcacagcccagtttatgccctggctttctcaagaatcgagtgtggggacacagagtcaccacctgttgtgtaacttactaaatacctgaaaattcaaacaactgtgaaagtgcctcgaaaaagtaatagcactcaatgcacagaagctgtccctacaattatttcacatataagcaactgcgaaagtgcctcaaaaaagtaatagcactcaatgcataaaagctgtccctaaaactattattttttattaaaaacatgttccgtattgaaggaagggacaccaatgctgtggctatcaccgtgggatctcatccagtgtcctggttttaaatacaaccatatgctgaggactcccaaagtgatacctccagccttgccatctccccaacaccaggtgtaggtaatcaatccaagtgtcaattctaacacacacctcaaatctaccttgtacaaaacacaactccccatcttcctccctaagcctgctcctccaccccttacctgctagtcttaaccacctcaatacctggcaaatccattctcctacttccttgggcgaaaaaccttgggagtcacccttaactcctctcctcactcttaagttcacatccaaaccatcagcaaatcctatctttcaaaacatatccagaatgcaaccacctcccaccagtcccaccatcaatgtgctggtcctagctgctatcatctcttggccctattatgagggcccctaatggtcgccctattcccttccttgctgtttccagtctttccaaaagcagtcagaggaatgacttctcacttcactcagagtaaaaaccaaagtctttaaaatggcctgtgacagcttgacatgacctggtccctgtgagccctcagccctcctctcctggctgtttgctccaggctgtcccgcgctgcctcactgttccagcaactatgcacactcctccccagggcactgccccctcccacctggtacactctttcattctcttctggacgttttcatcctcacttgtaaaatgggggtaactgcacctctgttgcccagacttgtgacagtccagtgtctgactcagaaagatgtggaaggactgctgagcctccagcctctcctgcccccatgcttggtttcctccctagaagggcgcggtctgcaggaaaaggctacttctcaatagtcttgaggagggccgcactgttccaagccctttttcctccactgtaggttatgggcccctcctcctccgtcttggaactacttcaaggctcagggaaccttgcacatctggagctccctgtacttgcccagttttcctaagcagacacagctctgggctctgtcccactgccctgagcccacatcaggttggcaactcctctagcatgtccacagggccaggcttgccagctttcaactctttagtcttcacctcacagaggcaactgcctgcttctgccctcagcaccaaccaagactgcctagaaacgctccatacagcaaggcacagtgaaaagactcccggttctggaatcagcctggtttccttataggtagaacagaaggagaaatacccctatgctttgccaggctaaagcgagagccattctaacagaaggcccagtggagcacctggcataccatgagcacccgggcagcacctgctccccgtgtcctgagacgctggagaggggcccacctggtttcgctgacgccccatcagcagcacgcagaggacatagagcacttccagtttgtacatgatctcatgcataatcttcattgactggggcagctgggttctggctgacgtgtgaggcaggccattctcctcagaagcccctggaggagggaacacaatggaggctgacacagccaccggagacaggattgagtcacagcttgtgaggaaacacgtttctgcccctcgaacctgctctgaacagacttgtagcatggccattcggctgggccatgagcccaaaacacagactctgaaagctgcaaaactccctccacaatcccaggagccaggtgagcgcagagactcggaaaaatggactctgcaatagttgtgcctcatcaactttaacataaagtaaaaatattcggacacagccaatacagtaacatgacccatccctccctgcttatgcccttctcctgccaccaaccagacccccaggaagtgcccaggcagatgtatgacagcaaattatggggaccgctcttcaagtcgcaaatggccctgcttacttggttcttctgctgagactccatgagggacactgctgaagcccaagagggattctttttgaagaattccccgttttttaaaagaagaaccatctaaatttttctaaggttcaactttctaaagcagactgggtatcacaactgatgctactgatgcagatgaacatattatctacaggcagattttcattttacccaatgtcattactgctaacatcaacagcagctaagtgatatttatgggacacttgatatgtgtcagacttgctggctttatgactttgggccagtcacctcctcactaggccttagactgctctgcagcagacagctagggttactgtgcagactgaatgggaacgtaagagaagcccagcatctgattcttaggaagcccccattcactcctagatcctttctttacttatttacagagtcttgctctgtcacccaggctggagtgcagtggcatgaccttggctcactgcaacttccgcttgctggtttcaagcaagtctcctgcctcagcctcccgagtagctgggactacaggcatgtgccaccacgcccagctaatttttctatttttagtagacatggggtttcaccatgttggccgggctggtcttgaactcctgacctcaagtgatctgcccgcctcagcctcccaaagtgctgggattacaggcgtgagccacggtgcccagcgtagatccctactattttaagagggcattggtcagagtcaggagaggctaggtgatcttagcagagtgacttcccttcagtttcctcattttaaaggtgaacagatgaatcagtaactgccaaggtcctctcaagttcctacaggaactgcttccctagaggccttttgcaaaggcctctatgtgttatagaggagtggttatcagatatattcaggtaaggctcatacagaaaacacagtgatactctttaaagtatcaagacagaagaccctaacttattccgactaggtgtggtggctcatgcctatgatcccaggactttgggaggccgaggcaggtggactgcttgagcctaggagtttgagaccagcctggacaatacagtgagacctcattgctataaaaaaatttaaaaaattagctgggcatggtggcatgcgcctgtagtcccagctactcaagagggagaggtggaaggatcgcttgagcctggaaggtgaaggttgcagtgaaccaacagagatcgtgccactgcactccagcctgggcgacagagctggactgtctcaaaaaaaaaaaaaaaagagagaatctaacttactctatcctacagacttggaactatctttccccgtcatgttaaaatcacaaccttggaagacgacaagctgctgaatgaagtgtgactgagacacagtgtgacacggtagttaagagcactgaccctgaagccagactactgggtttgaaccccattcactagccgggtggtcttcagtaaatcagtggacctctctgtgcttcagtatccatcctcctttgtaaaacagcaatactgacaaccatacctaccccttaatgttgtaaggagtagagggatatactgaaggtgcctggaacatagccccaagtaagcaacatacaattagaaactaaatagaagttaagttctcagaaaactgagtttttctgcgaatgcttgcttgttactttgtattctttttcatctccaagcttttaatgggaactaaacaggcaggaggcaaagacttaggaaaaatttactggagaaatttttaatttaagagattctatctactcatatttattctcctgtaccttgggcaaaaaactatagttactcaatttccatgttagcactccttggcccagcttccagaacagttaagtgtcagctaatctgtgaagtgaacctgaagaactatcacgcagaatcctgcctctgtcgtgcactgctgtgagaccttgcgtgcttggcatcctcggcacccagcccatggtgctctagggagtcctgcagggaaggatgtttatgcaagcagtgggcacagtgtggggcacacaagtcctactgagaaatgaacgtctgcgaagaaagagacagggcagcctgacccctctccaagtcaccaccaacttttggtgcctggcttgcgcaggcctgacaagactttctgtgataaatattttcaagaaacagtctccaaagcaatggccagagcttagcaacaaggtcagtcccaaggatgaggatgggaaaaccagctcacgaggcctgtgctcccctgagtctcttcagctctaccacaccgattggagcggtcaccactctctgtctgcactgcactgttttctgcggacatgcacactcacttttttttttttttaacagctttgaggtacaattcacataccatgcaattcacccatttagttaaccatggtatcgtgatttttaggacattcatagagttgtgcagccattaccacaatcaattttagaatatcttcatcaccccccaaaagcagccttgtactcactaccagtcacttcctatttcccaccaaactccttagctctaggcaaccatgaaactattttccatctctatgcaattgcctgttcaggacacttcatattaatgaactcatgcaatatgccatcttttgtgactgcttctttcacctagtacaatgttttcaaggtttatccatgttgtagcccctatcagcattcccttttattgctgaataatatccgctagtataaatatatcacattctggcttggtacagtggctcaggcctgtaattccggcactttggaagaccaagacgggaagatcatttgagtgcaggagtttgagaccagcttgggcaacacagcaagatcctgtctctttttattacaaaaaataaaaaaattagctgggcgtggtggtgtgcacctgtttccagctactcgggaggctgaggtagaaggatggctgagcctgggaggtcagggctgcaatgagctgtgatcacaccactgcactgtagcctaggtgacagagagagaccgtctcaaaaaaaaaaaaaaaaaaaaaaaaaaaaaattctgtttattcattaatcaggtgacagtcatttgcgttgtttccatattttggctgttatgaatatgctgtgatgaacatacctgaacaaatttttgtgtaacatatattttcatttctcttgggtatatacctgggagtaggatttctaggccctatgacataactgtatgttaaccctttgaggaactgctagactcttttctaaagtggctgcactattctacatgcccactaatagtgactgagggctctgatttctccatattcttgccaacccttattatccaccttttttgatgataaccattctagtgagtatgaagtactatatcattgtggggtttgttttttcctctatcatctagactacttaagtgcagtggcaggatcacagctcactgcagcattgaactctggacccaaacaatcctcccacctcagcctcccaagttgtcaggactatgggcacgtgccaccatgcctggctaaccgaaacaaaatttttttttgtagagatgaggtcttgctctgttgtttgagctggtcttgaacaatcctcctgccttggcctcccaaagtattgggattacaggtgccagccactgtgcctggcctcactgtggttttgatttgcatttccctgacggctaatgatggtgaacatttttcacgtgcttaataattatttatatatcttctttggagaaacatctattcagatcctttgtctatattttgaaatgggtttttttattattgttatgagagttctttatacattctagatacaaatcccttattagatatattatttgcaaagatgtcccaccctgccttacccacaaaaaacgttcttccattctgtgggttctcttttcactttcctcattgtgttttctgaagaacaaaaagttttaattttgatgaagtccaatttattatttatctggttgcttgtgcttcagatgtcattgtgtatgacagctaaattgttaaatccaaggtcatgaagctttatccttatgttttcttctaagggtttcacaggtttagctcttacatttaggtctttgacccttttaattttgtatatgacataaggcaggggatctaacttcattctttcgcatgtggacatcaaatggtcccaataccatttgttgaaaagactactactgtttccaccaatgaatggtcttggtacccactgaaaatcaattgatcataataagcatgagggtttatttctgaactctcaacaatattccattgatcaatatgtctatcctcaggccagcagcatagtgtctcgattgcagctttgtagtaagttttcaagtcaggatgtgagttgtcttaggttgttttttttttttgagacagagtcttgctgtcacccaggctggagtgcagtggcacaatcacaggttactgcagcctcaaactcctgggctcaagctaccctcccacctcagcctcttgagtagctgggactataggtgggtgtcacgaggcttgcctaatttttaaattttttatagagacaggggtctcactatgttacccaggctggcctcaaactcctgaggccaagtgatcttcctgcctcagcctcccaaagtgctgggattacaggcatgagtcactgtacccggcctagttcaagactgtttttgttaatccaagtctcctgcatttccacatgaactttaggatcagctactccatttgtgcaaagtagtcagctgagagttatgacagaaattgtgttgaatctgtaaggctgatctatagatcagaatgggactatcattatcttaacaatattaattttctgattcaaagacatgggatgtctttacatttatttagggtttaatttctttcaatgatgttttagaattctcagagtataagttttacacttaagttcctaagtattttatttttttgatcctattataaataaaattgttttcttaatttttggtttgttgattgctactctatagaaatactactcattttttaatattagccttgtattctgaacctttgttgaacctatttattagtttactggtttttatagtagattccttagatttttctacatataagatcatcccatctgtgaacagtttcactacttttctaatttgcatgcctttaatttctttttcttgcctaactgccctagccagaacctccaatacgatgctgaagagaagtggcaatggcactgccacttccagaaacgatcaggaactcgtcttgttcctgatcttagtggtagaagctttcaattttttgccattaggtatgtcagccatgggtttttgtagatgccctttaacaggctgaggaagttctctcctgagtttttgtttttaccatgaaagggtgttggattttgtcaaatgcttttttgctcctatggaaacgatcatgtggtttttgtcctttattctattaacacagtgtattacataaactgattttcaaatgttgaaccaaacttgcataaatccatttggtcatggtatacaatccttgtatgttgctatacttggtgtgctagtattttgttgaagatttttgcacctataatcataagagatactggtcttgtgatgtctttatctggttttggtatcatgataatatgacctcaaagagtaagttgggaactgttccttcctcttttattttctattagagtctggaaagtattggtgtgaattcttcttgaaacatttggtagaattaaccagtgaagccatgtgggccaggacttttctttgtgggcagtttttcattatttattcaatctcgttgttatacttcaggttttctatttcttcctgagttagctgcaatagtttgtgtcttttaacttgctcatttcatctaggttatttagtttattggcttatattgtttatagtattcccttagagtcctcttactttcttaaggttggttgtaacgtaccttctttcatttctaatttagtaatttgagcctttcttttttggtcagtgtggctaaaagtttgtcaactttgttgatctttttaaagattacctttaaaaaaatcacctttggttttacagattttctctactgtttttctattctctatctcaccagttttcactctaatcctattacttccttttccttttgagatgtttgttctttttccaatgacttaaggtagacgtttaggcaatttagatttatttaaaaatgtaggcatttatagctctaaagttccctctaagcacgctttagctgcatcccataagtttgatatatagtatcattttcatttgtctcaaaatatttccttttttttttttgatggaatctcactctgtcacccaggctgtagtgtgatctcggctcactgcaacctctgcctcgggggttcaagcaattttcctgcctggacctcctgaccttaagcgacccgcctcctcggcctcccaaagggctgggactacaggtgtgagccaccgcgcccggcctcaagacacttcctaattttgtttgtgatctcctgtttgacccactggttatttagaagtatactgcttaatttgcatgtatttattaatttcccaagtttgttatttatttctaactcaccccactgggatttgaggacatacttttgtacagttttaatccttttaaatttgctgaacttttttttaacagcctagcatatggtctgtcctggagaatgttcatgtgcacttgagaagaacgtgcattctgtagtagttgggtggagggttctacagttctctgttagtccttgttggtatacagtgttatttaagtcttctgtttccctgttgatcttctgcttagttttatccattattaaaagtagtatgttaaggtctccagctgttgtttttgaactactgctctcttccaatctgttagtttttgcttcatgtattttttgggggctgtttttggatgcatacatgtttataactgttgtatcttcttgatggtttcaccctgttattatcaaatatccctattttgctctgataacagtttttgttttaaagtctctccagcttttttggctgggtggtggtggctcatgcctgtaatcccagcactttgagaggccaaggcaggcagatcacctgaggccatctgagaccaacctggccaacatgctgaaaccccatctctactaaaaacacacacaaaaatgagctgggcgtgggctccccgcctgtaatcccaactacttgggaggctgaggcatcagaattgcttgaacccgggaggtggaggttgcagtgagctgatcgtgccactgcactccagcctgggtgacagagtgagactctgtccctccaactttttaaaagtacagcctctccagctttctcgtggatgctgcctgcatgatacatctttttctgtcctttactttcaacctattttatctctgaattgaaagtgtgttttctataggctgcatataactggatcttgttttctgatccaatataacaatctgtcttttgaatgaattgttaaatctattcacatttaatgttactattgataaggctggactgacttctgccatttaactttttgttttctgtatgtcttgtgtgtttttttgttcctctatatctcctttagtgtttcttttgattaatattttctagtataacattatatctccttcaattatttctttactatatttcccaagttactttctttttttttttttttttttttttttgagacagagtctcgctctgtcacccaggctggagtgcagtggcgcgatctcggttcactgcaagctccgcctcctgggttcacgccattctcctgcctcagcctccccagcagctgggactacaggcgcccgccaccacgcccagctaatttttttgtatttttagtagagacggggtttcaccacgttagccagggtggtctcgatctcctgacctcgtgatccgcccacctcagactcccaaagtgctgggattacaggcgtgagccaccgcgcccagccccaagttactttcttagaagttgctggctggcgcggtggctcatacccgtaatcccagcactttgggaggccaaggtgggtggaccacctgaggtcaggagatcgagaccagcctgactaacatggagaaaccccgtctctactaaaaatacaaaattagctgggcatggtggcacatgcctgtaatcccagctactagagaggctgaggtaggggaatcacttgaacccaggaggcggaggttgcggggagccaagatggtaccactgcacttcagcctgagtaacaagagcgaaactccatatcaaaaaaaaaaaaaaaaaaagaagttgcttaccacatacatcttaatcttttccagattttttttaaaaattagaaataaatatggaatgcatcaggaatttgcatgtcatccttgcacaggggccatgctaatctctgtactgttccaattttggaatatgtgttgctgaagcaagcattttcggatttattctaacttagagctccattccatcttcattctttttgtgctgtaattgtgcatattgtatctatgtatgttaaaagcccaacaatacttgttctaattgttactttaaataattttatgttagagaaactgagaaaaggaatgaagagcaagtatacatttatggagtttttatatttaccctcttattaccattttggttctcctcaccgattcctagggattcaagttgcaatttggtgtcatgatactccattacaactttggtaccacccgttttctttgtacagttattgcaaaatatgtttccatatgttataggttcaacaatataattagatggtttgtgtaagttttttaactgaagaaaaggagaagaaatatgcatttacacaatctcttacaattacagaattacctttacttaaggtgctctttgtttttcatgtggagtcaaattactgtctgaagtcacctgctttcaacctgaagaacttcctttggtatttctcataagtcggtatgctgcttaatttccagatgtttgtctgttactaatgagttctttcagtttttcttttctaagaatgtttttatttcaacttcatctttgaaacatagttttgtaaaatacaagattcttggttgactgttttctttcagcattctgaatatgtcaccctactgccttctgccttccattattcctgatgagcagtcagccactaatcttattggaatatccttgggcatgatgagccatttttctcttactactttcaagattttcttatctttcaggattttttttttttctttttggaggcagggtctcgctctgtcacccaggctgtgattgcagctcactacagcctcatcctcctgggttgaggtgattgtcccatctcagtctcctgagtagctgggattacaggtgtgcactactacccctggttaactttttttttttttttttttttttttcaaagagatggggttttgccacattccccaggctggtcttgaactcctgagctcaagcaatccacccttcttggcttcctaaagtgcagggattacaggtgtgcgccaacatgccaggcctcagcgtttttattaccatgtgtctgcatgtggatctgagtattccgacttggattctttgggcttcttgaatgtgtgcattaatgatttacattacatttgggagattttcagcattatttctttgataatttttctgttactttatctccttctggtactcccattatgcatatcttggtgtgcttaatagtgccccacattattttaaggccctgttttctttattctttcttccctctgttctttagaatgtttaatctctatcaacctattttgctgagtctttcttctgccagttcatatctactgctgagtctttctagtgattttttcatcttgattattatactacttaaaaaaaagttttttttgagacaaagtctcactttgtcacccaggcgcaactgcagtggcaccatctcagcacactgcaacctctgccccgggttcaatcgattctcatgcctcagcaatccaagtagctgggattccaggtgtgcaccaccatggccatctagcttttgtatttttaatagagatggggtttcgccatgttggcctggctgatgtcaaactcctggcctcaagtgctccgcccacctcagcctcccaaagtgctgggattacaggtgtgcaccaccatggccatctaacctttatatttttaatagagatggggttttgccatgttggcctggccaatcttgaactcctggcctcaaatgctctgcccgcctcagcctcccaaagtgctgggattacaggtgtgagccaccacacctggcctgattattatactactcttcaattctagaacttccactgggctcttttcaaatacttcctatctttttattgttattctctatttaacgacacattatcaaatagtcctttacttcttcaagcatagttttagttctttgatcttttttttttttttttttttttgagacagagtctcgcactgtcgcccaggctgaaatgcagtggcaggatctcggctcactgcaacctctgcctcccaggttctcgccattctcctgcctcaggcctccccagtagctgggactacaggcgcctgccaccacgcccagctaattttttgtatttttagtagagacggggtttcaccgtcttagccaggatagtctcgatctcctgacctcgtgatccgcccgcctcagcctcccaaagtgctgggattacaggtgtgagccaacgcgcccagccctttgatcatatttttaatggctgctgttaaatctggtatctggaccctttcacaggaaatttctgttgcctgctttttcttgtgtataggttacacttcctgttttttgtgtgtatgtctcaatttttgttaaaaactggacattttaggctgggtgtggtagctcacgcctgtaatcctagcactttgggaggccaaggtgggtggattgcctgagctcaggagttcaataccagcaactaggtaaaatcctttctctactaaaatacaaaaaattagccgggtgtggtggcatgcacctgtaaccccagctactcgggaggctgagagagaactgcttgaacatgggagacagaggttgcagtgagccgagattgtgccactgccctccaacctgggcgacaagagactccatctcaaaaaaggacattttaagtaatatactgtagcaactctggatactgattccccctccttcagggtttgttgttgttatttgcttatttattagtttagtgacttggttagactattttcgtaaagtctccttccccaaagactggtgaagattttcatgttgtgcctcagagagtgcaaccttgggcatgtacagagtctccctgggatgacattgagccaggctgtctttgactagctctttccatgatctctctgttaagctttctacctcttctggtatcacatccagctgttaggctctactaactgctgactgaattctcgactgtttttgataatgccctggagtatacactgctccaaagtctaattcaattaaattcaggaaggggtaatttttgaaattgagctttgttctgaccttgggagagttcttctcagctgtctccttccctggttctctggtgaactagctggcctgtagatcaccctgttcttaattaagaagagggtacctggccaggcacagtggctcatgcctataaacctggcactctgggaggccaaggagggtggatcacttgaggccaggagtttgagaccagcctgaccaacatggcaaaacccgtctctattcaaaaaagagaaaatataaaaaataaaagagtaaaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccgacctgggcgacagagcgagactccgtctcaaaaaaaaaaaaaaaaaaaaaaaaaaagagtaaaaaaaaagaagaggtacctctttttatttgcttaccatcaaaatctcctcaggcatgaacttccctggactctgttcttattaactgcctctctctgtgggcaaattctcagagcagggtcagtagcctctagtcttccgggcttgcctctcccagtgtaaaacctctgtacatgagcaagctagggcaaaggtgatcagagccatagaattcttggcctcaagtatgtgggatagagcttccacaccgtgagtacagtatggagctgggtggaggaaggaagcctctgacctctttgccatactcaccgagaacttagtctcttcaatttggagctggagggaagaagaaaagctgatggccccccactcccaatgagaaacctattccttgtttgggagctgagaattcctgggtttgtatattctgaacctgctggccagagtcaaatgctttaaggctgggcacctaaccaaagatgggccagagttctttaccaggaagctggagctgagactgggagtcttcttatttaataggcagtcttctgcctagtcccatcaaggggaccaggaaaaggtagggtacagtgagagagaagactaagaaacactgtagaaagaaaaagagacgaggagagaagtttctaggttcctaagaatgctctggttactggttcttgttagtccctgagacacagctgtctcaggtctgcaacaaagcccttctccctgaaatcaggtccactttggggagttcaatgaagtttctgtaacaagctgtcaaaagagtcttaatagtcatggtctagaattgccttgaggacaattctactctgagcaaatctcaaattaatccttcttggaaagaagagcaagaatggtcccaggcgcccaaggaaaagctcccgatcactcaggggacccatccttccataccttgattgtgctctgactcctcattggccactcgcatcagggcatctagcaccaaagcattgtctagccatgtgtaccactcttccaactcctgaaggaagctggctgtgcccgttgactctgacacctttcgagtcgccagtttgcaaagccgctcaacaaagccaggaatgctgagaagggccgctgccagggaaagaacaagcgaggaaattttcaaaatagagaccagcaaaactacccctaaagccctaacaaacaatctgcatgataggaataattcttactctgatagtagctaaagctactcttttaaaatgaatgtcaaaccaaggtaaatagtaattatgttacaggcataagctcagtttttagcaggtacagggaaacaggctttttatctactgggaatataaattagaataatctttatgccttaaatgtgtgtgtctttgagccaagaggtcaatttctgggaatttaccataacgaaataaccagtcatattacacgagaatatctgtataaggaggttcactgatgtggtttctgtaacagcaaaaaggtgaaggtaactaaatgttcatcaacagctgattaattaaatacaatgacacatttatacaatggaatactgcatagacactaagaatgatgacacatacatctttatatagtgactcaaaacagctgtttacttgttagagagtaaattattaaacaatatgaatttaattttcttcaaaaatttaaatatttgcttcttcaaaatacacaaggaatgaaagcatatataccaaggaatttactgtggctgttcctaagcaggagagaatacaaacaattctcttaaaattactcatctatagtttctaattttcctgtaacatttactagcaggatgaaagataaacatttttttaaggtaaagaaaaaaactgaataatcacccaatttttctttccaccaatctcattttattcacaatgagtgaggtggaaattctgatcggcatattagaacatcataaactttggaggcagggagatccagattcaaatcctgactccatcatttaaccttctttaaaatgagactaatgcctgatcatgtttgcctgtatatgcattaagtctccctggaaggacagaaaagaagccaagagcagtggctgccacagtaaacagccataagatggaaacagccaaaatgtccgtcaagtggaaaaggggatttaggtcactgagagtaacagtggaactgaaacttttcaataaatacctttttgaatccgcagattttttggaaccatgtgaatgttacacctaattaaaaattaataaataactagatatttcaggatatcaagggattactattaatttttgatacagtggcagttacgtttcttaaaagtcgttatcatgtagaaacactgaaatatatgcaggtgaaattatacgatgtctggggtttacttcaaaataacccaaggtgaagtagggtatagtgaatgggagtagagataaagtaagacaagctggccaggcacggtggctcatgcctgtaatcctagcactttgggaggccaaggtgggtggatcacttgaagctaggagtttaagaccagcctggtcaacatggcgaactccatctctaccaataatacaaaaattagccaggcgtggtatcgtgcgcctgtagtcccagctactcaggaggctgaggcatgagaattgcttgaacctgggatgcagaggttgcagtgagctgagactgcaccactgtactccagcctgggcaagagtgatactctgtctcaacgcgtgcgcacacaaacacacacacacacacacacccctcccataattagtgagtggctataagatgatgtttgaccttagttataaaataaaactacattgaggttcctcaaaaagttggccaggcacggtggctcacgcctgtaatcccagcactttgggaggccgaggcgggtggatcacaaggtcaggagatcgagaccatcctggctaacacggtgaaaccccatctctactaagaagtacaaaaaattagctgggcgcggtggcaggcgcctgtagtcccagctacttgggaggctaaggcaggagaatggcgtgaacccaggaggcagagcttgcagtgagcggagatcgcgccactgcactccggcctgggcgaaagagcgagactctgtctcaaaaaaaaaaaaaaaaaaaaaaagtcaaacataaaattaccatatgacccagcaatttcactcctacatatatacccaaaagaattgaaaacaggtgcacacacaaatatgtgtacacacatgttcatagcagcactattcccaacagccaaaagatgaaaatatcccaaatgtccattaactgaagggataaacaaactgtggtatctacatgatgagtattattcagccatataaaggaatgaagtactgacatgctacaacattaatgaaccacaaaaacattatgccaagtgaaagaaaccagattcagaaggccacatgctatatgattccatttacagttatgcactgcattaacgctgttgcggtcaacaacgaccacacagaagacggtggtgccatcagattataatactgtatttttactataccttttttctatgtttagatacacaaatacttaccattatggtacaactgcctactgtatttagtacagaaacatgctgtacaggtttgcagcctaagtgtatcatgggctataccagctaggtttgtgcaagtacactctatgacattcacacaatgacaaaatcacctcactgcatttctcagaaggatagagactgctaagtgacaacatgactgtatatgaagtaatctgaataggtaaatccacagagaaaaaagcagaatggtggttgccagcagttggggagaaggggtaatgggaagaagctgcttaatgtgtacggcgtttccttttggggtgatgaaaacgtgcaactagatagaggtggtagctgcacaacactgtaaatgtactaaatgccgctgagttgttcactttaagacggctaattttatgttacgtgacttccatctccataaaataattacacagaaatagatttttgtttgagacaccatttttttttttaacatatcagcttggcaaatataaaaaagtttgataatgctctgtactgggaaaggctacagacaacacggtggggaagatgaacaagtaatttctttggagggttaatttgtcaacacttaccaatttccattaatgggggactaattaaattacagtatgcctgtataatagaatattatataattacaaaaaggaatcatataattctatatatactagagtgtaatttttggcaagataagtttaataaaaagagagcagcacttattttatattacctatttacattaccatctgtacaaacaggagtcaatctctctctgtccctccctccttcccccgtcccatgattgggcatgtatagaatatttttcgaaggacgtttaagaaactggtaaaaagttaccacagggaggggaacaaactctctgctgtactttttgtatcatttaaaaaaaattttaggtgtgtattattttttctaaaaacaaatcagtaggcggggcatggtggcccatgcctgtaatcccagcactttgggaggccgaggtgggtggatcacctgagtttgggagttcaagaccagcctggccaatatggcaaaaccgatgtctactaaaaatacaaaaaaattagtcgggcctggtggcgcatgcctgtagtcccagctacttcgcagactgaggcacgagaatcgcttgaaccagaaagtggtggttgcagtaagccaagattgtgccactacactccagcctgggcaacatagccagactgtgtctcaaaataaaacaaagcaaaaaaaacaaaaaagaaataaaaagaatttgtattctacatgaaaatcttcacatagctggatttttactcttatacttctgttctcagcaaaaatagctcctgctgcttgacctgctcctctcaggacagcatgtaggagctagtcttccccattcctgcacactcaacacactcctccagatgggaagtgcccggtactcagggttctaagtctgacttcccacctgagattcttgagctgttgtgagtcactcacctcttgaaaagctaataaaagctaagaccttctccccagaaaaaaattcactggaccaatcatacctagcaactcatacacaatctcatgggctgacatcccagcatatccagtccttgtaattctcacagctttatcagtagctaccacacctggctggttaatgttaaactgacaactaaatcactcacaacccctgagaatttctgcagaagcaggcctcttctctcttctcactgttgaaacatcagtattccccccatactcctgtagtttcccctcctgctttccagcttcatgtgctgcataattcagcccctctcagctaagtgtcacttataaattgacaattatctagcctatagcttcatttacatctctgctaagaatcttgaaagacgttactttcccccagaaggaaaccagctgttctcttctaaatcgacagaagaacaactggtagttctgagaatctcaaaaaggactcaaaaaataattatttattttaaaatgaatctcaaaaaataatgacttacgctatcttcctggggctcagataatttacattagataattacatgtaaattatctgagccccaggaagatagtgtaaatcattatttttgctagacaagaaaatgacctcacagccacagtttattaaaaacgaaacgaaaactttttggcaacatcctacatatttcagctttccatacagttatggactgtgtccccaccccccgcgcccccacaaattcatacgttgaagctctagccctaaatatgactgcgttttgaaacaggccctttagggaatgcggtggtgtgatggttaattttagctgtcaacttgactggactatgggatgcctacatggctggcacagcactgtttctgggtgtgtctgtgaaggtgattccagaagagattggtgtatgagtgtgtgaactaagggaaaatctgccctcaatgtgggcaggcaccatccaattggtgggggagcagtgggaggcgatggaggaaaacaaaaagggattctcccccttctggagtgggaagtttttctcctactgctcttggatatcagactccaggatctttggcttttggtctctgagacttgcaccagcagtttctggggtcctccagccggggagctacaccattagctttcctggttctaagttttccggacttggactgagccatgctaatggcttctcaggttctccagcttgcagacggcttatcttttattttatttatttatttttggagacggagtttcactcgttgcccaggctggagtgcaatggcacaatctcagctcactgcaacctctgcctcctgggttcaagcaattctcctgcttcagcctcccaggttgttgggattacaggcgtgtcaccatgcccagctaatttttgtcgcagatggcttatcatgggactcctccgcctgtgatcgtgtgagccaattcccctaacaaatcccacctcataaatcctactgcttctgtctctctggagactgctgcctaatacagggaagtaattaaggttaaatgaggttacaaagtgtggggccctaaaccgagaggactggtgtccttctaagaagaggaagagacaccagagatctccgtctctcctcaatgacagagaggaaaattcatatgtggatacaataaaaaggtggccttctacaagccaggaagaaaggcctcaaccaggaaccaatcctgacagcaccttgatcttggacttctagcctccagaactgtgagaaaaataaatgtctgttagttaagccacctagtctacggtaccttgttatggcagctcaagctgactgatacacacacctgagataaaggcattcactactggagcgcaattcaagaatgataacattcagaggactaagactttcctcatccactcgtgatttaattatgtccaccagcttggccttcccagggcatttgaatggagaaaatcgtgcgggtaagggaatggagtaggaattatggtcagggttgggaagggtcagatcctgcacaacctcatgtgtggaactacaacttttaggctttatcccaaaagctacaagcagaatcacacatagactgtctactaggctagtcacacagatatgaaagtgaatctagattattttatagagactttaagaaaaaactcccaaataaaaaaacaaaaacaaaaactgggctttccgttctcagttaatcaaaaaagcccagctgaccagaacagttcattcctcaagaataatgggtaatgctggttttacttaagtcagtttacaaataggcatctgaaagcaatcaatactaacaggatcaaaatcatctgccagaatagattccttaaatgggaaactaaaagatgaaagttacttagtgcctcggcatacacaggcatccaatacagaacctttctagccctcagtttcctcacatgtgcaatggggatactaatctctattccacagggcacttgaaggattaaataaaatcacttctaggtaaagcagttacccagcgtttgccacataccaggagcttagcaaatactaccttttgtcaatgtatatggaggtgtgtacaccagctctgaggtataatttagttataatgaaagtcactttttttaaaattatactttaagttctagggtacatgtgcacaacgtgcaggtttgttacatatgtatatatgtgccatgttggaaagtcacatattttttaaaaatgtaaatttcctaaaatgagaactcccccaaaatcataaaggagtgggaagaaaaccgtacacagaccaaggaagaccttgtatctagtgacacaggaggaaaagcaaatctagagagagaataaactggggttggagtccacaaacttctacctttacatatgactacaacatgtaaaattatattccctaataacctacaaagtatagttatgatcacctcatgttcctaactaaaactagacaataacagagtgaatggcaggttcatattcagcctcaggagaggaggctgctctgaagcacttgataactctgcagagccagcctggggaatgcacacaactggactttagaaacaaagaactgttttcagagcatgattagggctacctctgcatggtcatggttttctactgctgctttttaatgatacatttgtataattttaccttgtttatttggtgtaccataaggtacacagtgataggtttttgtattaacaatatttccagcctgttaacattgaaaaactagcttttaagacacaagtttcagttcaaatatgaattatctacactcttatgaccaaaatacatctatgccagtttctccaaaatctgtgcaggcaacaacattttagatagaacacagttcttttgctactgaacagaaataggtgggctagattggttagaatagtgttttgtttttaagtaatatatttacacggttctaaaatcaaacaatatatgaaagtatacagtaaggagtcccactcccactgctactaccttcccttaccagctacttcctattaataaccactttatgtttcttgtgtaccctttgtttctttaggcataccatatatgtgggcaaacgtatggtcttattctccccctgacttaatacaaaaactataccatatacacactgttctgtattttcctctttatcattaatatatcttggagatttttctatagcagtacatagagatcttcattttttcaaagctacacaattttccattatataaatattgaatacactaagcagtccagtgttaatgaacatctgggtttctagtcttttgttattacaaataatgttgcaatgaataatttttttttttttttttgagacggagtctaattatgtcgcccaggctgaagtgcagtggtgcaatctgggctcacagcaacctctgcctcctgggttcaagcaattatcctgcctcagccttctgagtaactgggactacaggcgtgcaccaccacacccagctaatttttgtatttttagtagagatggggtttcgccatgttggccaggctggtctcaaactctgaacctcaagtgatcctcctgcctcggcctcccaaagtgctgggattacaggcgttaagccaccgtgcctggcctcagtgaataatcttgtacagtagtcctcccttagtcaagaccctcacagtggatacctgaaatggcagatagcaccaaaccctatatatactatgttttttcttatatacacacataactatgataaagcttaatttataaattaggtacactaagagattaacaataactaatgataaaatagaacaattgtaacaagatgctgtaataagagttatacgaatgtggtctctctctggaatttttcagttaatattttcggattgcagttgaccacggataactgaaaccacagaaagtgaaactgcagacaagaggagattagtgtctatacatcattatctataaaatgaaggcccaggagagacttagtagatcaaaaagtatatgcatttgtaattctgataaaaagtagttcttaactttttttgtggttctgagcccattaacaaatctaatgaaaggtatggaactcagttcccaaaataatgaacagatacacaaaatttacatactaggagccttcacatggatccatctctagagatatttaaaaggggtgctaggtgtggtggctcacacctgtaattctagcacttcgggaagatgaggtgggtggatcacttgagaccaggaagtcaagaccagcctgggcaacatggcgaaaccccatctctacaaaaaatacaaaaattagcccggtgtggtggcacctgcctatagttccagctactcaggtggctgaggtgggaggatcacctgagcctggggaggtcaaggctgcagtgagccacgattgtgccactgcactcctgcctgggtgacatagtgacgatcccatctcaaaaaaggaaaaaaaaaaaaaaagaaaagaaaagaaaaagaaaaaaaactagatgatttagtaagggcctcagagctataatctcaaaattctgagaacttggagactttaccttgattgatttcagctgcagaaggccccaaactcaagctcttcttctgttgagcatttttggcaagaagcgtgtgcttgtcatcattccctgtatccatctctgaaatggtgacagccagaatccggcagaaattagcgagctgctgctgatcgaaattggatactaaggaactcagattggggacttcatctagtcggatcatttcctacagaagacaaaaatgaaacaatccccatgctcaattcactcaagagattggatgtgcctctctttcgcatccccttacatacggggcttagtggctagatcacttaggttcctatcccagctctgtaacttgcagctctgaaactttggttaagttacaaaaacctttcgagtctttgcttgtttatctgtaaaacggaactaatctacctcacaggattagtctgaggactaaatttaccttttgagcaccactgttttcaattgttcttgtggtatattttgcctatttaaaaaaaaaggaaatgcctaccactcaagttttggaaatcataaattaccattcttgctacagatttgcttttttaaaaaataaaatacttcaaatatagctaaaggcctctgtgtatcccccatccagtcgcatttttttctctccctgcagacgtaaacattattttgaactctgtgtttattattcccgtgcatgtttttatacttacaaatatttccattaaaatacatgttactgctctgcatgcacagtgtgaatgataccatactataccttacttttcatccaacattttgaagtttatctacactgatacaagcagctgattcaatcacttcccgccgttttaccccacagtttaatcatctctctcttttaagagacagggtctcactctgttgctcaagctgcggagcagtagtgtcatcatagcttactgcagactcaaactcctaggcccaagcaatcctcctacctcagcttcccaagtagctaggactacaggtgcgtgtcattacacctggctacttttttaatatttttttttttgagatggtatctcattgtcgcccaggctggagtgcagtggcgcaatcttgactcactgcaaactccacctcctgggttcaagtgattctcctgcctcagcctcccaagtagtggggattacaggcgcccgccaccacgcctggctaatttttgtattttttagtagagatggggtttcaccatgttggccaggctggtcttgaactcctgacctcagatgatccatccaccttggcctcccaaagtgctgggattacaagcgtgagctaccacgcctggccaatactttatttttatggagacagggtctcactattgttgcccaggctggaactcctggactcaagcaatcctcccaccttggcctcctaaactgctgggattacatgtatgagccactgtgcctgaccctttcttcttttaatacatatttaggtaaactacagtttttcactattaaacaatgttgcaatgaacattcttacaggtactctctgtgtacacatgtatgtgaccatttatccagagtgagagcaagaattcttgtctttttcttgactttaccagaaataattccaaaacattaaaattaagttcaatatttgctgtaaattttaatatcctataagttaaattttaataaataccctatatatagtttataagttttccttctattgctagcttttattaagaatgataattttatggaatgccttgtgctatttggttctattctcactcattactccttaaaatctgtaaatggcatgtactacatcaacttttctcattttgaaccatccccgtgctactcagataacacctgctatccttcatcccactaatttacttccactggattgggtgtttctctttcactgcacagatcacatgaacttttaataatctgttcctgcatctatttcccaaataatctgaccatactttgatgaaggcatatatcctaccctttctcctgagactcaatgcacaggacctggtagcaagggtatcagtgaatgtgcccaaaacgagtgcatgattcctagaagctctcatgaatcccatactcgcctctatttctagtaatggaggacaggaatttgctgtgcagggggcattggggaacaactgcttccacttttccttttccctagtacaaaacaaatgtaagctactactattattggcaactgtaacttgtagctcaccagttcctctagccctgtctaactcagtatatggttcccaaaacaggtcccaccacccccagcccacttcttatggttttttgttttgtcttaaattttaagatttttttttttaaggcggagtctcactgtgatgcccaggccagagcgcaatggcacaatctctgctcactgcaacctctgcctcctgggttcaagcaatttttctgtcccagcctcccaagtagctgggactacaggcatgcaccaccatgctgggctaatttttatatttttagtagagacagggtttcaccctgttggccaggctggtctcctgacctcaagtgatctgcccacctcggcctcacaaagtgctgggattacaggcatgagagccactgtggctggccaagaatttacttcttatgttttaatttttgatatgtacaatacgtattatgcagcacaacaaaatgactagctgtgtgtgcctttcctattgcatctctctgcctctgggaaccaccatcattaattattattgccttgccatttaaaaactagttttatcaacaaataatttgcttttttgagctttatgaaaatgatatactacctacagtgttctgcaactggcttctaccactcgattatttcaattactcagctatgttgttgcctatggcaacagttcattcatttctactatataatattccattgtgtgaagaaagtacattcatcccttctcctattcatggatcagagacttggtttcagttttttgttctgaaacaacgaagctacaaatgttcttatgtgtttcttgatgcacaggtggagaagtttttgctggggcagtggcttctaaactttttagctatcaccaagaacgaccaccagtaaacatacatattggaatgtatatagaaatgtcaaacaaaaacttattcaaaaaatacccttacacaatacagtttgatcttttctacttggctggtagacccgatggactgactttacaaccttctgggtttcaatcctaagaatcactgttctaggactgagcttccccacaagtgtgtccaggcacaggttataggtaacccatggcaaaatactgatgcctcagccctcagggtaaagcttccctaggtgctggggcacaagatatgtgcctgttcaactacaaaacaaaaaaaaagaggatattctgctgataaacatttatcagtagtatacaagtgtttccactgatacacacactcaccaacatttgcccactctctccctcactatggtattgatttgcatttccttgattgccaatcaagttaaacatcttctcttttatgtttatggaccatttctttcttgtctgtgaaatgcttgttcataacattgcccatttgtctactgggctatttctctttttcatgctgatttgtaagaattctgtttttttttttttttttgagagggagtcttgctctgttgcccaggctggagtgcagtgacataatcttggctcactgcaacctctgcctcccgggttcaagcaattctcatgccttagcctcccaagtagctgggactacaggtgtgcaccaccatgcctggctaatttttgtattttttagtacaaaatgagactgggttttgccatgatggccaggctgttctcaaactcctgacctcaagagatctgcctgcctcagcctcccaaagtgttggaattacaggcatgagccaccgtgcctggcctgtaagaattattgataaattctgaatacaacaaatcctttgttggttacctgaattcaaatgtcttttcccagtttatggtgtttccactttctttatggtatctatccccctttcaaactgcaccaagatacccataatgtttggtggaacacctcgccattttggggtacacaaaaaggaatgagagggagtgagaggcaagtgggaaaagttgtgaaggagcacttctagactcctatgctgagactgctaaggagtctggagtttccactctggaggtcccctttcacacactggctggaacacacaattactggaataacaacaaagcctttttatcaaagggcacaaagggtctgtctggggcctgcacacatctccaatgtgttcctacagacaataggccacttgtgctgggcaatgacaagcaaggcctggggaaagcacagcaagaagaaatgaacgctgggttcaccacagtgcacatgaacatccacctccctgcaacagcaacctctaggaggctgctcaacaggaagagaaagaaatctgccaaccagcaaccaacatggaggctcaggacagattaggactggggaggtgagctccaggtcctaacaagcattacaccaaaaatgtaacacagtaagtctctaacagagatctatgaatgtatttttgggtatctgtgaattcttgaaatttttaatttagttttcatttcgatcatagctgtttttttttttttttaaagttatgggtcatccgaatattaaccttatgaccaagtggcaggatttcagagctcccatttgtctcctactgcgctggtgccaattaaccaactttaattgttgaagactaatgagaaaaaatagaggcggacttcataagtgaaagccaaacattactaccaaggagaacatatcctaatgaatgaaggcttcacaccagttcagatagcggtaaagtggtaagagaatggagtcactgcatagcatacaatagcacatacatgctacaaagaacttgccccaacggtgatgagtgaggggcaatttgatttcagcaaagtaacatgaggcatcaccctacattcacagagtcaatctgaagttctgagttttagaattagtttgatttcaatgtatgtctgtttaggttttacagtcatttaagaaccactagtataaggggtaatcaagttttatacttgaatacatctgagtaacaagacataatttaacactttcttttaaaaaagctctgtatattattcagttttgagaatccaatggtctgagacacccttccccatctggtcagctagaggacacagctcacctttttaacacccaaaatatcttcaatgagggttgctgtttgtaagaatgtcttcttacttgtcatcaatgtaaacaggaagatcacaaagtcattcttttctgccaaacgctttgtaactccctctgtctgtcacaagaagaaaaggcagaataggttgtaagtacaaaataaattatgaaagtacaaggcatcctttacagacactgaaaagcagtttcacctctgaaaactggcatgagtcaacaaaacaggaatggcatggcttaactgtgggaaacgctcgttaactccccagctatggaagaaaaaagtctcctgacgtgcaggctacacaagtgggaactcacttgtgagaacataacacaatgagatggtatttcctaaaataacttatctcagagttctgaaggccattcttaaatctgaaatcaaacagtgccgaagcatggacttaagagtcagacctaagttctaattccagctgtgtgatcctgagcaaatcacttctcacctttggaactccatttttttcatcagtaaaatgatcatcttaaaagtctttgaggccaggcgtggtggctcacacctgtaaccccagcactttgggaggccaaggtgggcagatcacttgaggccaggagttcgagaccagcctggccaacgtgccaaaaccctgtctactgaaaatataaatattagctgggtgtggtggtgcatgcctgtagtcctagctactcaggaggctgaggtaaaaggatcatttgagcccagaaggtggaggctgcagtgagcctagactgtgcaaatgcactctagccttggcaacagagggagaccctaactcaaaaaaaaaaacaaaacaaaaaaaccaacaacaacaaaaaaacaaaacccccaaggggtatgaaggaagttaaggaaactagctggtaaaagaccttaaaacttaggttcaagagtttggatttaaaactgcagtattgtcaagtgcagtggctcacacctgtaatcccagctaccccggaggctgaggtgagaggaccgcttgaggccaggagtgtgaggccgcagtgagctacaatctgtctcaccactgcattccagcatggggacagagtgaaaccctatctctaaaaagaaagaaactgcagtactgctatagcttacacacacacacacacacacacacacacacacacacatatatatcccacccctactgccttaaggcaactagagcttagtgactttaatatttcttttttttagcctctaagctgaaaaaattccaaggtttactgcgataaacttgacttctccttaaaaagtataatcaagagtgcagacacacacagtttggtaaatgggaaccccaagctaggaggcatttcagaatcagtgaaatgagatatgttgcaacaaatttaattttctttcttttaattttagagacagggtctcactctgttgcccaggctgaggccatgactattcacaagtacgaatatagctcactacagcctcaatcacctgggctcaagcgatccccccacctcagcctcctgaatcactgggactacaggcgtgcaccaccgcacctggcaaatttaattttcaaagtgaaggcatcaataaagatgtgccacgtatataaatctttgacgatcacattaaataggacactaaagaaagcaatctccatctgtattaatacatttcggttcttcagtcgtagcactgacacattaaaaaaaaaaaaaaaaaaggttgttattcccgaactacatacagtacctacactggctatgatatgtgaaacaggactgactctagttttactgacaagcaaaagttctggaagatccaaagaaacagaacaaaaagagaactaaatttacactttctcaaagcttaaaaatctatctccaggctgtcaaatacacaaccctgctgctctaactagctacccttgactacccacctttctcctctcttcaatttatcaaagtgctactccttttacagactgactaaaatgactcctcttggaaaaccttcccaagtcaacagtggccacccaaaaggccatcacaatccttcctttcctctatatcacaagttcttaactgaggccaaaaagcactaaaacaatatataaaaggttgtatgcaactacatttttcgggggagagttttttccatgtaacattcatcataggtttttttttggtttttttttttttttggagacagggtctcactctatagcccaggctgagtgagtacactggcacaatcatggctcaccgcagccttaacctctcaggctcaagcaatcctcccacctcagcctcctgaggagctgggactatggtatataacaccacgtccagccagttttttattttttgtagagacaggttctatgttgcccaggctggtcttgaactcctggacacacacaattctcctgcctcggcctatcaaagtgttgagattataggtgtgagccactgcgcccagcctaatcataagctcttgacctagtatctgtcaagtatctaaatgaggagctacaaactagcatccagtaggccaagctttttctggtgagcagtactgtttatttttttatcttttattttttgagagaccctcactctgtcacccacgctggagtgcagtggtgcaatctcagctcactgcaacctctgcctgctgggttcaagtgattctcttgcctctcctgagtagctgggactataggcatgtaccaccacacctggctaatttttgtgtttttagtacagacggggtttcaccatgttggccaggctggtctggaactcctgacctcaagtgatccacccgcctcagcctcccaaattgctgggattacaggtgatagccaccgtgcccggccaacagtactttttaaacttttgaattcaaacatctttagacaggacatacttgctccagtttagtcacagtttacacaagtccccactccaacaccagcaattccaaacatttcctgttttctgcctgatccctggaggcattggtgtttgcaaccctgagagccccaggttctctacattaacatggaattcagccagatagcacataattgaaccatatcgccctatgttcctcaaattttttaaaaaattttatttaaaaatacttttagttgatatataataaaggtacataatttcagggagcatataatttaatacattcgtataatttataaaaatcaaatcaatgtacttgggatagccatcagcttaaatacttgtcttttctttatgctaagaaccattcaaattctcttctagctattttgaaatgtaaaacagaacagaatattataaactaagtcacccttactgatttatctaacactaggtcttatttatcatcccatatatttgtacccattaatcaacttctcttcatacatttcatttttttaacttaactgttttattggaatgtcactgattaacattaggtatcatgattttaaaacggcctcataaaactagtgactatatggagttgccaaagatggagtcattatattatacactgtcttcttctataaggacaatttcttattggccttagttgcaagaactgtgcatttcctgaacaatttgaaattttatcttatagatctccctgtgcctatctctgtcattggctatacatggctaccgagcacttaaaaggtggccaggccaaactaagatgtgctctgggtgttcaaacaagaggaaagaaaaacaaaacacacacacacattggattttgagagctcaatacgaaaaacaagtaaatatctcattaataattaattatactgattacatgttagaatgacaatattcttgatacactgtgttaaacagaatttatcattaaaattaacttcaccacttcttcctacttttttctttaaaaaaatgtggctacaaggaaatttaaaataacccaagtggcttgcattatatttcaattgcacagcactattatagatgctgaattacgtaagtgttcaaacatattcccctatttgtgttggctgctaagaagcttgaagccaaatttgtgcccatccgtaatacagatgattttatggtcttcatttttatatcagcccaattcctggctatacgttatgtccccacctttatcttcttctttcttacctgcttctaagttcgtgatcttggtagattttgcatacacccacaagatgtcagaaatcttattttgaatgaggcaagaaatgaaatggagctaaatgtttttttttttttatttccacagcatacagggttcacatttataatagcgctcgtctcattctgccatgtattatgattcacagtttacacagtttatcataagtttctaaaagacaggtactgtatcttttaaaaactaacatttatatattgttttacaaagtgttttcacatctactatctcatttctcacaataaatctatgatgttaatacaactgctaactgcattctattggtaagaaactacggcttgggaggtgtactaagccaagggccagaacacaaaatcaggtcctaacactaagtgccatcctcttttgtttctaccagattgctttctttattcaccattcttcctggctcagtggtcaacctagtagagtcctgctcaatatatgggcggggcttctggttctcattttgttttctaacaaggaaaatgaagaaataggcataatggagttaaaatgagtcttaaaggtcacagtctgccaacacttgtcaccttttgacaagtgtccagtttctacttggacagctctaaggccaaaggagtttactacctgctgcagcagtcctggctcttaacaactgctacaaaattctgcctccccgtaatttctaccagttagtcctgattttcaggcacacataaaataagcccgattcccccactgtctgaaagcagctcttatgtctgccattctactcgaatattcccatcttaaacattgcagacctggtaggggagataaacagagccccagtggcaggggtacttacacagacacaggtattatacaggatactcaagcagtccttggacatttcatcacttactgaaagtgaaagggtaatgactggttatttttctcaatgaaaagatagtacaacagttaccacatttttttcagcataagaactgttataatcccctccaagatgattatttttcctttaatatacttcttccagcccctgtctaccaaaggttttcatagtgcccatcagaacctacaagcccatttgcatattgcttttggtttgatacagcagctgttttcttattatgctccacagtcttcataatttcaacctgttgttgtgccatcatttaataaagccattttcccttaatgtcttgcttaggatatatctaggatttgttttttttgttttttgtgttttttggctatttaagtagaccacaaatgaacaacttaatatatatgtgtatccttttcatgtttgtattaaactagttcctcaagatacattttcaaaagtagaactactagaatctaaagtataggcatcttttttttgttcatttgttttggttttttaaatgaggtcttactctgtcactcaggggcacaatcacagctcactgtagtctcgaactcctaggctcaagcaattttccctcctcaccctcccgagtggctaggactgcatgcgcgtgtaccacgcctggctaaaagttaaaagtataagcatctcaattgctcttgttataaatttccattgaaagttctactgcagcaaacaaaaataccatttttatcagactcattaactgagcatttctttttttgttgctgttatctgtgttgggcaaatggctcttaatgtctgatctattactaattcttataaagaaactactacttccctgtgagcaggaacaggaaagtagcataaaaacgaaacttaattttcatgagcccaaaaccaaaagatgatgaaactgagtatgaaccatggacaaagtgctttatttggcacttgcttctattttttaaaattgtttccattcactcctaagctgctaggaatgctaaaatgctaggtctccttctcagatcccaatgggcagccctgccaagctagcttgactagatgggttgtctcataatcctgagacaacgcagacgctctgcatcccttatcaccacctttcaacctactggggctctgtgattgatttatttaacgacttcagagcagggtgaaacactgctctgcatgtctcactatatatctcactatttctagatcctccatttttaaaaggaattgggattcactcattcatcaagtattgttcagcatctactctagagcagatacagtggtgagggaaaaaaagtctcagccttcatggaacctataaatctagtgggaagaagagagactaaacaagtgcaccaacaaataattacaatatgctacttgctatgagggtacatagagaacatgaaagaccaagttagaatacacagctgagacattaaaaatgaatataaatcctcttaataaccactactgcatgcacaaatgaggccttatacagtatgtcgtattggggtaaaaaaaaaatcttttaaattaaaaaaacgcaaagttggtaggagggcattcaccaaacattaactgaagtcatctctggcttttaacaccagagtaaagtgcattcacttttttattttaaattaaataccgaagctgggtgcggtggctcatgcctgtaatcccagcacttgggaggctgaggtgggcagatcacttgaggtcaggagttcgagaccagcctggtcaacatggtgaaaccccatctctactaaaaaaaaaaatacaaaaattagccgggtatggtggtgggcgcctgtaatcccagctacttgagagggtgaggcaggaaaatcacttgagctcaggaggcggaggttgcagtgagccaagatcatgccactgcactccagcctgggcaacagagcgagagactgtctcaaaaaaaaaaaaattgaatacctaaaaagaattatttgtaacgtgtaagttataaaaaataataatagaatattacccatatatctaccacccagcttaagaaatagtgcataccaaaacactctgactttttaccattcacaccctggtaatgcctgaactttttacaaagagcatgtatcacctttctaaaaaaaatagtttaaaaaaaataaaacagagtgatcttactctctcagctagttatatgtgagaaagaagaatttcccaaggaaacatagaagctggatcacaggactatcaaaagtacaaagatgcattctcttaacccagatctgaatttctacgcagtacagaatgaataaagacagctgcttagctgggggaggagagagcaacctgtagctaaatgtaagacatgtccttactattaagagttaggaagggaaggaagaaggcagctgctgggaactgccaccgtatcggcaggttggaaaacaaggaccagtagctaataggtatacttacttttcagtttctgtccccggatagagatcgtaggcctcataagaatttctacaagaagctataaaaaaaattagataaaatcttcaaaattaattcaaagtataacttataaaatgattttgccataaccattcatggcccatgtatctgtcacagtattacaagacccttttgttccaggaggcagttaaggttcagtaaggctcctgactgcagcaagtcaggagacccaggttctagtcccagcttggccacctacttgcccttctctggcctcagctttctcatttttgaaaagaagtattttagattaggtaatctctgggatctaatgcggctttaatttctgaaaagctgcagaacattattactatgattcttctgtttaaagaacatttgtaagtttattttaaaaggactcaaaagatacaccataaattgttaacactgatttctacaggtttgggggttatatgcatgtgttttttattttacatactttaatacaattttgcacaaactgtttaaaataagcatgtatttaaaaattcattctacggagagaaaggatagttgataaaagggtcaatccattagaaagatataacaactacaaatatgtatgtacctaacaatagagcccaaaaatacatgaaacaaaagctggcagaaatgaaggaaacagataatttaaaaataaaagttggacacgttaataactctgctttcaataatagacaactaggcagacgagcaaagaaatagaagacttgaacacaacgaacacatatattctaacagacatctacagaacactccatgcagcaagaacagagtatacattctactcaagtgcacatgaaacattctccaggacagatcaaatttcaggccactgaacaagcctcaataaatttaaaagcacttaaatcacatacagtatgttgtgtggccacaatggaatgaaattaaaatcagaacgaaatttgggaaattcatgaattatatggataattttaaaaacccatcctaaataataatgggccaaagaagaaaccacaaggggaagtataaagtatccaagaaggatgaaaataccaaaacttatgatgtagctaatggagtgctcagagggaaatttatagctgtaaatgcctatattaaaagaaaattcttttttttttttttttttttgagacagagtcttgctttgtctcccaggctggagtgcaatagccctatctcggctcactgcaacctccgcctcctgggttcaagcgattctcctgcctcagcctcagagtagcagggattacaggtgcctgccaccactcctggctactttgtgtatttttagtagaaacgaggttttgccatgttggccaggctggtcttgaactcctgacctcaggtgatctgcccaccttgacctcccaaagtgctgggattacaggcatgagccaccgcacccggccaaagaaaattgtttctaatcgataacctaatcttctaccttaagacactggaaaaagagcagactaaacccaaagcaagcaaaagggagaataagagttgaaacaaatgaaacagagaatagaaaataacagaaaatgaacaaaaccaaaagctggctctttgaagactggcaaattcttaactagactgaccaagaaaaaaggagagaggatacagattactatactcagaaataaaggagagggcattaccaccaaccttatggcaacaaaagtgattataaggaactactatgaacaactgtatgccaacaaattagatgacctagacgaaatggacacattcctagaaagacataaaactaaaaactgacttaagaagaaacagaggctgagcatggttgttcatgcctgtaatcccaagactctgggcggctgaggtgggaggactgattgaagccagaagattgagaccaccctggccaacacagcaagaccccatgtctctacaaataaaataaattagctgggcgtggtggtacgcctatagttccagctacttgggagactgaggcaggaggattacttgagcccagaaggttgaggctgcagtgagctatgatcatgccaatacactccagcctggatggcagggtgagactccatctctttaaaagaaaaaaaagaagaagaagaaggaagaagaagaaagaagaagaaataagaagaagaagaagaggaagaagactacgacgaagaagaagaagacgaagaagacgacgaagacaaagaagatgaagaagaaggcgaagacgaagacaaagatgaagacgaagaagatgaagacaaagaagacgaagatgaagatgaagaaaagatgaagaaaagacgaagacaaagatgaagatgaagaagacgaagacgaagaagacaaagacgaagaagacgaagaagaagaaaaaacagaacatctgaacagccctataacaagtagagactgacttagtgatttaaaaaaaaacaaacaaaaacaacaataacaaaaaactacccataaagaaaaaccttggacatgatggctccattggtgaacaatacaagacatttaaagaatgatcaattcttcacaaactcttccaaaaaacagaagagaaggaaacatttcccaactcattctttgaggcgagtattaccctgataccaaaaccaaacaaagacatcacaagaaaactacagatgagtatctcatgcatatatacacaaaaatcctgaaaaccctagcaaacaaaatccagacacatacaaaaaggattatactccacgcatgatggcttatgcctgtaatcccagcactttgagacgtcaaggcaggaggactacttaagcccaagagtatgcaaccagcctgggcaacatagtgagaccctgtctctacaaaaattaaaaccaaaaattagccaagcatggtagcatgctcctgtagtcccagctactcaggaggccgagataggaggctcgcttgagcccaggagaggctgcagtgagctgtgatcacaccactgcattccagcctgggtgacagagagaccttgtctccaaaaaaaaaaaaaaaaaaaaaaaaacaagaaaaggattatacaccatgacactatgacaaagtggaatttatcccaggaatgtaaggttggttcaacatatgaaaatcaatataatacaccatatcaatagaataaaggacaaaagccaaaagccacacggtcatctcaacagatgcagaaaaagcgtttggaaaaaaaaacccaaaacactttcatgataaaacaatcaacaaggaatagaagagaacttcttcagcctgataaagggcttttattaaaaaacccacagctagcatcacgcttaacagtgaagactaaatgctttcccattaagatgaggaaaaagacaaagatgtccactctcgccacttcaatttaacattgtactgagtgttctaaggcaactagagaaaaataaaaaaagaaattaaaggcacccaaattggaaaggaataagtaaaactaactatttacagatgtcacaatctagaatacagaaaattcctaaagaatccactcaaaaaaactattagagccaataagcaagagttcagcaagatttcacgatatgtgatcaatatacataaatcaactgtatttctaaaattgtagcaagaagcaaaaaaaactggaattatgaaaacaattccatttaaaggagcatcaaaaacagtaaaaacacttagaaataagtttaacaagtgcaagacttgtacaacaaaacatttttgaaagaaattaaagacaatctaaaaaaatggaaagctatcttgtagttcatggatcagaagatttaatattgttaagatgataatactccctaaattgacctacaaattcaatgcaatcactatcaaaatctcagctggcttctttgcagaaattggcaagctgatcctgaaattcacatgcaaatataagggatgcataacagccaaaacaatcttgatctgtaaatacaaaaataaacccgtgtctatgatcagttgatttttgacaaggttgccaagacaattcaatgatgaaagagtagttttttcaataagtggtgctgtgacaactggatagtcacatgcaaaagaatgaaactggacccctgcctcacatgataaacaaagtcaatgcaaatggatcaaagatctaaatgtaagatacaaaatataaaattctcagaagaatacataggtaaatctttgtgaccttggattaggaaatggtttcttagatgcacaccaatacccaagtaacaaaagataaaatgaacttcatcaaaattaaagactttgtgtttcaaaggacaccatcaagagagtgaaaagacagctacttaatgggggaaaatatttgcaaattacaaggaattagtatccagaaactaatacaactcaataataaaaagacaacccaatcaagaaatggagaaagcagatgaacagacatttctccaaaagtccaataataaacagatgatcaacattagtcatcagggaaatgcaaatcaaaaccacaatgagatacctcttcatacctactacgatggttataatgaaaaagacaaatagtaactattggcaaagatgtggagaaattagaaccttcatacactgctggtagatatgtaaaatggtgcagctgcttcagaaagcagtctggcagatccttaaaaattaaacagagttaccagcaactccacttctaggtatataccaagggaaattttttagtaagacaatctaatagaaaatgaaaacacgtccacctaaaaatttatatgccaatgttcatggcagcattattaatcatagcagattactaataatagccaaaagtgggaacaacccaaatgtccatcaactgatgaatggataaataagatgtggtctatccatacagtggaatatttcttgacaataaaaaggaatggagtattgatacacgttatgacacggattaaccttgagaacattatgttaagcaaaagaagccagtcacaaaagaccacgtattgttatgactccatttatgtgaaatgtccagaataattaaatctataaagacagaaagtagattagtggttgcctaaggatgtgggagggaggccttgggaggaaatggggagtggctactgaagaatatggtgtttcttttttggagtgatgaaaatgttttaaaatcaattgtggtgacagtggtatataactctgactatactaaaaaactgaattatatcttttaatatatcttttaaatgggtgacttgtatgacatgaattatatctcaataaagctattatttaaaacaataaaacacctcatgctcagttatagaagctagacataaaaagccacacagtggacgattctgttgatatgaaatatccgtaacaggtgatatggtttggctgtgtgccctcacccaaatctcaccttcaattgtaataatcctcatgtgtcaagggtgggaccaggtggaggtgactggatcatggaggcaggtcccccatgctgttctcgtgataacgagggagtctcatgagatctgatgattttataagtgtctggcatttcccctgcttgcactcactctgtcctgctgccctgtgaagaaggtgcctgcttctcctttgccttctgccatgattgtgagtttcctgaggcctcccaggccacatggaactgtgagtcaattaaacctccttcctttataaactacccagtctcaggtatttcttcattgcagcatgagaacggactgacagaacaggcatattatggacattatggatatttcacaacaggcataatacagacataaaatagattaacggctgccagagctggggagaaggggagatggggagtgactgctaatttgtacaagatttctttttggcgtgataaaaatgttctggttatcactgcacaatactgatgggtggttacaagaattaactttatgtaaattatatttcaataaagctgttattgctggggaggcagggtggctcgtgcctataatcccagctactgaagaaggtgaggcaggaagatcatttgagaccaggagttggagactgcctaaggaacaaagcaagacccccatatctctaacaaatattaaaaaattagccacgtgtgatggcatgaacctgtagtcccagctactcgggagactgaggcaggaggatcactagagcccaggggttcaaggctgcagtgagctaggatcgtaccactgcactccagcctgtgacacagtgcaactctatctctaaaatcatcccaacaatttttaaaagctgtaattaaaaaaaattctgttaaacaaattctaggttaatataaacagaaaaaaataaatgttagaaaggaatactcccgaatcttaacagtggttgaattttggtgacaagtcccaagacagtttttcacattttccttgacaaacaccttttccttttaaaatgagaaaaattaggacctttgttttccaaaaaagtccaattttcacttaaagcatttaaaaattatctatatgctgagaatatgactaagcccatatgtttaaagacattccctatatacgtatgtattttttattattgtttaaatcaagctaggagctaccccagaacaaaaagaaaaattcttccttagccccttctagctataggccaatacttaggcagcatgtccaagacacctcaagccaaatgaagaaggaagattccatagcattttttaaattaaaaagccagcaggcaaatctttgagactagacagttcagcttgagggtctgagaaagcctctgctcatctcaaaccagcaacaaatctttagaaagtaattcacatgccatgagattgctcgtggcatgaatgtgacactataattcaacatcctgaattaagagagatgtgttattttagcttaaagcagcagattaaaaataaaaatcctaaactactacaccacagattgtcaattctagagaagcactgggctcagctttctgcacatctgtatttattgttaactgcacttgcaggagggaaaagaaagaagtctcatgacttgaggcaacaatgaaaactgccctgaacatatgcctgctttgctttgtataatagagacctaaggtcatcctctagaaaaggtgaagtaattattatacagtatataaccattttatagcctgttttcatcatgaattttcccatattactataactttaacattatattaacaacttcataaaattcaacaaaatagatagaataaccattatcttctcctggtagatagtcattacaaataatgttacacctaacggtcttggtatacacaagctttatctcattttgacttacgtcttcatcagagtcacagaaatggaaacaacagggcaaaatgagtagtaatgtttaaagctctgaagtatactacaccaattcttctcaaaagagatcacattcatccaagtaagacgtaagatgctcaagtgcatagaatgtatttaaaataaattaacttcaaatggaagatagactatgtcagtgaataaaagttcctgaatgccaagcaatggcttacacctggcccacaattactgaaaagctggaagatttttacctacaaatctagatttcccataacctctcagggaaacactcaatgggagaggaagagtcatttcctccataaaagcaggcacacactctctagcccaaaacattccccatactcatttaatttatgcagatgagcttgctctgggtctgcttcactccacttagttacatacttcacatctgctttgtaaactctaagacacacttttcacagtcatgttatggatagggtcaggctgacaaggagtgatcccactgagctttgggcagcatgaccaagagaggcttactttgggttcttgctagttattagcagaggaagaaataacaagctgtttggaaaatactaccagcagcaggacagcaagagagttcactaacaaatgcacccaaactgaaggtcagtgaggtgcataattacttaagcaggagcccatgtttataaaatgactgggattcctggagaagctgccctaactcaaagcaggaaagaaaaacccccacaaaatcaagaacagttgatccaaagatgtccgaagatgggataggctcctactagagagccacatttccactgcaaatagacacaggctacagacctacattattatttttcctcccataaatacatcagttcttactaagtagatttcttgatgaaacaattcaaaagtaaagggtctcttgagctagccaagtaagtaaatgccctaggaccaccgacactgctgtggagagggaatgcggagcagcagttaaagaagaaaggctgtggctgatgccatgcatgcagatgtcacactcaatctttactttactggaaaatggtagctttaaacaaaaggaaactttaataattgaagtataacgtgataccgcataaagagtacaatttttttttttgagatggggtcttgctctgtcacccaggctgcagttcatggtgcgatctcggctcactgtagcctcaacctcccggactcaaccaatcctcccacccagcccccatcaagcaactgggactgcaggccatgtgctaccacaatcggctaatttttttaatttttagtagtgatggggttttgccgtgttgcccaggctggtctctaactcctcaactcatgcaatccgcctgcttcggcctcctaaagtgctgggattacaggcatgagtcactgtacctggccatgagtataaattgcacatgtagttttacacactgaacaccattcctgtacaatcgccacatagatcaagataaagactaaccataatacccagaaatgccctctccctcatgttcacttcaggtaatggggttaagggcagatatctaggggagcaaagtcagatcctaacccctcagtcattacaccaaaataaacttcaaatgatgcaaaaatttaaacatacacaataaaaactgtaaaatattagaaggaaataggcatggtttaaatccaacagtgggaaaggcatgaaccaaaactctgaagccattatagtaaaacactgatcaatctgacaatctaaaaattaaacatttctaattttaaaataacatcaaaatttaattctcaaaatagtaaaaaaacacaaatgacaaaggcctttaaaaaatcaaaagcacttacagatcaataagaaaaaggacaaataatcaaatcgaaaaaggtgcaaaacagaaaactggcagaaaaggaactacttataaacacaagaaaaaatatccaatctcagtcatagaagaatgaattttaaaaactatgcagagaatttataaagaactcttacaacacaatattcaaaagagatatatctcaactaagaaattgaaaaaggagagacagacatttctccaaggaagatatacaaatgacaaactcaagaataagatggtcatcattggcaatcagagaaattcaaatcaagaccacaatgagatgtctcttcacactcactagaatggctgtaatcattacagggctggagcgggggctcatgcttgtaatcccagcactttgggaggccaaggctgggggactgtttgagtccgggagtttgagaccagtctgggcaacaaagcaaaacgccatctcagtactttttttttaaattttaaaacactttcaaaatgacagataacaagtgttggcaaggatacagaaaaactgaaacccttatacactgctggtggcaatgtaaaatggcagggcctcttggaaaacattctggcagttcctcaaacaattaaacatagagttaccccatatgacccagcaactgtattcctaggtatgtatatgcctgagagaaatgaaaacatgtccacaaagaacctgtgcaagaatgtttatagcactgttattcataatagcaaaaagacggaggcaatccaaatgcctctcaacaaataaaaaatgtggcatatccacactgtgaaacatcatttgaccataaaaatgagtgttgatacatgctacaacacagatgaatctagaaatcattacgctaagtgaaaagaagccagtcacaaaagaccacatattatataactaaatttatacaaaacgtccacgacagagaaatctatagagacaaaaagtatactagtgtggggagagggggaggaggtggtagaggtaggggagtgctagataaaacacatggagtttcttttttgaggtgatgaaaatgctctaaagttgactgtggtgatggttgcacatatctgcaaatatactaagaaccactgaattgtgtacttcaaatgggtgaaatgtatggtatatgaaccatatcttaataaagctgattaaaaaaaactatggaaaaatatcacttttctcataactgcttagtaaatacttaaaatacactgtttgtggaagggggcttctgggtactggtaatgttctatttcctaatttgggtggtagtgcaaaagtgaatgtattttgtggtaattattggtgtacttttctgtatgaaggttatacttcagtaacaaagtctataaaaatacacacataaacacagtatgttggtgatggtatgggtaaacagacgctcatactttgttcctggggatataaactgacaaaacttcttaggtaggtaaacttcagatttataaacaataaaaaacatacgttcttgttccaaaggtatatactcacatgtatacaaaaatatgtaaaagatctttactgcaaccttgtctgtaagagaaatggtgtggaaaaattataaatgccagtcaactggggcctgggtaaataaattatggcacaatcacaccaggaaacactaaccatttaatttttttttgagagctcatcacccaggctagagtgcagtggtatgatcttggctcacggcaacctctgcctcccggcttcaagcaattctcctgcctcagcctcctgagtagctgggattacaagtgcctgccaccgtgcccatctaattttggtatttttagtagagacagggtttcaccatcttggacaggttggtctcgaactcctgacctcacgatccacctgccttggcctcccaaagtgctgggattacaggcgtgagccactgcgcccggcctaaaattgttttaattaaaaaaaaaaaaagaagaagaaagaaggtacagaatagtgtagccgtgtatatggtatatcactctatgtgcggagaaaataaactaaggtggaggtggtggggaatatttacacacacacacacacacacacacacacacacaaaaaaaacaaaacatcttaagcaggacacacaagaaactagtaatcacaactggttctgaggaggggacactgggaaatttagagatgtacttttcacttagtatttttttaaaaaggtatacaccaatttaaataaatgaattcttctgaagtaaaaactatgctgcttcaacatgtaaatgccgctaagcttctaaaagttaaaatctgaaatgttataaattctgaaatctttcctatctcccatttcaaaagttaaattcccaaaccattaagcagtagtaacagcagtagtaataataaatagctacttacatcaacacctccaaacaagtcaaaaatgtaagtatttggataagtggtttcttgggtaagtttcctctcttcagtaacaaatgccatagcctccatggagagaagaggagaaatttcctagtttttttaaaaaaaagtacatacattgttttagtaaccaacacagaccagacactaaagcatcagtttgagctttagtcccaactggagttcccatgaacacaaagacagtccccaatgaaccacacttcctagtattcaggcccctgtaaagccccttctcacactaaatctgggctggtatgacacacctcaactaacagcatgtggtagaagtgacactaggccacttccagcacaagccttaagaaagccaggctcacacctgtaatcccagcactttgggaggctaaggtgggcggattacttgaggccaggagtttgagaccagcctggccaacatggcaaaaccccatctctactaaaagtacaaaaattagccggatgtggtgctacacacctgtaatcccagctactcaggaatttgaagtacaagaagcacttgagccacggaggcagacgttgcagtgagccaacatagagccactgcactccagcctcggcaacagagggagactctgtcattaaaaaaaaataaaaagcctgacagacttcgctcttgccatcctggaacccaaacatcatgctgtgagaacacagccaatggggaggccataaggagaagaaatgaggccaagagcaacatccttagttgatctccagctgacagccagcaccaacctgccagggatgtgagagagaccattttggacattccagatatctcagtaccaccctacccaacagcacatgaagcagaggagccactcagtcaaccaagaattgttgacagataaatgattcttgttacttccggctgctaggtttcggggtgactagttctgtagcaataaccaagtcactgctcaaatataatctcctgcaggaagtcttcttgatttcccccaaccagaagcatgctcttcagacccccaaaacaatctacaactcatttgtaacatttagcacttttactttgcacctatttacaaaccatttctttttttttttttgagagggagtctcgctctgccacccaggctggagtgcagtggcgcgatctcggctcactgcaagctctgcctcccgggttcacgccattctcctgcctcagcctcccgagtagctgggactacaggcgcccgccactgcgcccggctaattttttgtattttcagtagagacggggtttcaccgtggtctccatctcctaaccttgtgatccacccgcctcggcctcccagagtgctgggattacaggcgtgagtcactgcgcccggccaaacctatgttatttcttccctagactaaacgttccttgaggacaacacaaacagatcccactttgtattccccacagattccaagacagagtatttgatacagcacacatagggtagtagttctcaaactgacggccacagaatcctttgttcatatggaacaaagctaagaggaaaaaaaatcttacaagaaaacctaaaacatagtaagtttcaaataagtacttacttaatgaataaagaaatgatgatcacatagcaaagatatacaaatattaatttccctcccctttaacttcacctcaatctcctgagattttgcaagaagcaaataatgtgcaactctttgaaaagcatttttaaacaagtttaagaagctataattatttctatcagactgtgagattcaaaatatgaaaatgtctcttcttaaacgtaaagactaagtttaattagtttctattacattttaaaataacttactatgtgatataataatcaaaacttcacctctgaagaacactgtcattcagtttcattacgttcaatataacttacatggtttttatttatttatttttgctgttttttattttattatactttaagttctagggtacttgtgcacaacatgcaggtttgttacatatgtatacatgtgccatgttggtgcgctgtacccattaactcgtcatttatattaggtatatctcctaatgctatccctcccccctccccccaccccatgccaggccctggtgtgtgacgttccccaccctgtgtccaagtgttctcattgctcaattcccacctatgagtgagaacacacggtgtttggttttctgtccttaacgatagtttgctcagaatgatggtttccagattcatccatgtccctacaaaggacatgaactcatcattttttatggctgcatagtactccatggtgtatatgtgccacattttcttaatccagcctaccattaaatggacatttgggttggttccaagtcttttgctattgtgaatagtgctgcaataaatatacacgtgcatgtgtctttatagcagcatgatttataatcctttgggtaaatacccagtaatgggatggctgggtcaaatggtatttctagttctagatccttgaggaatcgccacactgtcttccacaatggttgaactagtttacagtcccaccaacagtttaaaagtgttcctatttctccacatcctctccagcacctgttgtttcctgactttttaataatcgccattctaactagtgtgagatggtatctcattgtggttttgatttgcatttctctgatggccagtgatgatgagcattttttcctgtgtctgttggctgcataaacgtcttcttttgaaaagtgtctgttcatatccttcgcccagtttttgatggggctgtttgcttttttcttgtaaatttaagttctttgtagattctggatattagccctttgtcagatgggtagattgcaaaaattttctcccattccgtaggttgcctgttcactctgatggtagtttcttttgctatgcagaagctctttagtttaattagatcccatttgccaattctggcttttgttgccattgcttttggtgttttagtcatgaagtccttgcccgtgcctatggcctgaatagtattgcctagattttcttctagggtttttatggttttaggtctaacatttaagtctttaatcaatcttgaattaatttttgtataaagtgtaaggaaaggatccagtttcagctttctacatgtggctagccagttttcccagcactatttattaaatagggaatcctttccccatttcttgcttttgtcaggtttgtcaaagatcggacagttgtagatatgcggcattatttctgagggctctgttctgttccactggtctatatctctgttttggtaatagtaccatgctgttttggttacagtagccttgtagtatagtttgaagtcaggtagcgtgatgcctccagctttggttcttttggcttaggattgtcttggcaatgtgggctcttttttggttccatatgaactttaaagtagttttttccaattctgtgaagaaagtaattggtagcttgatggggatggcattgaatctatcaattacctcgggcaatatggccattttcacaatattgattcttcctattcatgagcatgggatgttcttccatttgtttgtgtcctcttttatttcattgagcagtggtttgtagttcttcttgaagaggtccttcacatcccttgtgagttggattcctaagtattttagtctctttgtagcaattgtgaatgggagttcactcatgatttggctgtctgttattggtgtataggaatgcttgcgacttttgcacattgattttgtatcctgagactttgctgaagctgctcatcagtttaagaggattttgggctgagacaatggggttttctaaatatacaatcatgtcatctgcaaacagggacaatttgacttcctcttttcctaattgaataccctttatttctttctcctgcctgacttccctggccaaaacttccgacactatgttgaataggagtgtgctgagagagggcacccctgtcttgtgccagttttcaaagggaatgcttccagtttttgcccattcagtatgatattggctgtgggtctgtcataaatagctcctattattttaagatacgtcccatcaatacctagtttattgagagttttcagcatgaagggctgttgaattttgtcgaaggccttttctgcacctattatcatgtggtttttgtctttggttctgtttatatgatggattacgtttattgatttgcatatgttgaaccagccttgtatcccagggatgaagccaacttgatcgtggtgaataagctttttgatgtgctgctggatttggtttgccagtattttattgaggatttttgcattgatgttcatcagggatattggtctaaaattctcttttgttatgtctctgccaggctttggtatcaggatgatgctggcctcataaaatgagttagggaggattccctctttttctattgattggaatagcttcagaaggaatggtaccagctcctctttgtacctctggtagaattcggctgtgaatccgtctggtcctggactttttttggttggtaggctattaattattgcctcaacttcagagcctgttattggtctattcagggattcattcaacttcttcccagtttagtcttgggagggtgtatgtgtccaggaatttatccatttcttctagattttctagtttatttccgtagaggtgtttatagtattctctgatggtagtttgtatttctgtgggattggtggtaatatcccctttatcattttttattgcatctatttgattcttctctcttttcttattagtcttgctagcggtctttcaattttgttgatcttttcgaaaaacgagcttctggattcattgattttttgaagggttttttgtgtctctatatccttcagtactgctctgatcttagttatttctcgccttctgctagcttttgaatgtgtttgctcttgcttttctagttcttttaattgtgatgttagggtgtcaattttagatctttccggctttctcttgtgtgcatttagtgctataaatttccctctacacactgctttaaatgtgtcccagagatcctggtatgtcatgtctttgttctcaatggtttcaaagaacacctttatttctgccttcatttcgttatgtacccagcagtcattcaggagcaggttgttcagtttccacgtagttgagtggttttgagtgagtttcttaatcctgagttctagtttgattgcactgttgtctgagagacagtttgttataatttctgttcttttacatttactaaggagtgctttacttccaactatgtggtcaattttggaataagtgcgacgtggcgctgagaagaatgtatattctgttgatttggggtggagagttctgtagatgtctattaggtccgcttggtgcagagctgagttcaattcctggatatccctgttaactttctgtctcgttgatctgtctaatgttgacagtggggtgttaaagtctcccattattattgtgtgggagtctaagtttctttgtaggacttgctttatgaacctgggtgctcctgtattgggtacatacatatttaggatagttaactcttcttgttgaattgatccctttaccattatgtaatggccttgtctcttttgatctttgttggtttaaagtctgttttatcagagactaggattgcaacccctgcttttttttttgttttccacttgcttggtagatcttcctccatccctttattttgagcctatgtgtgtctctgcatgtgagatgggtctcctgaatacagcacgctgatgggtctagactctttatccaatttgccagtctgtcttttaactggagcatttagcccatttacatttaaggttaattttgttatgtgtgaatttgatcctgtcattatgatgttagctggttattttgctcattagttgatgcagtttcttcctagcatcgaaggtctttacaatttggcatgtttttgcagtagttggtatcggttgttcctttccatgtttagcgcttccttcaggagctcttgtaaggcaggcctggtggtgacaaaatctctcagcatttgcttgtctgtaaaggattttacttctccttcacttatgaagcttagtttggctggatatgaaactctgggttgaaaattcttttctttaagaatgttgaatattggcccccactctcttctggcttgtagagtttctgccaagagaaccgctgttagtctgatgggcttccctttgtgggtaacccgacctttctctctggctgcccttaatattttttccttaatttcaactttggtgaatctgacaattatgtgtcttggagttcctctcctcgaggagtatctttgtggcgttctctgtatttcctgaatttgaatgttgacctgccttgctagattggggaagttctcctggataatatcctgaagagtgttttccaacttggttccattctccccgtcactttcaggtacaccaatcagacgtagatttggtcttttcacacagtcccatatttcttggaggctttgtttgtttctttttattcttttttctctaaacttctcttctcgcttcatttcattcatttgatcttcaatcactgataccctttcttccacttgatcgaattggctactgaagcttgtgcatgcgtcacgtagttttcgagccatggtgttcagctccatcaggtcatttaaggtcttttctatgctgtttattctagttagccattcgtctaatcttttgtcaaggtttttagcttctttatgatgggttcaaacatcctcctttagctcggagaagtttgttattactgatcatctgaagccttctctcaactcatcaaagtcattctccatccagctttgttccgttgctggtgaggagctgtgttcctttggaggagaagaggcgctctgatttttagaattttcagcttttctgctctggtttctccctatctttgtggttttatctacctttggtctttgatgatggtgacatacagatggggttttggtgtggatgtcctttctgtttgttagttttccttctaacagtcaggaccctcagctgcaggtctgtcagagtttgctggaggtccactccagaccctgtttgtctgggtatcaccagcagaggctgcagaacagcaaatattgcagaacggcaaatgctgctgcctgatcctttctctggaagcttcatctcagaggggcacccggctgtatgaggtgtcagtcggcccctactgggaggtgtctcccagttaggctactcaggggtcagggacccacttgaggaggcagtctgtctgttctcagatctcaaactctgtgctgggagaaccactactctcttcaaagctgtcagacagggacatttaaacctgcagaagtttctgctgccttttgttcagctatgccctgctcccagaggtggagtctacagaggcaggcaggtctccttgagctgcggtgggctccactcagttcgagcttcccggccgctttgtttacctacgcaagtctcagcagttgtggacacccctccccctgctttgctgccaccttgcagtttgatctcagactgctgtgctagcagtgagcaaggctccgtgggcatgggaccctccaagccaggcgcaggatataatctcctgctgtgccatttgctaaggccgttggaaaagtgcagttattagggtgggagtgtcccgattttctgggtaccatctgtcatggcttcccttggctaggaaagggaattcccccaccccttgcgactcccaggtgaggcaatgccccgccctgcttcagctcacactccgtggactgcacccactgtctgacaagccccagtgagatgaacccggtacctcagttggaaatgcaaaaatcacctgtcttaggcatcgctcatgctgggtaccatagactggagctgttcctatttggccatcctggaaccggacccccacttacatgggttttaactgcattagagctggtgctctaaattcaaatttagatccaaactacagctaaagtttagatactccagccctactgaatcagaatttcaggggtggggcccagaactctgtgttttaacacgctcttcaggtgattcataaacacactccagtttgagaacaattatcctagcataatgtctccgtgctctttccactcatttcccaatcatcaaacctggccccttcaatcttcttacgttagtaataatattcaacaaccataaggcctcttccacgagccttcagcagtatgtaatcttctaaacccttttcaaaaagaatgtcatcccaatcacaggatagtgttgacctcccaaaattaagcaagcactgccacaaaataaacacacatagagcccaaaaggataacacagggaacctaatggtgattatcttgggatgatgggattataggtgatgtatattttcttctttgtactttttctgaatttctcaaattttctatagctcacacagtaaaaacaggctatttttaaaagccaacggaagggaaaaaaaaaacagcagacatcttgtgtcacctagaggccctgaatacgcccctccaaggtccttaagagttaccttgaggatgttttgacactcaacaaagtcactgtggaggtggctggtggtgtgcagcttgaggagcagctgaggaattccactccacttggattgtttgtccctctccgtcaaaaaagtctcagtgaactgtgagtcaaaaaaagagagaacatattattgtattattgatgataatagctgatacggcaaaggagagcagccgacttccaaacccacccaggacagttacaaatttatctctaagcactactataaaaagcctctttctataaatcttcaaaacctccccaacagcctattactatgttataataagaaggagggattggaaatactcttgtaccactcacaaacagcacaatatcattgagagtggacttagactcgtcgtaaatatatactggaaattctagggcaactgctaaaagtatttttacaagaagaataattgatatgctaagagatgaaaaataatggaaccatataaactgctcagttaagcccataaaaggcagaaaaagaggggaagacaaagaacaagtataataaaacaaacatggtatacattaatccaactatatcaataatcactgtaaatatctatgaatggtctaaacttaccaatcaaaggaaagagactaaaagaatggatttaaaaaaccaagatccaacaatatgctgtctacaagaaactcatttaaatatacatatagataggttaaaagtaagggaaaaggccaggcacggtggctcacacctgtaatcccaacactttgggaagccgaggcaggtggatcacctgaagtcaggagtttgagaccagcctggctaacgtgataaaaccccatctctactaaaaatacaaaaattagctgagtgtggtggcaagtgcctgtaatcccagctactcgggaggctgaggcaggagaaccgcttgaactcgggaggcagaggttgcagtgagccaagatcgcgccatggcaccccagcctgggcgacagaccaaaactctgtctcaaaaaatagaaaaggggatggagaaagataaatcacataaaaagaaagatggagtagttatattaatttcagagaaagcaggcttcataaaaaaattatcagaaataaagtgggtcatttcataatgacaaaggggttaattctccaagaagacataacaatccttatcatatatgcacctaacaacagcatgtcaaaatatgaggcaaaaactgcctaaaagaactgccagacaaaaaaatggcaaatcaactcttacagttaaaatattttaaactaaatgaaaatataacttatcaaaatttgtgggatgcagcgaaagcagtaataagccagaagtgtatatcactgaatgcatataatagaaaagaagaaatatctatagtcaataatctaagcttctaccttagtaaactacagaaagagcagtttaagcctacagcaaacagaagaaaaaaataaaaatgagagcaaacatcactgaaattgaaaacaaaaaatcaagagagaaaacaaaaccaaaagttagttctttaaaaagatcaatacgattgataaactctaaccaggcttatcaagaaaaaaagacagaaacacaaattactaatatgtggtacataagaggagttattattactgactccatggacttcgaaggatgataaaggagtattatgaaccgtttgccccaatatttgcctagcactttgggaggctaaggcgggaggattgcttcagctcaggagttcaagaccagcctgagcaacatagcgagagctcgcctctactaaaaataaaaaaaaaaaataagccaagggtggtggtgcacacctctggtctcagctactcagaaggatgaggtgagaagatcacttgagcttgggagaatgaggcggcagtgagctatgacagcaccactgcactccagcctgggtgacagagcaagataaaaaaaaaaaaaaaaaaagacatcattataaccaaagagtgaaacaactcaaatgtccatcaactgatgaataaataaaatatagtatatccatccaatggaatattattcagcaaaaaaagtaatgatgtactgatactacaacaaggataaatcttgagaccattatgctaaatcaaagaagccagtgtctaactgggcacagtgtctcatgcctctgatgccaaagtaatcccagcactttgggaggccaaggtggacagatcacttgagctcacaagtacaagaccagcctgagcaacatggcgaaaccccacctctacaaaaaaaaaaaaaattagccggatgtagtggcacatgcctgtagtcccagctactcgggaggctgaggtgggagaatggcttgagcccaggaggcagaggttgcagtgagccaagactgcgccactgcacttcagcctgggcgataaagccagaccttgtctcaaaacagaaacaaaaacaaagcgagactccatctaaaaaaaaaaaaaaaaaaaaaacctaaaagaagccagtctcaaaaggccatatattgtctgattctattaatttaaaatgtccagaataagcatatccagagacagaaagatcactggttggcaaaggctgtggggatggggaaactggggagtaactgctactgaataccaggtttcttttttgggtgataaaatattctaaaattgatcgtgatgatagatgcataactttgtgcatacagtaaaaaccactgacttgtacacttcagttttttttttttttacccttttatctccttagtttaccaacttgtacactttaaaagggtgacttgtgcaatatgtgaattacatctcaataaagctgctataaaaactaaataaataaatgaacataagtgaactttttaggatgacaatgttctaaaaccagattgtggtgatggttgcataacttcatcaatttgctgaaaatcactgaactgtacacttacaatgggtaaattttattgtatataaatcatgcctcaataaagttgtttaagaaatatttaaaagaagaaagaagagaaaagggaacaaaggataggacattaaaaaagcatatattgtattaagcaagtataaacaccaaaatgtcagttattacattaaatctaaatatgctaaaatgctccaattaaaaacaaagtttgggccggttacagggcctcatgcatgttactgcagcactttgggaggcagagacagacagatcacttgagcccaggagttaaagaccagcctaggcaacacagtgaaaccctgtctctaccaaaggaaaaaaaaaaaaattaggcatggcagcatgtgcctgtaatcccagttactcaggtagctgaggcaggaggatcccttgatgctaggaggccgagactgcagtgacctgtgatctggtaccatactccagcccgggcaacagaatgcaaccctgtctcaaaaaataaatagaaaataaaataaaataaaaataaaataaaataaaataaaaacaaagtttgttatgccacctaccagagaaacagaaaggctaaaagtaaaagaatgggaaataatactcaatgtaaacatataccaaaaggtagtataactatattaaaatcagcaagagcaaagaaaaagcattaccaagccaggcatggtggctcacacctctaatcccagcactctgggagaccgagacaggtagatcacttaggtcaggagttcaagaccagactggccaacatgatgaaaccctgtctccactaaaaatgcaaaattagctgggcatggtggcacaggcctgtaatcccagttactcgagaggctgaggcaggagaattgcttgaacccaggaggtggaggttgcagtgagccaagaatgcaccattgcactccagcctgggtgacagagtgagactctgtctcaaaaacaaaacaaaacaaaaacaacaacaacaacaaagtactaccagagataggcactttaataaggataaaaatggcaaactggataatgttaatgatcctaaatttgaaaatatctaataaaaacttcaacatacataaagcaaaaactgacaaggctaaaaggagaaataaggaaatccataatcataatgggagattttacacatctctttcaaaaactgatatatgcagacaaaaattagtgagaatacagaatattttaacacaattaaacaaaatggacacacctcgagcagtatatctagtaaatgcactctacatgtcctttacaaatacaaatagaacatttgcaaaatgaccagctgctaggccatactgcaaatgtcaatacatttaaatgaactgaaatacagactatgttccacatcagaaagatagttataaaatccccatgtttggaaaataatatacttctcaaaaatgcatgggtcaaagaagaaatcgaagtggatatatgaaaatatcctgaaagataatgaaaatactacacatccaaactgatgaggtacaactaaagccatgcttactgaccattataaccctgataccaaaacctgtcaaaaggaaaactgcaggccagtttcactaacgacgatgtaagggaaaaaccacaattcaaaaattgaattaaatttaaaatttgtatcagaaattaaaagttggtttaatatttgaaaattttattcaatgcaattcaccacattgataacataaaggagaataattatttgataacataaaggagaataatgatatgaatacctcaattgatacagaaaaagcatttgataaaatttaacatccattcatgataaactcaaataaaaaaatgaatttctagtaacaggtatccacagaaaacccactgcaaacatcatacttaatggcaaaatgtttaaggttttttccctcttagatcaggaacatgctacttctattcatcatactggaggtctcaggcagcagagtaaggcaagatatatagaagacataagattggtaagggtaagataaaagattcatttgcagatgatataatattcacagatgactgtacagtatacaatccaaaagaacctaaatgtaaattatcaactattacagcaatatacatgaataatataaaaatctatcttatttttatattacagctacaatttttaaatgcagttttaaaaacactacttacaataccacttttaaaaacgctaaggaataaatctaacaaagttatgcaagacggctacatagaaaactgtaacacactcttggctgggcacagtggttcacacttgtaatcccagcactttgggaggctaaggtgggcagatcacctgagatcaagagtttgagtctagcctgaccaacatggtgaaaccccatctctactaaaaataccaaaaaaaaaaaaattagctgggcgtgatggtgggcgcctgtaatcccagctactaggggaggctgaggcaggagaatcgcttgaacctgggaggcggaggttgcagaaagctgagatggtgccactgcactacaatctgggagacagagcgagactccatctcaaaaaaaaaaaaaattacaggaaaataacttccaatttatacttctatacccagtcaaactaaatatatgtgtcagaataagacattttctgatctgcaagctttaaaaaaaaaaaaaaagttacctcccatgtactctttcttgggaggctaccagagagtgtgccccaggaaaaaggaagacaattgaggaaacaaggtctaaaacatgagaaaagaaagaaaaatgctctggatttggtgaagagaagtcccaagaactcagctgtatagcagacctagtaagcagctaaactaaactgctaaactgctaaactgcagtaggggaatgaagggcttcaaatgatttctttaaaaaaaaaaaaaagttttagaatttaggaacaaattataagtatacagaaagcaggccgggcgcggtggctcacacctgtaatcccagcactttgggaggccgaggtgggtggattacctgaggtcaggagttcgagaccagcctggccaacatagtgaaaccccatctctactaaaaatacaaaaaaattagccagacttggtggcgggcacctgtaatcccagctactcggggggcataggttgcagggagccgagattgcgccattccactccagccgggcaacagtgcgagactccgtcccaaaaaaaaaaaaggtatacacaaggcaaaacaatttaaaaggatgcattatacctgacttcaccaccatgcgatacaccaatgtagcaaaatttcacttgtaccccattaatacaaatttaaaaacagtaaaataaattaaaggatgcactattatgctaatgaaagtcaaaagggtatatgtatatatgtgtgtatatatgtatatatgtgtatatatgtatatatctatatatgtatatacgtatatatgtgtatatatgtatatatgtatatgtatatatgtttatatgcatatatgtgtatatgtatatatgtttatatgcatatatgtgtatatgtatatatgtttatatgcatatatgtgtatatgtatgtatgtttatatgcatatatgtgtatatgtatatatgtttatatgcatatatgtgtatatgtatatatgtttatatgcatatatgtgtatatgtatatatgtttatatgcatatatatgtatatgtatatatatacagggtatatgtatatttatccttcaatttaaaaaatggaagaggactgtttttaacactacaaaaaaattatataaaacaaatataattgtacaatatatggccctgctgtaaataataatgctaacatcataatgtaaatacttaacaacagccaaagctgtgatataactacattggtagactagtggagacgagtaagaaggaatcgaatgtgtgaattaaatcctagtctttcaagagcgaagaaaatagatagtatctaaaagtgaaaagaaacagctttataaccatgttatttagaaatactggctctcctgtttcctggatccttctcttgcaaaagaaatagctaagtatggacactgaacagcattaggagtatggaacttagaggtgcaaagcaggcagggcactgctgtttttttgttacaagctccatgatacgcagagatctaatcacagtccaaatatttgacttcacaagcaatttctttactatttatacattgtcttacaaggcatgtactctcatttaaaaataataatttggggctgggcacagcggcttacactcatatcctagcacttgggaggccaaggtaggcccattgcttgatcccaggagtttaagaccagcctgggcaacatggcagaaccttatctctacaaaaaaatacaaaaatgagctgcgtatggtggcatgcgcctatagtcccagatactcgggaggctgaggtgggaggattgcttgagcccaggaggcggaggtttcagtagttttttttcaccactacactccagcctgggcaacagagcaagaccctgtctaaaaaaaaaaaaaaaaatcattagaattttgttttccttgtgaacagctcagcactgtgacaaaagtgccaccattcagtcatcttcccagttgaattactggcaggtatcacatgggttttctcttgaagtacttgtggtttaacagtttacagcagtgataatctcttacatcataccctctaaactgtcaacctgtttagcaaatatgacatttctagacatttacagtttccactgattttattgtttttaaaaataactaaaggctaaattccatgaagataactgtgcatcttatttgtttctttaatcctaaatgtaagacatctaatgcctcaaaataccacactaaatgcaagggtctcgcgcaatctcactgcaacctccgtctcctgggctcaagtgatcctcccacctcagccctgcccccttccccctcccagccccccacaccaccaccactgccaccaagtagctgggattacaggcacgcaccaccacgcccggataattttttgtatttttagtaaagatggagtttcacccatcttgcccaggttggtcttgaactcctgagcttaaagaatccgtctagctcggcctcccaaagtgctagaattacaggtgtgagccaccgcacccagcctaaatagatatcttaaaggataataaagataaaataccttgttgggttattctgacaatacatgttaaccactgaatacttttgtgtcctttaatggggtatgattcagtaaaattaggagcaaatttaagggcttgtgaatacgaaaacttcccattgaaatgaatggcatatgtgtgtgtgtgtgtgtgtgtgtgtgtgtgtgtgtgtgtgtgtgtatgtgtgtgtatatatatatgtgtatatatatgtgtgtgtgtgtatatatgtgtgtgtgtgtgtgtgtgtgtgtgtgtgtgtgtgtgtgtgtgtgtgtgtatatatatatgaataagactttatcctaatcaggagtttttcagtatcaaattacctttgaaaagccaggtaagatttgtttgacttaaatgcctaggtttcataaatactaatggttagaatgaggctaaaacaagtagtgcctaatgaaattttttttaaaagttagtgaatctggctgggcacggcgactcacatctgtaatcccagcactttgggaggctgaggtgggtggatcaagagatcaagagtttgagaccagcctagccagcatggtgaaaccctgtctttactaaaaatacaaaaagtagccgggcatggtggcacatgcctatagtcccagctactcaggaggctgaggcaggggaatcgcttgaacccgggaagcggaggttgcagtgagccgagactgtgcactgcactccagcctgggcaacagcacgagactccatctcacaaaaaaaagaagtcagccaggcgcagtggctcacacctgtaatcccagcaccttgggaggccgaggtgggcggatcatgaggtcaggagatcgagaccatcctggctaacacggtgaaaccccgtctctactaaaaatacaaaaaaaaaaaaaaaattagccaggcgtggtggcgggcacctgtagtcccagctactcgggaggctgaggcaggagaatggcatgaacctgggaggcggagcttgcagtgagctgagattgcaccattgccctccagcctgggcaacagagcgagactccatctcaaaaaaaaaaaaaaagtcagtgaatctaaagaaaaaatataaagtaaggaacactcaggggcatttagatatgccaataatcataaaggaagcaacgactgccatgtgggaaatataacagcatcccacaacccagtctgtcaccagattgccaaactgaagggcatccagggatggcgggtcatgacctgtaatgtgagctgcactatcctagagcccagcgtttactcagtctatcctttccttcaactcgtactgatcatttggggccttgtacgcccatggtaaggaatccagaattgattctatcaactgcaatgagatgaggctggagagttttaagcaaaggatttataagatctgatttgcattaagcatcaaatgtgctgatgaatatgaaaaggctcagtaaactccaaagtatcaccccagcatattttattgccttgacagagggcagaacaaaacgaagggaagaaaataaagcaaactaaaatccaagtagaattgacccattacaaattatgtggccagtagtcatgactcaggcttcccttatgccccatttagggagatggagaagatcaggtctgatggaaaagggagaggattttggctttcgacatactaagtttgagatgcccattagacatcaaagtggaaatgctagaaggcaattggatatacctacccatccagagctaaaaggagaaacacgaatggaaacagaaacttaggatccgtcagcgtatagagcagttattaataacaatacaagctaatctttatagcagtaagctatgtacttatagctgagaaagtatgtttcagtcactattttaagtgctttatatgtacaactcacttggtcctcaccacaaccttggaaggtcaggtcctatgatacttactttacaaataaataaactgaggcataaacagattaaataacttgcctaaagacacatagtaagtaaataccagagctaggtttcaaacctaggtaatctgactctggaactctttaaagccatgagattgcttggcaagtacagacagaaattagactgaggacacagtatttcaatttaagcaatttcctgaatatcaaatggctggcaaggtttcaggctctgcagatacaatgaaaaataagacacagtctcttcaggaagcccagtctaattaactactagctgagagcaactatttactaaacaactattcctatatgccacactggctacgcttttaaaacatattatttcacttaatcctcctaacaactttatgggatagatgttatcatcacctctttagaaataaggaaactgaagttaagagaggttaaataacttaatcttggtcaccctgctaggattcaattcaggtccaccttactttaaaatctgatttttttttccaaggaaattccatcacatgctataccacagatgatccttgaggacattatgttaagtaaaataagccagtcacaaaaagacaaatactgtattactatactggggttatctaaagtagtcaaactcacaaaaacagaaaggagaagaatggttaccaaggactgggagggagaaatgggaagttgttcaatggtagtttcagatttgcaagatgaaaaagttctggaaatctgtttcacaacaatgggaatatacttcacattacttaactatacaccttttttttttaagatacagggtttcaccatgttgcccaggctggtctcaaactcctgggctcaaacaatccgctcacctcagcttcccaaagtgttgggattacaggtgtaagccaccacactgggcctgacctatacacttataaatggttaagatggtaaattttatgtttacatatatatatttatatatgtatatagtttgaggcagggtctcattctgttgcccaggctgcagtgtaatggtgtgatcatggctcactgcagccttgacttgccaggctcaagcgatcttcccacctcgggttcctgagcagctgggactacaggcatgcatttccacacctggttaatgttttttttttttttttttgtagtagagctggggctccaccacactgcccaggcttgactcaaactggctcaggtgatcatcccatcttggtctcccaaagtgctgggattacacacatgagccaatgtacctggcctatattatatatttgtttactacaatgaaaaaattttggctaggcgcagtggctcacacctgtaatcccagcactttgggaggacaaggcagggggatcatgacgtcaggagttggagaccagcctgaccgacatggtgaaaccccatctctactaaaaatacaaaaagtagccaggtgtggtggcacacgactgtaatcccagctactcaggaggctgaggcagaattgcttgaatccgggagacggaggatgcagtgaaccgagattgcgccactgcactccagtctgggcaacagagcgagactccgtctaaaaaataaaaaataaaaaatgtttaaatctggtcttttcctactataccacatgccataacagtataaaaatatgggtaatctgggcaacagagcaaaaccctgtctctaccaaagatacaaaaattaatggggtgtggtggcacacgcctgtagtcccagctactagggaggctaaggtgggaggatcacttgagcccaggaagttgagcttgccactgcactccagcctgggtgacagagcaagattctgtctcaaaaaaaaaaaagggtaagcaaataacttattctgcaggatgggagagaggagcggaagggcacagcatggaataaattaaaaaaaaaaaaaactaagaaaagaaatatttgaaagatgaaggtccccattttatcctcactatagctccaggcagggggtctctacttcaacttctgaaatagctcccacacctatatacaaccatcagttaccacaataacctgccttgcttttgtggctccagaatattccagcagccttgtatctggtgagctttttttttttttttttgagatgaagtctcactatgtcacccaggctggagtgcagtggcgtgatctcagctcacaacctccacctcccaggttcaagcaattctcctgcctcagcctccagagtagctgggattacaggtgcttaccaccacgcccggctaatttttgtatttttagtagagacggggcttcgccatgttggccaggctggtctcaaactcctgacctcagatgatccacccgcctcgacctcccaaagcactgggattacaggaatgagccactgtgcccagcctctggtgggcttttctaggctcctcccattctaagtcattcagcactggaaacaaattaagttgcctaaattgcctcatttatcatgctaaagaacttctgtggctccctattattctcagaacactgattatcaggatgggtgtttaggaacatatcatctaacctctctgagcctcagtttcctcatccatattaagaaatgagtcttgaagcataactcaaaagcttgaggattaaagataacatatgccttgtaccgtactttttctaaaggttatgtgctcactaaaagttagtcctctttctgcctgtctctacacacccagctcggtaaggtatcttagcttaagaaggaaagagcaagtatttctaggatttttttttttttttgagacagggtctcactctgtcaatctccgcctcccaggctcaggtaatcctcccacctcagcctccccacaggcacacaccaccaccatgcccggctaaatttttggagacacaggattttgccgtgttgcctgggctggtctcgaattcctggattcaagcgatctgcctgcctcggcctcccaaagtgctgggattacagggtcttaagtcaggtcttaagaacacaagggggaaaaaggctgctcatctatggttgtgtgatggccaggaaaacatttctcactcacaactgctcctttcgtccacagtcctccatacacacagaccccctagcctttattttattctatccttttcgtcatttgaggaagtgatattcaaattaaatttaaataaagttacactgtgaaaagtctcactcccattttctccccctttagcccaattcccacctcactcccaccaaccactttatcagtttcttgagtatccttcaaactttttatgaaaaagctgtctttaaataaagctaatgttttacaggtgttagcaaggttcggggtgggggagggtggaagaagtagtggactaggtcctattcaacctggtttaccctaaagcagtgtccttcgctcactcaaaaataacaataatcatatgttgggcacctgttataagtcagatgcttaatattaactaccttcagcccttagtatgcaccagaaatgcactaatgctttacacaattgccccctttgatctccacaacaatcttaaaaggtaggttactaattctcatcttcatcttacaagtgaggaaactgaggcacagaaaggtcacctgcccaagcaagagagaggagcagggctttgaacccaggcctgactccagagtccctcttaaccgtgacgctctacactagcaaaccagatatagtctctgcacccgctggaactcagcctaatgtgggagacgggcgagaaaaaggcagacaacaaagaaatacgaaattatagactaagaaagtaatgtaaacgaaacgaattcgcggctgtgacagaataacaatggggacctactttagaaaggggaaggaaagagtgtcaaggaaaggcctgagaaaatgacatttatgaaatgctcgggaaccatttgggggctgcaatgatgaccccctcccccacgcccaatacacgggataaactcgaggcccacagaggctaaaacaaacacgacagggtcccccagacgtgtagacgtggcgcaaagaagggaggatccagaaactgggcccagggttcgtacacgccatcagtgtccacagcagcccagccccgctcggcccctgacaagggacatcaagccagctgcttcccacggccccgctgcagctgagagcgtccgggcagctcacagggaggccttccggccagccaaaagggctttggcccgtccagcggcggcctggaaaggcctcttccccggccccccgccagctcccgcctggtccgccccgccccgcccctcctggtccagcctcgtacctgcaccgcccggaccaggccccggccggtcagctggccctgccgcagctgcagcagaatgttaccaggccgcggccggccgccccatccgccccaagccgccactgtggctgccgaccgtctccctcggccggctccagacccagccgctaccggcgccgccgccatgtctcctcgtcggacaaacaggaagcaagcggcctcggggccgcggagatttctacggggcggcggaggggtcgccgcagcgcccccagtgggccgtcggcggaggcgcaagccgcgtggcagggaccgtgtgcggcgtggaggctactgggaattgtagtcctgcgcggcagcggggtaggtgggaaaagagatgtggcctttcctgcactgccggtttctctggcccccgggcccagcatttcggcgaaatctcccaaggtccacattctcccatttctctcgccgatttgggcaggatgcaggcagctggccaagaaatgatcctgggcttcaggtcaggagtcaggccctcgagtccgcttcctgcctgcttctctctacacgtgactcaccgcggacatcgaccaagtcatcgcgctctgccactgcgcctgtgtcctcgtcaggtcactccatctatagattctgggagcctgatcaatcgtagttcctggggctttctctgcgcccgacaccaaaccatgtctaggggaaagggagggtgtctgggatacagtggtgagcagaacggcctgggatcctttatcacgaaatgcaggttacaggggaagacagcagatccatacacaaagaaacgcagtctcaaactggataagttgtgtaactgggtaggttgttgtgaaattaaataatggaagggaaagggattagtaaattgtgacatcatattctctgtcagatgaaaaccctgtcctaatttctatccaccagatagcatgttgtctctaatactcattttttcagctaacttctgtggcaggatggcactgactccccccacccaacacacacacactttttcccttcctagcagggggcctgtaataaaaatgaaagaggagagctaagtgtgatgtaacagggaatggtgaagattgtgactcataactaagatgactgtaacttactgctcaaaccagaacactttaaagaatgaaaagacacaataaataattacaccgggacggtaggcataaaagtgactctcccaggtgaactggcactatggttaccatcctcacaccccatctaaaaggagtagactcaccatccatcttcatagaactagaaaaaagaatcctaaaaatcatatggaaccaaaaaagagcctgcatgtccaaagcaagactaagcaaaaagaataaatctggaggcatcacattacctgacttcaatctatacaataaggccatagtcacccaaacagcatggtactggtataaaaataggcacatagaccaatggaacagaatagagaacacagtataaaaccaaatacttatagccaactgatcttcgataaagcaaacaaaaacataaagtggggaaaggacaccctattcaacagctggtgataactggcaagccacatgcagaagaatgaaactggatcctcatctctcacattatacaaaaataaactcagccgggtgcagtggctcacacctgtaatcccagtggctcacacctgtaatcccagcactttgggaggccgaggtagtcagatcatgaggtcaggagttcgagaccagcctggccaacatggtgaaaccccatctctactaaaaatgcaaaaattagctgggcgtggtggcatgcacctgtagtcccagctacttgggaggctgaggcaggagaatcacttgaaccctggagacagaggtcacagtgagccgagatcacgccactgcactccagtttgatgacaggatgagactccatctcagaaaaaaaaaaaaaaatagccaaagaagttacagtcaggagatattttgttccctatagaaactgaatataacatcttaaaatttgtccctgagtgttgtttcttagaaactcgaacccccaccaaatggatctgctgataggcaaactcagataagggagagctgagaactaaactttgacttctattttttgttataaatttcttcctagggggcctggaggaggacacgaccataagtcagagctaacattcttttctgcagatcccaaatttttagacaaagctttacctccttaaccaattacaagtcagaaaatctttgaatccacttgtgggcccctggttggagatgtcctgtctttttaggtggaaccaatatacagcccctatgtattgatttatgacttcgcctgtggcctctgccctcctgccattaaaaacctgtaagccggctgggcgcggtggctcacacctataatcccagcactttgggtggccgaggcaggtggatcacctgaggtcaggagttcgagaccagcctgaccaaaacggcaaaaccccgtctctactaaagatacaaaaattagccaggcatggtggcacgtgcctgtaatcccagctactcgggaagctgaggcaggagaatcgcttgaacccaggaggcagaggttgcagtgagctgagattgcaccactgcactccagcctgggcgacagagcaagactctgtctcaaaaaaataaaataaaacccctgtaagccataagggagttcaggtcttaagcataagctgtttgattctcctcgcttggcaccctgcagcaagtgcaataataaatgcctcactttctcttgctgtaatcccaatgtcagtggctttgctgcaccaggtaagcagccctcactttggttcaataacaatacttttcataactttttgcaccagctatgtatcatttctagattcaagaaaaaaaagtcttctaatatgtgaaattaactttaaaaagacataaaaagaaaaggcatttccagggatacaaacagggcattggtgagctgtccgggcagcagccagccttaccagggaatccacagcccagggattccacccagagctcttcctgaggcatatggtgatggatattctcacccttgtcgcggtgaggagacaggatcctgactaatttcacagttcacatggccctccaggtttcccttggcactcatcatgctagggacaaatcttcccacctcagctttgacccaactgcaaatgtcactttccattcctcagttcctatctttgtcagtctagcctggcccaggcattcaccaaagctgggtattcactgggtcaaaaatgacaacctcaaattcagtccttacagataccatgtgaccatgaagtaaggggacatgtttccagaaacctctgtggaaagacactcttttccacttcacctctgctctgccagccttttccgtagaaactagctgaggctaggcgcggtggctcaggcctgtaatcccagcacttttggaggccgaggcgggcagatcacgaggtcaggagttcgagaccagcctggtcaatatggtgaaaccccgtctctaccaaaaacacaaaaattagctgggcggggtgaagcgcgcctgtagtcccagctgccctggaggctgaggcaggagaattgcttgaacccgggaggcggagtttgcagtgagccgagatcgcgccactgcactccagcctgggccacagagcaagactctgtctcaaaaaaaaaaaaaaaaagctgagtgtctctcaccaccagagggcgaagtacctctcccaccagaggtctgttgatgtcaattttaatcagcactagaaaaaaaatgaagctcccaaactggctaattttttttccaccgtaatcccaaatggcttaaccaaacatgatgatgctattcagagaacattaactcttgtaaataaatcgccaaactcatctcaattgggcagacagattttctgggacttttttttttttttttttttttgaagtcttgctctgtggcccagcctggagtacagtggtgtgattatagctcactgcagccgccaagctcctgggctcaagcaatcctcccgcttcagcctcccaaagtgctgggattacaggcatgagtcatggcaccctgccaagaagtcactttaatcaaagcaactggcactgttatatcaggccatggtaacagctgtcccatgcaactatgcattgtcctgtggtgtcattttttacagtgatttttttttacattacatttctaatgtacaacctctccatgatttgtcttttaaatgtttgttaagtactatcttatgtgccaggcactgttataggtgctgtggatattgtgctaaataaaataaacaaaatttcctgccctcatggggcttatacttctgggtaagatctaccctttattgagcacttaccattggccaagcactttctttgcactatcttattattctcgcagcatttttggggaagtttttcaaatctacagaaagttaaaagatacaccattaacactcatataccctttgcttagacttgtcagctactaaaactatattttatctttctctctgtgtatatatacacatatatgtacatatatgtgtatatatacatatacatatatacacatatgtacatatatgtgtatatatacatatacatatatacacacgtgtatatatacatatacatatatacacacgtgtgtatatacatatacatatatacacacgtgtgtatatacatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatgtacacacgtgtgtatatatacatatacacacgtgtgtatatatacatatacacacgtgtgtatatatacatatacacacgtgtgtatatatacatatacacacgtgtgtatatatacatatatacacgtgtgcctatatacatatatacatgtgtgcctatatacatatatacatatatgtgtatatatacatatatacatatgtgtatatatacatacacatatatacatatacgtacatatgtgtatatatacatatacatacatatatatgtgtatatatacatatatacacatacatatatgtatatatacatatatgtatatatacagctctttccatatatgtatctctctctatacttcatttatacgtagagagggtttgtgttagttttgctaaacatttttttttttttagacagggtctcgctctgttgcccaggctggagtgcagtggcacgatcatagctcactgtagccttgggctcctgggctcaagggatcctcccatctcagcctctcaaagtgttgggattacagatgtgagccactgcacccatcctgctaagccattttttgctaaaccatttgaaagtaaattgtagatattatgacacttcacctgcatattttagaatgtatctcctaagatcaaggacatgctcctaaaaactatgataccatcacacccaagaaatttaatattgatacaatttatctttttttaaatttatttatttaagacagggtttcactctttttgcccaggctggagtgcaatggcacaatctcagctcaccacaacctctgcctcctgggttcaagctattgttctacctcagcctcccaagtagctgggattacaggcatgcgccaccacacctggctaattttgtattttcagtagagatggggtttctccatgttggtcaggctggtctcaaactcctgacctcaggtgatccgcctgctttggcctcccaaagtgctgggattacaggcatgaaccaccatgcccaggctttttttcttttttgacatggagtcttgctttgtagcccaggctggaacacagtggtgtgatctcggcttaccacaacctctgcctcccaggttcaagcgattctcttgcctcagcctcacgagtagctgagattacaggcacccaccaccacacccagctgacttttgtatttttagtagagatggggtttcaccatgttggccaggctggtctcgaactcctgacctcaagtgatctgcccaccttggcctctcaaactgctgggattacaggcatgagccaccatgcctggccattatttatcttataatccatattcaaatatctgcaattaccccccaaatgtcccttacagtctcttccccccagtccagagttcagtaaaggatcatgcatacatttgaaagctatgtcttgtcactgtcttttaatctagaagagtccctcatctcttttgtcctttcgggatattgacagttttggggtccgggccagttgtactgaataccctgacatctggatctgctttattgttttctcatgatttggttaggattaagcttttatggctagaatattaaacaggtgatggtgtgtctttcccattgcttcatatcagaaagaaataatgtaaatgtgtcccattattgatgatgctaagtttgatctgttggatcaaacttaatatgtcttcattggaaacatacattttggggttaataagtaatctgtggccttcaagactacgagactgtcttgttctccacccacctttcacccagtaatgtttgtgtttgtttgttttgagatgaagtctcgctctgttgcccaggctggagtgcagtggcgcaatctcggctcactgcaaccttctgttcttcttctcttgcctcagcctccctcccgagtagctgggactacaggcacgagccacttcacattgcaagttttgcttttttttttttttttttttttagtagagatggggtttcaccattttggccaggctggtctggaactcccaacctcaggtgatccacccgccttggcttccgaaagtactgggattacaggcgtgagccaccgcgcccagcccccacccagtagttttttttgttttgttttgggttttttttgtatttttagtagagacggggtttcaccatgttagccaggatggtctcgatctcctgacctcgtgatccacccaccttggcctcccaaagtgctaggattacaggtgtgagccaccacacctggccaacccagtagtttttatcatcccttgatgatccctccctggattatcatgctggtggttgcaaaattgtaactttctaattctaccattgcttcctcttttattaggtaatattcccccccaaaaggagctcccgccctttttctggggtatcactatggactcataaacttttttttattttatgtgttataatccattactatggttattctattttcccttggttttattagggtatcatttacataaaatgaaatgcatagatattaggtaatatgtaatctgatgaattttgacatatgtatatacttgtgtaaccaacacctgaatttaaccaatactcccaatggatatagaaatttccattactccagaaagttctcatgcacttgttacttactaactccaaaggagaaaaatgtacctctccactgttctaattttatcatcatagattaattttgactgttccataacttcctataaatggaaccatctaatatatagtcttttgtgtttagcttttttcactaaggatgatgttttctagattcatccatgttgatctgcatgtcagtggttcattcctttttactgctgggaagtgtaccgtctcaggaaatgatagtccagggccgggtgcagtgcctcacacctagaattccagcactttggaaagctgaggtacaagaatcgcttgaaaccaggagtctctacaaaaaattttaaaatgagctgggcttggtggcacacacttgtagttctagctacttgggaggctgaggtgagaggactgcttgagcccaggagttggggtctgtagtgagctatgatcccaccactgcactccaacctgggtgacagtgtgagaccctgtctctgaaaaaataaaaaagaagatgataccctaagataaaggcttcagaagcagctctctctgaccgtctcctgcccttctgtctctggcctcttattctcccctgaggctagtcatagaaactagaatccctcttccccaaggcagggtttagaaaccagaaactggcagggcgcagtggctcactcctgtaatcccagcactttgggaggtcgatgcaggcggatcacctgaggttaggagttcgagaccagcctggccaacatggtgaaaccccatctctactaaaaatacaaaattagccaggtgtggtggtacatgcctgtaatcccagatactctggagactgaggcaggagaatcgcttgaatgtgggaggcggaggttgcagtgagccaagattgtgacactgcactccagcctgggcactagagcaaaactccatctcaaaaaaaaaaaaaaaaaaaaaaagaaaccagaaaccttcctccttccccttgccagcggtgaaaccaaacctaaaaatattactctaactccctccccctaaaccaccacacctttctgtgcataaactggccatcaagaaattatccaacctacctggtttgactgtaggtcataagacccccattccagagagggtcctgctgcacacccggaaggaaggacaagaacaaaactctgtctcaaaaaaaaagaaaaaaaattctgtgtgtgtgtatttctcattctttttgatgctcaaattgtcccaaatttgaccattggtagtcctctcaaattaattcctgtgtcatctttgggacaatcttaattttaaatgggccctgtgggacttaaacttgtccaacactatgatcggttctgagttcagaaaatagtctctctaaatttttgttccaatctccacagatgtagattcttacctcattcccaaagctagtcactccttaatctacaacagccattcttcagcaacactgaagactcttatgacataaagttgaaacttctttccccaaatgatgcatgcatccgacacacaggcagacacacacgtgcatgcgcagacacacaggcagacacacacgtgtgcgtgcggacacacaggcagacacacgtgcatgcacacacacacacattttgccagtggttcttggattgtttacagtgatctctaaatcactgaacgcctactatgtattagagattgtgctagatgcaaagaaatgcaaagggaagaaaataagaaaattaacatttaaaaaagacctaggccccatgtggtggctcacacgtgaaatcccagcattttgggaggccaaggcaggagggtcacatgagcccaggagttggacacaagcctgggcaacatagtgagacctcatctttacaaatatatatatattttttaattagcctggcatggtggtgcatgcctgtggtcccagctagttgggaggctgaggtgggagaactgcttgagccctgggggccaaggctgcagtgagcagagattgcacagtccagcctgggcaacagaacgagaccccgtctcaaaaagaaaaagaaaatacctaccatgtatgttccggacattgtactaagtgtttgatacatgtcatcttaacaaagatgcataaaatagagatttcataaactaacaaattatcacagcacactagaatacatactattgtaaataaaggcatgtagtcactgaattacattcattcaccagatatttcttgaaaacttcctatgtacaagctctgccccaggcgtgggggatacatctgtgaataagacaaatgcagcctgtgccttctagggctcaagtctagtggaggaaggcagacacataagcaattaccatcagagctccaacccacacaaacatttttaaaaacatattattgtagagacaggttctcactatgttgcccaggcttgtctcaaactcctggcctccagcaatcccctcacctctgcctttcaaaacattgggattgcaggcgtgagccactgcatctaacccaaaaatatgtttcaaaaagaaaaacaaaatctaaaacccactgcctct

SEQ ID NO: 563 - DNA, 23638 bp, Homo sapiens
aggaagtctaaaggaaggagcagagcttctgtgttaggtgctaccatcacacttgctcaccactaaatatgggaagcaatgactcttgtcaagaaattcccaaccctaagcaccttgtatatttgcacgccaatgaaatttgaacataggaaaccttaaaatagtgtttcttaaaaacaaatgggccgggcgtggcggctcacgcctgtaatcccagcactttgggaggcggaggcaggcagatcacgaggtcaagagattgagaccatcctggccaacatggtgaaacactgtctctactaaaaatacaaaaaaattagctgggcatggtggcgggtgcctgtaatcccagctactcaggaggctgagacaggagaatcgcttgaacccgggaggcagaggttgcagtgagccgagactgcaccactgcactccagcctgggcaacaagagcaaaactccatctcaaaacaaacaaacaaaaatggtggtatatggggagactaaaatatagaggggatggccgggtgtggtggctcacgcctgtaatcccagcactttctgaggccaaggcaggggtggatgacctgaggtcaggagtttgagaccctcatggccaacatggcaaaaacctgtctctactaaaaatacaaaaaattagccgggcaaggtggtaggtgcctgcaatcccaattactcgggaggctgaggcaggagaatcacttgaacccaatcggaggttgcagtgagccaaggtcacgtgactgcactccagcctgggcaacagagcaagactccgtctcaaaaaaaaataacaattatgccgggtgcggcggctcacacctgtaatcccagcactttgggaggccaaggctggcagatcacgaggtcaggagatcgagaccatcctggctaacacagtgaaaccccatctctactaaaaatacaaaaaatagccgggtgtgttggtgggcacctgtagtcccagctactcaggaggctgaggcaggagaatggcgtgaacctgggaggtggagcttgcagtgagccgagattgcgccactgcactccagcctgggtgatagagcgagactccatctcaaaaataaaacaaaataaaaataatatatatatatgtgtgtgtgtgtgtgtgtgtgtgtgtgtgtatatatatatatatatatatatacatacatatatatgtatgtatagagagagcgagagagagaccaggaaggcctcaccaaggtgacttctgcaggaggcttgtgatgaaggagcaccacatgcaaaggcctcaaagcccaaggcctggtgggtctgaagaacagcaatgaggccactgtggctggagcagagtgaacatgggggagaagagcaataatgtcgaggaggtgactggggccaattgtgtaggacctaccactttaaggaatttatggttcatattctgaatgagatgagaacctactagagaggtttaagcagagaaatgacaagatctgagatgtatctttaaacttatacttgaacaggatcacactggctactctactgagaacagattgtatgggggagagggcaaacaagggaaaccagttaggaagctataaaataagccagctgagagagatggtttggaccagggtgggggcaatgggggtgataaaaagcacttaaatttaatgtttgtcaagatacagctgataggattttctcttttttgagacaaagtctcttcaatctgtcacccaggctggagtgtagttgttcaatctcggctcactgcaacctctgacccccgggcccaagtgattctcctgcatcagcctcccaagtagctgggattacaggtgcccaccacctcgcccagccaattttttgtatttttagtagagatgggattttgccatgttggccaggtgggtctcaaactcctgacctcaggtcatgcacccgcctgggcctctgaaagtgctgggatcacaggcatgagccaccgcgcccagctgttttttttttttttaatcagtttcttccactatattataagctttacggcacaaggatgggggtctgtctggtcccccagtttctagcatcctgctgggcatgaaggaaacacttggtaaatgaatgatgacctccaatttgggaatggtctcttctgcttttggcacccaaatagcccattttacttacttgcttctgtgttaaatcctttgtctcaactcacctggatctgaggttcttagatgaatttcaggttttcgaagcaaccaggatgggagacccccctgagacaaacataaagagaacaaagaagcatgtaggttttgttttggggtgtggtggggaagctaggaagggaaggaaggaagggaaggaattgaatatagtgctggagatggccctagagtgtgggcagatgggagtagtctaggaactgcacaaggataactggttctatcccttctccagctaactcaccatctcccactctgcacagatgtaaggtcctggtctcagtatgaccaacaggttcgctagagctgcctcattcagaaaggcaatgaggtcccggctgccattaaagttatagaccccaggctgtggctcgtggtagttccagggcacataactgagaaaggaagaggttaataggaaccaaggtgaagagacgccagggaggcctaacggctcaggccttgcagggaatctccaggaagcggttggaaggaggtcctggcctgccctttcccacccttggcctaggagtcctggcagtcttcctgtcccgaccttctttataagggggcggtagaaaaagtagatcccatccctccgcggctcttgcgagcacttcttacaactgtatggcgttgaggccgctccatcgcatcttcaaaagccggtcggcccaaagcacccgcggtacccgaaagtagtgcaggctgccagacacatagcggaacggggccccgtctaggagaaaccggtcatgacccctatccactacgaacgaccgagtgtctgcctataaagagaaagagacgctgctcagcagacgcctggagggagcgtcgagggtcagcgcctgccaagagcggaagagatggaactagccctgcgggttgtttggttgttactttggactttctctcatccgctggatctgatcccgctcaccgcacccggcaggctggttcaccgtctcatcttacctggggcagcagtagcgtcaggctgagcggcagcagcagggaacgaaggcaggacagcttcttgggagccatggcgtttacagcgctcctctagtctgagacggcggacagaccgtcacgtgtcggattcctgggagggaacctcagcgagcaagggggcggaaaccacctcaagttgccaggcgtttagcctggacttcctctccagcctgcagccacccccttactctactagtttgtaaaatttctacatcatgttaaagtgcagttcacgaaccagcttcatcgacatcacctgggaacttgttagaaatggagaatctggctgggcacgatggctcacgcctgtaatcccaacactttgggaggccgaggcgggtggatcacttgaggtcaggagttcaagaccagcttggccaacagggcaaaaccctgtctctactaaaaatacaaaaattagccgggcctggtggcacgcgcctgtattccaagctactccgagggtgggggtgggggtgggggtgggggtgggggtaggggctgaggcaggagaattgcttgaacccggaaggcggaggttgcagtgaaccgagatcctgccactgcactccagcctgggcaacagagcgagactctgtctcaaaaaacacaaacaaacaaacaaaagaaatgtaaaatctcagatcctacctcagacctatagaatcagaatttgtattttaacaagattcccaggtgatcctaggcaccttcaaaattgagaagcatggctttacttgactgggctccctgaggacagggagtgccctgttcatctcaaatcctcagcctctagcacagggccgggtatatagtaggttaaatctggatgaatcaatgtcataaccaaaaggctaaaacaggttcagaaccaggggaaaccattggaaaatcttcagggtgatccggggtgtggaagggaggaaccaggtcacaagaaggacctctttcctggagagtcctgtttcagcaaaacagccattccctcctggccattccaccttctttggaagtgcacccctctccagcttacccctgcctgcctccgcaacagatattaaggacaactgctttgtgccaaagctcgaaaatctgtgaatttccgttccttttgcctttacagtctcaagaatgggatgtgaagatcagggtaataataattacggtttattgacacgtactgaaggctatgtgtcagatattgtattaaacactgtacatctcatttaatcttcaactccatgaggtagataattatttccattttacagaggaggagaggaaaggacagaaacattaagtagcctgtccaaggtcacacaactacgttaacggagctgtcatttgaactagtcagtctggcctcacagttaagctacttaaccttatgtactattatacctattttacagctaccaaaagtaaggatccgagaggttaagtaacttgcccgaggttacacagctagcatgctattaacactcaatttagaaactggaagtctggttcacaagcctgagctcttaaccactgagactaggggtagtgggatacaggccagagcccagaaggttgtacgggatcaggagaccaggccaccagacccgcccctcactggatccccctccaggctgcagtgtagttggccgctttctgccccagagcgccagaggtatgaagcctcctacctccaacattgggagatggaggtcctgggggcctcgggccgagcccggctttgctcccctttggcgtaggtgcctgcgtcttgacccccaccgaaggccaagtagagaaccctcaccagggtcctgggacccgtccacccctacacctagctagcccggagcctctcagctccgcgtccccacatcctccggatgcccagcggttgctgagataccgcgggccgttacgccggcgcggactgatgatgtcagcactgcttccggtcggtggcgcttctctctggcccgagccaggtcagtccggcagtgcagatggcccatcccgggctctgggctcctagaccggggtgggccctgccaggagtgggcctgagcctcgcacgtcctctgaaactacgctatgctctgcttttgcggcgcgatgggcgtgggagcgggggctgcccaaagatgggctggggttggaggaagtggcccggtagccgctgtgtgtcctgaggccgtaaggcgcctgaccccacccctgaagctggcgacggagcagggcctgttttctctacactatagtgtaggttccagagacctgggcctgagctctccgcattggtacttcatgggtcgtctggattgtgccggacctgtgaccctgccgttgttttctttccagcatgatccgctgggcccccagcgcatctcctggaagagcccactcaccctggacgagctcttcggtagcctcagaccgtccttgaagaggatgactgagacattatgggccacgcgctgtgtgtctgctctcggggaactgtcatcattgacaataagcgctacctcttcatccagaaactgggggaggggtgagtgtttggaagtcagttaactagtcctcaagtttatgatcattgaaggacagcggtgtgcatatgcttggggcacaagggttttatccctatccctgtcctctctcacctgacagaacctagctacacagtatcaagaaggtggattctggagccaggcctgctaaatccacctcgtgtgaccttgataaaccatgtttttttcatcagcttaatggagatgattattatccctcactgatggagttgtgaggattaaatgagataatgtgtataaaatgtctcacccaatgcggggttgacaagtacttgataagtgttggctattatttatttagcatctgtcaagtgcagaggtctctattacgaccataggacctcaaagatttctatatctctgctcctgaggagctcacggtgtaatattcttcagatttctcttagagccacatcttgggaaggtttctgctaaatgggaaggacaccccactccccaccaggaaatttctctaggtccaagccatgtgggagatgaccatggccctttattgacccctttggcccacagtgggttcagctatgtggacctagtggaagggttacatgatggacacttctacgccctgaagcgaatcctgtgtcacgagcagcaggaccgggaggaggcccagcgagaagccgacatgcatcgcctcttcaatcaccccaacatccttcgcctcgtggcttactgtctgagggaacggggtgctaagcatgaggcctggctgctgctaccattcttcaaggtcagaaagactcctggttatggagggggttgcagcagagccacctactcaagggctgtgtgagcagtccagcatgttaggaagcagggaccatgtcctgggtttggccactttagattttgagtttgaggtgtgtatcatgaaagggctgataggctttgacatagggaagggatcaggcctaaggagcagaggctccaaaaacatctccaactgtagggaaacttgtgttgcagagaggtacgctgtggaatgagatagaaaggctgaaggacaaaggcaacttcctgaccgaggatcaaatcctttggctgctgctggggatctgcagaggccttgaggccattcatgccaagggttatgcccacaggtcagtgggaggaccctgtgtgcttgctggggcccagaggaagagcctcaccaggagacatgggaggtctctgttctcccaagaaacagcctgtatgattcttttgcttgctgggattccagccttcctgtccagagatgctcataggtcacttctacttctctacagagacttgaagcccaccaatatattgcttggagatgaggggcagccagttttaatggacttgggttccatgaatcaagcatgcatccatgtggagggctcccgccaggctctgaccctgcaggtaaaagagtctccaggttccttttctcacctgttccccattcccaccccttctggtgcatgtcccagtttggtcacatgaccatgacctgtgccccacttttgagctctgggatcactgttccaggactgggcagcccagcggtgcaccatctcctaccgagccccagagctcttctctgtgcagagtcactgtgtcatcgatgagcggactgatgtctgggtgaggagcatgtgggtgggtatctgggtagggagggctgtggctctgtacccaccgtggagtagagtaggttgttggtttctgttgcatggggcgccaggaaccacaatatgtccccatccacttcaacttccttcctgggaaatgtcactgatactgtacccagttgtaccggatgtggtataatctgtgcccctgaacaaggtgagtacagctcagtgtcagtagtgaaggcactggctaagcaggggctaagctaaacaggggctgcggaggcctccagctgactggcagtttctctggaccctggtggtgccatgtggctgaggtcagcgtattctttttagcttatggagtctccttttaccacagaagtaaagggagagatgtcacctccactggtccccttctagggactaatcaagttatgctcagtccctaggctgcgtgctatatgccatgatgtttggggaaggcccttatgacatggtgttccaaaagggtgacagtgtggcccttgctgtgcagaaccaactcagcatcccacaaagccccaggtgagtgagcaacgaatagggcatcaagtgtttcagactcccccctggtattagctgagttgacagataggtgtcatccggtcaccctgggctcctccctccacaggcattcttcagcattgcggcagctcctgaactcgatgatgaccgtggacccgcatcagcgtcctcacattcctctcctcctcagtcagctggaggcgcttcagcccccagctcctggccaacatactacccaaatctgaaaaagcagcatgttgagaagatggccccttgtgccttggaaagaggttcccatccctcattggaatcaccacccattccatccaggacttctcttacacttgggggtagcggggtcaggacaatcatctcagtcctgcatcttttcttctgctttcttccctccaagagcaaaacctgggcaaggggacttactgagtgggggtgggtgggggttgggaaaagggaaactggtgggatatggaacatggctctgagcaggactgttgagctcacatagtgttctgactccaaatctgggagcaggagaatgtgtaaacaagaataaagtggaagcaggttggtgtagatcttagtctcagtgttcctggagtgagagaagaggtgcaaggggcccaaagtcaggttgccatttcaggcgaactgcctgggaaggaggaatggtgcagagtcggcaatggtgtgacttcattctacaggaggttggttagcagtggacagttctagcttgtcttagatcaaaacttaaagctgcttgggctcaagctggcatctgcctgtgtcaagaactagggccccctaaaaacactcaactagttctttccttccttcactcctggggtgagtagcttagtcaaagctgcctagccggtttgctaggcaagggcctctgggtggagacacctgaggaagctttgagacaggtagattacaggtctcccatcctcagcctaggggcgaggggagtggaggtggcagcggcagctgttttggcctgtgtctccctgatcgttcaagctcatacatggttaatgattaatgaggcagtgtggtgtggcagtatccagctgccacttcctgcctactctgctgagtaaacaggggccctgtcttagctgggcttcaaacctgttccctagggaagggctctgttccctgaatcaccagggaggaaaggcaagggcagggttggcatctcctgctcttttgtgatccaagcctcctcccccgaaccatgtctaccccacagtatgacatcagcatggggcctggggctcctgttagcaaagttgaagctttccccagggccctagcaggagtctcccactagctagcacagaggctgaggccagaaagaaatcacaaacagaggggagatgacctgacttttaatggcacagccccagctccagcaaagcagcaagacaggaagctatgcaaagctgctcagaggtgcagtggcacaaacaactctaggagatcgcctgtgttccctcccatcccccaagcttatgacgtggctccatgcccaggaactctgggccagcccagccccactcccaaaccctcataatgcacagaggagcctgggccaagccttgcttccagagttggtaaatgtagaggcagcaggaagaacagggtagcagtctaactttcaaagacagaaaccactggattatactcctacttggaaaggagctgaagactcatccttcaacagtttgtgcctggattttggtcctcatttcctccctatactgagtaaccctaggacttcaatttaaagtccctggggttatgcttcctgggcctggcaagaacccctttgcaggtctcaccttcagcgatggaagggataagggtcatgaacagcaaacagagcagcagcagcatgaaggggaaggcagcagaagctcaagcactcagagggaacaagaaaccgtgcaaggaaactgtttatttcgaaaggattttgcaataaacatagtgaataggctccaggcagctgctttattcttctccctcatcctcgtcctcataggagtcgatgcccacctcctcataatccttctccagggcagccatatcctcacgggcctcggagaactcaccctcctccatgccctcacccacataccagtgcacaaacgccctcttggcatacatcaggtcgaacttgtggtccaggcgggcccaggcctcggcgatggcggtcgtgttgctcagcatgcacacggcacgctgcaccttggccaggtcacccccaggcaccacagtgggaggctggtagttgataccaaccttgaagcctgtggggcaccagtccacaaactgaatgctgcgcttggtcttgatggcggcaatggcagcgttgacatccttgggcaccacatctccacggtacagcaggcagcaggccatgtacttgccgtgccggggatcacactttaccatctggttggcaggctcaaagcaggcattggtgatctctgccaccgacagctgctcgtggtatgccttttctgcagagatgactggtgcataggtggccagggggaagtggatgcgagggtagggcaccaggttggtctggaactctgtcaggtccacattgagggccccgtcaaagcgcagagaagctgtgatggaggagacaatttggctaatgaggcgattgaggttggtgtaggttgggcgctcgatgtctaggttgcggcggcagatgtcatagattgcttcgttgtccaccatgaaggcacagtctgagtgctccagggtggtgtgggtggtcaggatagagttgtagggctcgaccacggctgtagacacctggggggctgggtagatggagaattccagcttggatttcttgccatagtcaacagagagccgctccatcaggagtgaggtgaagccagagccagtgcccccaccaaagctgtggaacaccaggaagccctgaagtcctgtgcactggtcagactgaaaggcaagaacgagaaagaacagtttaggtaggggaggggcctgagggactctatcacctggctccataaagcgtaagatacatcagcagtcagggcaaatactgaggatgccatagcagcaccacactcgagaccatgtatagttagagatgacctcctgaaaggatctgaaaaaaaatattcctgaccattagcacagtctcaaaagttccctccctcccaagacacactctcaccagcttgcggatccgatccagcactgggtcaatgatctccttgccaatggtatagtgaccacgggcatagttgttggcagcatcctctttcccagtgatgagctgctctgggtggaagagctgtcggtatgggccatttcggatctcatctggaagggcaaaaaccacaaagctatgctcagcagggaccttcctcccccagggtggtagctgtggccagatgcatggaaggactcatcctcctgccagcctgagataccagagtgtgagagaaacccagaccagctgcccaggccagtctcagatcagcttgccttctgcagcttcaagtacggctaggaattttcagggctaggaatgcctggtctaaataccctctctctccagggagaagctttgagtcatgctccacccccttcaattttgtccccacttcctctcaccaatgaccgtaggctccagatccacaaaaactgcccggggtacgtgttttccagcaccagtttcacagaagaaggtggtgaaggagtcgtcccctccaccaatggtcttgtcactgggcatctgcccatcaggctgaatcccatgttccaagcaatagagctcccagcaggcattgcccatctggacacctgcctgccccacgtggactgagatgcattcacgctgagggatagagagaggggacacagcatgagccccacatccacaagtcctcaccttgcgagtctctcttccaccctatcatctaccagctaggatgactcagttggcaagagtggagggttggggctgggcagaggtgagaagagagtagcagcctgcccgggctcccaggtacaggactccccacctggaggcacccagcaatgcaggccaacctcttagcccacttctcagtggggaatctgtcaagtgagcactgtggctccacatgacaaaaggtttcctagaggtatgggtttacagctagaggccccccccccacttgattaattatttgctttgagtatgaacagctagaattcatagaaccctttccctctttctttcctgtaagctgcagaggtgtctcagccatccaatctggcatcaactgaccacacgccatcaggatgccctcctccctcacctttaaatcccatctggctctggggatcaatcccatctggctcctctccccacctccacccccgcaccctgggtgtcttcaccactttcatctcccgtgtcagcccgcacggaaatagcggcggtaatgcttgtaagctcagacagcaggggccagcaataaggtttgagggtactggggcgctcactgccttaggctccgtccctgtcagcccgaaattaacccctaaagcactaaagtccggcagggcccgcgcgctcttcccacaccgaaatggcggggtgacggtttccaaatacccagaaaggaagtggaacctgcggtgaggccccagaggtgacccgccttgtcccgggcaggatgggcgccatcctgcagcccagccctacatccgctctccctctggagtctttacagttatttcccagcccaaagcggggattgggtttcggcccccgctcctgggctataaataccaccccctacatgcacctctctcccctccccccaacctggcctcggcccgcgcagtgctcagcgccagctgtctctgcccatccgcgcacccgggcttcggctggagagggccagctcgcttcaggaggccgaaccccgttcccaccaaccctctcagctcagacgcggggtgctgagtcacggggggggggtggttctgtggatagttggaatgcatacacagaggaaagggggatgcggcaccaggtaacctgaccccttccaccttctagcgccaagcacgtgctcggtcagtgctgaggaccagggactggggatgtaagagggcagccaaacccgtcttcttttgcccgcggaaaggacggggcgcgggcccgcgtgactctcatacagagtcgggacacaaatgctcgtaaggcaggagcagagtgccaggaagggttcctctctgttactgaagagtcgcactccaccccaagccccaaccccagccaccgaaggtgaactatacggctcggccaaagtcaccaggagggggttggggagggaggatgcaaaaccctcgcacctcctggagacccggaacgcccggtggaggtccccgagcatgcctggaagaagtgtcccccaaaggagaggggcaattaggggacaggcgcgaccccggccgggccgcactcaccatggtgagtccgggcggtgcgtctcacgttgagtcggggtgacaggtctcagtgagaactgcgctagctgcagtgccgcaccgcccttataggcggggggggggcggggcccgcgttccccgctcgcccactagaggctgggcggcccgcaggccacgcctcccgggagggtaagcggcccccccgaggggcggagcctggcctggtaccctccccaagctgcgcgggggtccctcacctgtcccgctgggattaagagtcgcgattcgggctttaaccattctttcctcgttttgagcagacacgctgggctcccgagggcctccgcggagatgcagggtgctgtggcagggcgagtctcacctgcacctgcgtcctggaggcaccggtcatccaggtgttctgacttaggtcgggagcaggcgaggcggtccttcccaagcggccacagctggccttcacccctgcccttccagccctgcctcccaggagactcgggccggctgtgaggctgtggcgcgtccccggggagcccttgccagctgcctgacgcttcctggtccccggccggggcggcagcctttcgccgacgcctgtgggcggccgaggacccagaactgcacagcctgagccccagattgccaatgccttaggcgctcccgcagagtcgagccccgcagcctgtctgccggggccgaccccggaatctgccgcggctcgccggccgcccgcgggtcagtggcgctgtcatcagcgcagtcactatgatgccctcgctgagggcacctgcccactcccctgctgccagaactgcgggagcgctgaccgggggacctcaggacctggattctcctccaggctaccctgtgtgaccttgagcaagtgacttaacctcactgagtccttgacattttcgtgggtgaaaaggagacagtgatgtcatagtggaaacattgttgtaagctatcaaaatgtctgttgcctctgaagagaaaagaagaaaatcgagattctcatatcttggatgattctgactcttggtctcttctgtctctaacccaagagcaggatctgcaacccgcaccttaatggtctcagcactcagcccctggtctccgcagaagcccttctttctacatttcattccgttctctccaccccatcttttcaagctacttctgctttctctttctctctctctctctctcttttgagtcagtgtcttgctgtgtcacccaggctagagtgcagtggtgcaatctcagctcattgcaacctccatctcccggctcaaggccatccttctacctcatccttccacctcagcctcctcagtagctgagaccacaggcgtgcaccaacaccatgcccagcttattttatttatttatctatttttgagatggagtttcgctcttgttgcccaggctggagtgcaatggcacgatttcggctcacctcaacacctgcctcgcgggttctagcgattctcctgcctcagcctctggagtagctgggattacaggcatggatgcctggatgatttttgtatttttagtagagacggggtttcaccatgttggtcaggctggtctccaactcctgaccttagatgatccacctgcttcagcctcccaaagtgctgggattacaggtgtgagcccccacacccggccttattttttgtatttttagtagagacaaggtctcgccatattgtccagatttgtcttgaactcctgagctcaagcgatccacccgcctcaacctcccaaagtgctgggattacaggcctgagcaaccaccccagcctgccttgcattttctaattgtctcccttcactggggaaagtcatctggcagtgccccaggtgctgctggtttgcagatcttaagaaacctgtcttcctggctctacatcacttggaaaggattcacccctccctcccccatcacctgacaacacaacataataccatgaaagaactagtgatggcaactctctatcaacaaaataggcaaggcatggaaaggaatatagtgaaatatgacaaggtctttcttcccagtagacttgccatctgattgggagaacaagactcattcataaaaagaaaactgacaggggcgtataatgaggcttctttggggaataaggtcatggtccctacaaagaaaggagccgtggtgactataggacacatggcagtaggttgcagaccctccctgaacctctttttccttgtgctctcctatcctagcagaatgaacatagtaagagacttgagctatcttaggaaaaactctaaacctctttgaccttcaggtgcagattcttcatttgtaaaaccgggataacaacttcagattgtgaatatcagatgaatttagagatgtacatattcacatcaaggcactgtgtaagtagctgtgacatttattttagtgcatatagcacatcatgctatagttatttgtgtacatgtccatcttaatattatagatagcaaactattggaggtaaggactgtgtcttattcatctttgtttctagctcctagcatagtgcttagcacacctggtaagcatttgctaagtgtgtgtcagaagaattgtttcacttcagagatggtaggcagaagaatgctaccccataaagatgtccacatcctcatctccaggacctgtgactgttaccttacatggcaaaatactttgaagatgttattaaggtaaagatcttgagatagggagatgatcctggattatcccaggtaggcccagtgtaatttcaagggtccttataagtgaaagaaggaggcaggagggtcagagtcaaagaagaggtcagacctggtgcagtgctcatgccagtaatcccaacactttaggaggctgaggtgggaggatcacttgaggtcggcagtttgagaccagcttgggcaacatagtgagaccctgtctctaccaaaaaataaaaattataaaataaagaagaggtcaaaagtaagtagaggtcagaatgatgtgattgttggctttgaagagggataggggccatgagtaaaagaatatgggcagcctctagaagatggaaaagtcgaggaatagattctcccctagaatttccagaaggaaggcaacctggccaacaccttcatttcagttctgtaagacccattttggcttttttttttttttttttttaagatggagtctcactgttgcccaggctggagtacagtggcgcgatctcggctcactgcaagctccacctcccgggttcaagcaattctcctgcctcagcctcccgagtagctgggactacaggcatgtcccaccactcctggctaattttgtatttttagtagagatggggtttcacagtgttagccaggatggtctcgatctcctgacctcgtgatccacccacctcagcctcccaaaatgctgggactacaggtgtgagccactgcgcccagcctttttttttttttttttttttgaggcaggatcttggccgggcatgtaattccagcactttgggaggccgaggcaggtggatcacgaggtcagaagttcaagaccagcctgaccaacatagtgaaaccccgtctctaccaaaaatacaaaaaattagccaggtatggtggtgtgcacctgtaatcccagctactcaggaggctgaggcaggagaatcgtgtgaacctgggaggcagatgttgcagtgagccaagattgcaccattgcactccagcctgggcaatagtgagagacactgtctcaaaaaaaaaaaaaaaaaaaaaaaaagagacaggaagacaggatcttgctctcttgcccaggctggattgcagtgctgaggcaggagaatcgcttgaaccagggaggcagaagttgtggtgagccaagattgtgccattgcactccagcctgggcaacaagagcgaaactgtctcaaaaaaaaaatatatatatacacacactatatatatatattttatagatatggggtcttgctgtgttgcccaagctggtctagagctcctagccataagctcttctcctgccttggcctcccaaactgctgagattacaggcatgagtcacctggcccattttgggtgtttttttttttttttttttttttgagacagtctctctgtgtcacccaggctggagtgcagtagtgtgatctcagctcacagtgcaatgcaacctccacctaccaggttcaagcgattctgctgcctcaaagtcccgagtagctgggattacaggtgcacagcatgcctggctaatttttgtagttttagtagagataggatttcaccatgttggacaggctggtctcgaactcctgacctcaggtaatccacctgccttggcctctcaaagtgctaggattacaggcatgtgccaccatacctggcctcattttgtttgttttgttttgttttgtgtttgtttttgtttttgtttgacacaaggtctggctctatcacccaggctggagtgcagtgacgcaatcttggctcgctgcaacctccacctcccggcctctagccatccttccaccacagtctcctgagtagttgggactacaggtgtgcaccaccacgcctggctagttttttttttttttgtattattagtagagatggggtttcaccatgttgcccaggctggtcttgaactcgtgagctcaagtgatctgcctgcctcagcctccctgagtgctgggattacaggcatgattcaccatgcccagcccacctggctcattttggacttctgaactccagccctggcagataacaaatgtgtgttgttttaagctatgatttttattacaatttgttacagtaacagtaggaaaataatacgacaacaatagaggtatgtggaagctaccatcttaagatgggcaacaagctccctccagttcgccacagtcctcatcactctctgtgtctccctgacacagaacacaagtgtctgttgtcatttaacttcatacgatcagcccacgttacacatttatgataccctggccactgtagctaagagtttataatccttgagcacgctttctagctgacaaaatggagaagacatgggtgcaggaagaaatgcccaagatggccgggagcagtggctccctcctgtaaatcctagcactctgggaggccgaggcaggcggattgtgaggtcaggagtttgagaccagcctgaccaacatggtgaaacctcgtctctactaaaaataataaataaataaataaataaataaataaataaataaataaataaattatccgggcatggtggcaggcacctgaaatcccagctactcaggagctgaggcaggagaatcgcttgaaccttggcggcagaggttgtagtgagccgagaatgcgccactgcactccagcctgggcaataacagcaagactctgtctaaaaaaaaaaaaaaaaaaaaaagaaatgcccaaggcatgttagtgaaatacagattctgcttctgattgtgtgtgtgtgtgtttgtgtgtgtgtgtatgtcctcaggatgtatacagatctccagaattagggccataaactctgggtgagtatgcaggtaatggtccattttaccagatcaaaaacttttagacattcacagacatgtacagaatctagaaaatgctaccagatgttgaattacttttctaattcactctcccgttgaattaacttttcagtccatctacctatatgtgtactctccctctgggtctctctccctcttctcctttcccattatcatctccatcttttctgaccccttcccagggtctcacctttatcttggagcagggcagcaaggtactcaaagtttaaaatgtttgcactgactccatctgggagagatagagccacagccttagtgatgtgcatccttcagtttttccagactagagcatctcccagccatcctccttctcacagcactgcctttacaaatggggtagccctactcatcacatatccatgaattcacccctcaatactctccctgcagacttgactcacatgctccgctgagatgcttttgccaaggtctctagtggcctgcctcttgccaaatccaaaggccacacatctccatcttcatctttcttagccgctcacagcagcatttctcatggtcgattcttctttccttcttgaaattcttttttgttggttttgatgacagcaccggcttctagcttttgtcctggcccctccttcttggtggcctctgatagcttaattttaaatgatgttccccatagcccagtctcaggttctcttatttccttcatttatttttctccctgaaggagcaattgttgaagcttggtgatgaatatatgaggttttattatattatctctatttttaggtatatttttaataatattcatcataaaaagttattgtaacatttttggaattatttaaagagaattattaaaaaataattttggaattattttaaaactagagtatatacattcccatacaatagtgaaggaataggataaaaagaaatgaatgtcatatatatgctgacgactcaaatttatatctccatttctgacctctcctctgaacttcagattcatatgactaattgctttcttgacatctccacttgaaagcccatgagacatctcaaacataacacagtcaccatggaactgttttctaccctcaccccactccctgccaaacctgcttctgttctaggcttcccagtctgagtgatcatcttccttccaagtgcttgagttaaaatcttaggattggccgggcacggtggctcacgcctgtaatcccagcactttggaaggccaaggtggcggatcacctgaggtcaggagtttgagaccagcctgaccaacatggtgaaacgccgtctctactaaaaatacaaaaattagctgggcttggtggcgggcacctgtaatcccagctgctcgggaggctgaggcagaagaatcatttgaaggaggcgaaggttgcagtgagccaagatcgcaccatcgcactccagcctgggggacaagagcgagacttcatctaaaaaaataaataaataaataaataaataaaatctttattttaggatcactttcctctctctctctctctctcctctccctcttttaagttagaattttttggctgcaaataatggaaaacctaacttatcaatggcttgaacaatgagggcatgtattatcccacaagaaatctgagtatagggtctttccagggttgattcagtcatgtcaccaataactccagtgtttctagctttctgcgctgtcatcctcaaagagcgggtgacatcttccctcaggaacacaagatacagcagctctaagtatcatgtccttatatgactctgtcttaaggcaggaaatggggggcttcctcccacatctgtttttatcaggagaaaaacctttccttgaagcgccctagcagacttcccccttctatctcactagcttttgcctaaaccagtcactggagggagggagttaaatggccatggatggtttggactaacctgtacacacccctaggtctgggggaaagctgtcttcctcaagcaagtgcaagggtgaatactcaaataaaatcaggaccttgctagtgaagaattgggcaggggcaggcaaggctgttgagaagctctgccaccacctacactagtatgtccttcactttactgccaacccagctacttctcaccaccccctactaccatcccgttattcctagatgccttcagcagcctctgaaccagcttcctgcctctaggcttgaaaccctaatgcagtctccacacagcagctgcagtcatctctctgaaacacaagctaggcaatgacgcttgtttcaaaccctcctgttacacttatataaaagccattctccttccaaggcccctccacctctatgatctcatcttgtagagctctctcctttcctcactctgggtttttggacacactgggctagttcctacctatgattgtttgcacttattattctgtctgtctggagaactggtttccagatcttgcctcgctgactcctcaccattcagccctcagttcaagtgtcaccttctggccgggtgtagtggctcacgcctgtaatcccagcactttgtgaggccgaggcgggcggatcatgaggtcaggagatcgagaccatcctggttaacatggtgaaaccccatctctactaaaaatacaaaaaattagcctggcgtggtggtgggcgcctgtagtcccagcaactcgggaggctgaagcaggagaatggcgtgaacccaggaggcagagcttgcagtgagctgagatcgtgccactgcactccatccagcctgggcgacagagcgagactcgagactctgtctcaaaaacaaaacaaaacaaaacaaaacaaatatcaccttcttatagagtggcttctgttcagtctaaaatagcagcccctgcatatctttctgttccattatccagccttgttttcttcacatgcttattgctatctggaatgttcttgtttgtttattgtctgtcttccccatgaaaatgaaagctccattttatttctttttgagacagggtcttactgtgtcacccaggctggagtgcaagtggcatgatcacggctcactgcaaccttgacctcctgcgctcaagtgagcctccctcctcagcctcccaagtagctggggccacaggcatgtgccaccacacccagctaattaaaaaaaaatttttttttttgtggaggcagagtcgcattatgttgcccaggctagaatgtaagcttcttaagagcataaacttgccaggcacagtggctcacacatgtaatcccagaactttgggaggccaaggtgggcagatcacctgaggtcaggagttcgagaccagcctgaccaacatgatgaaaccccgtctctactaaaaatacaaaaattagccaggcatggtggcatgcgcctgtaatcccagctacctgggaggctgagacaggagaattgcttgaacccgggaggcggaggtcgcagtgagccgagatagcaccactgcaccccagcctgggcaacaagagcaaaactccattccccaccccccaaaaaagcataaacttttgtgtttatcactgtatccctggcacctgaaatggtgcttggcatacagcaagcactcaatatttgttgaagaaattaagagtattcatggcctcttatgttttaatctagatgcattaaaatgctttaaaaatctcagtcttggccgggcacagtgcctcacacctataatcccaacactttgggaggccaaggcagatggatcatctgaggtcaggagtttgaaaccagcctggcgaacatggtgaaacactgtctctactaaaaacacaaaaattagcggggtgtgttggtgcatgcctgtagtcctaggtactcgggaggctgaggcaggagaattgcctgaacccaggaggaggaggttacagtgagccaagatcacaaaactcagtcttttcattctgctttacataagacagctgactgccattaggatagttttctttttggagttggtgatacctaggttgactctgagagtccaactcccaaggccagttgggagaagtttcagtgctacacaagagagttttgagcccagtgggccctctgggccccatatcactccatctggacaataattcctgaggtccatggtttcatgggccaacccagtagaaggctgagctttcttatctttgatatgttaagtggctgggtctcttctttgggcctctttgttccaggtgggagacagaagagttctaaccttcagtctgtagccaaagccagagttaaccaacttgagatcattccctagcttactgggttgacagggtctctgaaaaagtcccctgtttcaactgcactatgtaacacagtggctgaaatttcacattagcaactact

SEQ ID NO: 564 - DNA, 400474 bp, Homo sapiens
gaaggcaccatgaaggaggcagatgcaggtaagtttttcacatttcatggcaggaggacaagagaaatggtctgatggcttctactttctttgtgaaggaaacacagtcatctactgagagtgaggggaaaggcagggaagtcagtggtttaagagaagtgaagaaggtttaaaattgcactggaaaattacagcttgatggggaaagagccagatggttacgggcaactctgagggccaggttaggcttcctgaagctgactgtggcacagtggccaagcgtagacttgggactgccaggtggcctgttggtgtgaatccagcttccctcactccctcagttgtgtgactgggcacattttgacctctttatcatgcaaatgcagcaacaggtcatggaaagtaagaattattactatcaaggggctgatgggccagaggagggaaggaattaattagaggagctaacagaccaacaaacaaacaaacaaacgaacaaaaaacccaggtcccaggacagggaatcctgatggggcggaggtggtatctccgcagttactgagagaggggctgtggtcagtttcttccccttgaagatgtttcttccccttgaagatgagaatgatgttaatatccactatctggagttgttctgaagatgaaatgacataatccatgcaccaagcatgtggtaagtgctcaactatagtattaacagaaattcatagtgccacttttcttgtggtttatgattttttttatctttttgtcagcaacccaaatacaggtatagagacaacgaagataggattcattcagggtactggtttatcatgcaaacgcagcaacaggtcatggaaggtaagaattattactatcaaggggctgatggaccagaggagggaaggaattaattagaggagctaacagaccaaaaaaaaaaaaacaaaaaacaaaacaaaacaaaacaaaaacccaggtcccaggacagggaatcctgatggggcgggggcggaggtggtatctccacagttactgagagagaggctgtggtcagatttcagagggggagcagctgagagtgtgatcgcaggagggggtgaatttaattcataggcaacattgttggtgatgaaagaggaacccaaatcctggcctttagatttgttgtcttcgtggattttgaaggtggcagtcttgggagaggaaggttgtgaggcaaaattctccagtgccacaggagaatgggaagggacgcaggcagtgagaggcagagagaggggctggccagctgagccgggaggcctgacatgcaaagcattgagtttttaatgcaataatctggaatcagcagttttgtatgagaaagaccccacctgcctcccagctgtggagtatttgagatgtggaaggaggaggctgttgctgctgcccctgaattgtcacctctgcgaaaggggagggaatgtgttagggctattgttccaagcattgtggaccctggagggcagaatgagaagtttggtttgtgaggggatccattggagattggatcaggaccagggaagcccaaaattgtctggggagtggagagtgcaggaaggtttgcgtctgacgcagagagaatgaagagtttgcgtgagattggtggtggttagccagctgcacttgtgtcaaaagagtgcatcctgatgctggaattcagactgacctgcttaaattccaccattttccacttttttcattctttggaagtacataatctgagcccagtcttcccacctgtaaattcccacctcttcgcgctcttgtgaggaaccaataagatgagtgtctgaattatgtgagggcccatgccaggtacatcacaggtgctcagaaatactgctctttcccctttctttcttttctttctttccttcctctgttttcttttttttctttctttcttttcttttcttttctttctttccctccctccctccctccctccctccctcccttccttccttccctccctccttccttccttccctccctcccttcctccctccttcctccctcccttcctccctccttccctccctcccttcccttcccttctttctttctttcttctttttctttttttctttctttctttcttttttttttttgacaaggtctcactctgtcttgcccaggctggagtgcagtggcatgatcatagctcactgcagcctcgatctcctgggctcaagtgactcccatctcagcctcccaagtagctgggactacaagcatgcaccaccatggctggctaattttatgtttagtagggacaagtcctcactatgtttcctaggctggtcccaaactccagggctcaagtgatctccccatcttagccttccaaagtcctgggattacaggcgtgagccactgtgcctggccaatgctgctttttcttcctgccattagtttagcaggatctacaattagcaacatttaaaaccagctgagatttgctattggtacatctctcccaccttctgtacaccccacttctgtgtgtcatgggctcaagttaaacttttcgcagaactcacaggcatactgacagtaaatctcagctgaggaaaaaaggttattttgttggcattggtcattttgtaagttgcaagcttgttgtctccatctggtcacagcagcaaagtacagatgactgcactctcagaagttttgtctctgcaaagtaatttctaatttctaccctaggttctgatctgagcttagctgtggggatctctggggctgctgaaggttctttgcttggcacctgtatgctggtactgagagacaggagcagagggaggccaagcttcagaactctccagggacctccactgagagacaggggcttaggttgggccctcagtgaagtctttgaaaatgcttgcatgccatcctaggtaaggccttctcagcaggaatctcagctaccaaagcttctaattaggggttagtggtctggtaacagggctgagcctttgccaccatgggttttctatgtaaagtacagtttttgtttgtgttttattgttttcattgtattttcattgttttatatggaatttgagttctctggctcagctgcagcccttacatctccctttgattttacccaggttccagtttatatatttccattacttccttagccttggagaaacatttgaattcatgatcccagcatggattgttttaagtcactttcttccagcccatggcatggaccagcttctcagtgctgggcaattgcttacacccttcagccacggaggctgaggggaggggtgggggcaggtggcagtccatctaaggaagtgtctccaggtcgttctctcatggaggacagggctgtctttgattctagtcttcagcctcacagctgcttcgcacctcacagctggagcccttggcttgctcgccctaaggcagtggccagcagtcctgtaccaagctgaactcctctgctggtagttgcttacctttcatttcctacctattagtatagttgtttgcaagcttcatttaaaatcagatctctgggggcagggcttgacactctatttagaagctcccgccccagagaattctgcagaagttctaagacattggttctcacccttaaccgctcattagtaccacccgggagcttttaacacccaagacccaggctacccccagaccacttccatcagaatctctggaggtgtgaccctggcgttagttcttaaggcctctctggtgattccagtgtgcagctgattttttagtagcaccatgctaaaacctcatcctgtgcctgcaggaggttgtgatcaccatccacgcaggacccaaagcctttctgtcccaccgaagaaacacgtggcagctctgaacacgcaagagaaccttgttattaagtgaaggaggcagcactttgttgcttataaatataatttattacctgtttaaaaattctttcttacattttgtacatgttggctgacagaataaatgcaggcaatttacaaaccaaggggactgcagggaaaatcaggattggcagccagggagagaaaagaggcacacccggagctggtatccctcacctccaccactcagcaaggcgccggacagatatccggagggcactctgcctctgccggggggtttttttagaaaaggaattgcatagaagatacagcaagagggaactccacaacaacaaaagtgttccatatcggaaaagccaaggttgtcatgttttgtttaaaaaagaaaaacgacaaagcacaaaacctcaatccgacctttctgcagttgaactgttccaaaggggacagtaggtggatgacactgcctcttcaacacgactgctggggatttttctctgacaaacattggtgtcttctttacaaagagcaaagaggaaggtcaccaacttgcttcagctcaacattaaactcaacacatataacaccatgacatcacacacacacagtgatgttccctgcaactgggctcgatgcattatgtctggagggcgagggctgcgctaccaatggcagatctaggaaagcgtgaagaagagaatgcaaatcacttgttccactgttctgactgctgtactttttcttgtccatggcctggaggagtagacatctgagtttttacccctacatgtacagatgccatttgttactttcgggatagaaaaggcaaaggtattttacaccagctgtagatttcttgctcttatatgtcactccgaacagagttgttttaacattgagaacctatgtagctcaggtccccattctctgatgctgcctccatagtgctcaggatcagaggccaaaagagagcccatcaatccttaggctgctgatcagcaaaacctgcctacaattcatcttctacacaccagtactgagggttattccaccccggatcagcgccatcaggttctacagctggtctgatagtacttagtccagtagacctttggaacttaaaaatgacacacaatttagacatatttgtaaaagacccttaaatggtatgacttgcaatttatatttttgttgaaggacaaatctgaaatggtatgttaaaaggctggcattcagtagcaaatactatggcaggtgggcagctgactatatctcagggtagcttccttgtttctactcagaagctagttgggccacaactgtcacgacattctgcagagattcccaacctgggattccagaagatctctggacaggtcccttcagtaggcaagcgtctgagtagacagcaggctgatgaagagctgctaataattggtgggcttgctgtgccagtacacttgcggagtacctgttggtttgtcctgctgatgccccccaaccatgctaaataggtctgaggcacacattacatttggttgaatgagcccgttaatatcctaccacagatgaatacaatgaggtgacaggaaaacctaggaaccatgacttatgaagactggctgttaaagtagcatttatgaaaatggggtaagcacaaggctgataaaactaaaggatctggaagctcatggctagacttagtctgcagagaaaacccacccagttctacacaaagccatctccccacttttcaaaaataggtttttcacactagaattctggaaatgacttcatttggctttcctggcctgtatggatatgggtttacataacattggttacaatatatttattcccccttatgccttattccattaaaaagaaataattagagatgcaaaggaaatcttccaaagtgatcattacagccagagattatacaaatagatatcttagggtagagaaacattacttcattgcccagaggcaaagttctaaagatttcagtcaatactagctcagcaaggttaaagaatatataaaaataatacaaaaagaaaaataaaagccaaagagtaatagttggtcctatgaggcactcgagaggtaaaaaaatgttttgttaacttgagataataaaatattttccttattagatctataaaatctaatgcttatcaaccattatcttgagcaatgatgtactgcttcacaaaagctcttccattctcaaagaagatggataaagtcccatttcatttcagctgtgtttccatgggacccctctcattcattagccttgggcttacactgagttctccacatgaaactgatgacttgtccagaacaactgcccagcaaaagctaagactcattcaacttgaaggcttgaaaacccaacaagtaaaccttttctaccttctttatgctctcttgcaagtccttatataggtttatattttcctggccccataggggcagaccttatagaggcaaagacctttgaattctggggagatggtgatcaccttattaactcccttctgcatacgtggattacagaggagtaagcagaccaagagcacagctgctgtgatcctgacagagacacacagaaggacacgagacaagagccttgttgctctttgccaggagaagtgaaaagtcttgattccaccctcaaaacgttgacttttcagataccttacttgtaggaaaaaataccttaaaaaaattactggtcgcatagtttcagggtgtcctgaactcagtccccacgacttttttctcctgaaaatcgctctactttttgatagttgagagacttaaatctataaaatagtatatatgaaaatggctaatgattatgcagtttgatattgaacacctcacccaaaagttgtccagttcttgaagagcctaacttgctcacagcaggatgggggttttctgcatagcagaggtgactgttcatttggaagatgccgtttgtgaaacagctgttagctgtgagaaccttggtgttacacaggtttgtcatcaccatgccagttatcaattctgaatccaacttctattccttccagatacattaaggaaacttgaaagagtgtgataagaagaaaataaaaacaggatgaaacctctgcctttggattcccaaattcagcagaaaagaagctgctttcttccctttgattaacaaccccaattttctcttccctagacatagtattccattcgcatatataagacttatttctttctaagcagatacttcttacatttccaaagataaatattaaggaactaaaaggagatttaaagtatacaaaccccaatgaaaaccataagtgttaaaaatgacaactcttcaaagactgttttatatagattttacatagttctgttacaagaagcaactgaagatatgttgtgtatgaatgagttgatgtactgggctcacagtgacctaatattgagatgagtgatgcaaatgaaaaaaaagtgagaataagaaaattataaatttgaagtgaaaatttccctacatctgtttgtcataaaggtccttgaactctacaggttttcattcccttcgtcaaacacattctagtgaatattaaactcaggttagattgtgttgtacaccactagatggcagcatgcacaaatgatagttttttctatccaaatgaaaccagccaaactgcctctccagcggtgtagaaagaagcaggatgtatcacatagaatggttgatgaagtggcttcctatgaaatgaactgttatatctggaccttctaagtttgaaagcaatctaacagctattactttactccaaaggagaaggaaatcagaatttgtagtgaaaattatttggtataaatagtgtatgtatggaagttgtcattcacttaataggaaacattaagggttctgacagatgagtacctcacacacgaaatcaatcacttttcccttttctggtggtgggaagttgaaccaaaaaagcatctgaagtgaaccccaagggttctcagtgacttcagtaagacaaacaattcctgtttgtgttcaatagttctgtgttggtgactttttagtcaaaataagtttttagtaacagttatggaattgattcatgttcatagctacatagttgctcccctctagttttcactaggcatagaagtttctttgaccattcagttcagattctagttcttgatttccatagatgattccacaaccctggtactgatgcgtaatcttgacaagtttatttcaaaatgtaggaatggacaatagctctctttcctcctcctccttttaaaaaatgtgtgtgtataactgcgtgtatatatatttgatttttaatttagaatacagttttactcattgctacaaacatccactgaacttgtttatagtgcaatctctcccttccccagtcagtgtacaaatattttaaatatggaaatcctaatgcagggggtgggctgagagagattttatagaatatatgtatgtatgtccaaaacagaagatacggaataaaaagcatgaaagaaagaagaggttccatagcaaggtatcagcagttcctcagggatgaggatggcggaggcatcaaggaatctcaagatgctaccaaaataggagcggaaacatggaaagatggaagcacatgtataattcaagtctgttcagcaacttgtgtgcctccagcctaaaagtaaaccacagtcatgttctaaaggttccgattcatacacatgtctgcttgttcttcagttttggttttgctactgggctttgattctttaatccccacctgctgaatgaattgagtccttgtgtttgttaaagagcttgtgatggtcccaaggaaacataatagttgtttacacaaagtagtgtgttgactaacaaacattttgcaggacaaaagtttttaaagagctaactagacagcttttataaatgctactgaatattatgacagcaaagaaagattaagggtgggggggtgtagcgtagaaaaaaatgcaccaagttcctactgccagataaacttgtaggagtggtctagatatcaagatgccaagacaataataaaaaacagaatttgcaaccagtcaggaaggctgggggcaggggcatcccaagagaggctaagaaaatgataataaagggatgtcatctctcagtgaacagcataatgcaatgatgcagagcgactcaggccaaacaaacaacatcataatgctggttagaataatcatcttccttgtcagaactacttgaaaggcgtaacatagcctgggcaaaagaccagctgatgatttttaaatgatgatccaggtcagagtccattgtggtcttcagactgatgaatgagactggaggcatcacggtggaagttgagcatttcagaacttggagatgatctaatcccaccctttcactttctagtgaggacactgaggtcgtgtggttaaatgactttctcaaggtggcgcaacaagacagtgacagacccacaatgagaactggtttcttgatctccagtttagagtccattcctccaaccacactgcctctagagtagagcaccatagggagtcgacgtggggccacacaacggcaatattaagtgaacttaatagagaacacgtctccttaagactcctcagaggagaaagaaagaccctgcctgagcaagctgaaggaacagactgacaaagccattcagcatttatcaatcacctttctggggtggaataagggaaaggtaaaaggtcaaggaagtgatgcatgttgaattaaactgatgaccacacccaccttgataggtgaaaaggtgggacaggtctagtcaataaccaaatactaacaaacagcactgctaacaaaaatagaaatttaaaaaaatcattttaccagaatacctgtaaataataataatacctttaaaaaaaaacacttcatattgcatattacaaacaaacacacatgttgtgaaaaaaatgcttgtttgtggggttgaacatgaatcactgtcttccctgcagtgctacagctttattcccaaagggcaccagaagggtccctccaaggaataggagtcttagttatttcttttttacacttagattctccacttccctgatacaaacagtaacactggttctacaagttctagaaacagaacactgatgggaggattatctgagacacttgatgcacacgatttgtagcaaaagtctgtgatttctctgtaaattactaatctgaaatagacacaacaaaccgtccacagcttcaacttcaaatgatttgaacaaaaatagaacgagccatggacagtgtctgcatccctgtccaatttgatgtaaacaacatttgtagaaattgggtttgttaagaaagtttatccatatatctggatagcaataaaaagcgtttcctaggaaactgtaagatcctgtaccacacagcatacagcccaactaagaggaaaattaggttgatagctaaattcaaggtacaaatttacacaatttttcttaactcccgtgatgatgtccgagtaaagtgggcatgtacatgggcagttgtatctgttttccttctggctcctgctgcagtcttgcctgtgaagtgcattggtctcatctggatttcctcctcagctgtgattcacctggacggccacagactccctgtgcatttttgtccttcatttccccttccagcatggtggttaatactgcccttctgctgctaaggacaccaccgtttcatgtcttcccatttcttccaagacagctgccagcatgctcaggtttccatctgggaagttctgtgcttcccaaagatccaggattacgccagttgggctggatttggtggcaaagtaattcaagtacctgtaattgggaaagagaaaatgtgctcaacagtgtgacttacatatctatttttcctcagctaaacctttctgtctctctacttgtctttaagtttcctggtcccattgtggctgacagtgagccatcctaaataactagcccatgcttaattagatcagccccagacaggggatgtgatgtttaactttgtgaacctcagctctgagtgagataatttaagagacaagatgtctatgggtcatattctaaacaggaaatcaagagacttatgttttctttctagtccaggcttggatgatctttgacaggtcatgccacatgttatgtttggtagtgacggtgacactccacaaagtagacgctccagaggtctctttataacttaatatcagtgctgtgttggcatgctaattattaatcaaacattaggtcctgctcaactgcagaggaggagcaataactacggtagtgaatggctatatgatttggggaatttagcccatcagcttggcaaagtgcatcacaaaacttgatacttaccaatgccagataagctcagaatgtctcttagcactctttgcaagcccgtagtgcaaggtacaaggacagagcttaatgcatatttgcaaaatgaaaaattaaatagatgtgtggatggaaaaaaaaatgaagctaaccctacgtctaatagttatcggtcctggagggcactaacagaaagaagctagtcttggggccagaccatacccacctgtccaggttcagcttatgggccagcatcctccagtcatggcctctcgtctggggggcatccaggctgctacagagcttctgccggatagggagagggatgctgaaagcactgggccccgtgaccgtggtgatggtgttcgcaggatccagcagcggcaaatcgatgccagtaggttcctgtagttcagggacaggaacaacacagcattatttctgaggacaaaagcaatctctattgaaccaatcaacataatgccttgctttgagtgataagaaaagaatgaatgctgttattcttcttaggaagaatggcttcttcttagcctgaaagttgtgcatcactagatgtaacctggctcagagatagaggtacatacattttgagctaactttgcatagcctcagatttgtgagtctttggtgaggactgggctggatggaaagctctggtgtgattcgataacagctttactaatgggattctccaggctgagagagaagagagggaatatcagagctcctaaaggtttaaatttcaggagaggaaaatgttcaaaagggcagtgctttgggaatgaatagatctgagattcaaggcttctggaaacagcctgaccttgaggagaaagtcctgggcaaatgctccagtagttctgctaaactccacagaagatgtctcagttctgcttttgttgaatgaactggaacatagctctcctctaaatgatatcaacttaaggctaatttcttaaaaaagaaaatggtaaacacagtatattattgccttagggcaagttgttaatggcatcctccaattgctgtatatccttattttttaaaaatctaattttagtagagaaaaccataaattggctcttaagatagtctcagctcataaaacagcacaaatgcaaaatctgaatttcatctgcaggagaaattctaatcattttctgatcacttgtgctggttggaaaagcaaaagcaaatggtgcctgggaactattaaagcaataaaagaaaatctacttaatctactataaatgccatctctctctattttttttttcttttttatttatttattattattatactttaagttttagggtacatgtgcacaatgtgcaggttagttacatatgtatacacgtgccatgctggtgcgctgcacccactaactcatcatctagcattaggtatatctcccaatgctatccctcccccctcccacctccccctaccccacaacagtccccagagtgtgatgttccccttcctgtgtccatgtgttctcattgttcaattcccccgtgagtgagaatatgcagtgtttggttttttgttcttgtgatagtttactgagaatgatgatttccaatttcacccatgtccctacaaaggacatgaactcatcctttttcatggctgcatagtattccatggtgtatatgtgccacattttcttaatccagtctatcattgttggacatttgggttggttccaagtctttgctattgtgaatagtgccgcagtaaacatacgtgtgcatgtgtctttatagcagcatgatttatagtcctttgggtatatacccagtaatgggatggctgggtcaaatggtatttctagttctagatccctgaggagtcgccacactgacttccacaatggttgaactagtttacagtcccaccaacagtgtaaaagtgttcctgtttctccacatcctctctagcacctgtcgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccattttgtaggttgcctgttgactctgatggtagtttcttttgctgtgcagaagctctttattttaatgagatcccatttgtcaattttggctttggttgccattgcttttggtgttttagacatgaagtccttgcccatgcctatgtcctgaatggtaatgcctaggttttcttctagggtttttatggttttaggtctaacgtttatgtctttaatccatctcgaattgatttttgtataaggtgtaaggaagagatccagtttcagctttctacatatggttaggcagtttcctcagcaccatttattaaatagggaatcatttccccattgcttgtttttctcaggttagtcaaagatcagatagttgtagatatgcggcgttatttctgagggctctgttctgttccattggtctatatctctgttttggtaccagtaccatgctgttttggttactgtagccttgtagtatagtttgaagtcaggtagtgtgatgcctccagctttgttcttttggcttaggattgacttggcaatgcgggctcttttttggttccatatgaacttgaaagtagttttttccaattctgtgaagaaagtcattggtagcttgatggggatggcattgaatctatagattaccttgggcagtatggccattttcacgatattgattcttcctacccatgagcatggaatgttgttccatttgtttgtatcctcttttatttccttgagcagtggtttgtagttctccttgaagaggtccttcatgtccctcgtaagttggattcctaagtattttattctctttgaagcaattgtgaatgggagttcactcatgatttggccctctgtttgtctgttattggtgtataagaatgcttgtgatttttgtacattgattttgtatcctgagactttgctgaagttgcttatcagcttaaggagattttggactgagacgatggggttttctagatatacaatcatgtcatctgcaaacagggacaatttgacttcctcttttcctaactgaataccctttatttccttctcctgcctaattgccctggccagaacttccaacactatgttgaataggagtggtgagagagggcatccctgtcttgtgccagttttcaaagggaatgcttccagtttttgcccattcagtatgatattggctgtgggtttgtcatagatagctcttattattttgagatacgtcccatcaatacctaatttattgagagttttcagcatgaagggttgttgaattttgtcaaaggccttttctgcatctattgagataatcatgtggtttttgtctttggttctgtttatatgctggattacatttattgatttgcgtatattgaaccagccttgcatcccagggatgaagcccacttgatcatggtggataagctttttgatgtgctgctggattcggtttgccagtattttattgaggatttttgcatcaatgttcatcaaggatattggtctaaaattctcttttttggttgtgtctctgccagcctttggtatcaggatgatgctagcctcataaaatcagttagggaggattccctctttttctattgattggaatagtttcagaaggaatggtagcagctcctccttgtacctctggtagaattcggctgtgaatccatctggtcctggactctttttggttggtaagctattgattattgccacaatttcagctcctgttattggtctattcagagattcaacttcttcctggtttagtcttgggagagtgtatgtgttgaggaatttatccatttcttctagattttctagtttatttgcatagaggtgtttgtagtattctctgctggtagtttgtatttctgtgggatcattggtgatatcccctttatcattttttattgcgtctatttgattcttctctctttttttctttattagtcttgctagcagtctatcaattttatggatcctttaaaaaaaccagctactggattcattaattttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcattaaagtgctataaatttccctctacacactgctttgaatgggtcccagagattctggtatgttgtgtctttgttctcgttggtttcaaagaacatctttatttctgccttcattttgttatttacccagtagtcattcaggagcaggttgttcagtttctatgtagttgagcggttttgagtgagattcttaatcctgagttctagtttgattgcactgtggtctgagagatagtttgttataatttctgttcatttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcattgatctgtctgatgttgacagtggggtgttaaaatctcccattattaatgtgtgggagtctaagtctctttgtaggtcactcaggacttgctttatgaatctgggtgctcctgtattgggtgcatatatatttaggatagttaactcttcttgttgaattgatccctttaccattatgtaatggccttctttgtcttttttgatctttgttggtttaaagtctgttttatcagagactaggattgcaacccctgcctttttttgttttctatttgcttggtaggtcttcctccatccttttattttgagcctatgtgtgtctctgcacgtgagatgggtttcctgaatacagcacactgatgggtcttgactctttatccaatttgccagtctgtgtcttttaattggagcatttagtccatttacatttaaagttaatattgttatgtgtgaatttgagcctgtcattatgatgttagctggttattttgctcgttagttgatgcagtttcttcctagtctcaatggtctttacattttggcatgattttgcagtggctggtaccggttgttcctttccatgtttagtgcttccttcaggagctcttttagggcaggcctggtggtgacaaaatctctcagcatttgcttgtctgtaaagtattttatttctccttcacttatgaagcttagtttggctggatatgaaattctgggttgaaaattcttttctttaagaatgttgaatattggcccccactcccttctggcttgtagagtttctgctgagagatcaggtgttagtctgatgggcttccctttgtgggtaacccgacctttctctctggctgcccttaacattttttccttcatttcaactttggtgaatctgacaattatgtgtcttggactttctcttcttgaggagtatctttgtggcattctctgtatttcctgaatctgagtgttggcctgccttgctagactggggaagttctcctggataatatcctgcagagtgttttccaacttggttccattctccccatcactttcaggtacaccaatcagatgtagatttggtctttccacatagtcccatatttcttggaggctttgctcatttctttttattcttttttctctaaacttccttctcgcttcatttcattcacttcatcttccatcgctgataccctttcttccagttgatcgcattggctcctgaggcttctgcattcttcacgtagttcttgagccttggttttcagctccatcagctcctttaagcacttctctgtattggttattctagttatacattcttctaaatttttttcaaagttttcaacttctttgcctttggtttgaatttcctcccatagctcggagtaatttgatcatctgaagccttcctctctcagctcgtcaaggtcattccctgtccagctttgttccattgctggtgaggaactgcgttcctttggaggaggagaggcgctctgctttttagagtttccagtttttctgctctgttttttccccatctttgtggttttatctacttttggtctttgatgatggtgatgtacagatgggtttttggtgtggatgtcctttctgtttgttagttttccttctaacagacaggaccctcagctgcaggtctgttggaatacctggccgtgtgaggtgtcagtctgcccctgctggggggtgcctcccagttaggctgctcaggggtaggggtcagggacccacttgaggaggcagtctgcccgttctcagatctccagctgcgtgctgggagaaccactgctctcttcaaagctgtctgacagggacatttaagtctgcagaggttactgctgtctttttgtttgtctgtgccctgcccccagaggtggagcctgcagaggcaggcaggcctccttgagctgtggtgggctccacccagttcgagcttcctggctgctttgtttacctaagcaagtctgggcaatggcgggggcccctcccccagcctcgctgccgccttgcagtttgatctcagactgctgtgctagcaatcagcgagactctgtgggcgtaggaccctccgagccaggtgcgggatataatctcctggtgtgccgttttttaagcccgtgggaaaagcgcagtacttgggggggagtgacccgattttccaggtgccgtctgtcacccctttctttgactaggaaagggaactccctgaccccttgcacttcccgagtgaggcaatgccttgccctccttcggctcacgcacggtgcgcgcacccactgacctgcgcccactgtctggcactccctagtgagatgaacccggtacctcagatggaaatgcagaaatcacccatcttatgcgtcgctcacactgggagctgtagactggagctgttcctattcggctgtctctctctttttaaagcacgtaacttgttggtgttcctcactagttgccagaggatgaactaactggccacacccagtttcagccatcatgaagtgtttggttcctgctgagtgctcagctcaggggctcaacaccaccatcatcacccagagcgccccccatatgctgccctgcaccgcttcagtggcctccccagccgtgaatgcactggcactgcaggcggtgaggttgcaactgcctgtgtgccagtgttgattagcagtatgttccacattctgcgatcagcagcaagtgctcacttctaggcttatgcaatcccatggaacagggtcaatccaggggtgtggagggcatttgaaatcttttgccatggtatgcacagtgctgttggctgtgatcatggtatttgtcctcaaatacatatatatatgtatttagagacaaggtcttcatgtggtaggaggggcatttgacacttctctgtcacccaggctggagtgccatggtgtgatcatagcttgctgcagccttgaattcttgggctcaagcgatcctcccacctcagtctcccaaatagctgagactatcggtgtgcaccatcacactgggctaatttgccttttttttttttaagagatgatggggtctcactgtgttgtccagattggtctcaaactcctaggctcaagtgatcctcctagctcagcctcccaaagtcatgggattacaggtgtgagccaccatacctggcccagtgagggatctttatatgaccttcctggttggctggtatgaggctgcaaggtgaccatgtgaagtgcagaatgcagtcggacatggagtagggctgttcacctgtgcttccaccacttcacaatctaatctcaggttgccccgtccttaccgtgacttgacctgactcataggctccttagagtctgagcaccactcactagttctcatgccatttctaaggatgcacctctaatagttattctgctctttcttttctttgatctctgtcaggcaaagtcctcaaagcctggtccaaaagtcctgtgccctggggcccccctgggcgagcataccctaggcgtcaggcctggaggtctcctcggtgcctcccagctcttctgtgctcctcacactctgctctgtgcacattggctgtatttgtaggttactgccttttatttctcacatttctttctttttggtgagagtatatcaatcaatcaatcatcctcagacctctatgataacactgtgccccacacacaagaagctactcaattaatgtttgtttgttgaaatgagagaaaatatttgtccttagtacagaaagaagatgaagccaacctctgatagaagcccacccatagactagggtgttgagctgccttccaactaaatgtggaagttaaatcctgaaatgagaggccagttgaagatagataggcatggatcttgggaaggcgtgctcacatattcatgttgtccccattttcttgtggataaagaactctcctcagcatttcatgtgggcattgaagtcctgagctctctatccctggctactcactcagcctatttatttctgtgtagatgaaacaagctcaatagggcatcatttctttgtttctttctcttatcaaatggctgacaacagccttgaaagttaaagtaaaatacgtttatacatttacatttcatctagtaattttagttgctattagttcttcctttacttccaggtaaaagtagagtttactctcacagaatgcttatttcaataatcatttataatatcagtaccattggtctttgatgttatgattcccttatgtaaacatatgatttttcaacattagtcaaacagctgctatgggtgatgacacacatattcaggactccacagtcctgaaacaactttctattctgatatttggacttttcctaaagtcgcttagaaaaactagattttcccaatggtcattttgagcaggttatggaaagcagaagatgtaaacagatgaaatggctgtagcagagtgatattactttgtacatttattttaaataaatattatttgtgtatacagaagtgctgtgcaccacaacttaagaggttataagatctagcaaatataaaacttaattataattgcttttattacctataaatctattattaaagtaaagtagatgagaacgggcgtggtggctcacgcctataatcccagcactttgggaggctgaggtgggtggatgacctgagctcaggagttcgagaccagcctagccaacgtggtgaaaccctgtctctactaacaatacaaaaatcagctgggtgtggtggcatatgcctgtgatcccagctactcaggaggctgaggcaggagaattgtttgaacccaggaggcggaggttgcagtgagctgaagtcgtgccactgcactccagcctgggccacagagcaagactccttctcaaaaaaaaaaaaaaaaaaagaaaaagatgactgactaataaatactgccccctaaaactgcaccttttttcagggttcagagctttcaagtaaagcaatgtgataaaccaacttggggatacatgctaccttcttttctctgggagctaatttttgtttatatttagttttcatttatttatataggatctgagttttatttttgtgtttattttgattgatgatagaaagaaaatctgaaacctcaattgatgacagaccccccccacggattgaagtagcaaagttgactcaaaagccctgttatccttatggcatcagtggcaccagtaaaaatggtgaacatagattaagcatgtgctctgggccaagttctgtttagaacacttacttactaacaaacattctcccatttaattcccacactggcccaagataatattctataccaatttacaatggggaaactgaggcaagaaaggattaagtaattggccctatctatctccatggaacagcctacttgggaatttcccatgatggatgtctgcctgtaactgaaacaaaatagaagatgtgaaaaaactgtaaatttatcatctgtcctctgcaccatgttttcttttcttttggagataatgagtagcttcctggttactctctctgcacttgtctatgaaaccaacaaacaaaatcttttatcatcttttacattttgacattcatttgtgtcaatacagttagttagtcttccagacattttccttcttaaacttcatctctgtgaaattaattaaagcctttgtctctagttaaggaatccctggctaaatcacccagagacaactggctggcccttgaaataatcagagtacatgtcacgcacagcctggtctctggggtgggcaacaggtcctctgtctgacaggacaggccaagggctgtgtagctttataaatgacgactggtgagtgcgtccggtggtgggtggctggagggaggggcagcacatttctggcaagccagctcattcctgggagataggacattggaacgggaaccccagcctcattgccatcttgccctgtgaccctaggaaggagccctgttcagaagaaagaaaccacaaatggagccttttctctacttgtttatggtttgtcaatcatcttgtaccctttcttgaaggttttgttgaggatctgggtcccataactctacagagtccattgttcttcagcgcagaggcttcctctccaacatcagtacacccatccacactccctcctctgcgcacccagcacccgcattcaaatgctaaccacaacagtgggattcagtgacccagaaggaaaagccgcagagtgccccttaatcccccaaagtcatcttgactcccctcacttcttccccgccctcagttaaatatgcttgtctgtcacacaagggcagatgcctctgacatgactgaaggctggtctctttgagcagactgacaccgtgttgcaaaagaagtaatctttcctctgtgttgccataagaaagcaaaagcccttaaattgtgatcacactatgcaaaactgtcctttttctgaagggaggtggcagccctggcgcgggagagcacagagcagctctctttcatttgtggctgcatctgatccacctttttaacacgcagccaatgttcatgtggaacagaaagcaagcatcaaaggaccagaccccctcacccccctccaaaattccgcagcctttgttgtcactggagctgggtggttattgaactttgcagacctgctgggcctggaaagtgaaaacaccctcccgagccagcaggggtggtgctgtgtgcctgggagatagggctgcgcatccgaaggcctggcggttgccatggcaccctgacaccgagatcattccttatgaatgtcaccgggggctgtgactaaagttgtttatgagtcaaaagtctcatgaaactacaggaggaaatgatgaccgcacctcggcaggctgtgggaaagaaagaaggatggagtgtagcggaagctgatgtgcttttctccccactcggtttgctaaggaagatggtctttaaatatgacatgtgaagcaagacaagctgaacatgctgacattgcattcgtcactgtgcatgacacaacgagggagaggtagtattttaaatcatatactggcccgctgtcattttcacatatgacaatcttgtgctttgtggcttagcacgcagcacagggcttagctccatgaggccccaaagaggctgccttctgcccttttggcttcttctcttccctttgttcctctggtgtgaagggttatcaattttcaaggctttggatccaaggtaacagataaggaaggtcatgggcacttcctctttccttaaggagaagttttagatagcagtgatcactattatttctgtaatatggacacagggaaatagccaactgaagtgtgtgaagatcacagcaaaggaaggcaaagctgatggccacaggggggaaatacggagattctacttctatttgtggcatatttcccccatcccggaggaaagtgtatctctctttatatttagagaatgatagagagaaaggagatcaagagatttctcctttcttcctttgaatggagaagaagaaaaagggagcagagaagcccctctcctttcttccactccacccagcagcaggtgattaggggaaagggaggagagttgctgagaaagaagcagaaagggaggagagacagatggaggatgggggaacatggcacgctaagggatgcatggggagaagttactccatgtgcacgctccttaaattaaacctttacttgaaattcagatctgtttttacaagttagaacataattcttaaaattcatgtcataaaaattaagacttgtttttcaaaaaggatcccttaatatatatatatttttttctgcagctagcttccattgctcattacaaatattattctattaacaaataggatctatagaaagcttttgaggacttcccatatggactatgttgagatacccttttagcccacacactctgtcttcctgagtgtcgcactctcccctgatttcagacagacaggagccacttacctctgacacggtgcagttgagctggaagatctgcccttctccttccacctgccgcacacagagtttgcaaaccagctccactgtgttcaggctaaatctttccagagtgaaggtgcagtgcaggtttctttgagatccactccaaacatggtaaaatggaatttcctaaaggatatgaaagtgttaaccacaattgaaggactaataccaaaaataactctcagatggtctgctgccaggtactctgagtatcacacctgtggcctcatttaatcctcacaacagccctatgtttaagtacatcctggacccttatcacatgaaaaacttgagggccagagaggttcaataacttaccccaaatcacacagcaagtaagtagcagggctgagatttgaacctaaggagtcagcctccagaatccatgtacctaaccagtctgccacatgtctctaatttacaacaacaggaaccattgtaaatgattaaaaaaaaaaaagagtttatacaattcccaaaataaaacttgcacacaccagccattgctcattaatagaatccctgtcgtgacattctggagaaaagcaaagaaagtctaaaggatactgcactgatgtggctccctttcatgctttacatcctcctctgcccaggacaggggaagccaaaacccactacagttggaaacttcagactcaattagctgccacagaaaagttcttggcaccaagcatcgaacaggctttaattttctaaaagtctagaccaccttacagagcctatcctagaatctgttttcaataaaggaaagaaaaggttgccacataaaaaatgggagagcatggctgtaaaaagcagtggcttcggagccaaatccagtacaaataagaaccccttatttcgcttacttgataacctggggcaaattacttaatctttccattgctcagttttcctatctgcaaaagagtaaacaaagagcttctcattcgtaggtctgctggggttaaatgagctaaaccaatgtatgaagagagtgtccagcagatggtaagcattcggccaggcttagctttaactaatatcatattatcattatcattaaaatagtattttcttataattgtataaaagaaattactcctaaaacagggagatttatagtattttatgacaactgcaacacagaggaaagaagaaagcaaagaaagaggtatactgagtaagtcagaagccttctgtctccatcaaggactgagctgtgcatagagagtctggcatgcaacctccgtcaaagctcatgattgttaacaaaccagtaggcttgtttcccataatttatgtgtaggaactagaccaatgagagtgagaatggagccagaatgtcttcccatcagtcttccagtatgttcattggcttacatcaggaaatagctaccagttcagaggcaatgctggggtttgggttgaatttgcataaatatcaacatggattcacagctctctaaatatgtctgcccctcctaggatggcatatgaggcttgcaatcccgccaaagtggttttctcaagagctcaggctgacggatgaaggaggggaaaattccttgagggtcatgtgattttcccccaggtatatacaaatgacacttgggaccagtattttcttgtctcttgtttaataatatcctgattgggttttacttttacatgctatttcagttctccaaagtagggctccctctaatttttcaatgtaagggtactggcctaggaaggctgaagcctaatttgtgtcccatggaataaaaatgtccttctgtttgtttctgtgaatgcatttcaagctgtttttacccattgatgtgaacatttagtatgaaaattaattgaaatgatggatttggaagcctttcatttattaaaaataaaacaatgatagtacatttatttaaaggaagaatttttaaaaagcattccctcaaatatgtctgtgtttctcaaaaatcctaaataaccccaaactattttggagaaacaagtaatgacatatgattaatttcaaggaaggggatttcctatgtctatataattttagacctctttcttagagatgtctccagaccttttgttcggcttgggaaccttacctgatatttagccagcaatttgctcttccagagggaatgggcgatatcgtgaattgacaggcgcaggttgtgggtgctgcctttaaaatgaagagccttaggttcttctaggagctgtcctcccatctgtctctcaagatgtaaaatttcctataatgacatgccccaaacccaaagcacgttattgatttggatcacttctgtcagctctctcattgaataagtttctttactgcctcctgaatggcaggcggaacttgtgcaacaccttgaacacccacttttgcagcctcgagaccctctaactaaactaactaaagcccctcccattttgtatgggaccagaccctaataacaaactatgttttggcagtctacatcacactgttgaggagcaatttcatacagtttgccctttaccgactgatgagtggagtatttatcaaatatgggggaataacatcagaactcaaaaccagagagccataaattaaagaaaaaataggtagaaatgtagacaaactgattgataagaaagtagattttcaattaacttttacaaaaagggacaaataactagaagagatactcattccttggacttgataaaaccaaacaacaaataaaaaattagaacctgttttagacatttagttcaatctcttatagttacttcaagtacagaaataaaaatataaaaagtttgcttaaaatgatttatgcataattcccaattattaaaaaaattagaatatgctaattatatattctattaaaggaaaatattccgatacagattaggaaggtttttaaacaccaaatattgaactaaacagttactccaattacattttcaaaagaatatttttgtttctcgagaattgtggctgatgaaaaaatttgctacataattttcttatactatacagatacaacataaagacagattctatatatacttccatttctcaggctagttaatgggagttaatgaagcatttccaactgcagctgtaattatccaaacagcagcaaaccattagttatcaatgaacaaactatcttgggtctcctctgctgtctgaaccatccctatgcacgttactcctctcatgccttaaaagttttaatggtacaaatacacaggaaatttgtgacccattttaaaataagggtccaggaatatatggattttagaaaaaaagcaaaatataattttttctttggtgctatttcaataaaaagcagggaattcaagaacacaggtgttcattcagactgtaacatgcatggattgggtacccaccagggtaccaagcacaggtgggtcgcagtggaggatttcaggcatgggaaccagattgcctcatattcagaaaaatgcatccaccttgcatttgttgaacgaattctaacccatgcacttgtagagcagtaagtgtggtggctaccacgatcattgattacatgcaaacagctcatttcaagatgctgcgttagtggttcttaatatctgtcatcttttggtgaggcaactattctgaaccatgcaagctgctcgaaggtcctataaggtgtaaaaaaatattaggataatgtggaatgtggtttcagacagggcgtcctctagttagtatctaatggaagagatgaggcaatagcacactgacgtagacaagtgtgtggtccagctgcctgagagtattgacctgctacttaatgttgctggctgatgagtagctatggcttgtgacaggagcccgagcagtcagccagcccccagccacagtcagccagacaccttgacacatatgttgtgtcattgtccccctagtctgctgtgcctgagctcagcaggctccgagggtctcccgtaggccatacagacccatccagccttgagtcacacacgctcctcacagaacgtggcacaccccactccatgacaccccactccacgacaagaatagagccatgtggaagtggagaagaagaagaaaagtgagggttaattgcagtttcttctgcttcagcaggaaggcataatgagcttatgttgatcatgtttggtgtctagttagcataatagagaaagctgatgttcccagtgaacctggcacctgacaaattctaaagctaaaatgatgtttgtttataagccattagaagaaaagaaacataattagaaatctttgagattacagtcatgccaatcaatcagttccagcttctttctttccatatgccctaattacctcatcaagacgtctaaagagcaatcgatagtaattatctgattactatagatcttcattatgtcgaaattatctccctgggatgtctaaaagaagatgcattgtattccaggaggtaattgtacccaacaatgtataatccacaccccattcctacaatcaacatagactgccagaggatatgaagagcattatcagttttcttggcaggcaggacattgaaaaaaacccaaactgcctattggccatgaccttgaagtcaggaaatctaacacggcattttgagtgcagagtcttcatgggagtcagcccaagaatcaggctcagttttttgtttcttcagcaatgatttgaaaagtcatggtgaagaattctccctagtggggaaaaagcctagactggcttggaggagcccttttttggatagaaagtaccaagtgccattttaaagacagtggggccacagaacacactccttccatagacttaagctcgccatttctccatcacccaggagtgacacaaagctgcagcacagggctggaaggaacctgacttttttctcccttccaatgggacataaaccctggggaaagacaaactgcccatcaggacacacccatgcttagagcagaggctataaacatgtttgccagaatagtctaccagtcaaaacattgagcatgcatatttataaattacatatctctattatcagtatgttaatatattgcattataaaatatacataaaatttaaaaatacataagatcctgtattaatctgtcttagcataaagctaagtactaatactgtattttttttggtcccagtggttcactgggcctggggtgtgtaaactccatattggagactgctggctcagacagcttgtcctttcactagtacctggggaagaattcagcccagcagtgaaggattcagtaaccttaccacacttaacaccccttcccgcaaagtggcaactggtatcgttgcactaaagacgttcatgacataggaaagcataacagaaaaaaggagaggacaaaaaccatggtgtgagttaaagagatctcagtcgatcatccagcaactcctgggaaacgagtataatctaaaaccacacaggaacaggagctgactcgtcacatacggcgaatctcaaatagagttttgtgtcagatgatagaagaagcaagcctgcccgaaaggctaatcaggctttgtcttgtgttaccattttaagtgttacaatttgagatttactccagcagattccacttaaaaatatgctgcaacttgtatttcacactgcttgattttctgaattcttcgcacatgatctcattttggttatttatatgatacagatatgtaagaggacagaaaaataacaaatatacaactcaataagacatggctttacagttcaatgttttcctctgcttcctctccctgggaacattcattcaacatcagtgagacacgttaggctgccaggaaccatgtcaggtctggagcacacagacaagtaagtccctgtcactgctttaaactgctaatgggctaatggttcatgggggttggggggtgacctgtaaacatgtaaccacaacacagtgtgctcaggtctaaaaccacttccagacaggctgctcttgaatcacaaaggttaggatatttcacacaccttaaaatagaatatgaacaaaatatatttaatgtcagaagatttaggaagacttaagagaaatatcgtgaccctggaaagaaatgctatagtaaggatgcggatcatctggcctctttgttctcagaaacctgaacgtcaagttcctttgcagaagttgtccttcctactgggagttcccccacctcagtggcctagtttggctctaggtgaatccacctgttgctttgatgagcttgttttgcttctgtgagaagggagacagtttctgacttcctttcacagttcttttattcaaaatatttttagacaccttctttcttgctctgtagcacaggctggagtgcagtggcgtgatcatagctcactgcagcctcgacctctgtgctcaggcagtcctcccacctcagcctcccaagtagctgggactacaggctcatgccactgcacctggctacttttaaagcaatggcaacagaagccaaaattgacaatgggatctaattaaactaaagagcttctgcacagcaaaagaaactaccatctgagtgaacaggcaacctacagaatgggagaaaatttttgcaatctactcatctgacaaagggctaatatccagaatctacaatgaactcaaacaaatttacgagaaagaaacaaacaaccccatcaaaaagtgggcgaaggatatgaacagacacttctcaaaagaagacatttatgcagtcaacagacacatgaaaaaatgctcaccatcactggccatcagagaaatgcaaatcaaaaccacaatgagatatcatctcacaccagttagaatggtgatctttaaaaagtcaggaaacaacaggtgctggagaggatgtggagaaataggaacacttttacactgttggtggaactgtaaactagttcagccattgtggaagtcagtgtggcgattcctcagggatctagaactagaaataccatttgacccagccatcccattactgggtatatacccaaaggactataaatcatgctgctataaagacacatgcacatgtatgtttattgcggcactattcacaatagcaaagacttggaaccaacccaaatgcccatcaatgatagactgaataaagaaaatgtggcacatatacacacgaaatactatgcagccataaaaaatgatgagttcatgtcctttgtagggacatggatgaagctggaaaccatcattctcagtaaactatcacaagaacaaaaaaccaaacaccacatgttctcactcataggtgggaattgaacaatgagaacacagggacacaggaaggggaacatcacacaccggggactgttgtggggtggggggaggcgggagggatagcattaggagatatacctaatgtaaatgaggagttaatgggtgcagcacaccaacatggcacatgtatacatatgtaacaaacctgcacattgtgcacatgtacccgagaacttaaagtagaataaaaaaattttttttttgtcgggacaaagtcttgccttgttgctccttgaactcttgcactcaagtaaacttcccacttcagcttcccaaagtgctgggattacaggcatgagccactgcgcccagccccccttgtacagttctatctgcacccctctaacttttccttgcaaagacaccctcaagagtaggtcatcaataaatgtgtctgtagcccatgcacatctacacacgcgaaccatcagtcaccagaagcaggccacctgcctcagagcccagcgtccgccagggatctgagcaatcctgtgggagggcctctttccccactgcgggcgctgcctccaaagcagactggccggcccagagtgagggctatattgattcagggagcctgtgagggattgctccaaaggcaggacaagagattccacagtagaaacaagcagctttcacaataaccaattaaaccaagacattatccatgccaagccattagcctgggccacttaagagccacaataaatccaggctgttttaaaggcttgtgtgcacaaaggaggcacctctggcctctacccagaatgctcccaggctcttagatgagaggatctcccctcgttaaggcttgacagagaggcaggagggaggatacatctgcgagccaagccactcctccactctggtctgtccagcccccgagtttcccactctgcattatgtccgggttagatttcatctgcctcatctgcttctcttgttgtctctctgcctgttccttccatgcttgggcaaatttccattaagtatcaggcttacagctattgctcactgggagcccccaggcaacagagtggcatatacttggatgctttgaagtatatctattagagtatgacaagtctgcccccagggtccaggctgaagctgggttacagagccctgcacagtggtgattttgtgccaaaaattgtgaggtgctagggtcccacagcggatctggtgggctagtgctccggaccctggctttgttgcctacaccctctgctcaccctccccaccaaccccactttgtgctcaccctcctcctctattcacctttctcccctgctctccctccttccctgctcgcactcctctcctgctcccatgctcacctgctcctctgttcgccgcctcctctgttcactctcctccccaatcacctcctcccctgcttaccctccttccctgctcacctcctccctttctcacatcctcctctgcttaccctcctcccctgctcacctcttctgcccaccttcctcccttctcaccttctcccctgctcacctcttctgctcacctttctcctctgctcagcctcctcccatgctcacctcctccccactcaccctcctccctttctcccctcctctgttcacccttccccctgcccacctcctcccctgctcacctcttctgctcaccttcctcccctgctcacctcctcccctcccccctgctaatcctcctctcctgctcacctcttctgttcaccttcctcctctgctcacttcctctgctcaccctcttcccctgctcacctcctcctttgctcaccttcctcccctgctcacttcctcccctcctcccctgctcatcctcctcccatgctcacctcttctgctcaccttcttcccctgctcacctcctccctttctcatatcctcctctactcacctcttttgctcgccctcctctgctcaccctcctcccctgttcaccctcctttcctgctcacctcttctgcccacctcttctcacctcctccccttctcacctcctcccctgctcacctcctcccctgctcaccttctcccctgctcactcctcccttgctcatcctcctctcctgctcacctcttctgcccacctcctccccccttctcacctcctcccctgttcacctcctccccttctcatctccttccctgttcacctcctccccttctcacctcttccccttctcacctctcctcccctgctcacctcctcccctgctcatcttcctctcctggtcgcctcttctgcttacctcttcccctgctcacctcctcaccttctcacctccttccctgctcaccttctcccctgctcaccctcctctcctgctcacctcttctgctcacctcttcccctgctcacctcctctgttcaccctcctcccctgctcacttcctcccctgctcaccctacttctctgctcacctcttcctctgctcacccttgccctgcataacaacttgcccctctctcactccagtgccccaaaattgcaccaccttcttcctcaaggcatgtgttatgccttccagtttttcaaggggcagttatgctatttgtggattatatgatccatagcttctttctctccctctctgcctctctcttgttctctctccaactacttttctgtctttcttttctttccctttttagaaaccatacaggctaaagaaaggatgaaagaaatgattaaagttaagtctcatataacccactgaaatctctcttgaagggaaggctggaaggcgatgaaatccaggatgtgtttcactctgctagcttctttctttatattgtttctggatgttatttctccaggcagtcttcatgtttgagagaaacacagaaccatgcattggctggatttactgctgccacgaggccaggcatcagcagcagaagcatgagcaggtggaggtagctactgagggaaagtcgctgagatcgctacatggagaggacagcacagaaggcaggaagcgaagcagtggccagcctggcactctggctgttttttgctttggttcggctttctggctcctggagatagaaccgctctccgtgctggagccggcacaggaggctgagttgtactgcagcggtgccccaccttcaccttgattctgggacacagacacaaagaacagaccagcaaatgtgcagcatgccactcatatgaaacttcaaaaggccagccctcaatgactgtgctggctggtgtttaaaaaaaatcacatctgccatcagatttcatggaacctgcctttcttctgttcattatcatgtgtcgaaaacctgcccttgtcatttggggctgagaaatctgtgcctttgcgatggtggctgtcactgctgtctctgtcacagctgtgggggcctgcactccaccgaagcagaggccaaaaagagcggccgcccttctctcctgttctctgccagcttttcggcgacgctgctgtcagccccccatgctctgtcccctcctctccggcttgcaggcctcagactgctgagccaggcagtggagaacatctgactgtcagcccggcctctcccacctgctcgggtcgccatccctggcgcccggcctggctttgctcctttcccttcctgtgttcacgccagggtgctctgctctccccctgagtttgtctgccttacttcttccctaataataacaaggctggactctggtgcccatctgcaaacatctccccgtcaagttgcttcgtttctagggctctgcctgctgttcccacagctgctgtggccacggatgcttggtctgagctgccacttccagcctgcacagtcagggcagtttgtgacacttttaaagccaaatgccaacgggtggtgctcaggcaagcagcgtgtcacttgtctacctctgggcgtgctcttaggacaacagttctctctcacatctatgtattaggaacaggactttgtaggtttttctaggacttttgaagtcatcttgtgtttcttttctcctgttaacacattatttttaaacttctatattagttttctactgttgccataagaaatcaccactaacatagtgacttaaaaaataacacaaactgattatctcacagttctggagggtgggagtaacacagttctcgttgagttaaaatcaaggtgtgtcagtggggctgccctcctctccagagccccgagaggagaatctgtactgggtcttctccaccttccagaggtttctcacattctttggctcacggtccccttccgctgtcttcaaatccaacaatgacagatttctctgagcctttttctgcagtcatatccctttctgaccatagctggaaaaagttctccaccttcaaaaccatgtaattagactggactcacccagatggtcccggataatctcctgaaatcacacaatcatatctgcaaagactgttttgccatgtagggtaaaatactcacaggttttgaatattaacctgtaaacatccttgggtgggggcaggggtgttattctgcataccacaacttctgttttctttctgttttctctctctttcaaaaagtaagttcaacatggcaagtcatttctaagataggtgatagacccagggccagatttcatcagaagatgataaaaatggggtaaatttagaggcaccaaaaatatccctgtgactaaatgtctaatcaaccagaccgctaccaaacctgaaactcaccccacagttagattccagttagatttaatatcttccttaagccattatcttcaaaatgccactgaagtctaaatgcccacatacgcatggcaaacagtgtctggtgtctattttgtgccaggagatttaataactttgatgtccttagaacttcaaagagtccttgatgcagaccaaattactgtcctaagaggtcaaattcagtgaccagggccaccaggctgataagtggcacagccagtcacggcagccagcctgactcgagctttgctgctgtaccacgctccctcccatacacacagcagcaatgatgcactaggaacctttaacacacgttttgttgttggtctctaattcacatgttgcacatgtgaatatattagtttaactccagaggccaggatcctgaaagtatacaggtaaggctatttttgaggttgtttgtgggaactataagagtaggtatggatactaggataattccagggaagatcagccttagaagacctagaagaagcaagcgtgaggagttcagagttcggtaaggtcacagcttgccgaggaaatgccaggaggacatcagtgaggaatgtgacaggtagcaggataaaaatataactaccttctccctgtaacaagccacgtctgactgtccatgactgtggcccaagaacgtgagcatcacacaattctcaactagacttccgccaacctcctttctctctcttcaccttccagtgtttctttcattcttctcttctcttttcacataatacaagctttcacagagttactctattacagttgggattagggcacatgaaatttatccaaggaaggtcttctccatgcccaatgagtccatcaaaaaaaaaaaagccaggttatgttaatacacattatttgatttatatcacaaatacatttgtcagaaattcaataaatatcatacactgcccataatgtatgaaaataactccttttttaggttctgaatctcagagtttagtataaaaccctttattccaaaaagagactgtcaggtattgtaccctttggatactgggacagaaatgacttatttccacatagacgtatgtttctcctaggtgtttttaaacttactccaaatataaccttgctcttggttaatttctggtctatttatactaggatttaagtcattgcaaataatgaaaggaaaacacctttttcattaatcacctgaagacgggggaaaaagaaaagctctgatataccaaactcaaccttttcaatagacttgacctctctatttgaattgattccaaactattctcacaattcttagcatctttatccttttatgtgaacacaactagagcattgctcccagtggtccttcaagcacatgcacaggaaaaagccctcctgaaaggtataaaataattccactgttgcccatcagccttgacttttgctctggtagtcactgccaacatgctaattctgtatcagtgctttcaaattgctaaacacagcttttaagtttcaggtgaccatttttgccccaaggcttaacaaaaccctggaaaattgttacaaaagctgccaagctcaaagaggtgagtagggagaagaaaaaatgcatcacagttgcttaagactgagtgtgttatccatccatatggataatataaataaatgtacaaatatatattatatttatgtaatatataatatatatattatatttatgtaatatataatatatatattatatttatgtaatatataatatatatttatatattatatttatgtaatatataatatatatttatatattatatttatgtaatatataatatatatttatatattatatttatgtaatatataatatatatttatatattatatttatgtaatatataatatatatttatatattatatttatgtaatatataatatatatttatatattatatttatgtaatatataatatatatttatatattatatttatgtaatatataatatatatttttatattatatttatgtaatatataatatttatatattatatatgtaattatatatctataggatatatacttatataaataaatgtattatctatccacatggataatataaccacatataataataataaaaagtgataattcacattcttgaaatacacagctccagacattggggcagtctttttgcaatagctctcctggactcattccctgagaataagtactccactgggcttctatctctgccctagtccagcatttctgtggatttttctgcaatttgtaaagaatccccagcacatagcagttactatacgaaaatatcaaatgctggtaaatgcagcctcaggcatcatttgctatgctgaagatggaggtggtcaggaattggattaaagcacaaacaaggaagcagagatccttttcatcagagtcagatgaagtgagaagaggctgaagtaaaaggtttggagggtagaggaccgcagctgggggagctttcattgagtggttaggtcactgctaggcaagatgcgggctttaaaacagccagggacttcctgagagcagaagatacatggaagaactgccgtgggaatcgggtaagtcaagaagagctaaataaaaggattacggagaagcagggaaggcatcccttagaacaggtatcttgagagtataatagacccaatcagaaatgtatgatttttcatagcaactcatcaacctggaagtagaagtagtgggcttattcagtggagggtatccttggttataaattagaaaaggctgcagcagctcataatgacgagagagttcagtgtggaagcgagtttgctgcccatacgggtaagaccaggggagggtttttggactgggaaactgcagcaggttgagggagcctctccctttttttttttttttttttttttaagagatggggtctcgctctgccacccaggctggagtgccgtggtgcgatctctgctcactgcagcctccgcctcccaggttcaagcaactctcccacctcagcctcctcagtagctgggatttacaggggcacaccaccacgcccagctaatttttacattttcagtagagacggggtttcaccatgttggccaggctggtcttgaactcctgacctcaggtgatccacccgccttggcctcccaaagtgctgggattacaggcgtgagtcaccgtgcccagtgagggagcctctccttaagaacaaagggtagcttccacgcatcttgtgggagagagagatggaaggtcagatggttgtagtcagaaagggggagtctgacaggtggagatcttggcagtggagcaattgctaatgaagatgaaatccagagcacatctatgccagtgaatagataatgtaagatgatgtgaatgctactagaataagtttgggcagagagactgtgatttaagtcatgacactgaatttgagggaatgatgggaataaaatggatggaaagacagaccacaaggcaagtactggtagggcaggatccacagagctctgtgcaaaggaactgaagtgggcatgagtagaagtagaaccatccagcctgggcagtgaagagatgccccagaaagggtcatggggtatgagaagtactggcacatttcctcttggccttggggtttgttaggggtacagtcttcgctggaggcattgtgaggtgttaccaggaagatccactggcagttaatgagagcaggtggagcaatgggaaagggaatgacgtgaggttgtaggaaagtttgttcttagtagaattaaagttccaaaaagatttgggaaagtgtttaggataatagctcttaactttggtggcacaatagaataacccagggagtattaagaaaataaaatgccccaatacctagaccaattagatcagaacctgtgggagtgaggccctggagtgggtttttataaaagcttccacctgcttcctctgtgcgctgagaattcctgattttggaagagcatgagcgtgagtcaggatgggggcaggcctgaaggagaaggaggccttcaggaggtgtgttgcaagaggaagtatttctgggcaacagtggttagagaagtagcgagatgggagagagtatgttgggaacattagcagggcgccaagaaggcagagttttagtaataaagggctttttgagctaatcagccccaaatttccaattcaagcgtgggtgtgaggaagagatggcgtgactgaaataattgtctcttcggtatgttggagaggccatttgcctataactaggattttggtatttctgcattattaaaaggccatgaggtgcaagaaagcctcatccattattcatgtttgtttcaggctaagtgctagatccccagatgctgagaatttataaatgtctatttagaaagcattgaccatgatacaaactgctcttgagttgtttttgctgcttaaacctgttcatcactctttctcactattgaccatttgcgtcttgggttcactaattataataatcagaattatttttataaaatattctatttttgcatgtatttgtgtgtgtttattgggaaaacaaggtggctgaggagagaactatgtgtgtgaatataaaatatgtaaatcaaacacttcaaatatgatgtaggtcttctatggtacgcttttgcaacgattttcttggaactgttgaaaagatttgccttaatcagaccccatggctcccctacagataccattttccctaattcaaacccagcatgattcctatcctgacagtgctttggatgtatcacatttgcaaggaatataaaagaaataaccttaagctttacattagagctgtgtgttcacaacttttattcgacatcagaaaatcttacaggcttgactatcaaaattatatgcgctgacccaagaggtctcatcccttccccaagaccatgctggtcaaatctaccatggtgaacagatgatggcaacaggcttctagctcaccttcctgtttccactcgtgccctctacagtcttttcccctggagcctgcttcccagtggacttatcctggaacgctcagtgttcataaccaagtactactctctgaacggaagctccagatggaaataccctgatattcagaaaaactttctttccttggcttccttgattcatttttcttccatttctattcctaatctggctgcttatccttctttagctcctttgctggctgcccttcctccttccttgcaaagccagggctttccctggtccccaggctctagggtataggtcttcaagcaactttgcttaggggcagagcagccaggctgcagccagttgcctgggcatgaagcctgctttctccacttaacagctgtgtgacctagggcaacttacttaaactttctgtgccttggatgatacatctataaagtggagttaatggtgccttatagataaaatgaagattaaatgagttaatataaaatatttagaattttgccaaaaatatagaagctctcagtcatcttgattatttttatgattatcttctccctctactctctcttgatattcttcctgaccactgtggataacaattatcaacataacgtagttggtttctgaatctctgtttcaaaatctgctctctgttcagagaaccatatccgtatttctaaccgtgccttgggcatcttttatacctctaattcagtattccaaaagaaaaggcacagtcactgttatggagtgatatctgtgccccccccaaattcatacgttgtaatcctaacccccagtgtgatagtattaggaggtgaggcctttgggaggtgattaggtcataaaggtggtgcccttaggaatgggattagtagccttgtaagagagatcccagagagctctctccccagctctccaccacgtgaggacacagcaaaatgtcagcagttcctcatcagagcccacccatgctggcatcttgatctcagattttcagcctccacactggaagtctgggttggaactgtgagaaataagtttgttgtttatgccacccagtccgtggtactttgtcagagctgcccaaactgtctaagacaggcacaatctctacaccccaaggcatcctgacccctgagtttgcttctatgactcagaggcaggaacttgaccttccgccccatccattgagcgctcgtcatgggattctcgaaaggccacttgaacaggactttttaggcttgttctctccatctcactcccctgtcatcattcagctccatcacacgttcctgcatactttgactcaccttttcactgaagtcaggctgatatttctaatatgtattttcaatcatgtcttttttctgtttaaacctctccaatctccattaactcaagaactgaatctcagctcctctctctggccgtaaaggtccatctagacaaaattcctatctattattctaggcttaccagaaataatatgcctgcagagagtcttcttttttttttttcagacagagtttcactctgtcgcctaggctggaatgcagtgaggcgatttcggctcactgcaacctctgcctccccagttcacgccattctcctgcctcagcctcctgagtagctgggactacagatgcctgccatcatgcccggctaatttttttgtatttttagtagagacggggtttcaccgtgttagccaggatggtcttgatctcctgacctcgtgatccacccgccttagcctcccaaagtgctaggattacaggcgtgagccaccacacccggccgagggtctttatttattgtttgcttctgtgtttattcacgctgttccctccacctagaaatcttgtatttttccctctactattgctggtcaaaacccaatcctccattagggccaatcatcaaatattagctccttttcagatttcctcaaagtaatgatgcctccgtctcctgagctcccatatagcactttgcatgtcagccactgtggcatttctcaccctctgacttacctcctcaaccttggcatacttcttttattcctccttctatatcataagttcttcaaaggcacttactatatcccttaaagcttcgaatgggataaaatgaatggcaataatcacaccaggaattaagctcatttattctgcaaagcagcagcctgttgtcaaatgctaacccgctccttcacagccctcataaaaagaataggaaagcatataaatgaagcagcacaccagaggaacatacagtgtgagcaattatgccaattccttttataggaagaacgcagctgagataaacatggaagcagattatttaccatccacgggtctcgttgccaaattcttctaaatttttcattaaaagaaatcaaggaaggtaaacaaagtagcccttgggaggaatcagtgtaaacagctcatatatcagcatggcctcagagaaatgtctatcttttttaagtgcatccttttgggccaaacacgtgtccacacacttgggtgcacacacacagccacatctccaagtgtgcacagccgtgcaaaaccttggcttccaggtggaggtgaagagggcaggctaggtgggaggcacttaccttcagggcatcctgggtgtcatccagacagtagactcggatgctgtactccagcgaggagcagcacaggggcccaaagatggccagcttgaggcgcttcgcagccgctttggtggtggaatgtcctaccagggcgtaggtgctgaggttctctgtgaggatgtggcaggcctctgcatccagctgaatgtagcagggggtggtgaagttttcctccccgaccaccaccacatcctgggggacaagagggaagggccatggctaagtcacccaggacgcatgccggccaccagggatggtggtgaatggtgagtagagcaggacctatcctttacttggtcttttttctctctcagagtttataatctgtctacttgagttcatcattctgtctctttctaccattgtctttacactgagaatatttatttagatgtctttcagtttgcattttttgatcttctaagaatctacattttccctaaaaatctgtacgtgtgaaaagaattagataaattaaggaactgggcaataatatattaatatgcaattctactatgttctttcaaaactcacctgacagtttcttcctaaagaaatacactgctttttctaagtaatcttggccgtcagattctaagaaaagcaagacctgacaaattccatgacacgtaagatacatttctctgttactttttttgttgttgttgggtcagtatacttcttttatttatttatttatttaatttattaattgaaacaggagtctcactctactgcccaggctggagttcagtggcaagatctcagcccactgcaacctccgtcccctaggcccaagtgatcccccaacctcagcctcccaagtagctgggaccacaggtgtgtgcaaccacacctggctaattttttttgatagagatggggtttcactatgttgccaggctggcctcaaactcctgagctgaagcgacccacttgccttggcctcccaaagcgctgggattacaggtgtgagccaccacgcccagccacaactttttaacatgttttatatatttaggatttcatattgtgtgtgtgtgtgtatgtgaaagcaggattttgctgcaaaaaggtttaaacggaaaacactcaacctagatcatgtgagcagttgttcctgagtcgtcatctgatgactgatggctgagcagaggattggccaagcaggcagctgtcccaagtcctagatgaccaggggccaaggacatggtacttggtgtcagggagctgggatgagggcagggtgggctgggatggtgtgtgagctcacaagaaggagctcagggaaattctaaaggcagcagctggcagtaaagctggaagctaaattgaaggagacaagtcagtgaaattttcagtctaaagagatgggtttttatgtgtcattaaacagtctactctttcagacactgaaaacatttagcaagaaataaaaataaatggaagtgatgatttttattttaaaaaatagttactaattcaaccaagttttgattcatctatatggttcaggccacagaatatatcagctgaaagaccatgtatgggatgcaaaaaccaagggttgggattccgaatgcatcctggggcaaccaggtaacagaggcatgtgaagtaggcagggccacagacaaggaggaatgatggagactgtggcgaaccagagtgcatgcctgtctaaagagctcagcctctgctgggcttcggcctacggttgctatgcaggaatgcaggccaagtatggacaaagcctcacatgttccaagacaggctggaagttcagattttaatgtgaaatcttccaacttttaattaactcgaatttaaaagaaaatctcaggcaggagaaatccacgcgtgagcatgagtcagtctctgcactgtcagagacaagagtcagtcagtctctctgcaggggcaggaatcatgtcgactttgcttcccactgtattccagtgggcctggctcagggtgtgtgtcccacaaccatttgctgaaacagtgaatgaacacttagttatacatttagttcagagggctacacaaagatgtgaaaggttgccacctaggttattatttattaggccttgcaacatgatctgagctataataagagctgtgttttaatagcatcagtgaaataatttcttctactgaacctatgcccccagaggaagcccctaaaaaggaaaagagagaagctcagaacctccaggtttattccagtcccaaaggacacctggaaagcagctgctttctccaggacaaaggaaagcctccggtatcccctagtggtgacatggtgcagaaagcttcctagaagacatggccaaagagtaacgatgcccacgtcccagtcactcacaagtacaagggggctttcatgaggactgtcctcttctacttccctcatctgctcagtttattgttaatgtcgttgttattgtaactactcaaacccagaaatggatagggtaataggaagagaatcatgcgaataatttaggatcacttcggattaagacgggatgtttttcagatacatcatttaaagcttaaacagaatgaaagttagatctggttaaatctggtcctaactcaacataaagtgtatttatttatttattatgtacgcttcggcaagcagtgatcccctgatatggtcaagagtagaacatgcccataggaaggaaatcccagtgaatcccagggatactctggtactcgtctacatctaatactatattttcttaaaatattaggagctggaatcttcatgtgtattttttctaagaattttttcctaaaaaattatcataagtaatcacaaagcatataatatatactttgcatattataacttcctattttatatgttttacattttatacaagtataaatgtatagtatagttttaaaattattgagtatttttggataaacatattactgaaatataggtgctaagtggagggttctaatataaagaactaggcttgtttaaagcattgtccttaagaagttctgatgacagcagctgcagacagccagaatgctgcagattttcttccttctagtggagctttggagacacaccctttctgttttccaaggttaagttcacaagaactgtatcccaggtacatgtctgcaagtaagtgcctaacattttctgatccagttgcaatgtttctgacctgcaaattatatacgtatatatacatatactttttttttttttttgagatggaatcttactctgttgcccaagctggagtgcagtggtgcgatctcagctcactgcaacctccgcctcccgggttcaagcggttctcctgcctcagcctcccgagtacctgggattataggcacatgccactgcgcccggctaatttttctatttttagtagagacaggatttctccatgttggccaggctggtctcaaactcctgacctcatgatccgcctgcattggcctcccaaagtgctgggattacaggcatgagccaccccatatacatatatatgtatatattatatatacacacatatacacaatatatatacatagacatatatataatctatattccaaaaggaacatgtctacaactcttatgtgcacctttcctatgagttatctaatgagtgaccatcattttctgtgtgcctgtcaatcagaagatataacactcaggaactagtctgcctgcctgtttctctctcattttgagggtgagctaaaattccactcatgttttgctttataaataaaaggcctcccataattgctcctgcttatctgcatggattattcttgcatagcatctttatcccgacagcagctcacctcccactgtccctgtgctgcctggttcttgagcagtattttccagtcctcggtattggggtctgcgcagtgatgcatagtgaggacgactgggcgggtgagcagagctcctgggggcccacagctcaccacaggggtcaaaagtgtctgagagtcatccatgggtggcctaggaggagagcagagaatggcttcagtgacatttccattgtattcatgaactatgcacttgggttctgaaggcaaacaggtcaagtagttttctcctggaattctttttttttttttttttctggggggttggggagaggaaataggtgatacagaattaaatgctctctataccaagaccttgatcttgcaggactggaagtctttatgataacaataaacttgccagcatctctttgatccccttccctccgacactggtctttctatggtagcttcctccaaatttatgtacagacactttcaagatggaatgagaatgaacagagtccctatgaagttacataagcagattttctgataattcttgccactggtctcacagggttttaaatacttttgtggtttcaggacctgacttgaaaaatagttttaaaaaatcatttcagaatgaggacactctagaactaaacttagtccaaatgactttcaggaataatttaggctagtacagcagattcattctttcaaatatgactagaaataatatagaactgtatttatacagcaacttaaaatgagatctcttgtatagttcatgctcagagaatctgggcagaaagaacctaaaatatgcagattctttattcttatatataaaaattgcctttaatcttttccctaacaggactgtaatcaacaagcaaatggataaattaacctagcctatcagtaaatttgtgaagatatagttccaaaggtattgagtggattgccccaagtctcacaactaagtgctagttagtgctgagatgaaaataaatgccctctcaacgacaacagtcaaactactcactcaatcagaagagcatagcttttgaaatcatggactcacagaattttagaagggcccttggaagtcattcggcagcaccttccatccagccagaacccctctaaaacatggctgacgtatagttagtgctatagacacatccagaattgttccattactgctaaaaggtcacctcgtttactataaactcaaatttacaaaatattcttacttagaatgagcacaacctgacttcctgaaatttctctgtatgtatccttgatttgcttttgatgctacactgtttcatatatttggagatcattatgatgtctctacagtcttctttattacagaccaaacaacctcaatgtttccaccctcagctggaatagcatggtttccagatctctcctcgggtttctatcttcattttcatatggatgcttgtcattgttttccaggtcctcgttaaagtggtggcaccttgaactcaacactcaaatagtatgagagagtattttctttgatttgccatctgtgtttgtattcatgcctcacaaaattgttgctgttgattattcccaatcaaggaattacttacaaatattatttagcaggctccagttacatgggaagatagagatagtatggttaagcatttcctttataaaatgaagcagtgaagctccaaggaagttaagaaatttgttaaactaaccactctaagtattcccaacatgaaaggctcttaggctaagtctggttccatgattgtaatgatggcttttaaacctatgtacagaaatttacatttagcttttcatttgaacttaatagtttcaaggtaaattttgggtcatctatttcttcatgctctatcttccctccaaacattggctatctcttccggtcttttctcctccctaaatctgatatgcttgccatttatgttctcattctaaccattgataactttgcaacacaagaacagggcaagggcagagaccttttcaaggacaccatttggaacctctttccagtctgatatcaatactttgagctatttagttccaccaaatataaacccattaaaatggacattgtttggttcacatcttttgatggaattcacatatatatgacaagggacacatcaaattcctttataattgcaatggtcacttgaaatggatttttctctagtttttgtctatggtttacgtattatttattacatattccagaagttagcttttatctatgggtaccctcgttgaacactcaatgaatggtagcagttgttattattgttaatattgttggaagacaattatccatggatttctcatgtttatgcatggatgtttgtatagcaattaccttgaaagataaagacaatgtctacttctggagcaaatggcaggcctgtctactcctcattataaaagactcaggttccctaagctcatagatccttttctggaatgcaaccattgagtgtgtagacttcatctgaacatttttgcatcaccatttctaaaatggggctcacaaaattggcacaaacatgatggtactctgtataatgctatcgctgtgggtaataagctgtctgttgtctttgatccacaagacttgtgtgttttatcagcacgcataaaactgtagcagctaacttggtagctcacaagtaagtttgtatcttagagcttccacagttgactattaattctaagaacacaattaaaatttggtatatgttccccttaataactcttggctatcagtgcttcctcacttattctgaaattgcaccaggatctcaccaacctatggcttttctttcttcctatttagaaaaccaacacaaattttacctacttttagtcttttaatagcatttccgttctctttaaataacaataccctttcctccattatagctaaagttatttaggtacttgggaatgtacttaaatttggaactataaggttattgggagcaacttgagacctcattactatccccattaccaccttggttttcattttctcttaacccaatttgtccttcttccagtctgaaattcattctcttagaacacaagtcaagttctgctttcaccgtgtcatagttaatactatactatctgccttaaggagtgactttattattgcttaattctattttttcctctcctggagggggaaaaaaccaatgattgcatttttctgagcagaactcttaccttctagttacaagtgtaccttgagaagtgaacattaaacttttaaggaaggagactagagtggaatgtatttcaagtggtctttgcaatatagttggggattggagacatctatctctcagtctggtgttagcagccggtgcttgaggcaggaaggaggaggggtccttctcatcactgacttggaacagaagggagaaggctccctgctgggctggggagctgtcagacctgtactctccaagtacacccctggcatgcaatattgatgggcaccattcttggaggagggatagcaagggaaggagggaggaaggaggggcagtaggtgtcaaaagaatttattaacccagtgaggtgcaagaatgtaatgaatagggaagtggtgaagtggaattcttaacagggaatgaaaaacaaagaagaaataatgataagattctcttataggctttcaagatgacataaatagcattgaaattgcaaatatctgagcatatatgtaaggagttacgcaggataagatttaactatgtgaaaactaaggtcagagtgtgtaacacatttcctttatacaaaggaagctattaaatcacatagaagaaaatagcagaaaataaaaatatctcagattcttgtttttgcagagaaggacttctctatgtctcatgtgttttctaagcaattcaagcagtctgtaaatattaattgcagatgatatggaaatgaacatagagcaaaaattagcttcagaagcatcaattaagtagaaatttcagcaaagaacaatgattaaaattttaaatgttttccaaagtccaacaaggataatattccagtaaatgctggatgggtgctgagtcctctaggacaaagcccacagagagaaatttcagtttcctgtcagaaatattttctcatcctttgcttgtcattatcagtgaggagaacttctaatcaagagtgcataatttacaaaactttcacataagccattgcatttgctgctcatggtacacctgtatggcagtgtatgtctattacctcttttccagaagaggaaactgaaatctacagatattaacacacttgcctaaggatgcaaagctaggtaggtttcaaacacaaatcatttaatttctttcacacgatgctgtattttgggttgcttagagtgggtttaagtccttgcgaaactattcttgtctgtttcctagagcaggctcaaggaaagaatctgtctccatccacctctgtgggaacaggagatgccttctagtagtggacatgtcttttatctggtccctcaggatgataatcccaccctaggctcagctgccttttaaagcacaggccttcacacataactggcaacttgaaatatttgcactctaggtacctgacagggaatatctaactcacttgctatcaaaagctcaattgtgcaaaaataatatttatgaaagccactccgaagggcgtgccaccatttccctagacaggccaaaatctatccctggattaagccagaactgataagcattatgcttatctacctccattgagggacactgatagaagcagcccttgaaactcattgctgtttttctttaaggatgctgttcactgcattagcaaaatgtcttctttatgaggaaccaaaggaaaaataattgggtttcttctgagcatatttttttcctcatggacatgcggatcttgtaacttaacacattcccttcttgaaaggcttagaaatagtaaattcacgacctggtactagcaaatgtgctgggaattacaccaactattttatattctaaccgctcgcctactttatcttatcttttataactttattttccccattttcttaccttttttatccacttatttaaatttatttctcttattgagaagtgttttcgtaaactatcttgaagcatttctctctaagtaggatttcaataaatgaacattgtcaagaacagtatgaggataagatttcaatatacctggactcactaactcccactgttagcctttttatggctcttccttcaaactgaggaacttgaggctcatgaatgagaaaggactctactaaaaggagaaagatcactgtgtttccttgagacagaataatgtcaactactattttacaaaattccaaaaaataacatgataagcaaatctatctctatacaattacctacatagggaattttggacctttatcctcacacattgctttattatttatatttaatagatgtatatgatagtgtcagttgccacactactatctcacatcttaaaccattgctaaggggattccaccaattaaaaaaaaaagttctgaacaccactaatgccccacagttgacaaatctaataatctttttgttgttcttcctctttctttacatttttactttaatgacacctcgtgttgaggctccatcttggagccctttttacctttgatttttgagatcctatttataccgcggtttgtctgtctacccttacaaaccttcgtactttcattaggaaatattcattgaggagccactactcctaacacagtaatatgttaagtactgtgctagatgcaaactcttcatttgccttatccttacatgttctatctagtttctctcatcacacccaaaccttcacaggagtatttcttaaagttctttccccagttctttctgcttctgcattttctcggctggaggttccttccttgccgtgacttcacttccacgtccctagcaggaatccacatccccactcacactgaacgcatccaaactggaatctgtcctctcccctggagccactgctgcttctcacctttctcacaattgtcacagtgccccaggcttgattcttgaatctattctgtgtgttctgcccctcctttgcaacacttctagccagctgtgaaatactttctcttctgaaatagattctctccataccctctccattctctcagactgggacctggctcaccctccggcccggttcctcctcctcctctctcctcacacctgcattactgccagggcccacccaggcaccaagccttctgggcgagtccttctgttccctccaccgatgcattccatgcactgtcaccggatcaatctttaaaaagcgctgctattcctgcgtcactcagctgctcagaaactttccatggctccctgcggtttacagaaagggtgttctatttacctttgtatttgcaatttctaaattgatttcttcaccctttgataaaactgctaggtgagtacagaatgcagagaaaagggaaaatcaactttcatatcttcaattccaattgttttccaacaagaatcaataaagaacaaaatttcagtctaggtcgggttcatttgtgcaaactgctactagaaacaaggcaaaaaggcccatgttagcagcattaattgtggaaattgtatccaccaggaaaacaaaggcgtcgccgcctttccagagatctgtaaagcaggagaggtagaaatcctgagcacagccttgcagctctgcaccctctttggtcagagaccgcttgtcccatctctgtggctcattcaggctgttcagctgccagcctgcactttcgcttagagcatattcagcaatgataagacccctcttgtcacattcactatgccacatgtaattaagttcacgcctcccttcagacaattcacatccgcagatgaccagctggataccatccagctggaaacatacccagtttgggatgcaataaaagtaatcagagagaaggaaaatggagaaaaatgctcagaattttcctacgaatgcatagtaacatcacagctcctgatgtcctcacagagtcttcttccaaagaagttctgtcttgtatcatgtgtggatagaaaggatctttagtgagcaatagaaagtgtatccaaaaatgcaccgtaatacataggcagaggtttggtttgtgcattggtgcaatggaggaggatggcacattaggaagcagaaagtgctttgtgatcagaaaagcctgagtctgaattctgccttgctaaggtactaactgaaaccttggctttggaacccaattcccctgtgcctcagtttcttcatctttaaagtggagctcatcacagcttgcagaacgtagtgagaagtaaatgaaattaagagtttgctggatgaagggcagggatgctttgttttatgactatatcctaaagcacattcttgccattgtgttttacaataaaaatgcatctggttcataacagaaaactagtgaagagaagacttctcatttatctgaaactgttatcctcctgtgtttgtttcttggttcatggtctgtagtgcatattttcttttgagatcttgaggttttcctagcttcatttttataaacagaacttcttttatgcacaccaaattcaacagagtaattccctctgcacctaacttcagatggtaggcatagcaaggagtgatttatagtttccgtttcattatagtcaaaggcagagaaccctaacagcagaaaagtgtctagctttatcaattttctgttttctctttctttcatctaaaatgtacaattatcctggttcggctgccaaggaaagtatggggagagcaggcacgtgagtgcacacctctttcagcttcagcccgtgcctgcagcagccccttaaggcttgatcttcagctgcagataatgataatctgatggaaaataggagagctcaggcatcttactgtttctcaccataaagcacaagccaatacttatttctatttaaacaaaatgtccacgctgacaaaggccttgatggatagatgtacttaatgctaaccttgactctggaagagagaaagaaaaataaaataaaataaagagatcttggagtttgctgatcttcttttctcctgatgcaaaagaagggagctttgagggcctgtgaatgttgctttgcattgggaatgaaaaaaatgaatatttgatgtgggtaaatacaagccttttagtgatttttctgttgctcaaatttaaggcatgaataatgctcaagaattgtattattttcttagacaggctagtatttatgtaggtggaagtacaccacccgaggaaaaaaatgttctgggtcacaccaattataaatgccagtatctccacctgagagcataatacaaaagctttatggctagtgaagaacaaggctaaaaatggacgtttttctgaggatgagagctgggaaaagaaaaggtataatgtgttataatgataacctagttctgcattgtcactcatgctttatattcagagctcagggctgaggagccgatgctcttccccttgggaaaaacaatgataattacatgatgaggatctccattttaacaacatctttcattttaagatcttggtgtacttcagaagcattaatcaggcttctaaagcactatttaacacacgcattttacatggaaactaatcaagaaatacccaatacgatttgttagaggccaaactgaaaattgaatttaggacttctcaatgcctcttgttatttttacttaaaataacttcttctttatgattatgaaacattctaaacaaaaccttttaattcaatctagttttaatcaatcctagacccattctgaacagcctaatgtggaatttataagtgttaaacataagaaggaaattagtaatacttaagctagaagacagtcacaaaaggaagaatcgtgggtcagaattaagggctaggctgagtgggagcggtagggattggaggagttgtccaatcctttgtgacctttgactctgtaatgggaacaggctggattcctgagccagatgccatgaagtcgacgtctctgtgtctacccacttgtctctctggacaatctagggatcacatttctggacatttttccaggaaatatggcaacgtgtccacttgggaaaagatctctagccttctacccatattcaagatctgcaaaagcgtctggagcctcaaagacaaagagaagtaaaacctgaccttttgtaggtcaagggaaaaagaatgtatgccagaagcaaggcacttgagacaaaaatatgttgggtttattgtgtctattgtacaattctcctccaagttagacattggtaaagtcagtgcaccagaaaaagcatatttacctcatagtttctttcctgtgtacagtcacatacatttcgtagactctcccttggggaatggccccagcgggaatcagcaagctgactcctgaatagcaaaagagaaaagcagtcatttaagacttttgcagcacgtaaaagggaatgaggagattttgtgaccgcgcagccataagcctgcttcattttctctaaagacatgtaaatattccgagttgctccattttccttcctcattggcctccttaccacggctccctctgaactcttatgcaattacttaaaggaatgatgtaactttttaaactcttgttttatttgaggaacagacagatggttccactgttgttttccttgcaagacaaggggaaaaccaacaactgctcaaaatttcaaacagctgtaatgatgcatcatttccatttttttttaaaatccccacaagattcaaagtcagggaaatgccaacttcaacataaaaaaaaaaacaacatgtattttttaaatatccggttagcatcaatgtaattccacaatggtataagaattggtgaagaccttttattatacataactctagaaagtgaacactaactcctagtttagtcacagcaggtcaaagcgtttctagttagttgctaatcggtgccctttggcagaactattagattgggctgtgttctaagctaactgtgtctgctgtggcagtggcttgcaaatttgagctcaggtcagaaccacctggaaagcttgttaaaccacagattactggtccctaccccgagtttctgattcagagatatggggtgtggggtagattttttagttcaaccagttgccaggtgatgcccatggtgatggtctggggcccacaccactgctcatcatcacaaagagtgattcagtgtggacagcactccaaagatgtttggctccatcatttgattcccctaaaatccagcttccttcagctccatacaaatttatgaagcatccttgtgagtacagtgtttgacactgttgtgaatttcaaaaaggaaaagatagtcttcctgtctttgagtaattcataatttaattagcgaggaaatggaatatgccaaatgagcgtggggcaatatgaaaacttgcctgaccacactggaaagtctcaagaaaaaagaatggagagttaagaggtagtaggccttcatgtaactggttgaagatgttgagccacagacctcttgagaaggagagtaatgtgagagccctggtgttgtaggaagtggactgtcaatgtacagaatgatttgtggaggacacagcaggaagatcacacatgaggctaccaagcctcagtgcttttatttttttcattgaaaacataaaacataccttaatctttgttatagggatgaaacagcattatgaatataaagtaataggtaactattgtttgtccattaaataaaatatcatatgttgatcaccattgcctaatacataggaagaatttaaaacatgctagctcactcccttccacttaagaggcctttataataatgcacatatgaaaaagtggtaggtagaaatgggaagaaaaggcagaatccaatacatttcagagggaaaagaactattttgagaacaattgtaatgtttaaacaatggaagaaccttaaagtatgttttgattcattcaataatggactgttataaagatatttaaaatcatgattttaaagagcatgcaatagcatgaggattaatgagaaaagggtggaaaacattatataatacatgatctcagctatgtaaactgtgaagaaaaaaatattttattaaatgttttgattttgttaaaatatacttttaaaggtttagggtaaaagttgccaaggcattgaaatgaaagagtgaatgacaggaagaatcaaataaaatttcatattcaggcctgaagactctttggtctgtatattccttgagtatacacatattatgttttttcaatgtgacaacactttaggtatttacattttaggtattactgtatttacaaaatactcacagccttgcccaaaagaattagatagatttagagaggaagccattaacccttttatgacccatggttccaagctcattactaatattgattaatgaatatcgatttttaatccaacagtatcaggcattaaccttcattcaccatgaaagacctttatgaggcttattgtctagatgcagagaaactacataataaactgaaaccaagtaatagtacaaaagcacacctgatgaatctggtgattctggatacaaatatcagaggtaggagtgagtacagtgtacactatcaatactgtgaggtgaaagactgtgtgatcaagttaggttaataaatgaagatttgatgtctattatgatacctctgatgatcaaaaaatttgttttctgtattattgcttcatgtagtaaattggaacttaatcaaatgatatatttaataattaattcgtccttttaaagtataatgacaacattaggacttgtggcttgatgttgccttctgaagttctagtaaaaaggaggtcaatgatggttctaaattacacctcagcagaaagttgtgagtatagaatttctagaggaagtgttttcagaattagttggaggaagagaaatggttttgctgatttgtctgaagtaatgttctgtttacattgaaagtagatttgggctggataggtcacatttaacatttcaggcctaatgaaaacatcccacgaacaaaaaagattttggtatggaaaaatatgtttcaagctgcctctttgcaatttaaacctctaggaattacctgaattgggaacaataaggtgacctcccagcgagttgaagctgccaaatgcggtacaggatggatcagtctgccttgctagactctggttcttcaggctgagggcttcattctccaacaacgactgggtcatctgaggggacagcttggacgtaaactcagagaggtcatcttggggggtgacagcacctgaggtgttgtacactttgattttcaggttgggcagtggatccagaattggagagttggtcattgggattttgtctgagacgtcatgcagggcatagacaggtcctctgtacatggctgcagctgacgtgaggtctgggggtacagccagcagatctgagtcagaaagagaaaataatcccattggcattctccattcaggccaacctacattagtcagactccccctcacactttctgagccgaaagtaaagcagctcagctaatatcggagatagatagacaggctctactgaaaacagggcaatcagataactaccagctcttttattattggctgtaagtaagtggtcaagctcattctataatttgctttgatgtctactcattatgcccaaggtatttggctatttcaacagattggattgaacaacgagcctcactaggtgacgattagctatggtttccctggtctatactggatttgggttcattggtaaatcattctattcatagcaatacaagatatcttgtcaaaggaagttaaaaaaagagactcaagaaatcagtcaaccaatcagggtactcttttcgattagaagttaaaaagtgacagagcaatctgtcagaaaagaaaaaaagaggatttatcttgttaactctaatttgttatgtaaatgacatcaatacagtaatgaacaaaattaactcaaattgctgtcttcatggagcttacattctagctgaatgagatgactctaaagtcattgattttgaaactgcttacatgcataagtaacagggtgtgaagtggaatgtcaactgaccttgtcttgctgccttgatgttcacaggctgaaagcccccattgagtgccgaagagtcaataatatctgactcaaagtcacgatgattcttccgatacacaaacaaggccacaactacagagatcgccaggcaaacgatcactgctatcacaatcccaacatagagagcaacatcatctgaatcaggagcagctagagaggagagtgaaacattgaaccagctgcttatagaaatttcccacagtacacatatgtattgctataattttttcagacatttactgccttttttataggttaatttcaaatctatttcaaaagctatataaaatggctgtggcctttcagtggaaaattgtctctgatttcttttcctttctcactctgcatctatccacccactaatctatcttataattgggcagcataacagactgtttattactaggcatataaagaaactggaactaaaaccatcccaacccacaggaaaaaaaagtttattactcatttcaggtggaaaagtttggaagggtttttgaattcactgatagttctttaaaaacataaacataaacactgttagaaatatctggcatgttttaaatctgcatatttattgaaccagaatattttcctaagtatcactccaagtcataaaatgactttccatagcactcttctcactttcccctaaatcaatggagaggtgggtgggaatggtgtaactaagcaaagcaaatactaggagcaaacatattaaatttgaaaggtgtgctttcagagggcccagatctgggggacagaggttaatgctgataaccttctctaagtccaggctttgatacagatgcagtattatctctgagaaccctgagcttctcacggtcccctgtcagagatttacatttgagctactcattactagaataaaatatagctctcttgtgcactaaggaagacaaaggcctggttcagtgatcagaaagttcagactaccccagaaggcaaataagcatttgaccaacacagtgtgtcagtcaactgaggtcttttttctggaacagaattcctataaatgttgcatgttgccttggtggcacagaacatgcttgcatctaactggaaaaggtgatagaagctgataattaaaacaaacaaatgaaatgaaacctttgtggacccctttgacatttttaagtctctgtttttagtattctgtgatgcacaaaaacatgttcagcaaaattaatcaaagctgctccactcactgtaaaagaggttgttaaattggtacttcaggtagtcgagaacaacctagaattttatggtcaattttatatacatgtacatttttcagggagagagaactttccaatttgtaggtcccatgacctcctaaaatgtgaggaaccacggccctctcctaacgctcacagccacatggtttacatggtgaaataactcatcatttcatttgccagtggctcatgagacaacccacactctaatgtcatggaatctttcacatattagcagtgtaaatgaattctttattgggaattgctctatctcttttggcattttgtgtttaaatgtaatgtatccaaaaggattttgctttcttttaaaaataattttcttcccaacatttccagaatattcactttcccatcaatcaagtcaatgttagcaaattttcttcagaaaaccagtgatatcacaaatactcgtgattgggtgagtgctgctttcaaagtacttacttcacttctctgttgggttttatttgaggcactgctgcaggattctgaactctggtcagaatattatatctaaattcttattgttttactttaccaggtcatagttacttattcaacattcatgatttctagctcaacccatctgtcttttttcaaccctttctgttttggtatttgaaccctgccctttacttatatcagcacatttcatgatatgttttgtcagctactgggactcaagctttgaatggtagactgatagattttaaagttggcagagtcttgaaatgaccctttcttctcttcagcagcaaaaatctaatttatttttcatgttagaatatattaggctcctatttcctgtgtgcacatctgtaatccgaagaaaggtaaacttgaactaggggcaataacgttaaatgattattcagcaacataaaatccaaacatcaaacttacaagaaaatccatattcattctgggttctctgttcagttgaaatgggataaatgaaaccttgaaaagaaaaaaaaatgaaacaaaaatgggaacaaaatcaaattaatgagggaaagaaaataggaagcatgaaaaatggtttaattaaaaggaaaagaaacctgtggtcttttaaaattctgattcagtataaaattatgattttgcatctcctgtctgctctggagcctcactaagaattaataagcaggcagattgaattttagagcaaaaactggtctcgagtcactaactttggagtgcttaaagtctttcttttattgagcataaactctaatggatctaatttatttcagacatcaggggtcattagcataaggaaaatcttttttccttatccctgccatatgctttaattcccaggacatattcagtaaggctctaaacagtttttttttcttttttatttaatcataacagcttgtgcttggtctaagagaactaaagaagacctgtcatcattggtcaaaggttaagtacccatttactgagctaagctgagaccacctctcccccgctccatctcaaatctactttttggattttctgttgtttcttgcccccttcatttaataggagttcgataggttttgcctagggactgaacagtttgtcaatgcaatggaaactggatgctttttatttgaaatcattagaaaatcaatagggcctagaggttataagggtatttattttagggcttcagagaaatggtgtatattgggaaaaataaaaactttcatctcaatagaaaaatgcagaaatagcactagcattttatttctcttcctttttagtgtattctgaaggtggaaactaacaataataatgcaatatggataatgataataatgtgaagtggaataagatagggaaaagtcacttaaaatatgtgcaacacaaactttttgaaatgaaaaacctatggaaagttttaaagtatatcttatactggtaaccacagttctccaagatttactattctgctacatatgaattaatcaaatgatacagcaccatttggattaataaaatgaagatgactaagaagcctgtgaattaaaccttcctagtaatactcaagggcaaaaaacagaggaaaacaagtttcacaattaactggttcaaaatgaaaggtctataaagctgtaatactaaaagcaactctaaatcgtgcctcaggtagcacttccgtagtttgccgaacactcagttcttacaagctatttacctatttgggggaactaattctggagaaacatgcagtgctaccttaatgaaagagagctttgctgtagcacagataggtttgctctgaattcatttttaatgccttattttagagcaatgattgcaacctcctactcagttttataaatattatattccttattctagttgtctgagtccatgtattaggtttgattttcatttttaaacaccactgcctggtaataaaatttttccatttgtattctgtgaactcaataaaaggacatctgggacatacacaggctctattttcaaaacccaaagacttaacacaaaacaagttcactgctagtagaggagaccagatcacaatgccatcttcctggaagtgatgatgttaagtagaagaatgtcaaaagacttatttttgcaggtaagaggcaaggaaatgagtataaaaggcatgtttacaaatgctatgatgctcatcctgaaacttttggtaagaatcagcctggcagccgggcatggtggctcacatctgtaatcccagaactttaagatgctgaggcaggtggatcgcctgagctcatgagtacgagacaatctgggcaacatggtgaaagcccatctctacccaaaatacaaaaaattagctaggcatggtggcgcgtgcctgtgatcccggctactcaggaggctgaggtgggagcatcacttgagactgggaggcggagattgcagtgagcagagattgcgccactgcactccagcctgggtgatagagcgagatctgtctcaaaaaataaaaagaaaagaatcagcgtggtcctgcttgaataagcagaagagctgcgtcttgcaaaaggaaagcctatctccagctaggtatcacgtggtccgaaatttctccctgtaaagcagttctgagttttttgtccctgcttcccaccagaattcctgttcttgataggcagaccaagaatagagaatataacttcgtaacttcgatttgaatgtcaactttcacaaatattatgtagatttaaactactcaataaatgttttgtgccttatggtatttatctgaaactgcaatctcattccaggcacagaattggaattcattcattcattcattcattcattcatcatccgtttagcaaatactcttgaaccttattatattctgggttctgttgtagacatggggatactttcctgtttttactgaagtttaacagaaaataagcaagtaaacaaaataataagatcatttcaaatagtaaaaaagttcttttaaaaataaaccaaaagaacataatgtgtttggagatatcaggatggccaacttagggaattaaggaagaattttttttttttaattgagatgaaatttgacctggagcttgaaaaaaagaaagaatctgccaagttaagatcaggaggcaagtgcttgatgagaaacgacaataaatacgaaagtcctgacagaaagacagaatggttagagggtggggagcaagcaagaaaggaaagggaggaggtggggtcagaggacaggcagcaccaggtcacgtcctggtgggccaggatgaggagtcttgctctgtcacccaggctggagtgcaatggcacgatctcggctcactgcaacctccgcctcccgggttcaagcgattctcctgtctcagcctcccgagtggctgggattacaggtgtgcaccaccatgtccggctaattttggtatttttactagacgcggggtttcaccatgttggctagactggtctcgaaatcctgggctcaagctatctgcccaccttagcctcccaaaatgctgggattacaggcccgagtcactgcacctggcctccacagtgagttttgattttattctaagtgaaatgcatatcctgtgatcgaatgtcattttgaaaaaaatcactttggtttctatagatatggattgtcaaatggagcaaggtgatagggttttacagatggcttctataacacatggcttgggagatatctgtcaataggtgtataatataactgatgaagtgtttgcatttgaggttgttctgaatgaaaataaaatattaaaaaaattaaatatcgcctcactctaaaatattaaaatatttaatatttaaaaaattttaaaaatattttacaaagtctcacttactttagttattcctcacaggcaattaggaccaatctagccaaactcttattttcctacatgggaaaatttaaaacagaccagtattaagtgtactcaccaaaggtttgacactccaatttactctgttatggaaacactgataaaaagttatgtaaggcatccctgtaaaactttttccatcattttcaaaacacttctgcaactacagaagtaaaacatcacttagcaggctgggaatcagagaagaaggggattactgttccatcccctaaatgaggggaacacagaatcactttctggagtttgtttttatgcttctccatctgatccgtctctcacggaacaacagggaacattttcttcagctaatgaggtgaccctgctgagagtagtcctagcaataatgaaaaataacatctccggcggaacacagtgcaaaataattgtttttcggttgctaccgacagcctggttcaaaagttagggatttcagttaactttcctgctacttcaaagtaaggtgggctaagaaaagcaccaggccatgggccagtacactgcttttcagtgtcatgaacatcagcttgaatcctagctctgccacttagctgggagagctttgccgaactacttcacttttctaagtatcagttttctaatctgtgtaaggggatatgaatacttacatctagagctgtggaaaggataaatgagatttgtaaggtgctggtacattgccagtaatcaagaaatgaccaacaatgacattgatataattatgatgcacgttactaaggtatactaagatgctgggtccttaagggattttatctgtagagtcaacatagcctattatctaatgagtgatcttaggaaactcgtttgaatttgtttccccagttattacatagacagggagcccagtttttcagagaagccgtatgcaatgctctcttctaaggactcttgcactctcttcatgtaaaaaggcttatgcctgtcctttgtggcttctggcaaaagatatggtggtatgtttccaaagcacattttcaaggccagagtgcaaattgatggtaaaaaggtatctcaaccaagagtgatgcaatttctcaagagggtgtttggaaatggggtagggatggtgtttttttttggttgtcataaggattaggtggttgttttttggcatttggtgagtggaggccaaggatattgaatgtcctgcaatgaaagaaacaatcttgccatgaaaggatggcccagaacaaaatccacctcccttgataacaactttcaaaatcacctctttttgactgagaaggcaagaacaggcatggcgttcagggaaaggtatgaggcttgttatccctgggtacagtgtggcctcagcaactgctttttcaagagcagtgctttttcaagggtaactgcttataacctatatccactttaaaacaatgtttttttttttttttaaatatttatttcgagatagggtcttgctctgtcatgctggctggagtgcagtggtgtgatcatagctcactgcagcctccacctcttgggatcaagcaatcctcccatctcagcctctcaagtagctgggaccacatatctgcaccaccacacccaggctatttaaaaaattttttttgtagagatggggtctcgctatgttgcccaggctggttttgaactcctgggctcaagcaatcctcccaccttggcttcccaaagtgctgggattacaggtgtgagccatcgcacccagctgtaacttgtatttttaaagaaaatttattttttaaagcatagattttcctgacttgcaggaatacagactaaaggagattcgatatggagaaaacctttaagtgaagaaaaaatatttgaaaactggagcaagagcaggctatgtcttaaacagtccatgcaatgctccttttacttgaagaccatctcataattgctcaaaacattatctcaggagattgtctcattcaatctttttcatatgaggagacagagtctcaaaggtgagaaaggatgtttgcaaagttacccaaagtgttgatattctaccaactaaaatttgggtcaataaaactgacaatgtataattttgcattgtccagctctgggtggcagcattcatatttgtgtttactgtagatttggattaatcatagaaccatttcctggctgctggtagtaaagtgacttagggaacgaatgacttttttctaatttgcacaaggtcatcatttagactagaggtgaggttgcccgaactttttagtgatgtccaaccattgtaaaagatcagagcccatgtccaagtattgtaaaaaaagaaagagagcaagagagctttccttggtgtttacactgaaggaagtaatatcaaattatccctaagtacacagccaagacccagtaactgagcaacaatatacctaaatgtagcctgtctggtgggtttatatttgagagtctcaagaataatgccagaaacaaaatgtaaatcttcatttccccaataaacagcaactacttttatttttctagccttttcaaattttttctttccaagccatatggatagatagcaaaaaatgatcatggttttattactactttttaaaaaaataattcaaactgtttttatgccatactacatactttcatataaataattatcaagcaaatattctgatgtgagaaatgtcataacttctgaacatcattagccaggtttaaatcctcaaaaccaagtctatgttctcacaaacttgcaaacccccaggatgttggagtgaaaatagatcattgattggaactccctaatttaaccctttgagtatagagtggtaaagggatttgtctaacattataaagctggtgaaacagcagagccagggttggatcccagccctcaggctacacctccaccgtccttcttaagtactatgtgagcaataattagtagattcgaatgaggagagacaaggaaataacagaagagggcttggtaggcacctggcttaatttgtaatttggtgattgcatgagataaccctgctgatttggactgtaaaatatctctccatttgaaatattatcatttatagtcatgacacttataaagccaaaaatagcatagagaggttgtctcctttacatgaaaaaaatttccaaacagtgtcttctgttacaagtgtggggcaagcaaagaggtgtaccaaacctcagcatttccactctaatgtgactggggagccttgctagagtgatgtagttgttaatgcatgataatcacattgcatttggcataaaaccctataagtaaatatttaaaggagaaacatcatttccctcaaaaatgatgccatgtggaaaaaaggaataaacatcaataattggaggagctctacacatcagaagaaaattccattttttttaattatacttcaagttctgagatacatgtgcagaatgtgcaggtttgttacataggtatacacatgccatggtggtttgctgcacccatcaacctgtcatctacattaggttttctcctaatgctatccctcccctagccccccaccccgacaggccccgatgttccatgttcccctccctgtgttggtgtgttctcattgttcaactcccacttatgagtgagaacatgcagtgtttggttttctgttcctgagttagtttgctgagaatgatggtttccggcttcattcatgtccctgcaataaaacatgaactcatcctttttttatggctgcatagtatttcatggtgtatatgtgccacattttctttaagcagtctatcattgatgggcatttgggttgattccaagtctttgttattgtgaacagtgctgcaataaacatatgtgcgcatgtgtctttatagtagaacgatttataatcctttgtgtatacacccagtaatgggattgttgggtcaaatggtatttctggttctagatccttgaggaatcaccacactgtcttccacaatggttgaactaatttacactcccaccaacagtataaaagcattcctatttctccatatcctccccagaatctgttgtttccttttttttttttttttttttttttttttttgagacggagtttcactctcattgcccaggctggagtgcagtggcacgatcttggctcactgcaacctgcacctcctgggttcaagcgattctcctgcctcagcctcccgagtagctgggattacagtcgtctgccaccatggccaactaattttttgtatttttagtagaaatggatttcaccatgttggccaggctggtctcgaactcctgacctcaggtgatccacctgcctcagcctcccaaagtgctgggattacaggtgtgagccactgtgcccagcctgtttactgactttttaatgatcaccattctaactggtgtgagatggtatctcattgtggtttcgatttgcatttctctaatgaccagtgatgatgagctttttttcatgtttgttggctgcataaatgtcttcttttgagaaatgtctgttcttattgtttgcccactttttgatggggttgtttttttcttataaatttgtttaagttccttgttgattgtggatattagccctttgtcagatggatagattgcaaaaattttctcccattctgtaggttgcctgttcactctgatgatagtttcttttgctgtgcagaagctctttagtttaattagatcccatttgtcaattttggcttttgttgccattgcttttgatgttttagtcatgaagtctttgcccatgcctatgtcctgaatggtattgcctaggttttcttctagggtttttatggttttatgtcttacatttaagtctttaatccatcttgagttaatttttgtataaggtgtaaggaaggggtccagttttagttttctgcatatggccagttttcccaacaccattcattaaatagggcatcctttgcctattttaaagcaataaaagctgacaaccacttgcttctggcatccaagatcctgcatgagaacaggcttaaaaatgagacagatctgccttcacacattggctccagcactcatctgtggatgttgggagggctgtttcaattatatgcctcagtttcttcctttgtaaaagagaactattgttaggggattaacaaaagttctgtttgtaaggttttttttctaccttttgagtattaattaaattgagctcaattcaattttttcttaacttggtcatgtctgacacagtagactggggtcagaagcaactaatgccagggcctaaaatcaatgtattaggtggacagcaaacagaattaaaatgaaatctgaaatatctttaaactaccatataagatatggtactttttatgccctctaaagtctatatgtaggtgtctgggcattaaaaccttgtctttacattagtatcagatacttggccaaaaaagagataggtagagttttaggaggtgtcctgcttgcctttgaggtttactcattacatttcaatatggagctgcttctatgaccttaatacccgtaaatagattttaggatactgtggggattaagcacaatagatgatagattcatatcttatgggggtggctaggatgcaagttatgcatatgacataatgtcatttataaaagcattaaacatattctaaaaaagtagctatttttaggtcacaaaggtcttggttagttttagtaatatttatctactctaagtccactaggctacttgataagattgttcctcattttctgatcctatccttagaagaatcccctctccttgacctggccgcttggtcttcttttttgccagttactttacactaagccaaaacatgggcaattttttcaccccaattacatttgttctgatgcaaatgttcttattaaaacctcaagggccattcaaaataaacatgtccagattttcttttatcctttaaggtcagctcttatctagcaaacccatcagggctgcactaatgatgtcaaaggtcaggtctgtcaaagacacccagggtcatttattataatttaccactcttctgagggtttatttattgatagggcttaaggaactccaaataaatgaatacataaatcctaggacatgacaacaacaattaaaaagaacatttgcttatcactgatgtcagttatctaaattgccatggtaatttactgctccagcctgctgaggacaatggccacacctcactaagctggttcatagccctgttccttacagtgaccagccacacccttctgaaaatgaatagtagataattaacatcccaggatgtaaatgtcttatctcatgattcacagtaggtgaagcataaatgcctgaaatttaaactaagttcattaatatcaaactcatagatcagctactcaagtgtttttatatgtgttatataaactatattatgttttatataagtgttatataaactataatatattacataaactatattatgtaaactatattataaaacatattatatatgttttatataagtgttatattatataatggactctatccccgtcaatgcttcttagaaaagaaaaataaattataaatccaaaagcaatgataccagaacccctccatggtagtaaagacacctgatagaaaaagtaaaatgatgaagagtcctgatgtataaggtgactgacttctagaatacatgaacctatctgctagatttctagcaagaagaaaattgagcttgcagccctggacctgcacccccgtgatctcgaaggagcccatgctttgctgtagttgctggcttggtggcacctttcttgatcccctcagaggtccctttccacctagaatctaaagaccttgcatttgttttctaacctgtttggtgctccgtaggtgttcattaggcttctgtaggctaaagtttctaaccacatccctgctttcaaaaccaggaaaatgttttaccagaaaggaaaacaaaagcaaaccacacttattataccggacactgtgtagcattgtgttgggcaggcaggccatgtacagaatatttatttgccagctgggacgctacacatatcaagaactacacaaacacagctatgacatcaacttcttccaactatggataaaagctctcactgtctaccactcacaattatgctttcctatcaaactgctgtgttgacaagaatttcactgggaaatgactagcaccttctcaaatgcctaccacaggcggttataaacgtatcattctaaagtcaagaaatgagtatttgtaaggtaaattacttccccacattaaatccacctgggcttctgggggccctggtatgcagtgtgtccacaccacagtttacacatggagagctctgccacttcctctgtacttctgagaattaatagaagagctgtgtgacgtgtaatttttttaatgagttgaaagtgctaactttgcagaatgcctaacattttaatttcccaaagtcaggaagttcactgatgcagacacaattccaagcagttcttgttagtaaattacaattttaaatttgtctactgtggcatgaaccgtcttcagcaaggagtaattctaagttcagatttgaactgttaaaaatccctatgagaaactccaaacttacaaagagaataaaaactaaaatctataggaatggttgcagtaacttaataatccaatctactgtattgataaatatatatataaatttgcatttctggactaggccatatatatagtattgaattgctattttcaaaaggaagaagtaagcagtgattaaactattcatattatatgctatccatgacaaatagatcttactaaaaattcattataaagattataaaagttaggccccatgtggtggctcaggcctgtaatctcagcactttgggaggctgaggtgggcagatcacttgaggtcaggagttcgagaccagcctggccaaatggtgaaaccccatctctattaaaaatacaaaaattaggtgggtagggtggcgaatgcctgtaatcccaactactcaggaggctgaggcaggagaattgcttaaacccaggaggcagaaggttgcagtgagccagaatggcgccactgcactccagcctgggcaacagaatgagactccatcacatttaaaaaaaaaaggaaagaaaagattataaaagttaaaagttatcaggtctcagtaatacaattgtatttcaacttaaaaggtaaatataatatgcttattgtcttagcattttttgagatttcttaagtgttttctgcttcttctgtatctttctatgtgtcctgttctctgtgtctctctctcttgtcataaccatttaatgtaaagcctatttcaaaaatatattgtaaaatgtggggggtggctgctttcacatcagtttagggatgatataaagaaacctaagtattttaatatgtacacagtacaactggtcttccaatactgattctgtagtattattaagtaaaaactgatatttgttattaatgttaagtttttttagatcagacatatattttcaattattttcaatagcaacaaacacgccaaatcgcttaccttttttttattatactttaagttttaggttacatgtgcacaacttgcaggttagttacatatgtatacatgtgccacgttcgtgtgctgcacccaattaactcgtcatttaacttacctttcttattcaatgcaatccatgtcatttagtgtaccacagaactccactttttaaaatgtagttttgaaaacaattaagtatgtgcttatgaacccaaaatgtccaagttatttctggcaccttaagtgattctgatggcttctaattactctttagtaatgcattctggtgaaataacatcaattttgtaaaggtcttaatttgaaggcaccaaggcattgattatctccagcgtaggaactactttttcaggccagtgagactttatccagtgtaatacatatatattatatgttacacagtacttacaatatgaactactatgtatgagtggtataaaaatgtaatagagcttctgaaattgtttaagaccacgattatatttcacaaatgaaattacacaatatcacataatgaatccaagttatcacacagtataagagtttaaattatgattgcaaggacagatatgtgtctatatatctgtatgtgataggcaactgggaaataatgtaaaactataattcagttccaaatccccatgtcttcaaaatacttgtgttactggctataagtcttgcaccctagggtttcatacaactagggttttatacaagtattttatgcaaatacttttttggtaatctaatttgaatcaatgtgaccaaagtcagtgacattgctagttcttaaattcagagagccatgcttccaagaccatgctgtggcctatcctcaacagttctttttaaaaaatgtcatttattattataaacataatggaatactaagcataaataatgtatagaatagaaagcatatagggttgtttgtttttttcttgtaaatttgtttgagttcattgtagattctggatattagccctttgtcagatgagtggattgcaaaaattttctcccattctgtaggttacctgttcactctgatggtagtttcttttgctgtgcagaagctctttagtttaattagatcccatttgtcaattttggcttttgttgccattgcttttggtgttttagtcatgaagtccttgcccatgcctatgtcctgaatggtattgcctaggttttcttctagggtttttatggttttaggtctaacattgcagtctttaatccatcttgaattaatttttgtataaggtgtaaggaagggatccagtttcagctttctacatatggctagccagttttcccagcaccatttgttaaatcgggaatcctttccccgtttcttgtttttgagtgggcaaaggatatgaacagacacttctcaaaagaagacatttatgcagccaaaagacacatgaaaaaatgatcatcactggccatcagagaaatgcaaatcaaaaccacaatgagatatcatctcacaccagttagaatggtgatcattaaaaagtcaggaaacaacaggtgctggagaggatgtggagaaataggaacacttttacagtgttggtaggactgtaaactggttcaaccattgtggaagacagtgtggcgattcctcagggatctagaactagaaataccatttgacccaaccatcccattactgggtatatacccaaaggattataaatcatgctgctataaagacacatgcacatatatgtttattgcagcactattcacaatagcaaagaactggaaccaacccaaatgtccaacaatgatagactggattaagaaaatgtggcacatatacaccatggaatactatgcagccataaaaaggatgagttcatgtcctttgtagggacatggatgaagctggaaaccatcattctcagcaaactatcgcaaggacaaaaaaccaaacatcgcatgttctcactcacaggtgggaattgaacgatgagaacacttggacacaggaagggggacatcacacaccggggcctgttgagcagttgggggaggggggagggatagcattaggagatatacctaatgtaaatgacgagttaatgggtgcagcacacgaacgtggcacatgtatacatgtgtaacaaacctgcatgttgtgaacatgtgccctagaacttaaagtataataataaaaaataaataaataaaagaaaaaaaagaatagaaagcatatagaaaaagaaaaaaaatacttgtaatctcattatcccagaaaattcataagtttcattcatcttttactaagcatacctttacacgcttatcactaaatacatatataaatccatattctgcttttccatgttaaaacctcataaatattttagcggacatcataaatgatgttccatttaatggaagtactatgtgttacttaaccatcatcctaatattagacttttgggttttacattttttacaataacaaagaatatagacatagttggcatacagctgctcctcagtatccaaggaggattgattccagaaccacccctgaccatcgacaccaaaatcagagattgctcaagtcccttatgtaaaatggcatagtatttgcatgtaacctatgcacatcctcatgtatactttaaaccatctctaggttggttataatacctaatacaatttaaatgttaaataaattgttatactgtattttaacattttatttttaattgttgtatttttttattgtttttaaaaatatttttgacctgcacttggttgaatccacagatgtgcaactcactgatacagagggctgactgtatatatttttagctattcatactaattacttaaaacttatgcattcaagtagaattattgggtcaaagggtatgataactttaaaactcttgacttatattgtcaaattgcttccccataaaaatttttattcccattagcaaagtacaaaagtttccacttaactacacatttgtttaacatttagcattattatatctttaaagtattcattagttttataagtaaccttcaaagcctttttatgaaaaatttcaattggtgtcaaatttgaggaaagaaatagatttctaacatgtcttatccaaacactatcaaactggtaaacaatttagaaaacttttgattaatttttcagttgaaattaagcattctaaaaactataaagcccataataaaactctatattcaaactatgagtcaaaaatgatctctaatatatattacttaggtataatgggaaatggaattgaataaagaatagcccaatcagatagtaaaagccattaattggacatgttaaaataaatactgaacagacccggcgcagtggctcacgcctgtaatcctgctttgggaagccgacgcggcagatgacgagatcaggagatctagaccatcctggccaacatggtaaaaccctgtctctactaaaaatacaaaaattagctgggtgtggtggtgtgtgcctgtaatcccagctactcaggaggctgaggcaggagaatcacttgaaccaggaagtcagaggttgcagtgagccgagtgcaactgcactccagcctggcgacagagcaagactccgtctctaaataaatacatacatacatacatacatacctacatactcaacaatactgtaagttccatttcttaactttcaatcttttcctataattatgatttaagtatgtgactcataaacagaataaaactgagtttttttctacaattttggatttccttttacaggtgagtttaattcatttacattatgatccctgatatatgtagctttatttccaccatctcatttattgttttaatttactagttttccttttgccaatttcctacccttaaaatttttattttgaatttatgcattcaatttttatgtgtgtactcaagtcttaacattttagctataacagtggaatcaaggaagtctaatgtaaataccattactattcttttcctgagcaatatatagaaaatggaaatttttaacttagtttgcaccttcccatattccatgttaatattgtctaccatttagctccatcttattttcagcttctcctcaattggtctcatcttattttaaggaaccaattgttgtttttcattttcagtagtttactcagtaaggtttatgagtaataaatcctctctatcttgattacctgaaaatcttttaaattttgttcttttattcagtaaatgttggattttctcattctatcctccattagttttattctctcttttacatattcacttatgtattaacaaaacttccctgtattgtgagaagtttcataagatctacattccagtttataaattttctcttcagctttatctaaagctgtatctgatttttcatcttccaatgagttttaaatttcaatcattatgccttcctctctagacattccatttgtttttttctccaaatctgtctttttaacaatattctgttatttcatttgtgcttatgttccttttaaaaatatggtttgtctttttacatctactttactctatagtttccttcagattgctctatgagttcatgttagtagactgctaactcatttattattgctgactctcccttacagtggacaattttcttgggtgattgggaactttgtattgtaagcttattgacaggtgtggcttatttttgtcttagactaatgaacttagttatgaaaggaaacttagatagtggcttgctgtttgctctgctggtgtcctagaagcttaattatacatctttcgtgttttgcttctagcactgtatcttagattccataccagagctagggtgaggttatggttttactatgggttttatttaaatgaagtcttcatttcccttttcctaccacttttttctatgtcttcccttggctggtgggcaaaaatgttatagttgtttcttgtgggtaggtcaggcatttgtgagtttcagctttctttagggttcttatttccaagtctaggtctcacaaagccaggacttcttctctgtgccaaaactgaaaccctgatttccagtccccgggacccatgtccatatccagctccccgctcctggttatattggtgtccactcacaccgttacctctctagcttggagttgcagcttcatttttggcatttgaggatttctctaatttctttcttttggaccacgtattttctctctctctctttctgcatgcacatgtatgtctctactaagtttgcaatattttatccaacattttaatatattttcagtcaaaggtgtttgtattaagcgcttaacaaggaaatatatctgaattcgttttgaacaaattaacaaataaatatcaacagtaatattttctatatatttcacattgtattcctcttaagtaccaagttagcttttgaaaaaatattatgctacattatctaggtaactctgaatcctactaacatccattatgaactctgaatttctcctatctagcagtacacctacatttatatcagaattatttgtatacaattttgaatagattcagaggttgtagttcttacctggttcactgaaagtagactagctttattttgagataaattgtgatatcattgaaggactatttattaatgcattccagacactaattctcccaaaggaaataaatattaaatgataattcctaattgctgattacaactttctggctatcttttctactcccattctttttcttaatactgaccttgtccctcttgcgaactttgcactttcactgttagaagcctttgttttccaaaataatggccaaacaatattatttttttacaagactttggcagtaatgctgtcccagatacactaaactaactggtaaacagaaactatagctttcactgtaaaatactgtaattacacagtgcagaatatctctgtggttttatcactgaggaaatcaatagtgatatagactacaattctctgttggactggagtggatacaggagggcagatgaaagagtttattgacttagtagggattgttactatagcaaatcagagctgcagaaataaatagctttaaatggaatgattttaacccgaacagcaaaatgtttccatcaaacaagagacgtgataaaaatacaaacaaaaacaaacacaaacacaaacaaacaaacaactaaaaaatctcctcctatagcctcattcctcttccctgtcaatagacacacacttcatgccatcattactggcaaatatccaatcataaggaaaaaattctatgaatgcctaagaaatgatctagaagctaaggggttgctatgtcatgaaagtcttagtttgaatatatcatgtttgtatttgtcataatttaaaatgtgacattttctatgactaataaaaggttctgtctcgtggcattgtattccttgttaaagaggttgttctgaggatttgtaaatatgcacaatggaagtagtaggcattaaatcacccaagattgaaatagtacattgagagagaaagaacgtgaaaggcagaaagatagaaaaagtccaactatttctactttgcaatcgcatgaatcagtttgttctagagtaaaggaaaaatactaagtgatgaaaatgttaaaaagactaacttgtatgtggtatgttgctattttaatcctcaacccaaacaaactctgtacctctagataaatggttagcaaagccgattttcatttatgcatttctagtacaaacttgtgaggttcacagtggcaggccccacatcattaccagaagctgtgctttatacactcagcagcagcccgttcttggggaatgcagtgtaccctgaacataaaaataagaggcctattggatttttattctgtgtgagcaacataattgtttatttgtattttaagtaagatatctttctaaaggttcctgtgtgtatagactctgaaaagtaaacaggatttcataagtgtggtaaaaacaaaatattttattcttaaatgacaagtacaaatacctttgcacaaacaccttcagctgcttgtattctgctagcaatgtgtaatgtattatgagaaatgtcaacactagacaaccattagttcagatccaaagacagcacattttttgatccattaatctgaataggtatgatttcagaataattcttaatacctcaatttatggtcatgaaaagagatagtaaactgtgtacatctgagggctcctcaataaaggggtcagagtttgcaagtatgaaatcaaactaccacttaattaagaaaatctaaagaacaaagacgtgaaaaaaatggagaatatctagcttatagcacccattacattcctgagccaatcttcggcactcattttaaaaatgtatgctttatcaatatttatttcctttaaataaactaaatcatacccgcattataatttctaatacaaacccagaattttcaagaggttgcagagatgttctcactaaacattcgttctaaggtaaatctacctacagaaatgtttgtcatctttacatctattttacactccatggacattttcgttaggtacctgccatgaattaagaataaacggcttacattttagaagtcttgttttgactctgtgaggagtttagagtgctcttttgtgctttctgataaaactaagtaatggttcccttccatataagtgatagaatcaacccttgctcatgaaaaagcaatattgcatgccatttgttagccggacatagttactttttattctggttcctggaaaattcgctttttccaattttgagagcaagctagaatattgctatgttattgcattttattgttgttgaaagaattctttatttctaatgtttccttaaaaaactccaaatggttcaatctccagccccctcaatgtctgcagtttgcttaaattgacttactctgcatgcaaagcccatcagtgcagttcttggattgcaagacgaggccgtcgcagtccttgcctccattcttgggggctggcgccgtgcactccctcctgcgccagtgggtgcactcagttccacaagtagaccacttgctccatggcgtccacctgccatccactgccatggaaaaaatgcagcaggaggtcagagggagaggcagctgcttaagggatggagcagagctcaaatataatacaacaaaacaaaacaagaacaagcatgccctactgagaagcactgtattcatttcaattgctgggaactgcatgttctacatcatttgggtttggtgagcttttcctatagagtgtgtgagtgctttctcattgaccaagccaagggaggctgactgagacatacaaaatccaaagttgtcaccaggagctatgtaaaagtaggccatgatggtttcccttttcctattaatgggggagcttctgggttttgtattgaaaattaggagggctctctttggatccaggattccttcattcctagggccatgtggacagtgaaagtaagctcatgtgagaattcagagaagaggttggtacggtggagaagaaatctatccaaccttccattcattcatccagttggtatatatctatttatctcttctctttcaactgcattttatatagtctttttattttacttttttcatctggcctgcttgattctgctgaaacctgtaatgttttcatgaaaacactattatttttcatttattatttgatgatgtttctgtttctatttttattaaaaaattttaggtaagtccctaatatttcttgtgattcagtcatttagaactgacttactttcttcctaattttggtggctggcttgtcagcaacttcaaagataatgaacttagatatctctattttaaaagcacacaacttaagtctcagtttgaaaaaagatatagtaaatttcaatcacacttcaaaatgcagcttaagcttctcacaaaaataggataaaaatattgaaataagagctttaaaatattaattttccctgaaatatataattatgatgatcaaggattcaatgtaaaacaatgctaaacatcatttcttgaacaccttaaccttttatatctacatattagtaaaaattatatcattttaatagtctacatagtttgagaaatctaagtgatttcatattcaaattattatgtaaatatattgtgtataatgtggatatggttataaacatacccacatgaaaaatgagaaaagcattaatatttcagtcatacagaactggctgtataagcaagtcccaactacttagagcaaaaacatttgctttgacctgcaccaatccagtgtaccaaaacactgacacacacacacacacatttctatttcaactctaattgatcagtgcatttttaattgtgggagtcagctcctataaaacaaaatctgaaattttaagctagctaagtgtcaaaatttgtttcataaataaaagctctcaaagggctcactgtgggagactgctctgacatttggaaatcaacacttgggaatgtaaagtgtagattatgtatatctctccagttcatttgtccagcccatctctgagaaaggttaaaagataaaggttaaaggataaacatgaccaaattaggcaaaaaggagaagtaaggaggctgtgtatctgaacaataaaattgaaaacacaatagctactccaatgagtgcagtaaatttatggattatttcaaaattttagcttagctttggaatatattgtataacgaggcattttaaagggttttgtttttgcttttggcaaatattatcttcgatttacctagggataagagctggtagcaatatgagatagtacagaaagatgctaagaggtggagagatgcatgcactcttgctgtaggtactacagcaaataacaaaaaaatagatgaccaacatttacagataacaaagaactgactgcattgtagtttcagaatccattatcccaagtaccaaaaaactttgcattccttataattcatttcaaatgttgtatttgcccttcaccagaaactgacaccaaatataaaatatttccatctaaaacattttctaaatttcagttccaattaatttctacggttttctgaagatcaaggattgttattcctaaaatgtgtggcttccagtgccattcaaatcctttgaattataaaatctgcaatcttggccccagcagttttgttgaataatataaagggattatatccagtagtgtttaatctcctgttttgtacaattttgcatgttttggtaacaaagttaagtattcttttggaggaaaatacttgatttcccagcaatgtaaacagtgagtaggatggatttaaataacgttcatcacacattcagatcaagaataaagtctgtgtatctattctctaaaagcatgtttcttgaataataggagatacttggaatgagaggactggtttatttacctgggcataacgtagtacaggctattttctgcacactctgcccttcacagaaggcacccccattgagtggtgccgggttggtacaagtccttgtacgtttctgataccctcgtccacagcggctgttacacacagaccactccgtccaggtggaccagccaccgttgactgaaaggaggcaaacagtaaaaagtggattaaacatgtgtgcatgcacaacacacatggacacacaaaacagacacaatatgtaaacaaagagttattttccaagcgaccattataaaaatccaaaatttcaaagccagaagagaccatggacctcattttatccaaagttttattgtatagacagagaaaaaaaaaagtttgtcaagatttactcacctactcagaaaaataaataggactgtatgtgttctcttttctttggccagtgttcttaaaaaatacacctatctcctcacctagtcaagctccaaaattacttttgacagctcgtctcaaataataaatgtttacatctctatgaaaagcctgcaagtcaatctatagcatgggaacagaataaaataatttagccttaaaaaaaagattgattttttaagcatatgtaaactttacaacgttttaaggatttttattcacttgcacaaaccagtgaacctggttaaaaaataaaatcttacagtactggggttataaacaaattgactggctatttgagttacttggcgattagttgatattgaaataaacacttactttgtgtataaaggccaattatgatgtctgatggagctgtcagcatatgtgattgtaaaacctacaccgtaagactgcacactattcagttctgcagacctctctttagaaaatactttgatatatatttttaatacttcaataatgtgagtctgtacaatattgtaattaaacaatttctaacaaaattatttccttgtagctaaaatataatacaactagtatatgcatctgtttcctgatactaaagaagtgtattagccattcaagtaacacaaaccttatatgtgcacagcatttgcccaatattttgttttctagaaacctatacaatagggaataatcatgaatgttatatttacagacagaaacattttttacagcaactttatttaatataaagatgaataattggaaacaactgtaatgttcaaaaacaagacaatggcaaagccagccacatatgttcatgtaatggactcctggacagccattaaaagtgatactgtagaaggctatttaataattcatgaggctgggtgcagtggctcatgcttgtaacccaagcactttgggaagccaaggagagagtattgcttgagaccaagagttcaagaccagcctgggcaacatagcaacaccctagctccacaaaaattaaaaaaaaaaattagcaggtcatgtcagcatgtgtatatagacccagttactcaggaggctggggcagaaggatcccttgagcccaggagtagaggctgcagtgagctatgatcacatcactacactccagcctgggcaacagagtgagaccctctctccaaataaataaataatacatgaatgtttcagtatgttttaaataaaagtaatgtttatggatacattatgcataatgtatatgtatataattttatataatatgtatacaatacttaatatgtatttatacattttaaattataaaagatgtataatataacaatgtataatgcttatttttaaatcttatgtatacatataaagtactggtagtatatgccaggtgcagtggctcatgcctataatcccagtactttgggaggccaagatgggcagattgcttgagtctaggagtttgagactagccttcatctctacagaaaatacaaaaattaaccaggtgtgatggcacatgcctgtagtcccaggtacttgggaggctgaggagggaggatcatttgaactcaggagacagaagttacaggagccaagattgcgccactgcaccctagcctgggcgacagtgaaaccctgtctcaaataaaaaaataaaaaaaaaagaaagaaaattcaagtagtatacatataatttttgtttaaatgctatctctgggtggcagaattataggtataggtattttcttctttgaccttttctgtattccaaattttctttaatggatgtatatttgcaatctaaaaattacattaacaaaaaatatataaaacagttgctaaatatgaaatactggttagatatatatgttttctatggagttctggtgagtccaacctatgaggcttggacaagttattttaggagttaatgtaaaggacaagcagatggtagataggtagggtttcagtgagtgttccaaaaagcaacttaacctgctcaagtttacaaaattccctgccatggaattgtctgtataaactgcttactagcatactggcaagctgatatttggggtttaggatatatgtactgttctgctgggattttaatgagaaatgaataatcagaaattttcagagatgaaaaagtctttgaagatcgtaggtttatcccttcatttacagagaaggaggcaagggctcagagaatcctggttaaaagaccctctgaagatcaggtagtgacagaaatactcctatgacccaatattcctgaccccagtccaaagctatttccttaattctaaatactaagttacttgcgtttgatccttcctaaagacaacacattcattgtatttatggatattgaaagcataatatacataggaagagatttgcatgtgcattaaacatctatataatacaactatatatagtctgccttcattagttatttatgactggcacatgctgtgattgtgccccatttctttcttgcatttcaaatgttgttaatcaagtctttcaggcagtttaaaaagagataagaagaagaaaacattttattgtgatttaagaaaggcaattgcatacaattcaacacagccattatctggactaggaaattaaacctcagggtaatcagaggatcaaaaaatttttgtgccatttttcctgtaattaaaatgacatttttaaagcagcactacattcatcctttggaacagcatagtggtttctcttctcataaacacacatccatctgaatggtactgtggggtaggcaatattttacttccactcttttaggattttttttttggctgggcctaagaattaaattggtgtaacacaaatcaacaggagaaaaacatgtaaatttacttaatataacttttacatggcctaagaaaatgaagacccaaagatgcagttatagttgaatgcttatatattgaattggacaaagagtagcaagttatgaaaaagtcaattatgtgttaaggctaaaagaagattaagagttattttaataagatcgatacagaattatctggatcgtaacttccccgtggtctcaacttcctgtccttgaggataagaatgttactttccttctggtatagggaagccatctttcagctgaaaatctcctctcctgcttttaagagacaggactagcagagtgatcttgagcccgctgtttctcaaggacctttaatgcagaaaatagtcaatatgccaagtggcatattttggggtgacaaattcttaactccttcagtcctatcatgtaccccataacatttcagtcaaggacagacttcatataccataatggtctgttccataaggttataacaaagctgagaaattcctatcacctaataacctcatagttgttgtaacattgtggtgtattactttactttttctacaaatgtgctatagcctaagtgtagtgttcataaagtctacagcagtgtagagtaatgtcctctgccttcccattcactcactactccctcattgactcacccagagcaacttccaggcctgcaagcttcattcatagtaagtgccctatacaggtttatctttttttttatctttgatatcttatttttatagcaccttttctatgtttagatatataaatgcttaccattttgttacagtttcctacagtattctgtacagtaacacagtatacaggtttgtagcctaggagtaataggctataccatctatcctatgtgtgcagtaggctataccatctaggtttgtgtgaatacactctatgatgtttgcccagtgatgaaatcacctaatgatgcaattctcagaatgtgtccccatcattaagtgacacatgactgactgtactatgagccacatacttgccagtgggtctccccctccttcagtcagtaagactccaaggcccacggagtttaacactaaaacagtgataaaaatcttcattatgttctaagaggtggtgaggcatggggacatcattctggaggtagcataacctctaaatacttcccaggttgttcaatttcctctgagacagtaaaacatcaataatatgaggaactattagaggtctaacattgtgagaaatatgtaaatatatagaccagtctctcagtctatcaaggagcttaactttagctggggagatgaatctactcatgaaatgactagaaaataactgagtgctaaaccacacagggagataaaagcatatgtgccacatcagaatggggtatgaaattgcttagtacttccagagaattgataggtttagagatgagctggcttagaaaggaccagggtgtgggaggaatcttcctaagaagttgcttcgttggactttagcatatcgttaggattagggccacttggccagataaggcagcccttatcttcactctgcacacctctgatggagtgagtagaatgagttataagaagctaaaattgctctaatgtattttgggaataggtcagctcccgctttctgagggtttgcaatgataagactgaggtgttaggtccacagaaacatcagcaggctgacagaagcatattcatctttagaactcaatctagatcttggtggtgcaggttctggagagaagagggcttatagaagcagcaggcactcaggtaggcttccttcgctttcctagaagctgactgagaaagggctgaggttgtctgagcctatcctttcatatcagtacgaggaaagcaattaaacctcattgcccctgtgaaaagcagcaagcaagcagcgatggagattgaaaaggagcttctagaaccgggcatggtggtacatgcctgtaataccagctactccagaggatgctgaggtgggagtatcccttgagcctaggaggttgaggctagagtgagctacggtcatgccattgcacgccagcctgggtgacagagcaagaccctgtctcaaataatatgaaattttaaaaaaagggcttctagctttaccgatgccaacgagaaactgcagttaaacatgaactagattgagaccctgaagggccactcaccatagactatgacagtggcagttgtacttttcctcttggcaacaatgtttttggcaacacaggtgtaatttgcagtatcagagagtcgggcctgctttatgatgaggttgtgatcaatagtaatataaaaattccgatcttcaacgggatcaattatgtcttcatttttcaaccattccacctaaagataaatgagaaaagtagataaatcctcagcatggatcccctgatggctgtctgtcctaacctgcattttgtacacttgatcttagccaaaaggccgagaagcgatacctgtgttttgtaatatgtacaatgttgttccaggccatgaacttctgcaaactggtgggaagtaactttccaaggtcatgttaagtatcactcacctgccaaacatgctgattctgtctgtactacattattctcaaatgtcagtgaaccagttgggaaatacagtgttcaaattgttttcactttgccctgcaggcacgaatggggaatgtgtgctgccaagttcagaacccaataaaaaataataggataagcgtttcaaactgaactcaaacctttcactatttgatttgtttactcttggcaacttacctgctgcttttcagaaaagaatagaaagactatttttaaaagcacaaaaggcattttagacatcacatagctgtaataaaataacatttggatggtttacgtgtagcctcactgaaacgtatggattaaatatccctgaaaatacctttcaaaatgtagcaaaacacatagttggagatgtatctaagccaaatttttttttaagtttttctaccaattcttaatacaatctgaatagcttacaaatcatactcaaatccctccttttgtataatgctaacattcaaatctttggctcagggtgtgcttttggggaacctgaccttaagacatgaccatttaaaactactgaactatttttttctatgtgaataatattaatgtagtaatagtgatgttatacttgctgaataaaaagaggaaacatacctgtataagctgttcttctggaggtaaactacttcttattctggcagttgccttttgtttttctatgcacagttttttccataaagcaaaacaacaaacaacgttgatatttaccacacttaaactctccttttgcattagggtgaatgtggatacaggtaacctttagtggtagggagtcaatattgttgccattttcaaaaccttaaggagctactctagcaccacaagacgtctagaaattaatctctaaatctgtcagtgggtttgacattgcacaactctaaattacacttaaggcagggactctcaaataatgctcctctaatccttagaagagaagccaacatttatagagaaaaataaaaatcaacaacaatcctgaaatatagaaacatatgaggttgtagagtagagaaactatttgtaatgatgtaaatgctgaaaaagctaaacattcttgatatttgcactcagggtagtgagaaaaagaatagaatctatttacaacagtgggtgttttaaatatgtattttgtttccaaatacagactctacattcagtcagagatatgcctgagtatctctgagatatatactcatattcacttgacctggattttctcaacgtttcaccctatgtgtggaaatacgatcctgctggaagtgcacgggagaaggtggcacaatttatactgttaaaaatctctttgatgataattaaaagttgaaattaatagtttttgagtggaatctttacctaggttatctatgcccttctaaagaaagcctcctatcacacaaagcatggacaggctcccttagtctcagttgttcttgcatcccttctacaatttttgtgctcagtgtgcttctctttcaagtactcatacctggccctcttctctgaagagcagccctcaggctcacggattgtttttgccaaggattttttataacttccccattagccccattagccattgactaatgggtgcagaaatatgacttctgtctcattgggtcagaatctgagctgtaactttccagaagtcccttgcagggatgaggctgcagctacatccttgagactggacctgaattgacactattataaatggagcatacctaatccaaaaatctggaatctgaaatgctccaaaatctgaaacttttgagcaccaacgtgacaccacaagtagaaaatcccacacatgacctcatgaccggttgcagtcaaaatgcaggtgcgtaacacacagtttattcagcatccccaagggaatgacggtgacaccaaacaaccatagattgtccacatgagtgactcacatagtgatccctttgctttctgatggttcagtgtgcacaaactttgtttcaggcacaaaattgtttaacatattatataaagttaccttcaggctatgtgcataacatgcatatgaaacaaatgaatttcatgtttgaacttgggtcccattcccaacatatctcattatgtatatgccagtactccaaaacctgaagtccaaaacaattctggtctcacacattctgtataaggaacattcaacctgtactaggcttctttcctctcctgcttgctcacccacttacagggttctcctggaagcactttcttaaaaaactactcacattcatacctttggttcatggtttgcctctggagaacccatagctattcaaaactacggttcctcctatgtaaatgatgtcagtttaacagtgatgttatcctaatcataaacaacataaagaagtcccaagggatattagaaaccacttgtttgtatgaagagtttattacatggaagaaagtgttcaatctgcatggttgacaaaagatttgaagagacatgattgctgggtatatgatcttcactcgattatacataattacacatttgccttgggtgtctcttgcctgtgttggagcagtggttctgacctgaacctcaggacccctgagaagccccagcagtgtttgacgacccctgtgggggacactgctctcctcccttaactcccacttgaatcacagaaactctgcttttatctgttttccatactggatttgctttcacgcctttgtttcaagaagcaaagggtcctacagctagaaaatagctgcgggaatgaagaggggggcccaggactcctccagcttctgacaagaccccacagtccccaacaccccagtgctgccagccatatcacagcactctgctttgagacaatcatctccatgaaaggctcagtgaggactgcaggccgcccctcacctcctgtgctgtaataccaggggctacacatcaccaactccagaagtcctgacactcttccataccgcctggaagacagcatgaaaatcttctaacattttggtctctttttagattgtttcctttacgtttttctcatactaaagtctaggtctttctgatgccattgtttcttctgaagtcctctgaaggggtggatgttgatttcccaaatccaatgtgccactgggtctggggatgggtaagtgctgtgcttgctcagcattgtgtctttcagactgttctctctaaacatctttgccttgaatctcatgtcaccagattatatcacccaattttgactctttttttgtttgtagttatttacagacctctgggcttatagtcactttatctaaagcataatttctgaagagtttaataaccacaaaggtgacgcttccaacgtcttggcccttcagttccatgaccctccatcctgcaatgaccttatcctctaaggtcacacattctaggccaaaggttttcaactccgcttcacaatagaataatgtggaaaacatttgtaatatattaattctaaattcaacccagagaagctaaatccaacccacaaaaactccaattcactggtctagcatcagtgtgttttaagctccccaagggttgtaatttactgttagggttgagaaataccagtctagatcattgcccttaaaaatgcaatccctggatcaatagcatcagtgtcactgggagcttgatagacatatagaatctaaggctctgcccacctattaccaaatcaaaatatgcatcctagtaagaacttcagggggttatatccacactaaagtttgagaagcatgatttagctcttgtccttatcatcaattacaactcctccataaacttagttccaattatcctttcctttacccttttctgtctttcctattcactctaagatactgaattcaataatccttcaccagcacctacaatctattgaatttaccaatttgtttctcagactttcaagtataaattccaatgtctagctttatatatgattcttgcattatactgtcaatgctctcatccctttgtcacttcaagatattcacttggccactatttgcctacaacaccactgtgtgttgttttttgttttttttttttaagacaaagtctcaccgtgtgcagtggtacaatctcagctcactgcagccagcctccacctcctgagttcaagcgattcctgtgccttagcctcatgagtagctgggattacaggtgcccaccaccatgccaggctaatttttgtatttttagtagaaatagggtttcaccatgttggccaggctagtttcgaactcctgacctcaagtgatctgcctgccttggcctctcaaagtgctgggattacaggtgtgagccaccatgcccggcaccccgctctgtgttcttgaggtggaacatgggtgtaaatagccatggagagtgggctcatcttaaaattcataacagatcacaagtgggcctttatttctgccaagaaagcacattatgttttcattgttcactttctccttctcctagataactatttcacactcctctccactacctccccttctagcctcactttcagctgatgaccaagatttctatgtcactgagaaaactgacaatcacaagacatcttccagggctctcccactatctgtgtcctcacccccatctgcaccctgtctcttatcactgggggagctctctgtgttcctatctgtcacctcggatttgtactccgtatcttagtctcgctcttctattcaagggcaagtcccagcaattctcttctttctctcctaaattattcaatttcccttgatactgaatcatttccaccagcctgcagatgtgctgttagctttcaaaacttagaacaaaaacccttctcacccgtttctgcctctactcaccccccgcccaccacctatatttctctgcttgccctgccttacaaaactccttggaatagttgtttacatttgctgtcttcaattccccactgagcccgctctaatctgtgttcacttccactgcttcaccatagctgctcctttctctttgctaaatgtgctgctgaggtcttagtgctcatcttacttgactcacagcagcacgtgatccggttactcccttcctcctcctgacttgctttctctggacagcacactttcctgggttttgtcctacattgcttcatgcctcacagcttccttaggctaacatttgtgtccctgtggctcggtccttggaattctgctgctttctattttctatccatattcacttccttggtgagctcatccagtctcacacagatgactcctaaatttatctccagcccagaccccaccgctgatctccagactcgtatatccaactgtcttcatgcaactccacttggttgtctgataatgacctcctgaaccgcctttccaaacctgctcctctcacagtcttatgcacctcacttaatgccaactgtagccttccaattacttagacaaaagcctgacttagtgttgaccacttttttcctctttcttagcccattcaatgttagagcagcacacattaggaattggaccacttctcattccctcactcccacctcttcctggtccaagtcactatcgtttccttcctgaattattgcaaacactgtttgtcttatcttctgcttttcctctgaaaactcaactgtctattttcaagactgtagttagagtgatccataaactgtaagtcagagcatactatatgtatgagtcagagttgtctagagggacagaactaaataaatatatatatatatatatatatgagtttattaagtattaactcacatgattacaaagtcccacgataggccttctgcaagctaaggagcaaggagagccaatccaagtcccaaaactaaagagtttggagtctgatgtttgaggtcaggaagggtccagcatgggacgcttgctaaatgtgctgctgagggagaaagatgtaggctgggaggctaggccagtctagactttttatgtttctgtgcctgctttatcctggctgtgctggcagctgattagatagatggtgctcacccagattaagagtgagtctgcctttcccagcccactgactcaaatgttaatttcctttggcaacaccctcacagacacacccaggatcaatactttgtatctttcaatccaatcaagttgacactcactatcaaccatcacactatacctcatctcaaaccctcctaatggctccttctcttactcagtgtcagcgctgaagtccttacaaccagcctggacaacatagtgagaccacacctctataagaaacatgcaaaaattagtagagcatggggcatgtgcttgtatttgcagctacttgggaggctaaggcaggaggatggctttagcctgggaggtcaaggatatagagagctatgagtgcaccactgcactccagcctgggtgacacagcaagacactgtctccaaaaaacagaaaagaaaagaaaaaagtggcatagggataggagacagggagaaaaaaaaaatggattcagacaataattggaagggacagaggacaggacatatgagttgacggtatgtggaaaggggggtgcaaggggcactcatcttccatttctggcttaaggacccatttacggagcagggatacaggaggcagaaagtaattgagggtagaaaggataatgattcagatttggctgatctcacaaggaatccagctagcacagcatgattttgacaacaggtaagttgctaaaaattcccattatttccatgaacaaagtgagtttttctcttaaagttttgaaataatttttaaaaataaccctgaggacttctgcttcttttggatcagctttatcttagcattaagaactgaacatggatattgataaaaaggatatttgcagggccagcatggctgcaacaacatttattaccattgtggcttagataaaaatgataaagcgttaataaaacttagaagatgaatggaaaggaaaacagtgtgtgagaataattctgtttatcatgtaaaggattgtctgaatcagcaaatcaatataagagccataacatacaatttaaaacatataaccttttcatgcagtatttccagaacacacactactaaactaacattcttccatgtgaaacaattccacaatgagtctccttatatacactgtatataaaattccaagaaacaatacagaatcttttgttgtgttagaaatttattgcattgaatagtatgtagttaattatattgttgcaaagctatttatttgtaagctaatcttggttaaccaggagtcagtactctggtctggccactgaattctgttcatattttggtcatttcaatgctttttgttgatttcaacctgaggcttctcttttctctactccttccattgaacaaactgatttatacaagaaagtagtctttctgagttagaaattatttttagttacataaaaatattccaagagaaagaaaaacaggttggagttcagaaaacaataaaagacttcaaccataaaccatgacttgttgtcatggttgcaatgatgcaaaataatgttcaaacaatttctgtccttgtggttcagtaactatagtcctttcaatgatttggggcatatttgaactaatttactcaagtgtttataaaggcatgggattttattaacaggtactaaaaacagttacacggcaatattagaatgacctgtttgcctattctgctgttgtttggtgttattagtcccactatgtgtaatcgaccatcttattcttttttttttttttttttttttttttgagacggagtctcgctctgtcgcccaggccggactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctcgaccatcttattctaaggagcagttcctaaagtaccagctaagagggctgctttcaactgcttgggcccaaaactgaactctgcgattttggagctaatgtttatgtctcccgtgggcaagtgtcttatcttctgtatgccttagagtcctcatttacaaaatgaggataattttagaacccattataaggttcttaaaaactaaatgaattaatacacaagacacctactgtctggcatacagttaagtatttgaaaataattattaacatttagttaaggatatactaaaagcggtgagacaaaccccaaacaaccctaaaaaataaaagagaaatggtgttaatctaaaaactagaagaaaaatatttaacacctgagtcctttcagccttcgctggcatttctgtggggcaaagtccactcaatattaggttataactcttcaagattgcactacaaatatgtaagtaattgagtattaaattggccaatattgtttgtatgctaaccctaaatacatattttcctttaaactctatgagtttataattctagagatgtcattagcatgcatttgctttataggtattaacattttaattaatcttcataaaaattattttctaattctaaagtataagaaaacattatcagttttaaaaaaataagtagaaaagatttttaatgaaacacaggttattaaaataaaagaaatattcactatcatacttggtaatgaggcataaatgataggcaatttatattactattatttttacctagaccatctatatttttataatttttaatttacttttatgggttttccatttcttttctcctagtacttcaagccagtctacttgttcttttaatgacatcagtctctcagccccataccatggcatacacatcattagcttcaacacccttatccatgtccctaagagatggaattttcttccagccacctctgctttccctaccaccctgaaagtacacctatgttggtcctatgactgcactggtccccaaaaagggactgtcccccatctttttcctcattaaactttgttttcatgggactcaaaattctgtgacagatttttggtcaagttgtttccattaaaaactatagattttaaaaacgaataattgccacatgcaaaacgaaacaaaaaaaccccaaagtagtccacaaaacagcctcctttccttctgaaggttttacgatgcattgttatcattaaccagtcttttaccattaaacttaaacagccaattgaaacaaacagttctgagcccattctcccaccactgattaagactggggtggcaggtattagggatgacattcatttagccttctgagctttctgggcagacttggtgaccttgccacctccagcagccttcgatccatggctttgatgacacacatggaatagttgtccctgagctctcttctttgcttttctctctccccacagaaaggattctggggcagatgggctggtctaatgggaaaggagaagtgaaaattatgggacacattctgtgttaaagaataatgaccattctttagggtaggaaaagtaggggatgtgaccttgaggggaagagggcaccttgtactccctaatgcaaatcatgagaatcctgacctggctttagggagcagagagagttcaaaagaagaacattttccttgtgctgaaattgggacgacagagaagcagttgggaggaatggagagaagttgcccaagggtaaaaaaggagaaaaacaagaagcttgtatggtgcattccaggtccccagcgaggtgctttgtacttagtgattcctcctcacagcagcctgtgaaagaagtagttgcattcccaattttcagatgagaagaatgatgctcacagagaagagcttgcacaggtttataagctcagaaaggagcagagatccaaattcaggaccgcctgagctctggactcttttctgtccataaaaccaagaaccaggaggagccaactacagtgctacagacttcagccttgacagagtgggctgcagattacgagataggggctggaaaaagctgggacaccaagacacatacattttagctactccaggacttgggttgaggctgtcctcaggctggtgtccccagggaagcagagaggtccttagaaaagaagcattggacacactttctgttatcaacatgaccctgtcactcataggaccaatacaggtttactttcagaactagcagtagaattgggtgtgctttgattttaggggcatcaggaaagcctccttaccctccaaaattgctcccccaaatttttgacaatgacttgaaatgtcattaagagagaccaattttaaattccactattagaaggatctcttcacatgtaaatgacctggagaaataacaaactaaatcatataaagtttcctaaaacatggcatataaataactaagggaacactgcagataaagaggagttcagggtgctaggatttcaagatagggctggattcaagtatccagcactatgcaaaaatttctaagagatatacaaacaaaaatatttttaagggaatcacagtatatctttaacttccatatgaattcctttttttttttttgaaacggtgtctcgctctgtcgcccaggctggagtgcggtggcgcgatctcagctcactgcaacaactgcctcctgggttcaagcaattctcctacctcagcctcctgagtagctgagactacaggggcatgccacgatgcccagctaattttttctatttttactagagatggggtttcaccgtgttagccaggatggtctcgattgcctgacttcatgatctgccggcctcagcctcccaaagtgctggattacaggcattagccactgcgcccagtctgcattccttcttataactaatatctctaagaacttgccctctgcttttcagaagaaagacatcttttgcatgaaaatcttgccatcatatattacatgagagtgtaaaaacctctagggcaccagataagggaataattgggaatattagtgttgtagttgagaaaataagggactgtaataactgggcgacaaatcctttttgcaaatcaggtggtttaaattctttgctttcatcaaaactgaaggagggcctaatatgtcaaatgatgggtcactgaacataaattttgatgacagatcgctatgtaatttttgacctgtaacttggaagacgtgcagagttgagggacactgttacaacataagtccacgtatttctacttacttatgtatgagaaggttctcagtatttgaattcattataaatgacagatagaaatgtaattgatttcatcctgtttcatttcagcagtagcattcaaactaggctaaatgagctacctagacaggcgagcagggatgaaaacctcatttctcctattaaaagctgtatttccaataaaaattcagtctttatgccaagtaattatttatcaaaacttgtagtacatttgggttttttaaaaaaaattaacaatttgatccctatggtcaaaggagataaagtttatacgcaaatttttattacagagaaatatgatgaccaatggaaatttttatgcctaaaatttattctattagagtaaaaacctatgggggaaatggcatagaaatataagttaaaatagaaaaaggaatactgtaagtttccctattttttttttttttgagatggagtttcactctgtcgcccaggctggagtgcaatggcgtgatcttggcccaccgcaacctctgcttcccgggttcaagcaattctcctgcctcagcctcccaagtagctgggattacaggcatgtgccatcatgcctggctaattttgtatttttagtagagacgggggttcctccatgttggtcaggctggtctcgaactcctgacctcagttgatccacctgcctcggcctcccaaagtgctgggattacaggtgtgagccattgtgcctggcaagttttcctactattaaagaagagtttgttcttacattttcttaatcggtaatgttgagtaagacatcattatggtgtctgcattccattggataactttaagtcaacaattctttttaaagatgtcaaatgtttataatatacacagacatggcatcttttcccactatttaatttttttgataatattttttagataccaacataaaatgtgcaaggagatatgtattttttaagtcttttagggatatgctagcaaaaattttaaagagcacttcacaaaggcatgagaggatagtggttctgttaccaagcaagaaattctaccaggggagaatgaggaaggctgagaactgggaagactaaagaacagggtaataggagtgggagttggaggtcagtgaatggaactctccaaatatgtctcctggatgcctctgcagttgtgtttatgctgcactttcacagaagcccagtgagattttgccaaaagacactcaagtctcaaggccaaaagcctagagataggacccagctgtgccattcactgagtctatgctcttcagcaagtcacataaaatcactcaaccttatttttctacttctacaacaagaaaagtaatatctgtcctaacttcctcataaggttcttgtgaggtttgaaaaggatactatatgtcaaagcacttttgatgacttctgtataactctgagctggtgttatggtgatttcttcacatagtaaataatttattctacaacatgtccttattactttaaataacttacaaactaagataaaagtttagtaaacagggaagaatgatatctagcataaaataagagatacttaaaaatattttcaatggatacattttccattaaattctgtcctaaagacaccatctatttatacatttccagatgctagaactcacagtgttcagcataactgaacactgtggtttgtttctttctcaggcaatatgctctggggtgaggatgctgagcaacagtgtgatataattctgtaaggaacaatcttcacattgtgagtctttattcaacaatcaatgaaagaccaacaaaaatagggtcatcctacttcagctgaaacgtgttagcaactaggaaaaaggagaaagtttattcagaagacatgaacttgaaggtttacatgccactctgaagaccatgcccaattgaaatcttgcactcagaaattcactcactggtaactttctaatatttgtcctcgtaggcttgttgagaccctgggtcaccaacaaagtactcaatatttttgtaattttccttaatctgagcagatggcatatgtctgtttcaacaaactgaatagtccaaaagatatcaactcccccaatgctctttctttgagtctcaagtaatacagaaacatgcctgcatctcttctaacctaaaaacaaaccaacaacaaaattaagcctgacacacccaccctccccagctatgcttcagacttctctttcccttagtggctaaactccttgaaagagtgaaatattcccaatccctctctatgcacctgctcattcactcttccatttagccatgtctggattcctgatccccactctactcaaacttcactttcaaaggtgatcagtggcctttctcgttgctaaatccaaaggcatcttctcttctctatggcaaacagctccactgtccctctgaaaagcctccctctgctgtctttcctgccacttgattatctgttcttttgcaaacctctttcactggtccttttataacatccagcattttcatatagtccttctcaaggatctccctctctctcattttctcctccttctactttatatcatggtcctttgtcctgcatcagaatcacctggggagcgcttaagccatcctgatgcctggggccccaccttcaatggttcttatttaattgggcagacaaagggcccaagaatcagtgtaaaaactcctcaggtgacctcaatgtgcagccaggtttgagaatgagatatgcactggttgagtgactttattcactctcaaggctgacaactcacaaatcgttatcttcagtcccaacttttcttaagctctattcatacttccaattactttttagataattccatctggatgctcaacaaatacaaaaaaaacataataagtgctgaatatgatgtgatcgattcacactgcaataggtgtgaatccatcacaatatctcctcacattggccttctctctataaactttgtcctccagtcttattcttcttcaataataaaatcattaatggatgctggagttgaatttctcttttccattcaaaaatttctaaaaattttcattatttatgaagtgtgtataaataataacacacaacacaatgaaatgtgctttctctacttttagaaaattgatgagatggatgtgacactttttaaatgaatgacttctccccaaatacatatttgcctggggtttatctgattagcttatgaaaattatcaaatgagatcacacagacaatttgtgtcattataatgaaccaaattttgaaaacatacagtcaaaaaaacttttttttgttataaggaaaacagtgctttggagtcaggcagagttggctttgaatcccagccctcccactaattgagcttgcagccttgcgcaggctataagctcccagaatcataatcttcacctgtacaaatggagggtgcatccctcctggggttgtagggggatttaaatgagatacgaaaagaaagcacctggaattaggagacagtcaataagtgtaatttaattgcctcttccctagaactaacttgaccctacacaaagctatacctacctaaatgtattttaaacaatgatgattcagtgcctcttagtgtctctattaagaagtacatgtacatatcttcaaattcataataccaaattaataatatcttccaaaaaaacacctgaaagaaatctgactttcaatttaccactgcacaggactataggtagtggtttatgagtcttcatacataaaacactcccagtgaggaaagtgtcgtcttatttacagcctcaatccctgctagtgtatgtacagaagagatgtcatatctctagcctttctacatggggaccaattccagctcttgcagtagaaggagaaagtgtttagaaatccctccaacagtgaggtcattcaattctactgacgccttcagtctggtacagtgttctcaaaatactaacatgattttattaacgaatatgaatgattcctaatttgattacaatttttaggactagagcatattgacagtatatggtatgttcccagaaaaggtgtataaaactgccatccctacttgtgtgcagtgtgatttaaggagcaactttttatagctcctagactcatggttttatagtttcgctgttactgctattttataatagtcagaaccattggctgcctaagtcctgtcagggaaagagaagttttgtagcaaaacaaggagatcatttttcaatggctcaggcttccataatttcttttgagtagcaactccagcattcagcaaccctcacatttcaaaaatgctctgttacctctttcctaaatactttattcttcagtttaaatttttatttatttacagtatcagcaaagacagagaaatatggattaaattttccagtggattatccatttatagctggtcactaaatatgggataagttataatccagttttatcttgactttccgtagtcattttctcacttccattcactcccctctcatctttattattaaacatgataaaaatgaagctaccaaagacagattccaatgttcttgtatttagagtgtatataatgggaccccatttagataagacagttattttccaaacaatacttatttccaataatttttctcatggtttgctatcaaaagttttagaattataactatgctcatgttttactattaaaaaacagaagacaaatatctggggcaaagtgatataattttaaaaaaggacaactatggcctctccctcagtgctgcattcttcacaatgccctgggcagaaggaatgtgtcccagggtgattcatatatttgggggtttcctggaatgtctgacactaggagtagtaatcatagctattttccaatatatttaatgtattttctgagttgttcctttttaaaataagcaaattagtgtcacagtaagaaaaaaatttataatctgacattcaagtcttattttctgtttctaacaagagggagaatatatttgtaatcacaataatatagacattatgataagaaaggatgatgttgcacctttagatgatacaaatacatagctgaatatcattaagcatttaggaatgtgagccatagtcggcagaaggtatagacttttaattccaaatgaaacaaaaagctttatcttctgatacactttgactatcttcaagaagactaatgtgttgattttataagtgtcttccttatacttttagaatcaatacaagcaggcactgcttatattatgaaataattggactataaccccatctctttctaaagccttgccaagtatgggatgcaaatgccagtaaataacaatacaaaaaaaaaatcattttttccccatcaatcagaatgctccaaagttcatatatcatggaaacatataagtagaaattataacaaattataatctgattctgatttacatgtttataacaccttcaatatgatcctgtaggctgaattttgtgattttttttttttttttttgagacggagttctgctctgtaacccaggctggagtgcagtggcgcgatctcggctcactgcaagctccgcctcccaggttcacgccattcttctgcctcagcctccggagtagctgggactacaggcgcccgccaccgcgcccggttaattttttgcattttttttagtagagacggggtttcaccgtggtctcgatctcctgacctcgtgatccacccgctcggcctcccaaggtgctgggattacaggcgtgagccaccgcgcccggcctgtgatttcttttagtgtaaccttttacataaagttgactttttaagggtttcaaatacctaagaacttgtttatttctttagttcaggataaataaacaacatccctgcattttaccaaaagggcaatgtaatgttttgttgttgttaaaaaggaaggaaagaccaattaaattctttgcagagatacttcagagataggtggactttggtcaggaccatgctaacaatgagaggttctcagctccaaaaaccacttttggcatcctttgcccttctgatacacaaacttgttaaccctatgattggttaaggaattgtctaatcatatatgtcaataatagagagcaaaacatcttgcagttttcttattatactctcctgtgaaagacagatgtgttgtgtctaattattcactgattggtatcgggagaaacgttaacataattggcacatttgttctaattaacagagggaaactgccacatgccacccaacatgaaaagtgagtccagcaagcattagctagaaaactccacgtctatcagaaaggttactctgttaaactcatactgaggcccatcaagtcagagcacaggttgaaaatgatatagcagagttgagaactgtgtgcacacctaaaagaatggagatttagcctagaatccttgtctataggtacattaatcaaacaaatgggaaaagcaattatggggctattatcaaatgtacactcagccaagccaagcttctccaaggagcattagctagtagctgggaatctgccaagttttactgactggtttggaagtgacaaatctgacgtttttgtgtatttgtttgttttaactttgtcctttacaccagagcttttcaaactgcattttagaatcacatggagagctttaaaaaatctcgataacctggctatatatcatgtctattaaatcagaatctctgggtgggatataagcattggtagattctaacaattcccaggtgattccactgtgcctccacttctgagaaccagtactgcagagtggttttgtttgtttgtttgttttctgagacagggtcttgctctgttaccccagctggagtgcagtggtgtgatgacggctcactgcagctgtggcttcgacctcccaggctcgagtgatcctgccacctcagttcctggagtagcacacaccgccatgcctggctaatttttatttttttattttttgtagagttggggttctcttacattgcccaggctggtcttgaactcctaggctcgagtgatcctactgccttggcctcccaaactgctgagattacagttatgagccactgtgcctggtgaagactggtttgatgatcttgctaagattttcattaagagttctgggtctgagattctaagctcctagatcgtgttgatgtagataatctatgtaccacagttagaatagcaaggccttgacaattttttttttttttaaatgagaccgagtttcactcttgttgcccaggctggagtacaatggtgcaatctcagctcactgcaacctctgcctcctgggttcaagtgattctcctgcctcagcctcccaagtagctaggattacaggcatgcaccaccacgcccggctaattttgtattttttttagtagagatgagatttcaccatgttggtcaggctggtctcaaacttttgatctcaggtgatccacctgcctcaggctcccaaagtgctgggattacaggtgtgagcccccgtacctggccaaagccttgacaattctaaaagacattgatagctaatactcttctgtagactttcacaggtaggtttggctctaattgctccggagtttgaagtcctactattattttcttatttctcccactggtgaaaggtatctcaccttcccttgtaggtgctttaaacaatcaaaaaagttctctactgtggataattatgctggatgttctctcttgctaaaaaccagaggctactttgtagatttttgcttctcagttttggaaaaaaacaagtatccattcacttctgtgttgaccactgtgaaatatactttgcacctttcagtaggtttgtgcaagtctgggtatttttgtgctttaaaaaaaatgttggtctttaagcaagctgaaattatatctttagacaatggtaaaaaatatagccaaaggataaaaataccaagtggaaactagtggcattttgctcagttgttgttacttctgtaaaggaaaggcatttgccaagaaagggaatttgttttcctgctggggaaacactctcttaattgcacatatgtctagcttattgcttttgagggttgaacatacataggccatattgcagaggtgaacttgtcttgaaatctgaaaacttctaaaacctaagttcaactatgaggagataaaagcatgatgacaaatgaactaataccaacaacaaccaaataaaataaaataaccaaaacctaaagtaaaatgactatatgtaataacaccatccaagggaacaaaatgtcattgaagtgtccgtaaaaggctaacttttacagggcaaaagggcaacaaattgactaatctgtagctagttcctaaccagtttttactataaacttgcctttcaggataagtaactctcagcctttcttcttatttaccagttaaaagtgttcaggtctatagctaagtctgaccatctgtagaaaaatacatgctttttgctctctctgactccataatgagtttatgatagtgtgtgtaggcatataaaaattattggaagaaatcccaaagcaagggaacttattgaagaaaaaccttttttgaacaaatgaaggccaacaaaaatttttgaaaaccctcctgctctgtgactatgggcacaggttaggtctttgcctgctgctgaatctctactgagatagagaccgtgctcgaacacagctgaggtttattttttatttatttttttttttttgagacggagtctcgctctgtcgcccaggctggagtgcagtggcgcgatctcggctcactgcaagctccgcctcctgggttcacgccattctcctgcctcagcctcccgcgtagctgggactacaggcgcccgccaccacgcccggctaatttttttgtgttttttagtagagacggggtttcactgtgttagccaggatggtctcgatctcctgacctcgtgatccgcccgcctcggcctaccaaagtgctgggattacaggcgtgagccaccgcgcccggccacagctgaggtttattaaccattgatcttaggtcatctgaataaagctcattctggtgggtctgctgaacttccacatggaacatttcagtttcttctgaaagactaaatattttctagattttcatcattaaataaacccataaaggtgtccctaaatccattcttgcacttctaaaatctattttccatgcagcaaccagaatgatcttttaaaggtgaatgtcaggtctcgacaattccttaatgtctccattggcttttcaggcatttaaagaaaactccaaatcacttaccgtctctgcaagtctgcgccctcgttccctctttcctgactgaatgtcgtcctgccttcctccttgctcactgggtctcagacacactggcctcctttttaaccctgtaaccaatcacctcctcctgagggtacttgtccttgttgctcccatcacctggagctttcttactcagatcttttcaagactagctccttccttaccttcagatctcagctccattactgtctcttcaatagactttccttgaattctaaagtcatccgcaatccccaacaaccatcaccctctctcatatgaccttgtgtaatttcctttaacttgtaattatctgaaaatatctcactcatttttcttacattcttgcttattgtttttctcctcgagggacttaactgactcgtatttcctacaaccagaaaaatgtctggcataccatgcatctgcagtaaatctttcttatataagtgaattgatgatttttagaaatctgcattttatactataggcttaaagcaaccactaagtacatgcaaaaatcaagccacagatgtataataagtcagataaaatctgttatttcttttgctttaaaatgcatgtttatgttgcttaaacttattgcaattttaatttggcttacagtgtttctgggcttgtggtgatctctgtgtgtaactattagaggcagatatcagaaaaaaatatgggatttttcccatactttttcaccccaaaaagtatgggatgatcataataaggaggtgactttggcgaatgttgattggaccaaagcaaagcttgaaggctgactgctagtaagggaacctaatacttttgaaaacccgtcttcaaggctgagaatcatatcataaccaaaactctgtcttgtagctacacacgtggtagcagaaaattccaatgggtaattactgggcactgaaagcaacatctccctccaaaccagtattcagattcttctttcctctctaaactcttttgcctgaaaagagtgtaaagcaccactctggagacaatatagctgcatggaaattcatcaatatgaagttcctattatggaagaatggcaaggaaacgtgaaggactcatgaaacaaagtgttcagcagccatatgaataatcaattagatggagagccacctgatgctgcacatttggcggagcctccagctgccaccagttttctgccctgtcagtatcagcttaaaaaaatctgttccctgtttatcacgactatactcagtaaaataatctattcttttgcacctcaccccatattttcctacttgctaattagagatgcaaatgttgataaataagatgacagtttctaagcacaactgggtcaataagttgaacattgtgccctgttcctccaattaaactcctatgagaaatagctcaattataattagagaagcaattatccccttgttaaaggtgaaagaaatcacaggttttagagaaaaattcagctttgctccttctgccatgccaacaaatcttgtatccattgatgttttgatcctagtactctccaaaagagataatctgataaagcatctcggaatatatttctggctctccatgtgacagtaacattttctaggcataaaataaaatgagcaaagaggattaatttcatagagtgctgctattatgctagtggaataacccagcaccagttccatgggtgtattaattttcttgcttcttcagggagatggggggaaggtttatctgttgaaagaaaggcaaatgcctcaccagaaatggaagaaaacaatcacatttttggcttgatcctaacaaaagtgttattaaaggaaacactgagctatatcattttagagtattcctgggatttgtttttctttctttcacctggtttacttgaaaatttatatattattattgacacctcccttatagtcctggaactcaagtgtctcccactcccagtggccttggttcctggtcctagtggtttggaaccttgccctcagggttcagactgatggagtctgtcatcccacaccaagatctctcaataggattgcatcttcagggacgagaaacaccctttttctagagctttccatctcctgaggtgctgcctccatgtcacatccagcagggcctctttctgtcatttagttaaatatacttagagaatctgctaagtgacttataacctgctggcattagagataaaacatgaacaaaaaactttttgcttcttatttcatcatgagcttgtcaggcaagaagaagagtaaacagataaatttcaatacaatcggtaggcagagctatataaaattgtggcatgtgggggctgcaatttagccaggtacactggttcatccatgccaggtattcgatgtggaaacagttctgtatctgttgctaaattactgagtgtccctcacccgcaggccctggctggctccctgggatttctggataccctgtgacccggtggctaaagggttatatctgatagagcgctaggcccccaagagtctgctctcgtgctaaggaagccatgcagttattaaatctttggaataaagtccccagatataaagaaaggactttagggagaacagacgaaggagcaggcaagtctagagttctgaaactcttgtgcttcagccctagggtcccctgttttcttattggaaagggcttaaagaagtataaggagtcctcggttggcctcttcctcctctgagacttactttgtcacactctttccctgggccctgaaaagaagacctacaaagagtagcctcaggctaaatttcctctttgggagaaaatataagggctggtctagtgtcctgagttgataaggactgaatgaacaatagtagctttaaagatcagggtaaggggccaggcgtggtagctcacacctgtaatcccagcactttgagaggctgaggcaagcagatcacttaaggcatggagtttgagatcggcctggccaacatagtgaaaccccgtctctactaaaaatacaaaaactagccatgcgtggtgatgtgcgcctgtaattccagctacccagaaggctgaggcatgagaattgcttgaacccgggaggtggaggttgcagtgagccaagatcacgccactgcactccagtctggatgacagagcaagactccgtgtcaaacaaaacaaaacaaaacaaaacatcagggtaagggcagcagtacaccatgacttgctataaatagtttcattaaccaattatttggtagtgttgttgaaagagcatttccttattttaaagctcacaatattgtcttcatttgtagcgtgtgtggactccagccaaagcaactgactagagaacataggagagaatcttggtgacagaagcttcccctctgcataccccacagtgccaagaagaggggcaaggtactcagtaagaattttgaatttaagaggttgagtttggtcttgtgtgaattaaaaaattataatataacaatagtaccaatgtttcttgagtgcttttgacatgttctaagtgatttgcatatattatctcatttaaacctcacaaccacattctgcaaagacactattattatctcccctttatagttgaggatactttggttcacagtatttaaatactttggccaaagtaaaaaatggtgatgtttgggtttgaacctggaattctgtaagaaaattagaaaacattctatggtggagactataggatgccaaaatagggaagaagtaaaatattattaccttagaaatgcctatgccattatttgtagccaaagtggtatatcaaaactaagactagagttcttgaaaaacttattgatttggagagaaaaggaattactgcttcctgacattctgcaaagaatgtacctgactacttcctcaatagaactagccatatgcttatacaacaaagatcaattgaaacaatcagccatatgttcattgaacatattttgcctgactctttcttggaatcatttgccttggagacaaaaggagcacaaatccagtctggcctcatctcccaacgactgatctaattattacaaaacacatgagttttacctgctggttttcctttaagatcaatatttcactttatcctatttttatgcttaaagattctttaaacaaataaatgaaatattaaataatgaatgcatttatattagaaggaaaatggtcgtataatcctttaactcactaagttacctttcatccctttcttttttaacgtatctgctcctcttgagcaaatggcagttgtaatatgtcatgttaaggtattcattagttttctgatcttggtgattttaatagtgttgaaaagaatctacacaggaatttattagcctgctcttgagcatgtatgtttgatctctcttctgactttaaaaaatgaaaaagaaatgcatattaaatatagttctttgaatgtcaaatgggtatatgatttttgagcttgccaagttttaattggtctcttccctagtgatgatacaaatagaattcacagccaattagtttgcagtcatgaatctttactccttgacaaagtgaactactttgtcaaggagactgaaaaaaatgaagaaattactaagatctccccccacctaaagtctttgcaaggatcagttaccttttagaagccctgagcaaaaatgatgccatggatacccatgttgctcatgatctgttttgggttttaaggtggtttcatggaggaggtgtgcattaatattttagaaataccattaagaagacatatgcactattgtcattatcaaaatgaaatattgaatagagaagagttttctccttcctagtcgtattaaatcatactgtgtcttagtgctgcgagataaggttttgatgctgttgaatgaaatagctactatcaagcaaaatctctgatacaattggcatgagatgccaaattaaggcaaaaaaataactctctttcaaagtaaaaaaaaaggaatttcattaaaatttcctttgagttctttgcattgactcatagagatatgaatggctgtgatagaaaaatggggttatttcataaggactctgcctaaattttcaattaattattattattactattaaaagaacaatcagatgtttgagcttgttgtcaggggaccagctaactacctgaccccatctttacttcttgaaaaaaatggaaaactatgagaagtaaaatagtaagtacattattaattattaattgctttatggactatgttgaaagtctcattagtattatttttccgtttcagagataggcacaacttcagggcttaatttttaaaaattcatatacattgaacccatatataggtcccaattgcaacaactgaaatatgcctctttcaacacatgcaatagagagtaaaactttcaaatgactcagtgtagtttggaggccaacaaggaccaccaccaaactggcagctatgccacttgtcaaattaatgtgtgcttggacttgtaggacacggggtcaattagggcaatagtgtcagatgcatataaggatgtctcctaataatcatttaaagggtaacctgtttttagagtttaggatttatttgttaacaaatgaaagacacagtattagttttcctcaacagtgtgatctaagatgatggtgagtgcttgcaatctcttctgggtcacagagtcctcttccccaaagagagatattttcaaaggacatggtattgtgtgttgctaatgaaaagtcatggtatgcatctgatttgtaatacttcattagcaaccaataggctttgttctagcagaaacaaaaagtggaaaatgtaggacttgatggaaagtttataggatgaaactaattgacaccttttactcctaaaatgtgtttttatgcaaggtgtgtgggcatggcttttaggtatgtctatgacttcatcatggaatggaaaatacatatgtaaggtgcacaggctcacagacacagaaaaacacactctcttcttacactcacatttttcgcatatcagcaagaacaataataaaattgatggcacattgttaagtcataccatctctctatgataagtgccagacaaaataaagcagtatttctgatttcttgaaagagaatgacaaaactaaaccaagctgcctgtggctttgtccaatggggcattctaattgactcccaagtcattaatcagttcccaatcaatctattttgccagcagcaggcagttaggactctattaccaaccattcatcatgccataccctaattcactgcaccattagccatggattaggcctctgttagaataacttagtgccaattgctaaatgcaaagaattgttgttattcacctcagccactgggatcccttcaggtggtcgacactggagtaagacttcctgttccaaagacacttcctttcctaggggttcctgctcaaatgtcttccgtagatctggaacgtaaaagtgacaaaatacatgtcaaaattaaacaacattttctcatttacagagagtacaaaaaattttctggcttagtattttatctgtgcttttttttctttcttttttctttttttttttgagacagggtctcactctgtgtcccaggctggagtgcagtggtgtgatcacagctcactgtagttttgaactcctgggctcaagcgatcctcctgcctcagccttctgagtggctgggactacaggtgcatgctagcatgcttggctatttttttaaaaaaattttttgtagagatagagtctcactatgtttcccaggctggtctcaaactcctgacttcaagtgatcctcccacctcagcctcccaaagtgctgggtctacaggtgtgagccatggtgcctggacttgcatttttgtttaaccacatgttgttagcactttactataatctggtgactatattatgtggaataaattgtgaaattcagaggttatgaactgttcctactttaaacttcaatggaagcctttggcagtccttattttaacaattaataaagttcattaattgctttttgttaggattttttgatcatcaattatgatgatcacagttttaaatcaaaagaaccccattctcttgattcttatgcctacagattcccttatgtatatacatattttcctcttttctcacaatggatactactgaagctccagtaactctggaatcttttgattaatactctaagtgagtttccatttcaaagtggaaaacagaatgctggaatctataaggaagaaacataacttcttcaggtgtctcaagtacaaggcagagaaaagagaattgagaacagtcccaagatatcactacatttaatcatatggccattctttaattagaagactagtcatttctgctcacatatcccaggcatctaattatgtatttatatagatatagttgatacaggagtatgcagctgagttttacaaactgttgttagatgggcacaaaaatgttagaagccagtttgtcattttaaacacatcagaggcacatacttcaagagataggtttaactaaatcatccctgaataccatataattattttgttttaatggtttggctttaaactctatatacatttagtctaatttctaaagttagaaaattaatttaatcatagaactttgaagcagcatttttttaaaatgcctacaaaaattttatttcatgcatgtacagttcagttccttccattaaagagttattagaattttacccagtgaattttaataaaaaattaatgcctctgttctgttatcccaggtccctgataaagacataagaatctgaaagcagcattgcagtggattgaactagcgagtggaaacctgaagactctagagcagtggtccctaacctttttgacactagggactggtttcatggcagataatttttccactgactgctggggcggggcatgggggggatggctttgggatgaaactgttccacctcagatcatcagacattagtttgattctcataagaagtgtgcaacctatatccttcgcatctgtagttcacatagggttcatgctcccgtgagaatctaatgccaccactgatctgacaggaggcagagctcaggtgttaatgctcactagcctgctcacctcctgctgtgcgaccagctcctaacagaccacggaccagtaccagttctcagcccaggggttgtgacccctgctcgcaaggtatatccctaatagagctctaccagaaagcacctggaaaaaaatgcactgagaaaggactgcattgttacacatttgccatattgttgaatttctcagcagaagaaaaccctcaagattataaaggttgtgagaaaatcatagatctatgagggtctgaggcaagacaagagacctccaaatgtgatagaatttctatcagaaaaatgcttctaatttgattgtcaagacattgaatatattgtagaaatgaacatttggggccaggcacagtggcttatgcctgtaatcccagtactttgggaggccaaggcaggtgaatcacctgaggtcaggagtttgagaccagcctggccaacatggtgaaacccagtctctactaaaaatacaaaaattagcttggcatggtggcgtgggcctgtagtcctagctactcgggaagctgaggcataagaattgcttgaacccaggaggcggaggttgcagcgagccaagattgcaccactgtactccagcctgggtgaaagagtgagaccccatctcaacaacaacaacaacaacaacaagaaatgaacatttggaatccacagagttatcataactttaaagttatctaaaccatgtcattatcttacttccaaaaaacatgttgaccaaattacctggagcctcacagcataataatcaatggctgccttagaacctgctgatacggattttctacattttgccaccccacacatcccccgacatctcttttggttaatttgtactcttccaatggaaacattaagaattttctcttctgatgtggtggcttctcttgtttttttgatctgcactgagataaaatttgatgaaacaccagataccaataaaaagagcagcagtgaatatcatttatgagcttcaatgttcttgacaaagtatatcttgtttgtaaaaaatgattctgagaaacttctgcctgatgtggggttgggcaaagacataataactggaatgagttctcaaattaaataacatagtgactcactctgatttaaattaatcaagatatcacaaaatgagggctaagaacaagaaaaagtaaggcatatatgtatttaaatagagcaatttcatttaacatttattcattgtctccatatggtagacattttattaggtacttaggatgaagatgtacaagacacagaaagaagactagaaaggtaagctgaggtgtgcttatgaaaagcctttctgtcatgctatggaaaggcaaaccctcaaaggagcaagatcagagaacaagggtgtccatcagagtgactgatggagtgaggcggtggtgaggagcctgaagttagttagggactcatttgaataaaccatgagggatgatggggtcctgaactcagctagtgatagaggacaggaagaggaggaagcaattctagaaataaatatatcataccttgaagaagatgtaggtatttggagagcgccagaaggcaaggataatgttatattctcagctactgcattgttaacttggtacaaacactgagtggcatagtatcaagatgggcagggaagcagagagaaagataaattcattttggtacatgttaggtttggcatatctatgaaacattcaaactgaaaagtatagtagtctagatcatggttcctaaacctcaacccttttaattttggggactgggtaattctttgcggtacagttgttctttgcatagcaggatacttggcaacatccctggactctacctgctagagaccattagaaccccatcccaaccttaacaaaataagtgccttcagacaatgccaaatgtcccctaaggggaaaagtcacccccagttgagaaccacaggtctagggcttggaaaagaaggcctggtaggatttcttgtgcttcaccaactaggcaatcgctgaagcactggaaacagatggcatcaccagggagagactgcagcataaaaaaaagaggacagtgacattcaagaggaaaagctgtcatccaatgatatagagtgaacaaagcggtaggagaaaacccaaggaagttagcatcagagcagccaagaggaaaataaaattttaaaaaatggggaggtcaataggagaaatgcagtgaaggactcagaagtactcataggagagaagtcattggtctgggaagtttaggagtgaccgggagcagaaaccaagttgtgatgaggagtggccaggaagtggggaaatgaccattctgggtactgtaggggcggagggaaaagttctccttagccctctgaaggttcactggaaaatcaactaagtcacaaaaggcagattaattggagagaagacagacaaattttatttaacatgtacacatgggagcctttggaatgaagacataaagatccagggataattgtccatttttatgcttccgttcaacaaagtctggacagccatgtagaaatatgattggacaaaaagaatctgacctaatgttaacagactaagtggagaggcccagcaagactgtgggtctagattcttcctggcctctctgagcattcattccttccttcatctgggtgtcaggcaggaccctctctggaatgggggtcttatgacctatgatcacacaaggtaggttagataaattttttatggtcactttttacacaaaatggaggatggaaatttagaataatatttttcagttttgtggctggttttggactaagggggtttctatgactcgcctcgggggaagagggattgtcttttccatggctggtcttggggaagaatggactgagagacaggagggcaggagaaggtcagagaaaacttttgcttctgaggccttcattttggggtattgttttctaagtcccaatggtatctactactcttttccaaaattttaaggtgacagaagttagtagcaccattaacgggcagtgggtttgagtgcagcatgctgtaattcttcttagaatatggtgcaatttttggcacagttttctaattcttgccatataaaggcacattttatgtaggcccttatttcctaattgagaatggcgacagctacaggcatctacttccagagacaggtttaactaaaccatcactgaataccacagaattattttaagggtttggctttaagctctatgtaaattttatctaatttctagaatgatctcacatttaaccccctacaaggcaatacttcttcctgaaaaacgcttttaattcctgccgtaaaacctcctctctggctttcagattgtgtaatgagcataggatatatcgcggccgtgcagcacagaagccgctcatttcagcatgctgcctcgctactctgcgaagggagggtagataagattttaagcatatcttttatcatctggagagatgtgatagaaggcaggccagttgccttgcaggcagagtgaacacaggggtgacgaatgaataagaatgaaaaacgaacacttgtcagctgggaattagatgtaaaacagaatggttcagaataatgtggccattcctgtcagaaaaaaaagacgaagttctgcccttggaagacctttaggattctacattctgctttctttccattagttataagactgctactaaaattaagtatgaagtcctttcattaataacctagattacttttgcaaagtcaacttggcatgcatctaatttagtcattgattctgccaattaaaagctatcgtcatatgtatgctttcagagagatgtttacttaagaacatgaatattggcttaataaatccatacactgaaatccaattagcagatgtagaatcagacctgaaacaatatagatttctattttccatttatacataaccaaagaaagtccctttggacacacacatgtgcatacaaagtctcattttttgggtggtagaattttgatgctttcagtgattttttttttgcacaatatactgtggctacaaattagctgtgatgcagaatacatgattcatggcattctgcaaacattagctctgctttttgacaaaaaaatgcagttagcagaaaagaagactcactgggagacagattttctggccttcagtttccatatttacgaaatgaaaatgaattactagataattctgaaggatgattttgctgtaaggacctattactgaacagactgagattttaaatacacattttaggggggaaaagcttatcctttgtggagtaaggtacttcttggttgccattatgtgtccaagagaaataatagaagaaattatttcaaaagtcaaggagttgacgcatctttgaagacaacagcttataatattctcctcagaacgactttcacagaactttttggacacttggatctacaggtgtgagtaagagttagaaactagggagagaagtgggttacagaaatttggtatttaaaaaaattagcaaattctttgtataaatcctggagagtaatataatgtaatccacaaaagcagatgaaaattcaggccctgatgattgtaaatgcactaagaattattttgacaaaactaattgtctgtctccatgggacagagaggataggggaggaaaatgcctatccaaaacagtgtggaagaaagcctgtcatgccaatgtgcgtatttacaaaaggggcagaacatcctgcctcttcccagtgccatctcttgagcaactttgcctgtcactgtctgaaaagggtgagtgtgacctataataggaaagtggaggctctattgtcatgggtcatactaacatctctccacctttgagccctgctgattttagaagactaggagaaaatatcagcaaaagcatctccctgtgttagctaagcaggcaggttgtggatactattgccttgaagaagataagcatgttttattctaatttaaaaatgatttacatttattaaatatttattatctcaccaaaggtacttcattatgcagaaagatttatttattagaataaaatatttttttctatccatcgttaagcacataataactttttttaagaaaacaaaatattggtgatgtgatagactgatattatgaagcaagtaattcttcaatgggtatacttcaatagactattctagtggaaatctaaatccttaaattccacagaatgataagacataaatgatatgttacattattactgttgttctttttttagacttcatcaggttttgtgaatattaaaatagatattgaatctgaaaagtttggaaaattataaagcacaacgtatgtaataaattattataattacatttattattactcagagagttctgaaatgaaaggtgattactcatctgcataaattttgtacacataattctcacacacactttggccataaggtccataaactatagtatctaatattccttattgttcttatggaatttcaggtttattgctgtttttcaaactgagtgttatgacccttgagagggttacaacatctattcagtggattaaaacccagcattaaaaagtgtgaaactgaatgaacagaagttatcaagatatacatagtcttatagatgtgtttgtgtatatacactcatatgtttctgtgtgtaaggatgcgggtatgtgtctagtggatcatgatatcaacctattttttattgtaagtcaaaaaggtctgaaaaccactgggtaggctaacactgtggctgagaacaaggttttggcatacaaaaccctgggtttaggtcctgaccctaccacttgactatccatttgaccttaagcacattgcttaacctcttcctgccttagtttcatcagcttataaatgggtataatttcacagggttatataggaaaggtcacctataaaattctaagcacatgcctagcatatagtaagtgcccaaaagataataatcccccactctactttttccccgaagtattaataaattttattaggctatacatctactgttatcactactaatcaaaataaacataaccaagtgagacaaagcaattgggagggctaataattgaaggtgatgtttcataaagagatatgcaggtattaccctgctgtgcttgattaaactgcagattccacactcaggttgggccctgggaatctacagttttaacaaactccacaggtgtgttttctgcataacactaaaatctgagaagcactggttgatgaattgattcgttgattatggaacaccaagttacgcatggcactgtgggcactgtaggaggctgtggggagccatgcagatctgcttctgcacggtggctctaaatgcctgctttactgggtccgtgttggtgtgtccacagagtcccagagctcacttttgtaccagctgatggctgacattgtctagcacaggacttgagtttcatatgtctccaggggccattcaggtaacaaatgggagaaagctaggcataagattttttttcttgaaacatgacacctacctgggttgtcttttgtttctaacttttaatggagatgtgggtacaaaaccaatcaatcagcttcctctttactctcgttacttagctccggctgcatggtgccaataggaatgcaggctcaatgggccacagaccccaaatctgatgactaacagaagttggtaatatggagttttatgagatttttttttctaactgtatatgttgtcagctacttaaaactttatcaaaatacttgtgtgggccaacattttgaggactaaaccaaaaaagtgggatgccatattgcacctgtggactgctactttgagaccaatggtccagatagttcaatgctgaaagtgtcaagttaccttaatgtttcttgtggcctctctctcacctcaagagaaaatccccagagccttttgcttctgactgtcagacacttaaccaagaaagccaacaagagatgttggtgagtaaagctgtttttgttagtaggattgcatacataacatttcataaattcatattttataattattcacttatactcctttacctactttcagaaggaatgttaggccataaatgtgggcacttcagaagattagctgacatttttaataaatgtaaaccaatagcacctgagttaggaaaagaaaaagcttcttgatggctgaaaagacactttgcagtcatttctgtaattcttgatgattacttagaataaaaatgtctctacattcttttcggaaccaatgttgtcatttctacaattgctttgaagaaaaacctgaagctctttcaggtatagcaggaaacagttaagagtggttatgatctgaattattgttctttagagtaggaatggcaaatatttggaaccactacattcccttccagctcgtgtgtctatacctaactgaccacgatattcttttctccagagtctggatttagcttcaggatctgctccaacacaggactctgggaggccacagcggagcagggattaacaggcaagatgcaatgaatctgcatcctcagcctagagttcactgcacagaaactcctgatatgcaatgtgcctgcacagttatggccatgtttttatccgatatcatgtcactgcttagttttacttcaaaaaacaaacttaatcccagccttgaatgctacatattaaaatttaaaaaatactttgagatcaaataaatcttggtgcttggtgctgggtatatagcagtgccttagtaaatgctgagttaaattcagttcccaaaataatctggcaattccctttactgaaggcctggaaacaatttcccttatgatatataactataaaatgtcttacaagtcacatagtccaaccccctcactttacagattatttatttatttatttatttatttatttattttttgagagggagtctcgctctgtcacccaggctggagtgcagtggcgcgacctctgctcactgaaaactctgcctcctggtttcacaccattctcctgcctcagcctcccgagtagctgggactacaggcacccgccaccatgcctggctaatttttttgtatttttagtagagacggggtttcaccgtgccagccaggatggtcttgatctcctgaccttgtgatccgcctgcctcagcctcccaaactgctgggattacaggcgtgagccaccgtgcccagcactttacagattatataactagaactgtgagaggctaactcactcattcaagctcaccagctatttagaagtggattactccatgatgtgaatttgctggaaaatggatgccgcgtagcagctgtatttgtttccagtggaaatttccacaaacttcctggcttaaaacaacagaaatatattcacttgtagttctaaaggccaaataattgaaatcagtttcactgagccataatcaaagggacagcaggattatgcgctccctctggagtttcttagggagagaccatgacttgcctctcccagattccagtggctgatggcattccttggcttgtggctacatccctctaatctctacctctgtggttacactgcattctcttcttcaatctgtgtcaatctccctttgtctttctcttacaaggcatttgtgatgacctttaaagcccacctgggcaatgtcagaaaatctctccatctcaagattcttaaccaaatctgcaaagatcctttttccacataaggttaatatttacaaattccagagattaggacctgatgcctttgggggtcattatctatcctgctgtggtggttacaagcatggagcctggatctgctctgccatagtttaatcctagttctgtacttactgaggttgctatgttttcatttcttcatccataaaatgaagataattctattacatattgtataggattactgtgatgattttaaaaggtaatataaatagcacacttaggacagtgcagttacataaagagtcctctgtcaatgtactcatttacatacccacttcctccagcccctaaatcagcattgctgtcaagtgttcacagagttgatggttgtactgatatttatttctttaaattttactaagaagccaaactccaaatatcagaaataagcttcttgcttcccaaattgaactggtcttgacaaaaaggccctcgatctgtggaaattctgtacttagaagagcttcatgttgttatctgctgctggccagcttactcactttctgacctaggcctgaccctgcattaagcaaatacagctgctgtactatgattcacattttcatattttcaggtgcttttcagttaattctttttacacactcactgaacaatggtgttgaacacattctaatatttttttaaaaaaagctgttttaatatattttcaaagtgctcctctagcaaatgatttcatggtcactcaaagtaataatactgtgttcttaaagggaaaaaaatgtatctttcttccaataatgatggaaagtgctaattatgttgtcatagcagactagaatttatgcttaaatcaccaaatctggctgttaacaggaaataactgctgtgaaccaaacagtgaagcatattttggaagaactagattggccttcagagctttgggcatttattaaaagtgaaaaatgcctgacttaatgccatagagccctgaaatgttagctatggttttcttttccaggaatagagtatctgatttttgctggaatttttaaaaataaagaaaaatattattatgctaagcaactcttattgtggtttgtaaatataaaggttatagaatattttaaaaattgaagctcggtgcagtggctcatacctataatcccagaactttgagaggccaagattggggatcgcttgaggccagggagtttggaatcaacctgagcaacaaagtgagaacccccatctctacaaaaaatagaaaaactagcagagtatggtagtaggtatctgtagtcccagatactagggaggctgaggtgggaggatcgcttgagcccaagaaagttaagggtgcagtgaactatgctcatgccactgcagtccagtttggatgacaagcaagaccctgtctctgaaaaaacaaattaaagaaataaaaagtttggtggtgtttttttttttttaacttatctttccttctcaaatattgtaaacaataaaacaaacaaaaatcaactatatgcagttccctctatagtttgaaaagtcaagaatggttgtatgttttttgcaactgtgtgcaatgaactggactgcaaagagaaaagtttgtttaaaattcagattcagtgtttcctaaacaggtgacatgggcaagttagctaatatttccatgattctgttttgttatttacaaaatgaagataacagaacttacttcataggatgtcgtatgaagattatgatagttaacatgaacaagggtcttataacagagttaggcatacagtaagcatataataaatgttggctactaggacagagactaaagaagaaagaataaggacaatcgactttgatttttttcctgttgttttataaccgcattttgcttttgtaaggggtaaagttttcgttctctcttaggaatttaccacaaacactttcataatatcataactcataaccaggaagagcggttagaatgatctgcagcaagtcagcagaaaggtaagcttggtaatttcttcagtcgtgccaagccctggctatcacttactgcactgagatcatttaaatgagagaaattccagggaacaaagactctttagaagggaggacaatttcagccattcttcgttatttcttgacttttgggcatttataggacaaacacatttgtattcagatagtcttgttaaagagttttttaaaaaaataaatatttcagctagcactccaaatgacatccactacagaaaagaggaagaaaaaaaatccatacaagccactcttttatattcaaaatgcatctttagtttcagaaaaaaaatgattatatgtcatcacagtattttttaaggtatgtcttagggataaataataagaaatatgccaactttatggatgaggaaactgacataccaaaaagctaaggctcttttctcagagtacaaaaaaaagaatgcaatgattgcagacaagctgttttcttgcaaataagcattttagccataaacttcacttttcatacagcataaaacatactttaataacacatttttgtccagtgtgttaccagccctgcctataacatacgtatagatgatttcccccaaaatatgacttatgagactgtgttctatgaattcgttgtctacctctcagaataaatatgagctataaatgcctaagaatttgtggggcatccatgaaacttgggaacttctgaccatctacaaaagcaaatatgtttgaaaaaatatagactgacacaatcaggtatacattataatatttaatcttgaaataggaataacctgataatacaactgtcaagatttatataaaacaagagtattaattaatttattgtttaaatatttttcccttatctaaaaatgtctaaagtatatatttaatcttatccaattcaaaatatggcctctgttacttataattggattaatgtgggctttaatggttgttatacaaggtatcatactacaactcagaaatgtaccttagtaaaaatgccatttattctggtgtacaggggagcctgctgaatcctgccagtacatttggtgttaggctactagaactgtttatagtatgaccttcatctttcaggatgcttgtttaaagaaatgcattatttttgttaaattgtataattaattttgttttatgccaagtagagtagacaggtagaaaataaaaaagtaacacataaggccacaaatcaggacttctgtacatgtgaaccaatataataattcatgagattacatatatatatacacatatatatacatatatatacacacacacacacacacacatatatatatatatatatatatatatatataaattttttttgtttttttttgagatggagtcttgctctgtcacccaggctggagtgcagtagtgcgatctcagctcaccgcaagctctgcctcccaggttcacgccattctcctgcttcagcctcccggagattacatatatatttaactggagatacttaaatacagaaatgtcaattcattcattcctttatgatatttcttgagtccctacattgtgacaggaatcaccctaggcgttttgaattaatcagtgaaaaaaccaaacccaaatctttgcctatgtggaccttactttctaagggggtgagggggtacagaatacaaaccattaactaataaataagtaaatgtatgatggtttagaaggtgagaagtgctatgcagaaacgtaataagtacaagagtgtagaggcaattacgtccagctacctgatgttcttgaattccttggggaaaaaaagtatttttattaaatgaacaaatgattcacattgaatagtatcttcacttttccccatcatgtactttcaatttaattcaattttatttcatttttttatgttttaatttatttatcagcagccacaggcaagggacgtcttctaggcactggagacaacaaggaagaaaagaaagtctctgtccttgtgaagcttacattctggtatggcagatggttaactcaaaagaaaacaaataatgatgaagaaaaatgttatggagaacaataaagcaggattaggattaggcaagtgacagggttgaggcccggatagacagacccctctataggagtgacatctcagtataaatctgaatgaaagaagaaagtaagccagttttagacttggggtaagaatgtttcaagtgagaagaaacagttcttgcaagcagcctatatgtggaatgaatctattgcattctggaaacaaggaaatggatgtggttagagcagacaaagcaataagaagagaggcaggaagccaaggtctgtttatgtttctgtattataaataatagtgagctttttttttttttttttttttttttttgagacaggatctcactgtcacccaggctggagtacagtggtgtgatcatggctcactgcagccttgacctcctgagctcaagggatcctcctgcctcagccttctgggctgacagtagtatcccagctgggatcacaggtgcacaccaccacacttggttaattttttttggcttttattagagacaaggtcttgctatgttgcccaggctggtctcaaacccctatgtgcaagtgatcctcccaccttggcctcccaaggtgctgggattacaacgtaagacattgcaccagttataaacattatgcatgtagagaataagatgtttttgtgaattgccagctgatctacaaatccttgtctcctcctcccttctttgtacccagtgtactggttaaacacatggacttggatgctggcctgactcactgctccatataccacctgtataacctcaggcgatttttaatctcccgttgctctcaatttccttgtctataaaatgggaataataataacactcatcacatagagtccttgcaaagactgaatgatctaatacataatacatgattgaaacagcacttccattattatcagtattattattctggagcctatctgtccaatgcaaaccacatgaggctttcaagcacttgacctgtagctggtcataactgaagctattgtaagggtacacacactagctctgaaaaaccagtatgacaaaaagaaagaaaagtatttcataaatacttgttgatattggtaatactgttgaaatgatagtttagacatactggactcagtgaaatacatgaccgaaataattttatctgtttctttttaaattgtggctactagaaaagtgtaaacagtatttgtggctggcatatttctattggacgctgctgttttagacagtgtgctggatactatagactcacgaatatgaacaagacttgatccaaatccacaggtgggtcacaaatgtagttattctctcagtgaaaatgatgagtgagctgtgagaggaagccaggaggggccaccttgatcatccttaattctttctaggaactaccttattcctctttgtggccagcaggctttgtgatgctggctgtgatttattggtttgcacacacgatcgagaggaaatccggaggagccatcctgctgttccccggaagatgaatcttgggtgcatgtaaatcccattatagctcatgactgtaggataagggtgaccatatggcatgttcttccatcctcaggcatgggcagaaggggttggaaattacagtcaaattttatgtgaatcagcagagaatttcaacctctaggattgacagtctagccctgggacatgaaatggtaaaggaaagacagacttttcagttttcaaagtttgctcagtattgatgtttcaaaataaacatataaagttgtttaaaatggttatatccatttttatgaacacctattatcattcgctgagcatttgcactgtgtctggcactatgtcatatgttttacaagtttatctcatttaatcttaaaataactctttttcatgctatggttgatgaaactaaggctcccagaggtcaagtaacttgactaaggtcacagtaggaagtcatggcactaggattcgaacatgagtcaatctgtccctcagcttgtgctattaaccagtctcctatgctgctttttccatcatatccttacccccacaacacaatcacaacattgtcaacaatggtaacatcaagagcggcactattgaaacccaaattgttcctgaggaaagaccttgtatgttaatattttgcctgaaccttaagctttgggattcactcatcagcctgtaacaagagacactggaagaaacaaccccatgatgacactgggagctgtattacagtaagggttctgcacaggacaccattgtagtggcaacttgaattctctcagaataaacttttctctgaatgaaaactaccagacccgcctaggaaatttggcactgctgtcttgttaatgtgcaggattttaaagcagatgtgttatgttctcagcacagcctggctgaatcctaactttcatatttccattttttcctctgccttgattgtctcacaaacctatttttacattttacatggtttgaatgtgtgaaatattgtaagcaagcttaaatacataaattaatagtcaatattcatttatggtttataaactgaaaatagagctttttcatgaaagaactatgggcccctccacagtacatcaaatgagcataaatctaattaggtaagaggtaatcatacttatttaagtttagcatcgtggtgatcttcacctctgatgagtttaaacttaagttgccatttatgtgatggccctcggtcaagtattactgggcagagcaccacagttcacttgatacaggacagagtagaaaacccataagtggctgggcacagtggctcacgcctataatcccagcactttgggaggctgagacaggcagattgcttgagttcaccagttcgagaccagcctgggcaacatggagggacccctatttctactaaaaatacaaaaattagccagggatggtggtgcatgccagtaatcccagctacatgggggggaggctgaggcaggaaaatcacctgaacccaggagacaggttgcaatgagccgagattgtgctattgcactcccgtctgggacagggcaagactttctctcaaaaaataacaaaaaccaaaaactaaaaaccccacaaacttctgcaacattagcaaggggcttctaatgataaggatcagcctgtacagagagaatttgaaaattcaaccttttttgttctcattatgatgcatatctttatgagtcaatctttacaagttaggtggggttccttcggtacacacatatgagttcagttagctacagaattataggtgaactgctcttgaatattattacatgagggtgaaaaggtaccttggataaataatgttgacctagaagaagagtttgtttttttatttgaaaatagattgaaaagccatgaagtaaatagcaaagtttatagaacatactgcaaagaaaggggtcttatacctatatgtacttaatgtttgtgtgctgaaaaagaatatatctactcaaacacatataattatatatatatatgaaattggcacaacaatggtctctgcaaattactgaaaattgaaggcttattaactaaaaattcattatttgaaactatgcagctcttaaagttcagctttagcaagtcaatgtagtgtggaatgtagactggcaattttaagtatatattgtgcttgctattaatgaatacatagaaatgaaagataaaagaatagctttctttccttgtgcctcctttgattacagtttgaaactgattttgaattcaattaaatctttgactgaaacatttgctttttgttctttttaaacatgattaaaagtatttttctttataattaataaaaaatcaattcttcagaatttgtggcagtggatgttgtggtatgctaccaggatcccctttcaggcctggtcccacctgttggaagtgttgacggtgaaagtctcagcttctctctcctggaatcaccctcagtggtgcagagctgacttggccctggttacacatgctggtggggtagggagtaaaggagggtcttcatccactgactagtctatgtaggggaatacaggtctgctcaccccttcagcctcagggtgctataactctgaagggccatgtgagcttcagattcctatggagtcatcacgtgttgtatttgctctgcaggtcaatttctccctctgcccaaccattgcctttattcctccacctgatatcctagtacccttagcatattgttcctaagggcacccctcaatacactggctgcatgtatgactccatttcacagtatttcatggagattccacttaagacaaagagaaaatctatttagacattctcagagaggaaagattaatgtcgagcatttgaacaaacttcactgggaattctttataacagttttaattcaagaaaattgttaaacatctgtgatactctaggtattgtgctaagcaggagagatataaaattaagtacaatagaattcttgatctcatggaactcactggcatgaaacacaaattttacgagtgaatataattgaaatgagacaagcactatattaggagtatggacaaactgctctgaaagtattgagaaaggaatgcccagcctcctccctctgtgaggcaggaatggcttcactaaagacatttgaaagaaatccttgataaggcttagccctttcaaatcatcctttctcttctttctctcacatcacacatccaaggtctcaacaaaagctgttatctctacttttaaatatatctgaaatcctggcctcaccacctccactgcttccaatctacagtagcttaacatctctcatagctgcagtctcatcactggtcttcctgcttctccccttgcccagcatggtccattctcaacacagcagccagatgactctgatgactctgctaatggatgtcaggtcatgagttcctctgctgaaaagattccaaagtgttcccaacttatcctcaaaaccaaatatgggccgagtgtggtggctaacgcctgtaatcccaatattttgggaggctgaagtgggcgaaatcgcttgtgcccaggagtttgagaccagcctcggtgacatggtgaaactacatccctacaaaaaaatgcaaaaaagtagctggtcatggcggcacatgcctgtagtcccagctacctgggaggctggggtggtagaatcacctgagcctgcgagactgaggctgcaatgagctgtgtttgcgccactgcactccagcctggtgacagaatgagacccccatctcaaaaatcaaacaaacaaacaaacaaaaccaaagataatttcaacacctacagaaccctatgccaactgcacacactgctcccatctttagcccaggccttacctttctggctgcatctgtggatgtcctctcactcactattctagccactctggcctcactgctgtctttgggacccaccagcacactcctgcctcagggtttttgtgccagccgctgtcccctctgcctgattccctcttgcccctccttcaggtcttcgcaactgtcaacttcctcagcaaagcttcctgaccactccctcccagccctacaaattcccttttcctgctgtattttttcttcgtggcacttaccatctgctctagacctgatgatcattcattttatttagagtttgcctttcctcaccacaacatgagctccatgagggcaaggatggttgcatgttttgtttctagtaccaaccccaatacccacaattgtcccaagaacagagtgaatcttcacttagtatttgtctaagtgaacaaatacatacaaacatatacatatatatgttgtgaaaggtagtaagataagggtgcaatgcttcagcatgaagaatagctgaaaggcatggaaatcaaagtagttttaatctagtgtgattacaatgtagaaatccttacccttccgagctagaaacataggttggatatgtaaaccacaaaatgtagttgttattggctgaactacatcccattcccccaaattctgatggggaagccctaaccctcagttcctcaggatgtgactatattgggatataagacttttaaagaggtgatcaagttaaaatgaagctgttagggtgggccccaacccaatctgactggtgtccttataagaagaagaaatttggacacacagagacaccagggatgtgcacacacacagagtaaagactatgtgaagacacagtgagaaagaggccaccagcaagccaagaagagcggcctcaggagaaaccaaacctgctgacaccttgagattgcacttccagccttcagaactgtgagaaaataaatttctattgtttaagccatccaatccgtggtgttttattatgggagccctagaaaactaattcaatgatatatgccattataaggaattttgcctatctcacatgtcactataaaatgtgaagcaggaatggaggcaagatgagaggtgtattcatctgttctcatgctgctaataaagacatgccccagattgggtaatttataaaggaaagaggcttaatggactcacagttccacagggctgcggaggcctcataatcatggtggaagatgaaggaagagcaaggaacatcttacatggtggcaggcaagagggcatgtacaagggaactcccctttataaaagcatcagatctcatgagacttattcaccatcatagaacagcatagggaaaatccacccccatgattcagttaactcccacaacacatggggatgattacaattcaaggtgagatttgggtgggacacagaaccaaaccttatcaagaggagacctaagttttagaaagactgtgtttgtggtaacagggaggaagggctggaatagagaacagacttgagccatggagactaactggaagatctgcaatggtccacatctaaatgaagaagcaagggagtcagagacaagtatagaactggggaatgctttagaagcaggattgatgggacttagagctaagtgatattggcatccaacacaaaatagaattagtaaaatgcaaagatgtaaagggttcagaaaagaaaatatatggatttcagcgctttctcatgtatgagaacatttctcaatatgaaaccttgagacaggttacgtggcatccatgttgcttaagacagacagaatatttactgaggaaagggctctgcaagctgcagcctccttctccctcgtggtgataacatgcatattagtgtattaaatcatctgagaagttttgcaatgaagcttctataactttgtcaaaaaatatatttcttacatttatttgattatggaagccttttttgcaaggtaccttttaacctcttcctgaacatgtatgctctagaaattaacacaatttggaaaacagtgctgtgtgtggtccaatgtactagaatggttccaaaataaatagagaagctttatcttggtaatctctattttgaacaggaaaacgactcaactttgtcttaaagtggtagaatgaactcattcaaggaatgatatatgccattgtaaggattgattttcctacagtctaattcctactagattttttacaaaatcaaaatctttggaaagtaacacagttctttcacatccctaaagaaaaattactcagtgccttaaaacaaaaaataaaaggaaaaaaattgaactcacagacatagagaataaaagatagttactagaggctgggaagggtagtggcagggttttgcggggaggtggggatgattaatgagtacagaaaaatagaaggaatgaataagacctactatttgatagtacaacagggtgactatggtcaataataacttaattgttcattttaaaataactaaaagagtataactgaattgtttgtaacacaaaaggataaatgccagaggggtggatacctcattccccatgatgtgattattaggcattgcatgcctatatcaaaacatctcacataccatgtaaatatatacacctactatgtacccacaaaaattaaaaaataaaaaagaaaattaaaaataaaatgaaatcttggcgacctaagaggaatatgtggctcaaatgcagaaatctgggagcagtttttttccaggattttttttttttttttttttgagacagtcttgctctgtagcccaggctggagtgcagtggcataatctcggctcactgcaagctctgcctcctgggttcaggccattctcctgcctcagcctcccgagtaactgggactacaggcgcctgccaccatgcccggctaattttttgtatttttagtagaaacggggtttcaccgtgttagccaggatggtctcgatctcctgaccttgtgatccgcccacctcggcctcccaaagtgctgggattacaggcgtgagtcaccgcgcctggcctttccaggatttttgaccagttttctttggtgctggagtagtcacagtgtaaactttcccttatgtgtatcaacttctgagacccaaggtgcttattgtacaatgactcacatgcaatgcgcacatacgccttccggctctttgtggtacccgcggagctccaggccacacactggcaccagtaatcttcaggtccaaagagttcttccacttgctggcgcgaaatctcaatgctcacttcccggacaatgagacctgacaagagaaaaagaaagatttaagtcaacacaagattcatactaaagaaatataaaccatcacatcatatttttcccccagtcatcccttttgatgccatagatcaacaacccagatattgtctctcatctcttttgactttcttctcgttccagttattttactcaacaactttttcattctcttatttgctatttcacatcttctggattattctgaggatgaaagtagaagggctctatcactccacaaagtaattcctttcccaatacagcttgctattttttaaccttcctctctatattgaaatataaacttgagtttcacatcttctagggtttttacctcaattatatagttgtgggtaaaataaacgtatgtacacagatttacaaagctaaaaccaacagtcattgtgattatttaataactaaattactttagcagttgtgtttcaattaaatggcacatcgtttttcttgaaacagatactaacctttgttaacaagcttctggtatcgtatccgaagaatatataactttaaagttttcatgcataatagtttgaaagcccaaaatgtttctctgtaattgtaatatactaaaaccctgttaaaggtaaagtagcctcctgctaaaatgctcaaataattggaatttatttcacagcattatgtaatcttgaataacaaaaaattgaactaagcatctgggattatcattttagaggtatttatcttgaattatcaaggctgtttcagacattcattcttcaatgtgcctctttgccctgagcaagaggggttatctgaacaacatatgtgggcaactgccagttctcccagagcttgaactcacacacttccagcatggagtgtccattgagggaaccagcagaacacccctagggaggaggagaatttgctttgggtcaagtataggtatagtaagaatgattaaatatattgttttgcactattcatatgtccatctattcatttattctttgaataaatatttatttagtatcaattatgtaaaagataatgtatcagcacttgtgaaagtaatcagtaagatagtccttcccctcaatgaacttatgttattgtgaagaggtatcatgttaacaatgcattatacaacttattatttaggttcaattgcattcaatgctgcaaaggtgggcataggaatgagtgtgagtaatcagggaacccaatctagtgtgaaggatccagtatgagttagcttggttcaatcatatggtgagcaggagggacaggacatatgggaaagagcaggaaagggaattaggagtttgagaatttaggagaagacaactgagcaccaaccacagagaatagtggcatgagatgaagctagagacaagaaagggtctagtttacatagttgtgcacaccagtgtttctgaaagtgtggcccccagagcagcttcatcagtatcacctgggaacctgctgcaaatgcacattctcaggctccatgccaaactcactgaataggaatctctggaggtggggtccagcaatctgtgttttgaccagcctgccaagtaatcccaatgcatgctgagtttcagaactactcacatctacaatgtttataattctcagtttcccccaggcactgtggctcacgcctgtaatcccagcactttgggaggccaaggcaggcggatcacttgaggtaaggagtttgagactagtcttgccaacatggtgaaaccctatctctactaaaaatacaaaaattagctgggcatggtggcgcacgcctgtaatcccagctactcgggagtctgaggcaggagaattgcttgaaccttggagatggagtctgcagtgagccgagatcgcaccactgcacttcagcctgggcaatgagcgagactttgtctcaaagattttcagtttcttcctaaaagccatggatattactaaagtgttttaagcaagtagatgacatgatcagatgagaattaaatatatacatatatgatatataaaatagatatgtgtgtatgtgtatgtgtacatgtgtatatctgtgtgtatgtgtatgtgtattcaattctttatagtttaataagttcataaaagttataatttctcaaaatgtttgattataggtgacaggagagggtatattttctggaactccttaaaaactgtattttagaactttccttaacacctagaaaatattcaaatgactaaacacactcagggaaatgaacaactacccaatgggagtaggagctgtcccactgggggaacaaacaatatttcctatcaagagctgatgaggcttgtgtcatagaaactactaagctcataggcccattaatgactagctaaatggtaatgaagcccaagacggtgggttttataatcccaaggcgtgacaggatcctaaggggcaactctattgtgaaaagcttatgaagtacattcaaaattatttcaatgttttgaaaattagcaatccttgtatgtttatatattaaccagtttaaaaagaatttccaagtaagtggcatattccaatccatcacccttctatggaaagaagattagtagattatgttagccaatgtctaactaatgtaacaatcctctcagcaacaatcctaggccattaacaaataacaccactttgcctcctctttcctggtccctactcaggcctctcattttcttatcttattgtattttttcacattattccaattctggaaatctatgggaagatggaatcacaacctctttccccagtccccatatctttctctctctctctttttttccccctactctctgatgtttgatggtttttccctgctttacttatttatacattccctcttcatggggaaattcagttactggaaacaaacctcttcctttaagattactgtagtaacttacagtcaccaaagggctgataaatttgcaatatgtgtttccttagaactataatggttctttatacgatgcagagcagcaactaatatgctcaggatattacaaccacatccaaatatttggtgtcccaagatgataacttcaggtctcattctcccccacttttacttaaagcaattacaggaagcctaattaaatgcttgaggaattcagtaggtccactgtatcctttagctcaaataggctcatggatggttctactgaccacaaatctgaagcctttttaaaagccacagaccaaccctcctgctacaggagttattcatagtctgaatgctctgaattgtttggctcaggctccctgtgggcactggagtcaagcacacactgatttttgtattcagcttcacagatgtcccattcaggaggagctgagttgtgtacagttgtcctattacatagcccaaagtttacattccaacttttggtcaacaacacaagaataagaaagaactgaagcatgaagtatctaaatacttatgactcagaagaattccgtagaattgactgcattattcagactctgagctacttggttacatgccatattttcataaccataggtaagtttattacctatgagagtttgttcatcagaccagagcctagtggtttgggtaaaagtagataatattttttctctttgaacctataatttcaaatctgcttgaagtctggagatggaaaaagcaaactaccttgaatttgaaatgccatcagcattacttctaaggtgggttgctttgaagagcatttgggaacctgaaattggtttcaggttatttaagggtgggggaaatgctttggtctacaggacttactcaaatacaaatgtgtagtttccatcacatctgataacatcaaagatttcccatcatgctgcttcctttaatagtggcatctcaaggatgcatgctgtttgaagtttgcagtgatttgtttttataataggatttgttgtagtttgggagccagagtgcaggaaagtaattagcatgttattccaagaagtcttatgatgagtatgagtgtgcacttgttaataatacatttcaaatgaatatagaaattcagattcaaatgcaaccctctgattggatctttgtgaggtcatacatgaatatggcaataagacctgataatgacatgacatttatttcttatttttagcatatgcttaatttcataatagtggtaaggcaccacaaatactgtttttctaggatactaccataaagtgagcacaaatacatgcttaatccaattaaatgattacttaaaataatatctgtatttccccaaaatgtaatctacagtgctatcaaataaagtaagtattaaagtccattaataacagatattatgctaagttgcagaaatgtaaggatgaatcaaacattacttagccttaagctctccatatattttatttatttttatttttatttatttatttttttgagacggagtcttgctctgtcacccaggctggaatgcagtggcgcgatcttggctcactgcaagctctgcctcccgggttcacaccattctcctgcctcagcctccggagtagctgggactacaggtgcctgccaccatgcctggctaattttttgtatttttagtagagatggggtttcaccatgttagccaggatggtcttgatctagtgacctcgtgatccacccgcctcggcctcgcaaagtgatgggattacaggcatgagccaccacgcctgcctcttcatgtattttataaacatatcttgtttattaggtgacactgaaaaaaatcacacatcatcttaaaacacattttcatgatagtgaatttgcgccttctgatactccatgtatatttctttcaaaagtatcctaactcaactttagacttaggtattatgtatgcctgagttgattcctctccatggctttatctttcttatggcaaaaggaagttttaagatatcatgttgtgcaggcctggcaatttggctttctccagcaatctctctaattggagaagaactgcagagctccctccaccaaatttcattatagtacattcacagttaggacacaggttggtaagaaatatacaaagctgcaggttgggatgttctggaatatattacaaagttttattgaattagtgtgatcttttggttctttcttccagtgcttcattctattataagcttttactagtattatttaaaatatgaaacatatcagttctagatgtcttaatattaattaaatcacaaaacaccctgtcattatttagaaggatgtcatactataaaaactgattattatttcagcatcttataactctcgttaaagtaattaaagtgtgataacttaaaaggcagaatttcagaatcaagacttcatgtgttacatgaagtcacttaacaatctttaactactatagcaggaagacattgtatacacaaaatttacctactctttgaaatgttttaattaaatttttaatataatgtttaatatataagcaaactatataatttaactaaaattattctatgcaagtgggaattgcaacttgctggtgtattagctttattatgagtataattttgttaaagttacagctactatctttgtgattaagatgaatgtaagaaacgcaacacttacagagactgaatcatgaaggaatagaaaacctgaacagaccaatcaatgatcagtaagatgattaaatcagaaataaaaagtttcccatcaaataaaggcccaggacctgcacttttatttaagaagaactaaacttaacctttctcaaactcttccaaaaaattaaagaaaagagactacttccaaattcatgttacaaagccagcattatcctcttaccaaaacctgctgaggacactacaagaaaagaaaagtacaggccaataaccctgataaacaaagatgcaaaaatcatcaacaaaatactaacaaaccaaatgcaacagcacattaaaaggatcatgcacccttatcaagtgggatatatccctgggatgcaaggatgtttcaacatttacaaatcgatcaatgtaatacatcacatcaacaaaatgaaggataaaaatcatacgatcatcttaatagctgtagaaagaacatttgacaaaattcaacatcctttaatgagaaaaactctcaacaaattggatagaaaatgaatgctcaacacaataaagctatatatgacaagcccagacctggcattacgttcaacagtgaaaagttgaaagtttttcctctaagatcaggaacaagacaaggatgcccactcttgccatttctattcaacatagtactgtcttagatggatcaattatgcaagaggaaaaaaattctaaatcacaaaggaagaaggaaattgtctctgcttgcagatgatgtgctgttacatttggagaatcctataaattaaacaaaacggttaaaattaataaatgaattcagtacagttgcaggacacaaaatcaacatataaatatcagtaatgattctatacatgaataataaactttcccaaaaagaaacaaagaaaataatcccatgtataatagctataaaaataataaaatacatagaaataaatttaaccaaagagatgaaagagctgtacactgcaaacaataaaacatgaaagaaataaattgaagaagaaaaacattaatggaaggccaggtgcggtggctcacgcctgtaatcccagcactttgggaggctgaggcgggcagatcacctgaggtcaggagtttgaaaccagcctggccaagatggtgaaactctgtctctactaaaaacacaaaaataagttgggcatggtggcaggcccctgtaatcccagctgcttgggaggctgaggcagagaattgcttgaacctgagaggtggaggtttcagtgattcgagattgtgccactgcactccagcctggctgacagagtgagactctgtctcaaaaaaaaaaaaaaaaaaaaaaaaaaaaaaaagaacaagaaaaacatgaatggaaagatatgttcatggattagaaaaactaatattgttaaaatgttcatattacccaaagtggtctacaaatttaatgaaatccatatcaaaactccaatgacaattttcacaggattagaaaaacaatcttaaaattcatatagaatcacaaaagaccctgaatagctaatgcaatcttgagcaaaaagaacaaagctggaggcatcacactacttgatctccacatctactataaagttacagtatcaaaatagcataatgctagcatgaaaacagacacacagaccaatggaacaaaatagctcgcccagaaataaatccatatgtttatggtcaattgatttttgacagagatgccaagaatacacaatggggaaaggacggtctcttcaataaatagtgttgggacaactggatatccctaggcagaagaatgaaattagacccttaactcataccatatacaaaaaccaactcaaaatagattaaaaatttaaatataaaccctgaaactgtaaaaccgctagaaaaaaacatagaggaaaagctccttgacattagtttgggcaatgatttttttaatatgaccccaaaaacacaggcagcaaaagcaaaaatagacaaataggaatacatcaaactaaaaagcttctgcacagcaaggaaataatcaacaaagtgaagagacaacttatggaatgagagaaaacatttgtaaaccatacatctgataaagggtcaatagataaaatatataaggaactcagtcaactcaagagcaagaaaaagaacccaattaaaaaactgggcagaggatcccaaaagacacgtttcaaaagaagacatacaaatggccaagggtatattaaaatatgtccaacatcactaatcctcagggaaatacaagttaaaacaatgagatatcacctcacacctggaagaatggctactatcaaaaagacaaaagataacaagtgttggcaaaggatatggggcaaagggaacccttgcactctgttggtgggaatgtaaattaatacagccatatgaaaaactgtatgaagtttccttaaaacaaaacaaaacagaaataaaactaccatatgatccagcagttccactaataggtgtatacccaaagtaaatgaatcagtatttgaaagggatatctgctcccctacattcgctgcagcacttggctattcacaatagccaagacatgggattaacctaagtgtccatcaatagatgagtggtggtagaaaatgtggtacatatacacaggggaaaacgttcaaccttaaaaacaaaggaaatattttgatttgccacaacttggatgagcctggagaacattatgttaaatgaaatgagccaggcacaggaagacaaatactgcatgatcacacttatatgtggattctaaaaaaggtgaaaccatagaagcagagcaaaaatggtggttcacagagggtagggggtcccaagatgggtgactgggaaaatgttggtcaaaggatattaaatttcagttagacagggagagtaagttcaagagatgtgcaacatgatgaacacagttgatggtaatgtgttgtgtacttgaaatttgccaagacagtagatttttaagtgttctcattacaaaaaaaatgagaaatatatgaggtgatgtatatgttaattagcttgatttagccattccatgatatatatttcaaaacatcatgttattcaccataaatatacacaattctgttaataaatgtagaaggctaaatttattcaaaagttaaataatttatatgactgaaactgagtggttcaagggatttgcttggaagcatttctaggtcattgactcaattcctttttatggccatagtttttaggaacttggctctgtgtggcagcctgtgtcaaatgaggatctgtgctttgttatatttttgttttgtctagaactgagaagaatattcactggattgtgtaactgggttggggggggatttctagtgcttctagaaagctctatgacaactatagatcaacgcacggttttctgccttaaaacttgaaattttaattataagacaatattacatagaatgaaaaataaaacttactctggcaatcataacacagttttcctctttcctttgtgcgagcatcaggttttgagttttacaggagaactaggccttctatttttgatttgactttccaactaacatcaaacttagagtccatatctgagggataacttgaatggtgggtgtgcaaaatatttctgttttacatttaaagttgcaacgaattgctagaaatcaaccttacaagcactagctgtcatttaattctttttaactttggtgattaaaaaaaaatctttcaaatgtgtgcaaagaagactttctgatactaaaagggcagctaaaatgctttctgtaattaacttatgccttgtgtgtcaatattctttggaatataaaaaaaacaattttgtgaatacatgacagcactttgtttaatttggaagggaacaaagcatgttccactgaattagcaaatgcaacattcttctaaatatttgtcctaaaacaccgaatatattacacatatttgaatgtatattccaacatttttcttggaaaatataattcctaattatgacctaaatcttactacatgcatgtctttgcttccttgtttcaggcattcatgagtagttttaatacaattttaataaaatttaacaaaatgatgcctgttaacgaaagtggggcatagtaatgtgttcgtggaaatctagttaactatacacttgtgaattatagacctcactattagtcttgtccagtcattcattcaatagatatttcttgagactttactatgtgacaagaacttttcttttccatgtgctgaggatacagtgctaaagaaagaagatatcaccttggcacactggttcatgcctataattccagagctttgggaggcctaggcaagaggattgcttgaggccaagaattcaagaccagcctgggcaacataaagagaccctgtctctacaaataaaaatcagaaaattagctaggcacggtggtgtatgcctacagtactagctgctcaggaggctgaggcaggagtattgcttgagcctaggagtttgaccttatggtgagctatgattgcaccattgcactctagcttgggtgacagagtgaaatccaatctcaaaaaacaaacaaacaaacaaaaacaacaacaacaaaaaacaaaaaaaaccccaaaaccagaaaagaaagcacgtaaggagataaggtctctgttctcctgtgggtgacattccagtatgaagataattcttaagcacatatttcattcattatgatagtttcttaggtggccacactgatgaaatgcttatgaatcctcccttcagaagatactaagactagagataaaatagttgttcattgagcataggccctgtcctatgcattctgtatccatcagtacagtaactggcacataatatttgtccagttaatatatgttaaataagtgaatgatctgtacatatatatagttacaacagaaaataaagtgtttaatcccaggcatagaataaacttaattgtagcttagacgagtaaaggtaactagtattttttgaacagctactgtgcatctcagttaatctgcataacaatccttggggattcatactgtcaaatctataataaatatgtaaagagcacagatcagaatctaaacaattgttcatatagccaataagtaccaaaataaagatttatatccacatgtgtctgaatccaatgttcctattcctttcactacaccaatattcctgaaactatgtctcagaaaagagttccatggtcaaacaagcttgggaatttctgttcaatacaccctcctctacaaaactcagaatgcccatccatatattgaaggcattggtcagaagttctgtagtaaagaagtctgtttagtacagattagcatcattttccctcaatttgttaaaccacacagccctacagtcaacgtagccacagaaactcacctcatcatggctctcagtatggttttgtttagcattctctacattgatctactgaataaaaatagtccaaaacttagaaaattctggaaatcccatgacaaaaggtatagtgaaatatttcagatggacagattgagggaccatggcaaagtggaatatttgagattgacactgaaacaaggtttgggtttaaagatttagagaaaggaatcaaagacacttcaggaagagagaatagcatgaagccaaagagcagagatgaaaatgcatggagcactctaggggagagtagtttacattcattgagtaaaggaataagtgttgaattagatagaagagaagattcatgaagagctgtgaatggcagctagggaagttggttctttggagcagtgagattgtgaaaattgtaaattggtaaaatgacagttttgaaaatgacatgctgcaggaagattaatttgtctctatgagtaaacaaggatacactgacttactttaaaggaattttaataattttaattttaattattattacaaaatggttttcagatcttcgatcttacatcaagtcattaatcataagtgttaagagcaatatccttattgaccctctaaaaacactgtctgacagtggaaaccaggtatatgtatccagaataataattactcatcctcatgggctttcattttgcatttattccaaatgatttgaaaacaagcattaagagcaatcacttctgagtgactaccacttaacaacagttcacacatagtatgttctattgaggattgctatttgtttatcttaaaagcaatatgtttcataatcttaatgcaactttaaaaagcatactataaagattcatatgtttaaaaattccactcacccaggacaattattattgcaactaggtgactgaaaacatattcatctaacacaaaacaacctagtgatttattgagataagaaagtaaattctgctctgtacgtattggctgacttttggcaaatcttaaattcatcaaaccttggtctcccatcttgtgaaataagactaaaaatgtgtttgtcttgctgcattgtgagaaaaggaacgaaataacagttatgaaagtacttgaaatccataaaatgtctttaaaatgtactgcatcataattatcttgtgaataaagctgtattctattcacaaaattatcatttgaggtactataaagacttaggaggggagaagagcaccactaattgaaaactatattagtcacatacccagatgagaaagacatgactggtttggggaattttcagtggactcgggcaagtcaagtctgagtgaagatttcagttgttcagggcaatgcagatgaggctaggttctttagaaatggattctgaacactagaaatgagttcaggggagttgcctttaagtttcttctccttcagccaagccacctggaattttactaatcctccagaaccccaccatcctgaagtgtagatatagcggagctatcctgacatgaagaatcaaagtgcataaggtctacttattttgacaaccacaatgcttgcacagctcctctatcaggcattccctagatccctattcaataacacaggtgaggcagagacattaagcaattgaacagaaattactaagtaggttagttctgactaattttggacagaataagctaacatccatattttaaaaaagatataaaattcatgagtataatcatgtcttctggaggcttccttcactttccaactagaatgtgagccccctcagggagctctctagctgctattcaaggctcttcacaaatcagatgtcacttttctgtggtttcagttttatctcttgcaaaaacatcaaaacatgattgactgtaaagaaaatgataatggtacttaaacactatgacctagtatttcacgtcaatttgttcaacatttatactggaaaatacattttgaaaaatattgcaaacatgaaattgtgaaaataatattttgtcacatagtaaattcatctgcattttgaggcagttgggcataatattaaaatcaaatattcagatatttgaaaaccctcagaattaatggaaatccgtctttgtgtatctaaaaaaatgtcaaattaaaaataaattttaattgtttggaggtaagcattggatcatggtaaaaaagcaacaaagtttcatggactttataagtatttttttcattcatttattcaataggtatttactgaaaacctactgtgtgccaagcatattatattccatatcatttaagtctgtgttatggtaagctgctgtaacatttagacaccccctactcccaagatggaatggctgaaacatgttagaatggtacattcattgtcataacaatcttaggaaggtgaccttgttcagggcagctcttcctgccttagtcaggagtgaacccagattctgagtatttttggaacttgtaatgtctttatgtctattctacactagcattacaaagaaaaaaaagaaaaatgattgtttcccactatgagctccaattccctgagacatttatgtaactgtataatattgacaatcgaacaaacagcttcaatcatgtctattcatatctccaggcaaagttttgttcttcttcctttattttacaaatgtattgcttcaaaggacacatacttttgtggataaacaatttccactagaagaagaacaggaaaggtagctatttaatatatgcagttagagccatgaggtatggatcatagtaaataatattttgcaatgatactagcactaataaagatgatgacatttgcatgattagctatgtttttagtaaaggaaaattaacggataggaatatttagcttgaaggatacatacaacatgctgacaaacaaaactgagtttcagcataaaaatggatatattacacagagagtatacataggctcctaatgtctctgtgtgcatttgtatgcatattattcatctagtattttctttttacttccaagttggaatgcatttacttcatatcttattataagcccatttggtaacacttctgtcagatttcagttgcatattcactgttgaataaatcagtggttaataaatgtccttggaaatgtgtttagagataaataatgaactgctgtatctgatcattaagtgtacatcaagctcacatttttactctcagaatcctaaaaggaagatagcatgacctactatatatgtacatggaaaaaagggaaataattatagagaaaacatgtaaaaggagcctggtttattactcttaaatgggtacatgatagatcaaaataaatgttattacaactgatcaaaaaatcctactgcaaaggaaataataaataaagatggagagtcaacctgtccatcataagtgctttttgttacaaagccaaggacttggagtgtggacccaaccccacagcatgcaaaaccgtggggctctcaggattccaagcctagcatccccaccctctcataggcgcttcggagctgaccgcaggcacacttttaatttgtggcaagatggtctgacaaacagcttgggaggacagcagaggtgaaaatacagatcaagtgcagataaaaatatgttcaccttgaaaaatacaaacaagacttttaggtaataatgcacagggaaatacctatcaaaaaatgagaagaatagaaccactgctttctcattaacagttttcacaatcccttttagcttgtattccaacttctgtccataatccaatatctgcatactccttacatctatacttaaataatatagatttttgtcccctgtacatatcttataaatgtcaatccatcccacctcaaagtttcttggtattcagcaagttttttaaaaagtcaatcatgtaggagatcctttagcaatacttcaaggtattatccctataaaaagtgaagagggatctgaggtcctaaaaagaaaaataatgacagagaatggctgtaatttcatatgttcctgatggaaatctcactgctcagaaaaaaaaagaacacatatgccaaaataaaagaaaaaaaaaaagcaaaaataaaagggaatgggaccacatataaccttgccaaaggttcatgttttacataaagcagcagttgggacttcacaaaggaaatctctgcactttttatttctggttcagaggatttacatgctctttctaatgatctgggccttcagcactgggtaatgtctcccagtgcccagcttagcgctcatgcaaaattgaagcactttggaggcagtttagtagttgcagatgaatctcaatgtgcaggaaaaggcataatggctgtttagcacttgctaggagaagctgaggaaatcagggggaaaaatctattgaattcaagccatctgggaagccaactgagagcggctgcattaacaacgtgtttacattcccattgtgttgctaggccaagcaaaaataagtgtgtgcgtgtgtgtgcatgtgtatatgtgcgtgtgtaaaggaaattataaagtgaagctcttttgattgtattggctattttggtttggctttggcaacaatgtggagaaagaacttgtatgagaaacgtggcaatgagaatgagacggaatggctgtcacagtgcaggggctggcaaggatgctgtgagcaggaggaaaatgagcgctatgcagagccaggctgagcagttctcttcctgtctctggccccgagtagaaggcagcagactgggggaggcctcagaaagctggtaaagaacactagggaatgctttcattgcctgttccatttatagttaccttagaaataccgaccaaatgaggaaaaacagccaggtaagtaagtgcctttactttcaacccccaccactcctactcggtctctccaccatcacttccctcctgcactgtcatattaagtgattttttttcttgacaaatgcttggtggctgtagtgggctgaatgcggaatggtgtcccacaaaggatatgtctatgtctgaatccctgggacctgtgaatcttactttgtttgacaaaaaggtctttgcagaagtcattagttaaagatcttgagataaggagatgaacagcctgggaggacagcagaggggaaaatacagatcaagtgcagataaaaatatgttcaccttgaaaaatataaacaagacttttaggtaatccaggataatatcctggattatccaggtgagcccagaatccaatgacaagagtccttggaagagacacacagagaggaagacagatgtggaggagaaggtgacgtgaagatggaggctgagatcgcagtgatggagctggaagcccaggagtgccagggcagccaccataaactggaagagacaagaaacagattttcccctggagctccccgaggagggcagctctgctggatttcagacttctagcctccaaaaccatgagaaaatatatttctgttgttttaagcctaggagacaaatgcagtgactaagggcacttactgtccattcaaagcctggatgcagaaatctgatagagcaaaaaggtgagaaaaaactgtctgccatgcagtgtttttctggtttcacaaatgccccccgaatgggtgtggagaggcagcctcttagtcactgaggtcacttcatacagagggcatcattgtccagggtcatccagggtgtagctataaaaagaggcatgccattcattgcctgccattcctggacttgccttgtacagaacattcccctgggttttgccagtgaaattttaattcacttaagcctgagagttccccacacttccctcagaaggctgctatccttctgctttagcagtttaataggcagagacaggggaaaggatattgaagaaagcaggagctctatccatgtaactctataccataggactaccaaggggtttcatgaatttattctcagaatgagaggaaagcctgagcaaatcgtaaagcatactcgttttcccccatctctcttttccctcctctctttcgctccctccagactggaatatccttaagtgcagtaatcaagtcttggttatgtctctacttacagcaccaagtaaagtatctaggtcatggattttgaacagaacatctatgtactccctctctgccacacttttacaataaataacatctctcttgtaccctggttttcaagcctggttgtacattagcattactagagagcttaaaacaaacacagaggaaaagctatggcctgttcccaattaaattattatctctggggctggggccaggacctaggtgttttcaaaagtcccccctggtaactgtcaagtgcagccagggttgacacttcctgccctaatagttccttgcggctcttgccttcatgttctggaaactttcttccagaacacaatttttataatcaggttaagcctttgatgaaattagaaatgagtccaaggctccgtcatcagaattgcttttcattgcaagatactgtatttcctacatgctgtgcttacttttttgccagaccctgatagttggcaaatggtagcgctcatgttacatgggctggtttttacatctccaaaaggtactatttagaggatctggcaagaatggatatttcaacaggcttccccaggactggtctgagaatcactagctgagggaagactcaggactgatggtaaacacgggggaagacaacatgatccagagctatttagcaatgtcctcccaactcaagggttcacatttgattgttcatcgattgtggaaatttttaactaaaaagttctctgttgtgttttcaaagatgccaaaaaaatgatagggtggggagagagaaatagcatcaagattttgaccaaattattgagagaataatgggtactaagatttagtggtacagaaacaaatagaatggaacaacagcctggatcattatctcataattaccaaccagtttacttatatttagcacaataggttcagacacccaacaataatatttaaattttaggagaaaagctatgctcttttggaagcggaccatctcttttaaccatacattgtttcttaaacttcttttaaaatgatgcttaatctgttttgtatgacaaccccaaacttttaaaaacatgtttcttccacaaaaataaagtacaagatggctctcgcctgtgtatcccagcactttgggaggccaaggtgggcaggtcgcctgaggtcaggagttcgagaccagcctggccaacatggtaaaacctcgtctctactaaaaatacaaaaattagcccagtgtggtggcgggcgcctataatcccagctactggggaggctgaggcaggaggattgcttgaacccaggaggtggaggttgcagtgagcggagatcatgccattgtactccagcctgggtgacaagagagaaattccatctcaaaaaaaaaaaaaaaagaaaagaaaagaaaagaaagtaaaagagactcttcttaaacccttcacatactttagccaaaggttagattaaaaagtacaatatggcttttaacaattgttctattctcactttgaagtggtcatattaaaactcaggccacagcatatgcacggttgctgagcatgtggcaaaattgctatagcaacacaatcactaattttgctcctgaaatgtccgtttcagtagcatgttatctggatgaagaacggtccttggactcctgcttcttattgtagcctctgcgtgggcctgagggtggacacgatttgattttttctcttctaaatttggaaaaacacacacatgtgtgtctgtacttacatatctacttatatgcatattcttgattaaattgtattaatcagtgctttcatcttcactgtggaaaggaagaggagttatgtgttacaagtaaccttgccctaagtgttaattggcaggggagaattcctttatgtttcttacactaaaaactctcactgtatataattttagaaaatttctcttttcccctagtgaaacacaacttgctaaaattgcattgaaaggtgtaatattttctcacctttactttgcaatcatgttctagaccatatgtgtgcaataaatatatgctagtaaaattttctatacagtatgaaattcaaacattaaaaatcttccccatgggatataattaaattaaaattacatagttctgcaaataggatatagtcggggtgctctggagtacatacagggtctataatactgatatttgcaaatatcggaattaccaaaaatgaacaaataacaataaaaataaaaacttcatgacaacaatagattagaaacaaaaagaatctaaatgtgtagcctaaaaattttcaattttctcttctttttgtaagtcagaaaaagaatgaaaacaaaaacgtttatacgcagaaggtgagcccaaataagtcagctagcagagattcatctgcgtgatataatagaagcaactgcaacaaatacataagttctagaactctgatctaactatgtttttgtaattgcagctgagtttatgttggccatgttagcccaggtgtttaaagacaaagtcaatgtgaaataaggatgaatcaattgtgaacactaataaatgaaaaataagctgaactatatagttcagtatcccatggggaagatttttaatgtttgaatcttcatactgtatagaaaattttaatagcatctatttattgcacagatatggcctagaatatgattgcaaagtaaaggtgagaaaacattacacctttcaatccgggacaattgatattctgttatgactaaccagcaactaccatcttgtgacattatcagattaactcagtgaaacagacttcatgtactacatgggtccttatcaattttctatttttatttactcagccctggggccagcctcatactgaaaagaaaaattgttagtttctggtattgaaataagtacctctgagaaagaaatcaaataaataattgatttaaattccagaatcatttatcttcattggcagacaactgtattacagatataaagctccattcttgccaaggcaatactcccactgacttaaataaaaaattatggaatgaggttcaagtagagttttcaaattttatgcatcatttactaaaatttaagcaaaacccacataacttccttttgaaattgttcactctgttaatgagaactgaatttaaaatgattacatggagaataacaattggtgtgataggtatatttattgtataaagtaactcttcttacagaagattaagctatctttatgtattcctcaaattacttattcatgaaatattccaaatacacactgttggtttgtctcactaaatttcagttccacaaatttagtaggatgagtagctataatctcagaaaataaactgtcattgatcattgcctgtgcttagcaccttgttataaactacagaaaagaaaaagctttacaaaatataaactataccataccattccaatctagttgaagagacagagattacatatattatatatacatgcacatctattaatatatgtatacataaatataactttaataaataacacatgatattgaatataagactgtgatttttgcacttcaaaaatggttgaatattggccaggcacggtggctcacacctataatcccagcactttgggagtctgaggcaggtggatcacctgaggtcaggagtttgagaccagcctggccaacacagtgaaatgccgtccctaccaaaaatacaaaaattagctaggcatgccagcagcatctgtagtcccagctactttttaggctggggcaggagaatctcttgaacccaggaggtagagattgcagtgagccgagatcatgccactgcacttcagcctgggtgacagagcgagattctgtctcaaaaaaaaaaaaaaaagaaaagaaaaagccgaaggtcaaatattgataatttcatatgaattatcaaaatatttccacaatcaccatgaatgtaatgaaaatggaagtacaaataacagaaatgaggacatatttacctatgacttgggtttgtatatagaaagattcattcacagtactgcatttgagatacttctttaagaatgagtaagatgctgacagaggtggagtgaagaaaactatggtataagggatagttaattcattcaaaatgtatttgttgagcccctattaagtacccaacaccatgttaagcaggagcaggaacagtaaaaaacacagacacgaccccggatttcatggagctttctcttcagctataatgtttagactgaagaggggagagatgtgataattgtctttttcaagttatctaagactaataataagaggacaggatgtgaacaaacttattttctgaagttccatctgacgtaagtaggtccacaaagtcaagataataaaaaattagtttcactcaatttaatgaagagcatgccaataattaattaagctgaactaaatgactgccatagttctcaaaacttcatgtttctatgattataatgctcaaaagggtaaagaaaagagtaggcatcacttgatagaatttatacagatctcccgtagttcccctttgaaaatgtgtgagcagcatttcctaaatcatctcctggtgtgacattaagatctcatgatatttcattagagattctgtgaaaaagattacagttgacaaatagtaaataaggttttcgggtcaggtgcggtggctcatgcctgtaatcccagcactttgggaggccaaggcaggtggatcacgaagtcaggagttcaagaccagcctggccaacatggtgaaaccccgtctctactaaaaatacaaaagttagctgggcatggtggcacacatctgtagtcccagctgctggggaggctgaggcaggagaatcgcttgaacccgggaggcggaggttgcagtgagccgagatcatgccactgcactccagcctgggcaacagagtgagactccatctcaaaaaataaataaataaataaataaataaggttttcccactacagacctttcctaagactttcacatgctaatacagaggtccccaacccccaggccagggaccagtactggaaccgggccacatggcaggaggtgtgcagcaggtgagggagcattacatcctgagctctgcctcctgtcagatcagcagcagcattagattctcataggagcacaaaccatattgtgaactgcacatgcaagggatataggttgcatgcgccttatgagaatctaatgcctgatgatctgtcactgtctcctatcacccccagataggactgttgcagaaaaataagctcagggctcccattgattctacattatggtgagctgtataatcatgccattatatattacaatgtaataataatagaaataaagtgcacaataaatgtaatgtacttgaatcatccctaaatcatccccctcccactttgcggaaaaattgttttccatgaaaacggtccctcctgccaaaaaggttggggactgttgtgctaatatacatttgctatggtctcattcatatcccctcaaattcgtatgttgaaatactaactccctaggtgatggtattaggaggtggggcctctggaaggtgactaggccatgggggcaattgtcatgaagaatgagttactgcttttataaaagaggcaagagaggcaccctttgccccttctgccatgtaaggacacagcaagaaggcaccatctagaaggaagcaggccctcatcacacaatgaatctgctggatcttggatttcccagcctccaaatctctgagacataaatttctgttctttataaactacccaggctgtggtattttgctacagcagcccaaatggattaagatgacttaacactttctccaaaacgggaatataattactacagtgtttcctaaattggctgcaaagcttttgttttcttgttttccaaaataacatctattaagaacttataagacactggtggtttgttgaagacagtttaagaggaaaaaccatatcggcttactatataaggcatgtggtaaaggtgaaactatgggacaaagctagaaagtttgattaggagccaattatactgaagactgaagataagatcaagcaggatgtgctttatttcatggacaaagggaaaccattatatatttttaagagggggaatgacaaccacttggaaaaaccatttgaacgcttgttttttaggcctataactacttggagaataaactgctggaaaaagaaaaaggccaaaataaagaagatgtaggtggctatttagataatcaaagagctatatattaaagagtagaaggggagtataagcaagacttaaaacagaaggataatttgaaaataaattggcaagacttgatgatcattttgcttgttggagtgaaggatgaagctgagattttaatttttggtgcctggatggagagaagaggtatctgaaacaggaatacaaaaggaggaagattttcagtgttcccactcctgcaacaaatggggacttgagtaagcacagtatacctaagtctaggttttgattagaagcaattcacttaaatttatgcccaattatagcttctcttcatcaattccttttttccattaaggctgactgtttgctaattggccaaagagcaaaggccttcaagaatggaaaaccagaccctaagcactagcttatgttattatgttaaagaatcacaaaggtctgcatgtggaaaacctgacacaaggcaaggaaggcaaataaaacatgaaaaatgcacatacagctgacactctgaagcagcccttctcttcctgggaaaacaaataattgtattgcatagctcttttttagactaactgttctgtgttcagtagttatggtaaaatttagggagacaccaggcgcagggccaagagcaaaggttttggaagcagagagctctgggttcatatcctggctgtgtcacttcctcattaagtgatttgaggcaagtttgtttcttcatcctgcagagcctcagattcctaatttaccaaaggagaatcttagaaattatctcataagacacttgtgatgactaaagaacagaatacatgtaaggtgctcagtataaggcctggaacttttatttttgttgtgttgaccttattgatattttctgctaacttgagaataattaaagatgaaaaaggaaaatctcagggattattacaatttcaacataaccatggttttctaatctcctttgcttcttcatagagaaaaaaatatttgcttttagatggtagatcttaggtaccatggaaacaagagttgaaaaggcttcaagtaaatagaaagcaaacagctgagcctgagttcttcttaaaaatgtaaccacaaaatattgagtagatcatgatttctatggaattttgaaggcaacataggtatgtattactatattaccaaatcaagaactttcaaatattgaaaatttctgaatcatttattataagctgctttccacttttctgtttcttatattgcatacatgtaagaaatgcaactgtggtttaaatgatggaaaggcaaagagtaatggtaatgaatgatcttcaatcagtatattttgttatgatcaatggatagatatactcagtgagtagaaataattatttgcttcctatttaatgatttcataatttaaaataaaattttatgagttggagaataaatttttgtttaagttttattgtcttgcaggtttttaatatgaagttacctttgatagatattttattgaatgtagtcaatttttcttagtctcaaggtaatgtagcttgtcactaaatatccttctaaatatgattataagtcagaggtatgtataaaagcaacttgtttgcaatgtcttttctctgtcttatcataggataaccaggtttgattttttcaaatactaagaaaatttacctgatttgaaatacgtttcaagacttaatgtattctaacatttcttgctattaagaaccactaagtccccaacaatactacagtcagactccagttgagaaccaaagttgcagggtggatctagcttcagggaaaaccccccaacctccacccctaaaaaaacaaatgcctttatttcaattgcattcacaatatttctgatctcacaggaaagcaaaaagctttaacgtaaaaagcctacaaatttctccaccaatatttgtccatattggggatttatgatagcaggcaaagagaggcaataaagtggtatgggctttttttcaggtttcattatttattatgaaaataacacattcacaggattgaaaaaaactcaaacaataaaagtccctttatcaccccagactctgagctgtcaactgcttgttatatgtttctccagaaaaattccaatgcacatacaaatatacatgcatcctctttctttatacatggaagcatatcacacacagtgttctctactttggctttcattctaaattttatctcagagagttttctatagcttcatatctggagcaacctcattgttttaaaatgtattagggcctcttcccctgtagccccagtgatatggggcagtataacttctgactgcatgactttggagaggagcctggccgcagatggccgggcttcacagaaagatcaccttcttcccataccatcctccttccagctccccttctgctgagagccacttctgccacttaataaaatcctctacattcataaactgttcctgtgacctgattcttccttaatgatgaaaaagaattcaggacacactgggtgcaggaacccaaaaaggctgtcacactgactcttcacggagctgttaacatttaagccatccgtggaggcaaagctaaaatagcattgtttataacatgtgccctctggggctccagagctctgtcacaggcaacttcttttttttttttttttttttaatttttttttttttttattatactttaagttttagggtacatgtgcacattgtgcaggttagttacatatgtatacatgtgccatgctggtgcactgcacccactaacgtgtcatctagcattaggtatatctcccaatgctatccctcccccctcccccgaccccaccacagtccccagagtgtgatattccccttcctgtgtccatgtgatctcattgttcaattcccacctatgcgtgagaatatgcggtgtttggttttttgctcttgcgatagtttactgagaatgatggtttccaatttcatccatgtccctacaaaggacatgaactcatcattttttatgactgcatagtattccatggtgtatatgtgccacattttcttaatccagtctatcattgttggacatttgggttggttccaagtctttgctattgtgaataatgcctcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagttgacagtcccaccaacagtgtcaaagtgttcctatttctccacatcctctccagcacctgttgtttcctgactttttaatgattgccattctaactggtgtgagatgatatctcatagtggttttgatttatgataccaaagccgggcagagacacaaccaaaaaagaaaattttaggcaacttctactcactgctgcaggctggtaaagggttccttcctgctggagcccaaaggcactcgccccagctcctgcaccccctcacctgcatgctccccctctcgaaagctgtttgagtgtggcttaaagagtaaatgagccatacccctgttccatgtcccagaaggggtggagggaactctcctctctcaccagtgcattgggaggctaaggcagcaggatcacttgagcacaggagtttggagaccagcctgggcaacatagcaagaccccatctctacaaaaaatgaaaaattagtcaggcatggtggtgtgcctgtagttgtagctatttgggaggctgaggtgggaggatcacttgagcccaggagtttgaagcttgcagtgagctatgatcatgccactgcattccagcctggaagacagaggaagacactgtttccagaaaaataaaaaataaatttaaaagtatcacagtagggataaacagtccctgctatgcaacagcaatgaaggttcaatggacaagctttgtgcacatttggaattatattttcagatagttcctaggtttgtaactaatcagtgaaatctatatacctttcaatattgatggtattttcaaatgggccttcaaaaagattgtatcaatttaaacacccatcaagaaattatgcctttaatcaacactacatattaacaaatgtttggatcctgatgacatctccttagatacttaattaccatttacattgctgttcctgtatcttgttatatcaacaactctgctcgattttctattcggttgctgatcttttccttaaatatagtttaggagatatttatgtatttataaaattagccctttggctaatatatagccacagatactataactagtttttaaatctgtctcttggttttgtttgtggttttcttgctttggatattcaaatttaataatgccttcctgtaagacttatagattgtgtgtcttaatttaaaagactatgcccaccactgaaaccaaccaaccaactgccaaattttctactaatgatgatggtgatggtggcgatgatgatgatgattttaagccccaacatctagcatttattttattctaaagaatgagatagattcaagttttctttattatttttctatttccaacttcctatcttgttatatcaattcatgtattgaataaactattttcctcactggttgaaaaactgatctttattacattctaggtaatgtaataggtacaaatgccttaggtcttttagtgtttcttgatctctattttaatctattaatctgtacgttttgtcctctgctaagatcaaactcttttaacttctttagcattatatttataatgagttgggttttcctcattactctactatttaagaattatctcagctattttcccaaattatttttaataaaatgatggtgacattacagattcatttataagcattagacatttaaacatattcgacctttccattcaagaatatgtctttccttaatgtaagtcatgatatcttttttgcctctaagtaggatttttaaatttcctttataaaattctgcaaaatttttgataagtatatacctacatgttttcttttacatagctattctaaatgacatcttttactgcattttaatttgaattggctgtctgtacataggaaagttggttggtgatacaaattttttatcacctattttctctattctcttcatttaaagattttttttcttttaaaatgcatacattttccaggagtaaaaaatcacataatttgtcataaatgataattttctactttcttcactatttttgtacctcttcattacttgtgttgtctaatggcactggctagtagattagaataataccaattaataatggtatctgtgggcatctttgcctttttcctaacttcattctttttatttgtagtaatttatgggatataagtataatttgttgcatgaatagattgtatagtggtaaagtcagggcttttggggtatccatcacctgaataacatacactgtacctattaagtaatttctcattaccaacccccctcacccacctgcatccttctgagtctctgttgtctatcatttcacactcaacatccacatgtacacattatttagctctcacaagtgagaatatgtggcatttattaatatatttctgggtctgagttacttcacttaagataatggcttccagttccatccatgttgctgcaaaagacatggtttcagtcttttttatggatgaatagtattctattgtttgtatatatcacattttccttatctgattatccactgatgggtacttgggttgattccctatctttgctattgtgaatagagctatgaaaaacatatgagtgcaggtatctttttgatgtaatgatttcttttcctttgggtagatgccaagtagtggtattgctggattaaatggtgttctatttttagttctctgagaaatctccatactgttttctatagaggttgtactaatgtacattcccaccaagtttttcaaaactttaaaggtaatacctacatgagtctagtatgtcagcctttggctggatgctggccttttctgtaaagttctggatgaaaatgaaagctcctaataaagctatgttgtatattactccattcctgaatctcaggagaactgagaaagtactgaatttcctaaatcttctcttagttctcatctatctctcctgaatttaaatgaaaacatgcaaactattttagtttacagttaatttataaggtagtcttattcattgatgtatgtaatattaattaatttttatgtacaattataaaaaataaagatttcacagagaagaaatctctctcaatatatgtgtatatgtgtgtgtgggtgtgttaccaacatagcatgaaattgttataagcgttcgatattagaatagtttcatttctcaaagtctcaggatacaaaatcaatgtacaaaaatcacaggcattcttatacaccaacaacagacaaacagagagccaaatcatgagtgaactcccattcacaattgcttcaaagagaataaaatacctaggaatccaacttacaagggacgtgaaggacctcttcaaggagaactacaaaccactgctcaatgaaataaaagaggatacaaacaaagggaacaacattccatgctcatgggtaggaagaatcaatatcatgaaaatggccatactgcccaaggtaatttatagattcagtgccatccccatcaagctaccaatgactttcttcacagaattggaaaaaactactttaaagttcatattgaaccaaaaaagagcccgcatcgccaagtcaatcctaagccaaaagaacaaagctggaggcatcacactacctgacttcaaactatactgcaaggctacagtaaccaaaacagcatggtactggtaccaaaacagagatatagatcaatggaacagaacagagccctcagaaataatgccacatatctacaactatctgatctttgacaaacctgagaaaaacaagcaatggggaaaggattccctatttaatacgtggtgctgggagaactggctagccatatgtagaaagctgaaactggatcccttccttacaccttatacaaaaattcattcaagatggattaaagacttaaacgttagacctaaaagcataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcacaacctactcatctgacaaagggctaatatccagaatctcaatgaactcaaacaaatttacaagaaaaaaacaaacaaccccatcaaaaagtgggcaaaggacatgaacagacacctctcaaaagaagacatttatgtagccaaaaaacacacgaaaaaaggctcaccatcactggccatcagagaaatgcaaatcaaaaccacaatgagataccatcccacaccagttagaatggcaatcattaaaaagtcaggaagcagtaggtgctagagagggtgtggagaaataggaacacttttacactgtttgtgggactgtaaactagttcaaccattgcggaagtcagtgtggcgattcctcagggatctagaactggaaataccatttgacccagccatcccattactgggtatatacccaaaggactataaatcatgctgctataaagacacatgcacacgtatgtttattgaggcattattcacaatagcaaagacttggaaccaacccaaatgtccaacaacgatagattggattaagaaaatgtggcatatatacaccatggaatactatgcagtcataaaaaatgatgagttcatgtcatttgtagggacatggatgaaattggaaatcatcattctcagtaaactatcacaaggacaaaaaaccaaacaccacatgttctcactcataggtgggaattgaacaatgagaacacatggacacaggaaggggaacatcacactctgcggactattgtggggtggggggaggggcgagggatagcattaggagatatacctaattctaaatgaccagttaatgggtgcagcacaccaacatggcacatgtatacatatgtaactaacctgcacattgtgcacatgtaccctaaaacttaaagtataataataaaaaaagaatagttttgtttctatttataatcttcctatataggcatgtcattattttagtaaagataagcctgaatatgttgtaacgtatttgagtttttgttatttctctttccttttatcattaaagcttatttgtttgaaatctatacaaatacatgagctgaaacaaataaaactcaatccacttgagattttgaagacatctggtggagttattttctgagtaattagaccaagaggtgggacaattccctgaagtaagctaccctataattggatacccagttatatctgcagtcatcagcttgcattcagtgagcatattgattcacaaattgacaagcaattatgtagagttgccacctgattttccaaagaccatttatgttataaagaatatgtcctacatgctttttaaaaagttgcctcttctcagtcctctcatagtctgttctatttctttatgttctgtcacatcaatatgctatttatcttgtcggagatcttgaaagtagaaagtagagccctcaagtgctggtctctacttgtctctggttaatccaacatttgggaacaaatatgaattatttacaatttggattttgaacatgtgtatccattttggttcagagagatatctagtaagggtaaaaaagatatttaaatgcttcaatttttgtcatgcttgatattctttggcttgaaaatgttgaataataaagtattaatacttaaatatatgtcaacattacaaaatcataagtctggaagagatctgaaagttcaaagagttattctgtctgctggagagcaaaaacacgtatgctaccatggaaagatatatatgtttccaatttaaaagaactccaggagattccacaactaccctaatttatccattgtgtagcagaaaattgctatcctttatatctaattgaaatcccacaggttattagaatctactccatcctttctttgcctttagtattttatctttaaggatggtatttacagagcagcaaagtcaggagttttaaccaagccaggggcaaagataatcagatcaagaccctctgagaaagggctacaattaccatttcttctgttcatgaatcctacactatcactgttctgaatcaccctcaatttaattttagataagagttaggaagttaggattcactttggatgtaagttatgagtataagatactttgaatctatgacatttacaaatccttaacaaatataagggcaaactatgcacatggattaacattagacattaatgtaaacacgttcaatttatccaagttaaaaatgctccccagatctcgggatatttagatctgactaccacgcaggtgcaattcaagaatattattatttgcttgggcatttaacattgtcagtctattcattcgcattatttatcttcttaagtatgaaccatgttttaatttcatgtagtccaacaggaagcaagtcaagatttattcacaccattttacttttcaacacatgaaacaagatcaccaaaccttaaccaaaccaattcaaaactttttgtcagagaataactccattttccattccactaattgaaataacagtatgtccacatgctagagtagtgagtaagtgaatcttgaagtgcaatgcaaatgcaatggaaaactcaccggaagtttcatctactctttcatctactatgtggtccttctgatgaacccattcactattacacttgaaatagatctgggtggcagggcttgctttacagtacaggttcacgggcttattcttcacaatataagcttcttcaggctcaataaggaaatgtggcagaggctcaggtggatcagaaggaaaagtttctgggagttcatgaaaaaagtcatcatctgagaaagaagaagaaagtggaagatggttaacacattgtaacaacttgccttctacttgctagtcatgtaaaaatagtgacttataaatgcagtaattaagtgatttgaatgcctgctgtgtgccaggctgtatgttagatctattgactggtcatttaaggatatggattattattcccatttctatacacagcaaaactcaacatcagggaggataagtaagttgccctgagcacataggtagtaaatagcagagctgaaactggaattcatgtgtatctcaattaaaaaccatgatcttcccaatgtatcactacatttcccattatagagtgtcacccttgagagcagacaaaagcaagagcaacttcattagaaacatgtatttgaaaatcataaggctcatagataaagcttacacactttgcaaggagccgagcagaaatattagaaactttaattaaggatatttacgttccaattcaaatctgttgttattttcaaaagatgtcattgtgtgaaatattcattcaacccaaaatttaaaaaccactttagataatttgcacactttgagatacattttaaacctggattctgcatgattcaaaataaaaaattaataataaatgtgctttttataataaaacctattattgtgttttacaaaagtcaaggtaaaaacagtctttccaacacaccataaataagttcagcctaataataatcttccaattgggacagaggagaacagagctattactaattccccaaactggttacaaatacgtaattgaaaactctgatgtcaaaattaaaatttttttacaagttctttaaatgtacgtatattcagtagtaaatatagagcatggtattggtacttaaaggctggttgctcacatattgtcttgaaagtcattttatttctccttcagttgttgccctgtgttggaagatagccattggtatagtggacatctgtccactaagaaaactggcttggaacttttttcattcaagtcataagatagctgtcaaatagtaatgatgtccggtctctgctactctgttttgcagtaaaaattgacttcacttgcatcactgacaaaactagcattccaagctgcccacagtagtaaatttttgacactgaaatgtaaatgttgtttcctatacctagatatttcttctcactttacctccttaatttgctttcttttggcagggcatcatttctagtttttccattgttgaacatcaaggaccaaaattgtcagcttactaaagaataaccttgtttccatcaattgcagctcctttagtcaatatgcaagaacattcaagactgcttaaataaacatagctcagaaaggcaaagggatgaggaactgaactattgacaaatccatcagcatgaaactgatgtcttgaaggtcttaaccaattttttttcttctaaagcacttactgttatatgtgatgatggacagtgctgataatcaataaagctccgcaaaacatgactcaaattctatagaagttagctgttggttttaattattactatttatgaaggtggaaggtcaactagactttattttttaactatgtttgtacacataaaacatgtgactgtatttaataactatttatttaagcatgcaaagtataataaatctttcagccattgtttcagaaggtaaaacttgaaaaggaatgattgcaagatacagatgattgtatactaccttaccttattcaataatatagcaaaagtatttaaatgttcacatgctatagaaaaacttcataggcactaaaaattgattactctgccttgccaaagcatgtatctctttcttctgattattttattgtaaactactgaaaagacaaatggaagcaaaaaagtcacacattttcaagtcaaaagcagctctgttaaatgctgggaaaaaagtgataatttaacaatatatttagaaaatgtatgggcaaactaactttgtatttccttaattttgacttttaagacaacatgatcaccacaagtaaagagagatgaacctatatcttggtttgaggtttcacacagttattgatttttcaagatgtttgttaacacttgaaaatgcaacttattaaggaagatttctatcattagaaatgttttaatttaataaatccagtttttctttgcatatcattatagtttctgcagaatcaatcgttaaaagtttatctagagagatgccttagccaaccacagcatagtagtttattaagatttcctataatattcacaaagtaaagtcaagcctatgccctggatgaattcctgttataggcaatatggcatatcacttctattactcaactcagttgttgagaatgatattaatatagaaaattcaagaacttgatttagtagatatgtacagtgggacagatatgataaaatgcaaataagctgattatcagtgggctcacccctgttgtgaaatccttgccttctccacatacaaaaatgagctgggtaccttactcaaccatcgaagttggtcccaccatcaagttaacatactaaaagaacactttctgattcttgctccatagaaaactgtcaagtttcagcattaattctcagatacagtgttattttagaaatcatctttttacgaaactgtatcctaacttttttctattctagagaaagttttgaaaatgaaacaagcaagccaattctcttcaactgaaataatagatgaaaactttaatttaaacatccagcatgactatagctacatgtatttaaagataaagtgatcagctacaaatactatttatcctacatgaatatttagctcctctgtgtaatgcatttgccagtcatacaagtggaggaatctacttttcagttttgcaattggttttataagactattaccaattttcaaaaaacttgaaatatacaataaatgcttaacactagagatgaaactctttgaaagcagggactatattgatttcattttcattttccctaagtctagcacattatatggggtcaataaaaatcttacaaatgcatgaatattatactaatggcaactttgatcattcctaagagattcacaaggaattttagagtttatagtgcctcagattcatttacaattataagatgttttaacaatagaaatatctacaaacaggactggctacaaaatttgtgtggcccggtgtagaatgaaagttcaagatccctgattaaaaatttattaagaattctgagattgtgacagcagaacattaaaccaaacactggtcctgtgtgacagcagaggtcacatacccgtgaaaccagccctgtctacaaatgtcaggtaaatgagcatctcacttcatggaaagtctgaaaaatgaaattgcatctttattactggatattcattttggaacttagtttgttttccagcttcttgtggtaattagctattttctaaaggaaaacacaattgttcagactgagaaactcaggctcatatcaattctctaagcaagcgtatttgcaatggtgtgcaagggaaggtgtgtgactttatgtgtctgtggccttcctttggatgttccctagtgcccatcaaaggtcctctgttccaaaataagtaaaatccctgccatgctaaaatttttactttttcagggcattaaaggactgctgaacccatggggataagaaaatctgtgattccaccctgaagtggtagactgtttactgagatcagtaccttcaattcaattaatattaccatactacaaaaaaaccccacaaaacaaaatgaaaaaaacagcttaaggtcatgctgcaaaacttggagctataaaaaaattgatttttttttcttcaaggacatcagtgagtacatcctcttaccactttattttttaatataaatatctgaaggagtgacattagggtgataataagaattcagtttgtgaacagcaacttcagactgtgaacttatttctggcaacatgccacaggtatcccaaattattaccttttctataaatgcacaccccagctgctggtattgactgcattgtgctatctgggcaaaatgacttgattaattaaattgtgaaacacgttttgtacatgtagttcattcaaattaacaaggtaaaatttccagagttgcttttgttctgtacattgaattcagtattaacttaacgcatttttgatttagatgtaacgctattattcattttaccctcctctgatatttgacttaattttccactttctactattactcaatactgacattccaacagtagtaccatttttatcttgatatcaataaatctcagtatttccttttttctgttatctcacataggcttttgctgtttcatttatacccaagaagagaaagcttttcaccatgtattatttttatagactttcattccacctaattcttcacaggaatatattatgctatgaacatcaatctagggagctttaggttgctgattttattgctaaatatcaagccttaattttcatcaacttaatacataagtttctatatttctgaatcataagacttaaactattattgcttatatcataaaatataggaccattatctctttgtctgagacttgaagcatactcctctgaaatggaatttacttccaagtgattcaagagcaatttaaaatgaatgactgcaaagctaatgttatctgcatttggctacccatccatcagagagataattcatgatatattacaacaaaaggcagctggaattaactagttgaatgagactccagcttatttttaatattttgattaaaatatcctcaggaagacaaagactatggtctatatttcaagcaatatattaatggattcatcatttaaattcaagtcgttgactacataatgccttaaatgtattgcacaacttggaagtactgaatgatttctaacttcaaaacaaacttttttttgcttttaaagaaatacttgccaaatcatgcccatacattattaataatatacagctaatatgctagttgatatccacttaactctgaaaagggggcaccattttctgcccgcttaagccttcatgaactctgacttttattaattaatctatcctcctaagtgttttccagcctatcatctctacctctgccatgtagtctacagtgtattcttagaagacattttcacacaaacacatttacccccttttgcaaataatttaataaatgcaatgtgatgttttttgcaaaagaaaatttttgcttaccaaattagctaaaaaatactcaatgactgatgaggaggtgaagaaatgtgcaattgcatatatggctggagtgtaaatgggtatcacagaagatagaatttgacaatataagtaaaaattacatctctgcatatctccaaataagctatcccacttgttggaatccatattacagacagaatgacatgaaagtgtaaatacatatgtacgaagatgtccactgcagcattatttgtctaaagaatacatgatatattacaacaaaaggcagctggaattacttatttgaataagactgagaacaactgaccaccaactgaggaatggttaaataatttctgaaacatccaagcaaaagtacactggctggccaatagaaataagaaagtggatttgtacgtattgacctagaagggcaagcaaataaaacaagtttttggccagtttgtgtagaattataccattttttttataagaaagagagaaagaaagaagaaagagagagaaagaaagaaagaagaaagagagagaaagaaagaaagaaagaaaaaaagaaaagaaaaaagaaaaagaaagaaaggagggagggagagagggaggaagggaggggaggaagcagagcaagatagccaaatggaagccttcactgattgtcctccctgcaggaacatcaaattgactatatacaccataaagcaccttcatgagaaccaaaactcaggtgagtgatcacagtacctggttttaacttcatatcactgaaaaatgcactgaagaatgtaggaaagacagtcttgaattgttaatgtcaccactctcccaactcccagcagtagctgtgaggtgtggagagagaatctgtgtccttgggggaggaagagggcagtgattgtgcgactttgcattggaacagagtgctaccctgtcacagcagaaaccaaaatggggcagaattcagctggggcccacagagggagcatttatactgccctagccagaggggactcacccatccttaccgtcagaacctgcgttctattaagccttgccaccatgggctaagggctgtaaggtcctaaataaacttgaaaggcagtctaggccacaaagactacaattcttgggcaaataatggttctatgccaggctcggaaccactggacttggggaacatgctacctagtgagataccagccaggctggctaagggagtgcttgtgccacccctcccctaaccatgggcagcatggctgacagcttataggagacattccttccctctgcttgaggagaggagagggaagagtaaagaagactttcttttgccacttagctaccagctcagccacggtaggatagggtactgggcagtcctgaggcccatattctaggccatagttcccaggctacatttctagagccgctttgggccagaagcaaaactactaccttgaagggaaggaccaagtcctggcagaattaatcacctgctgagtaaagagaacttaggccctgaataatcagcagcaatatccaggcggtacatgctgtggttctggggtgagactcagagacgtgctggcttcatatggcttcagactgagcacattcccagctgtagtgagaatggactgggatgaggctccttctgcttgagaaaaagggagggaagagtaaaagggagtttgtcttgcaccttaagtaccaactcagccacagtgggacagagcaccacatgaatcccttgaggttcccaattccaggccttggctcttggatggcatttctgaaactgccctgggccaaaggggggcccactgccctgaaggaagagtcaccacaagctgactgaagagcccttgggccttaagtgaacattggtggtagtcaagcagtacttgctgtgggcctggggtggcagtggcagtggccatggaaaaagactcctctgatggtggaaaggagagggaagagcgggagaaactttgtcttgtggcatgggtgccagtttagccacagtagaatagagttccaggtagattcttaaggtttctgactccaggccttggctcctagatgttacctctggatccgcacagggctgggggcaacttgcttctctggagggaagaacaaaggcctggctagttttgctgccagagccctagggccttgagagaacatagatgatagccaggcagtggctaccatgggccttgggtgagactcagtactgtgctggattcaggtctgacccagcattgtcccagtgttgggtagagacagggatgcttatgtcacccctcttcaagctctaggcagctcagtagacagagaaggagactctgcttgtttgtttgggagaaagtaagggaagagaccaaaattctctgcctagtaatccagagaagtcttccagatcttatccaagaccacaagacctctatgagtctgcaaaagtcatagtgttactgggcttgggatgccacctaatgcacacatagctggagtgaccaaaaacttagattacaactcttcaatgcacagacaccaataaacatccacaagtatcaaggccatccaagaaaacatgaccatgccgagaaaattaaataagacaccactggccaatgctggagagagagagatatatgacctttcagagaattcaaaataactgctttgaggaagttcaatgaaatctaagataacatagagaaggaattcagaattatatcagatacatttagcagagaaatggaaataattaaaagcaagcagaaattctggagctgaaagatgcaacagacatactgaagagtacatcaagagtctcttaaaagcagaattaatgaagcagaagaaagaactagtaagcttgaagtcgggttatttgaaagtacacagtcagaagagacaaattagaaaagaatgagaaaaaaatgaagcacatctaccacaactagcaaatagcctcaaagggacaaatctaagagttattggccttaaagaggaggtagagagagatataaaggtagaaagtttattcaaagggataataacagagaacttcctacacctagagaaagatatcaacattcaagcacaagaaggctacaaaacatcaagcaggtttaacccaaataagactacttcaagacatttaataatcaaactcccaaagactcaaggataaaaaaaggatcctaaacgcagcaagagaaaaaaacaacataaaatggagctccagtacacctggcagcagacttctcagtggaaactttacaggccaggatagagtggcctgccatatttaaagtgctgaaggaaaaaaaatcttcttttcctagaatagtatatcaagagaaaatatacttcaaacataaaggagaaataaagactttccagacaaacaaaagcttagagattttatcaacaccagacctgccctacatgagatgcaaaaaggagttcttcaattggaaagaaaatgttaatgagcaataagaaattatctgaaggtgcaaaactgactggtaatagcaagtatacgaaaaacacacaatattataacgttataattctggtatgtaatctactcatattttgagtagaaagaccaaaaggtgaactgatcaaaaataataacaataacttttcaagacatagacagtacaataaagaataaatagaaacaacaaaaagttaaaaagtcaggggacaaagttaaagtgtagagtttttattagttttctgtttgcttgtttatacaagtcagtgttaagttgtcatctgtttaaaataatggatgacaagatatcatttacaagcctcatgataacctcaaatcagaaaacatacacaaaataaaataaaaaacaaagaaatttaaaaatgccaactgaggaaaaaaccttcactaaaaggaagacagggagaatggaaagaaggaagagaagatgactgcaaaacaaacagaaaacaaatcacaaaatgtcaggaataagtccttatttgtgaataataatattgactatgaattgattaaaccaatcaaaagacacagagtaactgaatggattataaaacaaaacaaaaaaaataagacccaatgatctgttgcctacaagaaacacatttcacctataaaggaacacatagactgaaaataaaggaacagataaagatattccatgcaaatggaaaccaaaaaagagcaggaataactgtacaaaatagatttttcaatacaaaaactatataaagagagagagaaagaaggtcattataaaatgataaacgggtcaattcagcaagagggcataacaattgtaaatatatattcatccaacactggagcacccaaatataatatataaatcaaatattagagctaaagagagagatagacctcaatacagttaaagctggaaactgcaacaccctactttcaatattgcacagatcatccagatggaaaaccaacaaagaaacatcagacttaatctaaactatggaccaaatggacctgatagatatctacagaaaatttcactcagcagttacagaatgcacattcttctcttcagcacatagatcattctcaaggatagaccatgtgttatgccacaaaataagtcttaaaaaattaaaaaattgaaattatatcaagtatcttctctgactataatggaatagcctagaaataaataacaagaggaatcttggaaactgtacaaacacatggaaattaaacaatatgctcctgaacaaccagtgggtcaatgaagaaattaaaaagtaaatttaaaaatttattgaaacaaatgataatggaaacacaacataccaaaacctatgggatatggcaaaagcagtactaagaggaaattatagctttaagtgcctacatctgaaaagtagaaaaacttcaaacaaacaacctaaacattcatcttaataaactggagaagctatagcaaactaaacccaaaagtagtagaagaaaagaaataataaagatcggagcagaaataaaggatattgaaatgaagaaaacaataaaaaagatcaatgaaacaaaagttggtttcattttcaagttttttgaaaaaggagacattacacctgatactatagaaattcaaaggatcattggagtctactgtgagcaactatattctaataaattggaaaatggagaagaaatggataaatttctagacacatacatcctaccaagattgaaacatgaagaaatccaagactcgaacagaccattaacaagtaaggggatcacagaagtaataaaaagtctcccagcaaagaaaagccaggacccaatggcttcacagctgatttctaccaaacatttaaagaagaactaataccaatcctctcaaactatttcaaaaaaatgaaggagcagggaatacttcaaaactcattctatcaggtgagtattacccttatacccaaaccagaaggacatacggaagaaatcaaactacaggtcagtatccctgatattgaacattggcacaaaaatcatcaacaaactagtagcaaactgaatttaacaacacattaaaaagataattcatcattgcccagtgggatttatcccaggcattcaaggatagttcaacatacacaaatcagtgtgatacatcctattgagagaatgaaaatcaacaacatatgacgatgaaaacccatttgataaaattcaacatcctttcatgatagaaagactaaaacaaactgagtatagaggaaatatacctcaccacactaaaagtaatatacaacaaacccacaactggtatcatactaaatgggacaaatctgaaagctttttctctaagatatagaaaacaacaaggatgcccactttcatcactgttagtcaacatagtactagaagtcctagctagagcaatcagacaagagaaaaaaaataaagggcatctaaactggaaagaaagaagtcaaattatccttgtttgcagatgagatgatcatatagttggaaaaacctagacttcatcaaaaaactattggaactaataaacaaattcagtaaagttgcaggatacagggtcaacatacaaaaatcggtagcatttctatatgccaacagcaaacaatctgaaaaagaagtcaagtaaataatcccatttacagtggctacaaataaaataaaatccctaggcattaattaaagaagtgaaatatctctaaaatgaaaactgtaaaacattgacagaagaaattgaagaggacacacaaaaatggaaagatattccatgttcgtgggctggaagaaccaacattgttaaaatgtccatactacccaaagcaatctagattcaatgcaatccttatcaaaatatcaatgacattcttcacagaaatagaaaaaaaatgctaaaatttacatggaaccacaacacacccagaatagccaaaactctcttgagcaaaaagaacaaaactgaaggaatcacattacctgatttcaaattatactatagagctatagtaaccaaaacagcatggtactgacataaaaacagacacacagactcatggaacagaataacaaacccagaaacaaattcatacacctacagtgaattcatttttgccaagggtgccagacatatacactggaaaaaggacagtctcttaaataaatgatgctgagaaaactgggtatccgtaggcagaagaaggaaactagacccctatctctcaccatatacagaaattgaataaaaaatggagtaaagaattgaatctaagacctcaaaccatggaaccactaaaaataaagattggggaaactctgcaggacattgggctgggcaaagatttcttgaataataccttacaagcacaggcaaccaaagcaaaaatggacaaatgggttcacatcaggttgaaaagcttctgcacagcaaaggaaacaatcagcaaagtgaagagacaacctacagaatgatagaaaacatttgcacactacccatctgacaagagattagtaactagaagagatagggagctcaaactgtacaggaaaaaatctaataatctaattaaataatcagcaaaagatttgaaaagacatttttcaaaagaagacacacaaacggcaagcaggtatatgcaaaggtgctcaacatcattgatcattatagaaatgcaaatcaaaattacaatgaaatttaatgaccagtaaagccagttaaaatgacttttattcaaaagacaggcagtaacaaatgctggaaaggatgtggagataagagaacactcatacactgttggggggaatgtaaattagtacaaccactatggagaatggtttggaggttccccaaaaaactaaaaatagaactaccatgcaatcaagcaatcccactgctaagtatacccaaaagaaaggaaatcagtatattgaagagatatttgcactcccatgttcattgtagcactagtcacaattgccaagatttgaaagcaacctgtgtccatccacagatgaacggataaagaaaatgtggtagatatgcacaatgtggtagatatacacaatggagtactattcagtcattaaaagtattttttaatgactgtatagtactccattgtgtatatctaccacattttcaaagtacccatttgtaaactacctgcaagcaggtatatgaaaaggtgctcaacaccattgatcattacagaaatccaatgaaaactacaatctataaaaaagattttttatgactgaatggtatttagttataaaaaaagactgtttctgtcatttgcaaaaacacaggtggaactggaggacattatattaagtgtaacaagccaggtacagaaagacaaacttcacaggttcacacatatttgtgggagctaaaaagtaaaacaatcgaactcatggagaaagagaatagaatgatggttaccagaagctgggaagggtagtgagagggagggcgggagggggtagagttaatgggtataaaaacatagttagataaaatgtataagatctagtatttgatagcagaacagggagaccacagtcaacaaaaatttattatacatttcaacataaccaaaagagtataattggattgcttgtaacacaaatagaggatgaatgctcgaggtaaggaatactccatttaccttgatgtaattattttgcattgttttcctgaatcaatacatctcacgtaccccataactgtatacacctactctgaacccacaaaaattacaaatttttaaaatgcagacaaaaataaaaagaatgagagagaaagggtgtgtgtgtgtgtgtgtgggtgtgtgtgggtgggtggctgtatctccctcatacacacacacccacacacacacacacacattacaagaaatataaggtaaaacctagaagctgatgcacacaaacattgatggtcattacttctggggaaaaggactggagggctttatgggggattttaacctttatttgaaacagatttttcaaatcctagattatcagtgattcctattttttctgctttttgagcttttattcaaatcaagagatagagaaataaaatattcccacatgcaacctattacttcagcttagaataaccacaagtctcttcattaaattcaaccctcccaaatcagtgatactgactctataaaaaaaatcacttgatgtctccattaaaacctgtgtttatagaccatggtacttgtaagtataatgtgtaacatttctttaattcttcctgcctttatctcatttttctctattttccaatgccctaacgtcctcatgtctgtgacctctgactttaaactaacatagtttagtagctttctcaaatttggcttagaaatcaatattggttgatcactttctatttgctgagactgtcttagctactatagtggaagccacactttatatttcaatgaaatctttttacttataaaaagaaatcatgaaatagaagatagtaaatttaagataatctgactttatgatagaaattggtctattagtctagttatgtaaatatcatgtttataactaatttgtaactcattagtacttgacattcactttaacgtgcttaattttaggatatcagaaacgtttgctaatatgtggagggtcttacatagggaattaagaaaaagttccggctgggcgcgatggttcacgcctgtaattccagcactttgggaggccgaagtgggcagatcatgaagtcaagagatcaaaaccatcctggccaaacatggtgaaaccccatctctactaaaaatacaaaaattagctgggcatggtggcacatgcctgtagtctcagctactcaggaggctgaggcaggagaatcacttgaacccttgagggggaggttgtagtgagctgagatcgtgccactacattccagcctggtaacagagcaagactccgtctcaaaaaaaaaaaagttctaccatttccttactccctattaatgattagagctacataccctgtactagtattgtgaacctcaggaatttgaagaacaaaaaaagattacccataggaatattgtaaaaattcaataattattgacagacaaataggacaacttaaacatagggttaagccttactagctaactaataagaatgatttataatatagaataatctaataaagattgaaaattcattattacaatgtatttgcatgacacatgctctcttctctggaaaaatctctgtgatggtcaattatatgggtcaacttggccaggctagagttccccattattcaatcaaacatcaacttaggtgtttctgtgaaggtattttgtagctgtgattgagaccacaattagtgaccttaagtgagggagcttattctagataatctggatgtgtctgattcaatcagttgaaaggccttaaaatcagagctgaagcttctcagagcaacatctagattattgtttgattgaataactggggactagagcctggccaggcagacactgtcagattctcctccccgcaatgtcatccccaccatttctcataactcttacacatttctcagatattagtttaaatgccccttcacctgaaggcctccccactcctggacattagcccttgctaacctctccctttgctccttgctgttttcctggttcacttttcttccccatgagatggcatgttcagagggtgaagggcagtgcctatcttactcactgctgcataaccaatgtctacttcagggtcaggcagtaaacctgactttagggttaggctttttttttttttaatttgcattgtggttcttaaagaggttctgtaagataagacagaagtttataggaattactctattaatcaaaatcatgaaactttggaagaaatccttgtacaaaataaaacagaaatgtgcatatttaaaaactgtccctttagtgtttgtaagtacagatccagttcccacatttaaaaaattctatgtggccaggtgcagtggctcatgcctgtaatcctggggctttgggaggcagaggaggaaggattgcttgagcccaggggtttgagactacagtgagctatgaccatgccactgaactcctactgggttgacagagtgagattgtgtctttaaaaaaaattaaaaattaaaaaaaatatgtatcttctatgcaagtgctaatgccatccaccatgagatgtgtagagccttggactaaatacattccttcactgaataattcaagttgactctaatacgtgttgtgaatgagaaataagatgacacctctgaatacagtgccccttcaacctctcggcctcatctgacatttgaccccactgcaccaactctctccttttgcaaacttcctcctctttgggggactgttcattagcactctattgcttcctgtcctatgtcttcgacctttccctttcttccttgctgcctggatacagtcagatacttaccaagctttctcctttagtctctccccaaggcatctcatcccaactgtggcttcagttagcagatcatgtcacatacacaaccttccactccactctgctgtttcttaaaacccttcaatgcctttgcactgaccaagtatgaaatcagactccttactaaggccgaaaagaactcccctgatctgattgctgccagcctctatgtctcattttcaaggccatgctccagacagacagactggtgtttgtatctttgaacacaccaaactcatttccaccctagggtattcacacttgcccttcacttctctaggaaggatatttcctcttctcactgccgtttaggtttcagctcaggatgtaccctggacaaagggattcttgaccattgtatctcaagtctatttctccctccaagaacgtttccttctatctgattatttcttactacctatcattttctcaaatttgcttgtttactaagttagttgtttatttcctttcccttccaataaaactccaagctttatgggatcagaaactttgtccattttgttcaacacttgacatcagatgaacttatcttccttctaaaactaccttcccctgttgacacagctccccaatccagactacaagatcgttcaaaagcttggaattccttctccctgtcaggcctaatccattgacaattacagtgcataccagctcttcattatttcactcaccctcaactcctattctccttttcatcaccaggactcaagttgaggtccttatcatttttatttgaattgttacaagagcctcaatactgatttgccttgctctagattttcttctctcaactccatttatgccacatcattacattagcattcccaaatgaatgtggaattataacagcttctgctggaaactttcagcattccacacaacatggcccaaagcttatttaatttccatttcacttaataccattccaccaaagccaaatttggtgattctattttccatcaatatagcctttaaaattttttccactttcacttatttattctgcacttaatgccttattccttaatgactttgagttcattcaaaaatctattaatgatcttcccagataaaaccattacttgctcttcaactgtaaaaatgctttaatgcaatttgggggtctcaattgtttttactgcagtcagctctaccacacacctaagcgggttctaaaacttttcattttaagtgaacacatctaaaagtgatgacttgtttcaagaactatgaagaaaattaatgtcatccccatggatagattatatattataaattaaattacctgaatataatctaaccatatctatctatatcaaaaatatgcatgcattatatatttcataatattataaaaattaagtatatgcaaaattaaagaacctcaagtacctataacccatcttcaagaaattttcaacactgtgccaattttgttccaaagaaaaaactgttttataaatatttagaagtcacaagcatggaaaattatatcagagtgttaggctaagatagtgaaggagactaacatcaccaaactgaaaacaagaattaaatttataatattgcaaactatgaaaagaaaatagaaatatattgaaaataagaatatttggtttatttaaaaaaagaaaacttagttgatgtggtacaatgtttatcattaaaattattgtgacactaaaaatagttataaccaacgataagaccatatggtttaaagtatattttaactaaataaccatttaaaaactctaatttaagattttctttaaaaattaaaaaactattttagtgactatagaatgtagaagttattacttcaattcagtgaaatgatttgttaataatacacatgaaaagtacagaagtccataagtcctaatgaagttcatgagcacagaaaaccttcaaaatcaaaggattgccccaagctagaaatctaagaattatctttgactctttcctctccctcatttccaacataaaaacaacgaagttctactcattgtatgacctacatactttttgaatctgtttctttctgtttcggattccactattatcatcattttttgcctaaacattttcaaatcttcataactgttgttgtgtgcctgctgtctaaaggtaagatctgactaagtccccctgtggtttaaattcctgtagctcctcgtttcctataagatgaatccaagcttgcccacatggtctatagggcctccatagcttgctgaccactccaacctcatctttcaccactccctgccttgccctccacattccaaaaacacagaccctgtatcatcctatgcacacaacacgcagtttctacaccttctgtcttcaatgacttttctatcgtattttacctaactcttccatatatatatattttttttttttttttaagagacagggtcttgtcctgtcacccaggctggagtgcagtggtgcaataatggctcactgtaacctcaaatgtctgggctcaagccatcctcccacctcagccttatttgagtacttggaactacaggcatgcaccactatgcctggctaatgtttacatttttttgtagagatggggtcatgctatgctgcccagggtggtctcaaactccggggatcaagtgatccttccaccttggcttcccaaagtgctgtctgggattacaggtgtgagtcaccatgcccagccagcatcatttcttttaggaagttttctctgactctcttcacctgtgccagtttagaaccattttctatctctctcccacccgtatcttcaacttgttaggggcttatatctatttctaacactaccttttataattagctctgtagctaactagctggctgttatgcatctttgcatacttggtgcttattatgctcagggagttgaatttgtattttttgaataaatgattgcagagctgtctgtatctaggaaagaatatagattttgttctcatagattaagaattgtgtaattgctataaaaataggctttgagattccacagacctagttttaaatatgagtactgctgcttattaggtatgtgacttctgacatttcaccaaatctcagtttttgtggctataaaatctgtagatatggcaatgtggcgacagtgtgtgggttacatgaaataagggaatgtaaatgacctagcttagagatgaccacaagataagatatccacatataaaaatattctacttgccttattttcttgttgaatgtctattttggtatcaagcttctctcattttcctaaatacacttgagctctagtactctttaatccctccaccagtaatgtcttttctctcctgtgcctggtgaactcctagtcttctaagttcaccttaagctttatttcctccagcaagtcattctgggcccttccagcatggggttgttgccatctccccctgctaccagtgcacaatgggcatcattgcaccgttgtgcctatcacacagtaatatattacattgttcttttctgcgccccacccccccagcatgaaacagagtttatctgaacaagtttctgtgcatttcatttattaatctggagtacccagccatggtggaagtacagactcctagagtgctaagggactcttggtacatagcaaaaccaaagataaataaaagacgaggtttgctgaataaatggatgaatacatagagattcctaaaactatgtttcccccaatttttaaaaatataaaagtcaatactcttcattttactacttttaataaacaatacgttagtttttgtgttaatgccttgttaagactccttattactggttgggtgcacacttcttattccagtagtttgggggactgaggtgggaagatcatttgagtccaggaatttgagaccagcatgggcaacatagagagaccctgtatctacaaaaaatttaaaaattagttgggtgtggtggcacccacctgtagttacagctactcaggaggctgaggttggaggatcatttgagcccaggagttagaagctgcagtaagctgtgattgcaccactgcacttcattcagcctgggtgacagaggaagaccctgtagcaaaaaaaaaaaaaaaaaaacaaaacaaaaaaaaaacagattcctcgttcttcctcattctttcctatggtatacaaaattgtttttgtcttatcttagttctctccctattaaaatttaggctataacttataatcaaaatttcagaatttgcttattaaaaatctccctatgtagaaattccagttaccatatcacttaccaaaatttgtttattttcaagtactgcttgggaggcatcagcaagtggtgaaaggaacattgaaccatgagttcgaggccttggtattggttccagccacattcataatgatcttttgccttttctaagtgtgtttaagtgagctgatggattgattcatattctataaacaaaaatccaagttgtaaagacatcatacacacaaatggcagtttccagaaagtgaatatagtctagaagtcccttagcactctaggagtctgtgcttccaccatggctgtgtatcaggactgtgtgagagagaggcctgggtaacaaggcaagagaaagaggtccagagaaatgtctcctttctttgtggccattctcactggctaactggcagttacaaaactgtagggtgggaaaacatgagtgagtattgcttgaggttatagagaagtaatctgttgcataagtaaatatctacagtgaattttagagttggtaaaactgtctcgttttatataagaggaaactgggcgcaactggtctgagtgacttttctgagattgcacaggtattaaggggaagaccttccaggccagtatcaaaatttcatggctctgctatgtattttctgactttgtaaggtctgtgacaacatttccaacccatttctaattcatctgaggtttattttctcttcttaattttgagctacccctgtggactactgatttcttgttttccttttttttgtttttttttttatttaaagacatggtcttactctgtgacatagaaggctgtagtgcagtggcacaatgatagctcactgcagcctccaactcctggactcaagtgattctcccacctcagcctcctgagtagctgggacaacaggcatgtgccactgcacccagataattttttaaattatatttttgtagagatgggatcttgctatgctgcccaggctggtctcaaactcggcctcaagccaccctcctcagcctcccaaagtgctgggattacaggcgtgcaccattgcacctggccttgcattttttttatgctgttacatgttccttattaaaaagctattattaaaaaactaaaatactgtccaggcctgttgtctcatgcctgtaatcccagcactttgggaggctgaggccagaggatcgcttgagcccagcagttcgaggtcagcctgatcaacatagcaagacctctgtctctacaaaaaattaaaaaaaggaagaaatagccaggtttggtggtgcatgcctgtggtctcagctactgggaagcctgaggtgaagggatcacttgagcccaggaggttgaggctgtagtaagcatgatcaagccactgtactccatcctgggtgacagagcagggccctgtctcaaaacaaaaacaaaaacaaaaatgacaaccacaaaaaacactaatagtaacatatgttagtagctaaaattttacagtaaagaatgaatgtgtgtgtgtgtgtgaatcacatacagtgttcaaaaacagataaatgggataatgctatacatgttctgtgtcttgactactgctttttaaataaatactctgcctcacttgatccatcccttacaaacttggtgctatcataaaccaattatgtgccaactgctgacctactatgtttagtataagctaccatcatacaatatttacaaaaaaacaagcaacaaaaaaaacaccactgcacatttatggctttggtaatgtttacatggtaccaaaattttggcaggtgttttacaacaaaaacaaaaaagcatcacaatccttattaatgcagtttctacctttagcttaaagtagatcaattctagatccatgtgtgtccttttttaaaatcatagtttccttgtggcatgtgatagaattcatttttttgtggctttgcaagaagagtgttaactctgttgagagaaaatgttcattataaaccacatttatttcatcctttttgatggagcaaatgacattcttccaaaatttattattttgaaggataatatacccaatatactgaagaagatggtaagggtatgagtcacctctagcaatgaacagtgctggttaatatttcacatttttacctctcctgcccttagaaatcacaatacttgacaccaggtcacaaaattattaaaacttcaagtggctacacttccttctccacgtgagtcctcacttctccttaacattttactctggcaatcccttcaggcttctggccttttctccctccctttgaccctcataactaattaaatctggacaagtctttggtgaaaatagtttcctttaaagttattcattcaaagttccccttaaggcattctttgtcactttagcccagcctgcaatctttacatgaagttgaaagaagtgagctatttttataagataaaaaaatcttgcaagacctaaatctactttagggccacagataaagactagattttgaaatatgacaaatgtttccacagccatgaaactgttattctgtagaagtctgcagataaataaaaagttccaaggactctggctatgcttaaaggcagttaaagttttaagatttcatgttgtatttggaggtagttatatttgaggtctgtaattaaattctacatcaaaagtaaaagattaaccaaccagtatagttgaagtcatgcccaataagtttgttttggaaatcatattggatttaagaattaagtagctagtatccatttatcagaagacaaaagtgaagattgaatgatataagaaattaagtctggggctatgccatggcttaagtattttcactgttgagataaaataaaaacttgccaagttgccaattactttagacctacttctacattgtacaaataaacagaaaataatgttttatttgtttacaaatttaagaatcaggcatgtaacttcttttgttggccaaaggtgttcagctctagggcaaaaaaaattggatgagatttaacgacaagcttcagcatcatttgttaaactagagaagtgttttctcagtttaataattgctacctatactgtttctaaaaaaaaaaaaggtgagagaagttttctttatgaagccatttttctacattatttaataatattaccttctcatttttcagctaccctctgggacgcaactttttaaagctccctgtgtttttcctagatgaaaacttgggttttgaaactttgagtgtgtcccaagactatccatctgtttaatagaagagctaggaaaggaatctaggtacctctggcttggtaagcctgactgctgtaaacatgacactgcctcccaaaatgtgaaagcttggttttgaaaataattctctaacagtattatggttagtaacaatattgaaaaaaatattttaaagaataacaaatacttaagaagcacttacaatatgccaggtatcctactaaggacttggatattttccctcatttaattctcacaatagcaccgtgggtaatatcattactgccattctgaagattaaaaaacaggcacagagaagtccattaacttgcccaatgtttataaagctagtaagtagcaaacattccctttttgcttgacaaatactcaatacatagacttagagaaccatctgatgaataataaactctgtggagtttcccaaggagataccaacatctatttattagttataggtctaaacgagaaatatacagatgttaccttttcaacaatacgtttatacatgctatatatactggtctcttcagagattacaatgacatgttcttattattctttcatttgcattactttctaatttatttaaccaatatatttataaaaatgttttaaaagttatctgtgaatttaaaattactggtaatctgtaagttaaaggaaaaagacttagcaaatcattgtccacaatatgaagaggagcagtaagacacgaatggcacaggatatgtataaccagttggagaattgttaactgctccacagagtaagagattagcactgttaaaagtattgtgaaataaataaacaaacagaaaatttgcaaaaaacatacagggaaaggattccaagttaagtagtgcaatacaactgtaatgtttagccacctttcactgttccttatgagccagaaatcttaaattgcattttatccattgatagtgtgcttcttcagaatatctacaatacaaaacaatgattatgagctaatgtaagctgaaacagacgagagtgatttgtggaaagatggaagcaccaaagatctaactctggcctcttgtgtttcaggaggtggatttctttgaacggtatccatttcctttctccaaggcctctgttttattaaacctccaaaaaagaaattagaattggccatctttggaaatataaaggaggcaaatgatttgtgaaagaaagtaattacaaggttttctcatgttaaggaggcattttaatagaaacgtactcatgtctagaaaatataggtctgtgagtatatgcggttattttttaggaaggcatcctttctgtcttccacttcagtaaactcagaaagtaaaaacacgttctgtgactgcagctagttcattgacatttccagcatatcattttcccaaagtttgagagagcaatggattgatttcagggttcacagtggggcaggataagacagcacggatcacatgtctttcggaaacaatataaattcatagagctatttcaaggtttcatgaagatgtgataaagtactggatttggttacacatttcctcctgcagggactattttatccactcttcttagataagtcaggctgatttgttgttttcatactctgtttttcttcaaatctacttaaataagcaggttgatttcagggcagtccctttaactctctcttcttctgcatgcgttcaactcaagttcttgtgaaatcattatccttttcataccttcaagatgaactgccacaaaaagtgaattaaaaagcaaacaaaactaagttaaaataaaatgtgatcaccaaggatgtgctgctctgtgcagatgtggacatggaatcatgcagcatttatgaaagtgtctcctgtgagtgtgggctgcagatcgaatgtctgtgactctctaaaacacacagtccttcaggccaaagtgccacttcactctcaccaaaactagaaccacatccaaatcaaagcaaacaaaacaaacatttcagtagtcaagagtgcagagaaataagacagccatttgcattggattgttttttgttgaaatcactgccagtaattccgaaaaagcttctacctacttgtatgatctgtcaaaaaaatcaaactgccttttttcacagattaggaaatcaagctgaatcatactgaaccaaaggctcaaaaaatagtcttatgattctaatgatcaatcaacccattcactccttcttgttcttcagtgttctcagagcaccatgctacgtgacgtatatatataaaaaacagattatctattatctattatatatatatatatcttacttctaatcacttacaaactgaaacagcccaacaattaatgaaagataaggtaaaaaacacactggactcagtgtcagaagacttacattgtcaagtcacatgtcttctctgagccctagtttcaacacctgttaaatgaggaatgatgtcaggaaaacatcttgtttttcctttttctatcatctatttcttcttgttttgaaaaagaaacctcttccaccctcttaggccacgtggttcggtttcccactcgcttcccctcctgcccatcggagcgttccaatcctctgaccacaattattggttcaggatgagcacatgacccaaggcagtgtaattacaatgaaatctgggattttgctgtgatggggagaaaatgattgctgaaagactggctgttagtatgacgctgttcatggccatcttgatgtgggatggaaacagcgaggttgcatggagcaacacaaagaaaggcacagctgagagatggagcaagaatgtggtcaggtcatcatttagagcaatggatttgactgtgatggagccagatgggtctaattctgggattttctgttacatgaaccaataaatgtgttttttatctttttgacttaaacctgcttgatttgggcttctttcacttgcacccgcaggattcctcactgttatatcatgtgacaactgagctgacataccaatatgaatggtatttttggaaagttcttacttgttaaaacacaaaagctaaaatccttggctttgaaaaatatatttgcacttttatttcattcattgaataactttaaatgaaaaccccttctctatgccataggcactctagggcctgggaatatgaagatcaagaaaatgaaacaagttataaaggagtttataggcaagtggaaatacaaatgtgttaaataataataggataccatggaaaaggtaaaaagtgtagactacaaaatgcagggatatcatattacacagctctagggggcgccgttcatattgtagtttatgtaaacatcaccccctggagttacacacactcagaaaccctagctacacctctgccagctggtggactgggccatggacacacttgcaccagcaagtgttttcaatcaccataacggttcttcttggctgtttcattttttaatgagctgattattgctcactatatctgagtttttagggggagtctctggcagacagctgcaccaccggcttaccattacacaaaccagacacaaatctcactgatctcacttggctgtgctatcatttgttagtgatcatttggcagaggcaccactaaatcaagagtctgcaaacaaaatgtcgcatcccaggattacagaggtcttcgggcagtgggagattcattgaacatcagattaagtttttggcaaaacaagtggagattttatgactcagagatcgtttacaacagcatactttcacattgttgcctcagtgataatacttcattttaagtggcaaaatcaaactataagtaaattagtagccaaattaaagcaacagctgtgtgttttgatagtgattaattgcactctataaaagaggctttgcttgtctcttgtcagtcacaaaagagagtgaaagaatgttctttgatataatgccccttctgaaacagtgccaagttagttcattgtttagctacaaaacaaaaaagaaacaaaaacaaaaaacctctgagagtttcatgcagatgccgcttttcactggtgaaataacagctacagtaccccttgacaccttggagagccaccctgaggcctcactccaggagtcaaatttagacctaatcacctctttccttgcacagcaaggtagcatcagccctaggcttggggcaattggcctaccatacgtagatgctgaatctcacacttctgggggaagcaattgaaaacctcatttgaactatactgggcaaagtgtttggataaagtgtgggggtgacatattgatatacttttacatctgtgtttaccaacatattaagatgtgccacttgactgcatgttcaaaatgacccatctcaatgactcctggtcccactttctgctgccactctcaaccatgccgtgaaactttctggagcacttcctggactgcatttcaaaaataccaaaggtctgaaggctgacaggtttgactgtagctgagctggcaaaatacaacactgctttcctggcacagaacatgtgactccaccaacaactgcacaagctacatcattgtgtctggagatactgaaaaggaaacctctttttgatacaccaaaatgctgctaaaatgttgatgttaggaggtgtggatgctttcaagaactatatcccattattgatatggggacaatttgacacagcattcaatatttggtggaggtagtttcaagtaaatctgtaaagcatttcactttatcttcaaaatgactgatattttatcctattgacactatgattgcttttgcagctttgatttagctgctaagtcttagaaccaaatgtgtggcaccctgtaaaatgtatatgtaattttacctgctggttttacggagaaggcaggggagctcagtgacccagagcccaggctcaaaggccgggtgacagatttcaaatgagtgcctttttaactctgtgacttggaatatgtaccttaatttctttttcatcctaagatatttctaaggttattgtgaggattacatgagtaagtacatcaaaagtgtctacagcagtgcttagtattgatgccacactgaacaaccacttcatcgtcatcaaatcattatcatcattgccttatttttctgccctactaactttctcaaggatttatcttattcattgcagtttatgtatttttgtaagcactgtcaaattctttatcaagaaaggacaccataagcaaaacaaaacaatgtaactaatatagatatatttatatttaagtatatatttatttacatgtaaaaaataaatatttaggtcgggtgcagtggctcacacctgtaatcccagcactttgggagtccgagaaaggcggatcacctgaggtcaagagttcgagactaccctggccaacatggtgaaaccctgtctctactaaaaatacaagaaattaactgggcatggtggcatgtccatgtagtcccagctactcaggaggctgaggcaagagaatctcttgaacctgggaggtggaggttgcagtgagctgagattgtgccactgcactccagcctgggcaacagaacaagaatctgtctcaaaaaaaaaaaaaaaagaaaagaaataaagaaaatacaatacaacataatacaataaaaaattatataacatttaaaaatatataatacaaaaatttaatataatatatattttattttctatatttttcatataaataatgtaaaaatataacaatatataatgtaaaagataaatatatattttcaaaattaaaatatatcactaaaagtactactccattttgctattacaataatacccttactgaaaattttataattctgtttaaatattatatttcataatgttatttctaatggctcaaacctattttaaaatattcttttcaatgctcaaatgtgtcaaagtgccaattgatctttatcttttcaaatgcagatcaatttctaacatacatagagttaaaatgagacatgttctaaatatcaatgcacatgaaaaatcactgagaataaacaacattaaagtaagtacaatagcaagacccagttgtctgggatgactgatgatttctagagatctgagctcaggcactcatctaccaggtgttattttcctttttatctagggtttagctgctatgtaaaaagtgatgtgattttttcccccaggatttctctgctctaaagaattttctgagaagttttttttttttaaatcaaaattataagctgtaatatgctatgttttcttccatttgaagagaaattaaatttggttcagtggaatatcctacagcaaagtactgccaacccactatctggtcctgtcacaaagggcctggagttacctacttttcaaaagagaaaggtacaattttatgatgttttaggaagtgaagtcgaggtaagcattattttgtattaataaaatacatgtgatgggctgagtgcactggtgtgcacctgtagtcccagctactcaggagtctgaggtgggagaatcactttagcccagcagttcaagacaagcctgggcaatgtagtgagacctccatctcaaaaataaaataaagtaaataaaataaaatatgtgatcctgaaaacactgatcaacttacaaattatatttcatccaagatttactgtaagagatgagtcactgtattcttttatcctaaacttcttgaggaactctaactgcctggagcatccaacaataatgaaggcaacacaattaaaatcccaatctctttcctggatggctctatgttttgagaaattgcttcacattccaaaatcttctatttgaataaaacaatcaaatactaacctagtcatgaagttgattgtaaaatgtaacaagaagcaattattggtaggacctttgtcaacataaaattgctagttgcaaacctaagtgcaaaatgattttcaaaggctatagctccagatgacaaccctaagaggtcttctgattaagtccagtcaaacctaactttggttttgtttcttttttaattgttaagcgaatttttgtcacattaaaacagcagagctaaacattgaggctgttatttcaaaagaaaaataacttttctttgtgaggcaatttataccaaaacttttctgtttttgcccaagtataatttgcaatgccatcaggcttgctggcagcagagggatattgtaagccatcacaggaatttaggaagttacatttataataatgtcttgcatttgactagtcatttgaagttcagcaaaacccttcacaaacctgtatcatttcatcttcactaagaccctgtcaattaggtagggcagagtttattaatccccatttaacatattatataaaggctcaaaaaacttaacatatccccaaatcataccactgctcactggtacgtcagacctagaatttgagtcttcttacttctcccattcttttttttttttttttcaaagaaaaatccaggagtgcagtggcaaatcatggctcactgcagcctccactttctgggctcaagtgattctcccaccttagcctcacaagtagttgggattatgggcgtacaccaccatgcccagctaatttttttgtattttatgtttttccttagagactgggtttcgccatgttgcccaggctggtttcaaactcctggtctcaagtgatcctcccaccttggcctcccaaagtgctgggattacaggcgtgagccaccgtactggccttttcctgtccttcttaacactatgctttgttgccactttatttgaatgtagatgttaaatattttaaatattctatatattaaatattttatacttaccctctaaaaatgtgatcacctcttctctaaaatcttattggtaactcctagacaactggactataagaatattaattatgttaccttgatgataatcaaactttgaacatactatttatcctaataatattaacttatctttctttactctgatgtttaaacttttcacataggctaatttcagtgactctgtaaattttagttgtttcaaggagatcaattatattacctaccatacttagcccattgtaggtgcttaagaaattctttttgaattgatcagcttctatctaagaacattatagatcatgttagcaatgaaatacaaataagacatgtggaaaattattttacattatcttccctagaaatggctgacaaattcattctgatgaaagacagatatggtgcagtgaatagatgctttcacagatgcattagaggtcatgaaagtaacccagacacagtctaaatcagtctctggtgtgctgacagcctgttagcatagcgtatgaatacccctttcatgatttaaaaacattttgacgtctaaaataacactgtctagctatctgtgatgtatgaaattatatcataaatgagtagttcaattcaatactgagatatttagaaaagcaaattcaataagctaataagtctatgtgcttttcctgtctatagaaactaagtaaaataacatgtttttataacatcttttttgaaaaaaaaaaaaaccaatcaatttcaaaatgctttacaaattataggcttactactacatttcacatcccattatggcattggtaagaattatcaattcatttaaaaatgtaaataaatgaaaaaagaaaaacaaataattctagaaacaaaaaaaggcaaaattatttcaaagagcaataaattgaaaggtaggctgtctctgatgacagctaatgtatatttatgatgcacttcattaaaccctgtgactttttcaagaggccacctgtaagccagttatgacttacaggttttaggaatgcattatattcttggccattactctccaaatcaagtgtttgagatgttctcaaagtccaggtgagacctaaaccagcactgtccattgcaaatataatgcaaatcgcatatgtaatttaaaattttcaagtcatcactttaaaaaagtaaaaagtaacaagggaattttaatgatatattttatttaacccaaaatgtccaaaatattgttattgcaaaatatattcaacattaaattttattgaggatatattttacatttttttccttgtaccaagtttataaaatcctgtgtgtgtgtgtatgtgtgtgtgtgtgtctgtgtgtctgtgttttgagacaaagtcttgctctgccacccaggctggagtgcagtggcacaattacagctcactgcatcctcgacatccactatatctagctaaattttgaatttgtttgtagagatggagtctcactatgttgatcaaactggtccttaactcctggcctcaagggatcctcccacctcggcctcccaaagtgctgggattacaggcatgagccactgcgaccagcccagtgtgtatttttatgtatactttctgcaatctcaatttggtgctaaatttttaccagaaatacttgactttaattcggttttcataaaatttatagttcaaaaagtaaggccaggtgtggtggctcacacctgtaatgccagccctttgggaggctgaggtgggcagatcacttgaggtcaggagtttgagaccagcctgggaaacataatgaaaccccaactctacaaaaaaatataaaaattagctgggtgtggtggtgcatgcctgtagtcccagctacttgggaggctgaggtgggaggatggcttgagcccaggaggcagagattgcagtgagccgagattgcttgcgccactgcactccaagctgaacgacaaagtgagatcgcatctccaaaaaaaggagattaacctatccaaatattccaagtgtactaaaaagtttcttaataactgcatccagtagcagttttcaatttaaattaacaaaaacttaataaaattaaaaatttctcagtcacattagcaataccattgataccgttatcaatggtccaatgtaactggggccgctatattggatagcacagatagaaataaaattaagcaacaaagaaagtttcgactacagcggtaggtaaaatatgaataaataggaaggacggcattgcagaggaagaaaacgagttgaaatgacaagtatggataaaactgctttttgtagcccccccttttttttttcaaaactgtttccaaaattattctatcatattgtgttcccagaataactttaccatctgtttattcactgtccacaagaatacacaggatatagttttagaggtagaaaaaaactaatgagcatacatttcaaattcttttaaagaatgagaaaggcttggtctagagctgcgctctccaacacattagccagtagccatatgtggctattgagccttgaaagatggcttatccaaactgagatgtggcttaaatgtaaatatgattaaatttcaaagactcaggccataaaagaaggtaatatatctcattaataatattttattatggaatacatgttaaatgatattttagatatattgggctatataattatattactaagattaatttcatttgtttttttaatgcagctactagaaaattttaaatttcatatgtggtcatattatatttatattatatagcatcatctagagagaaagtttacttttgcttatgtcacagcattgcctgtacatgcgatttctgatattcaccaatatgctagcaggaaaaatgctagcaggaaaaggctgcatattcctggccacagttgggccttaggacctggtttcctgtcactggcttttgcaagcaaaattgggtacactcatgaaaagtagagcctacatgaaaagaaaggtttatttgtactcattttcagctaattgttgttttgttttgttaaccttcttttgctcacttatatttggcagcttgatttgtgtttttcattcttctgaagttgcaaaagcagcaaactgcaccacccattgtgggtgactccatgtaattaccgcgtacaggtttatactttatcacagtaagacaacagcatcataagaaaagcactacatgatttccaatgattatatgaataaaataatcactgggttgtacaaaagagtatgtcattcaaaagaatacgtagttcaaagtggtcattcgtttttctaataagtaagcggtctgtagagggaaagctataggtttaagcttgtcttgacgttgtttatctagtgatcacaatacatagcagggtcctggggccattaggaagtttttaggtttatttatctattcatatttagtacattatttaagaaaagagtaatgccaattacttagaaattagaaacttctagttgtttattgataaagttactttaaacattgtttagtccaaaaaacatggattgaaagcctgtctgttttcagtaacacttcagtgaggcagccttcccctagctgtgatagtctcctcagtgtaatgctgtttcataacgtttctccataggttatatcttgacagaaaaacggacatgaaataaaaagaaacataaaagatgagaaaaatccatactgctttttaaaatgttgcaaaccccactgtacataaggcagacctgtcactgttcttcaacatttgctgaacctacagctatgataagaaagaaataaaaacacagtatattttgtgggggggggggagtatcaaatgtgattgaggttagagttggaaaagatgaaaactgataggaagatgcagcataatctgatggtttagaggcaagtcctgcatctacatacattgcctgagttcactatttagtacctgtgtgaatttggatgagttacttaacctctctgtgtcttgtttttttcacttgagaaacagggataactgaatcgccagcttcaaagtattgttatgtaaattaaataagttaacatgtgcaaagcactggaaacaccagggctacgtaagtgtttgttcaataaatagtttttcacagctcaaaacctcacagtagcataaaggacacttgagaagctggaaatcaaatgggtatttaactcaaattttcacccaataaaacatctgttctcttccaaatcatgacattaaaatgcaataacccttactaactttggcaatttatttataaaaaccatgttctgcatttcttagtatagattttcaagctatgtgtctttctgatttctacattgtaatgcagccagccccagagccaggacaattgcactgtttcctatcaattgcctcttcagtgcaatgcctcctgaaaccatttcctgaaacatgtaacaatcctatcacataattgtgtaaaaccctagacacccatgcctgttgtttaatgctaatttccttgagcttcctaagaggaattgctattgactactttcattaggaaactattgacccttctccagtggagcatcctgagaagaaattcactaaatatgcccgtatttcatcttttgaatatcaaggtgcagtaggcatgctgcaggatatggcttatttaatccaaaattaaaattttataggctacattacctaaagtaaattgcttaatacatttagaagaacagctgctttctaagtgtttggcatccatgtatttgagacctaaattaggcaaacccactgacacaaatgcagacataatggtctccatgatattttggatgacatcccctatcacatacagaaaagcgatttccaaacgggaaaggttgctctgttaggtattattgatttcaaagagatttcttaattcttcctcttattgttattccataaaattgagaaatagtcaaaaacattttatgggatttaacatcctgatttttagtttctttggccctgtttgggtactattacatttttattaaaaatgagtattcgttccacattcaaaattagatctaaggcatattacaatagaaatagatataaaatatagcacttacaggcagaacgaatgtgtggttggtggtttgttaacacaggagagattttcttgctctgcttctatgcaaggtactgagacatcattctatagtgctcagaggatgcacaaatataacaaaagagttcagtttagatttctgaaaagttgggtgtaagaagtagcaccaggccctaggtcctgatcaggaagaatcctcaagcagctacaccatcacaggagagtaaaaacaatacaaggttgtagcagattctgccagcactccttgaagctaggattaagttctgatttcctaaagaccaaatatacctcagattcaactcctacaacgtcttctgctaccaacagagtcaaaaccaccatcatctcactatctcttgtcttgtactatagtaatggcctccttgcaggtttccttgttttgacccctaaacgcaactatcccgcaacagccagagtgatcttttaaaaacataagtaaacacatgccacaacactacttaactgttccccggctttccatggtttcattttaccatggcctagaatgccctacatctatatgagctgaccctcttcttattctatttcctaacattttctccctcccataatctgtgccagtcactcagactttcttggtgttcctctaatacttactaaataatatccttctaggtatccacatatcctgctccctccacgcatccaggagcactctctactgttgctttgccaaagaatacttccctgactgtgatccgtctccttacgcaccatttcattcttcttggtgacttttatccctgcccaatactgtggcaattgttgatgtgttgatatgatgtttatctgattcttcctcccaaatgtcctaacagtttgtttgtttcgcggctgtatcctcagcactagcacagcaactggcacaaggtagacactcaggaaatagctgctgaataagtgaatgagccctgagtttatgggacataaatagcttagctgttgaatatgggatggaaagacactgattcattttacaaatgtgggaagggggtggcgagcttccattaatgtccctctgatgttgaactatgttatgcttcaaaataagaaagcaggagtaaaaattatttcatcttagtttgttaagccattctaaatatgatgaagttattttgatgacaatctctaatggaatcactacacatgagatctgatctccagttggcctccaactgtgatcttttcctgcatttgaagaatgggtctgaattagcccttaaattacattataagcaagttgacataccaacaaaaaactcggggagcacgtactctgatgttaagaaaacaggaaggagatgtcaaagcaacatccctcaggactcttcttaatgaattatgaaaataattcaagaaaacaaaggagaataatatttcaatgcagacttgccctcaacatttgccgggctcaggataagagtgcaaatggaggtttgcacaccatatgcctagatacttcaaggttatatatcaaggcaacaaagtattaagtaaaatatttattatcctctaatcttgacaaatatatcttctagagatatattataaagctaagttccaaattatcattctttaagtgctttgagtgtcacgggttttcaatgaccagattccttagttgccataagcagccctgcatatgcctctatggccatcctggtccactgcacatgctctgtccacaccccttacaagcagtcgctccttggcctcccctcagaatcagggatttacacactgacagcaaggcttctacttgagaggacaggcccaagcaaatgatccatgcagaccctggaaagcaagctagagccatttgagcagaaaattctggaatcttgactacccaaggcataatctagaagagaaggtaggtgaggaggagcatagttggggaaaggctcaaaatggggaccctctggagagggaggcccagggtggcaggccatctaacccagtctaagtgaggcatggtctggtgcagtcagactccttctcaagaggacatgaaagaagcagaaaagtatggaaatcaagtataatatatatgtcatataaagtaaatacaaagtttagaaaaatttacagtactgactctcaggaagttaaaaatgttatggttgctaaattataataacatcgcaggttgaactataatgctgaatatttaaatcagcacttcaagcatgaaacagttgaattgatatagaaaagaatataggttagagtaacatgtagtaaaaatgcttaacagagactggaaagtggatattttattgtatttatctttccttcatccttcttgcctagtaatttgtcacgtagtagactcacaataaacatttggataagaaggagatgaacaaacaaaagctaaattaagaaatgatgagagaaaatgacagacacagagatacataataggagttcagaatcaccataaaaatgaattagaattggttatgaagaacataattgaagaaagcattttaaaacttaggtaaaaataagaagaaaccaatatcaaagtagtttctcttaagattctttcatgtcatagaaaaatacattatccatacttccaaacagggtaaaaaaatgacaatggattattttaaaggagaccattttcaagaaatacgtcagtattccttttacaatgaagaaacaggataaaagttggaatataaagatgattgttataaagaaacatgttaatataaaatgctaatctgaaaacccacaaaagcatcatacaattaatttgaggcaaaaagtttttgatgacatttaacactcattcttaataaaaccattgaaaataagattagaagaacaattttctaatagcaaagtacctatcttaaggcgaaacgcaatattctttatgggaaaattcttcagaaatttcctttaaatccaggaataaaataagcatgctcattatttagcattattgtggaagttatttctcatccaagaatagttttaaaatatacagaataggccgggcgtggtggctcacgcctgtaatcccagcactttgggaggccaaggcaggtagatcacgaggtcaggagattgagaccatcctggctaacacggtgaaaccccgtctctactaaaaatactaatacctgtagtcccagctactcaggaggctgaggcaggagaatggcgtgaacctgggaggcggagcttgcagtgagccgagatcatgccactgcactccagcctgggcaacatagcaagactccgtctcaaaaaacaaacaaacaaacaaacaaaaatatatatatatacagaataaacagaatcaatgtttgattcattaactcattttaaaattttcccttgagatatctgttcctttctatatatacttacacatacatctcatatatgtatgaatacatacatatttatacatatatatcttatgtgtatgtatatatatatgcatacacacaaatatatatttgttttcagtaaattattttgttcttaattctgtactgctgaactatacagtaatccagtttctactctaagaagcaggttatatgatattagagactaaaagaaaatagattccttttaaacattaaaatcgttttcatattctatatgaacaagtatatataaatgctatgctgatttatcaatatttatgttggctaaaaacagggtcagcttgagaaccaggaatcaatttatacctttagaagctcctattttgaaaaatcagtttaaataactctttccaagttataagaacctcttgaaatgttcaagtgatcctataaaatatttttattatgatgacaactgatttatgagtacatgattttgaaccaaaatacagtcatttgacataagggttaaagttactttgaaataagaataggctgcaattgtatcaaattgtttctaagtattttcaaattacttttaagataaaccactattgttgtgtataatgaatacactctacatccatccaatattttattgttaaaaattcacatttgaccacttaatatgcaagtatttttactgaaaatatggtttcttcttacaaattgagtggaaactcagctgagcccaagagcccctccagtgctccctttacaacagttctggttgtctgcctttttgctgttgttttaagccagcgaagtgctaatatcattctccacttgcaggccttactctgcagaattatttaacactagacacactggtatagggaaatcactgttcagtagtagccagggaacataatcagttccttgatttttactttggaatgtaatagcactgagggaaaagaaaaccaaacaacaatgacaaaaggagtaggcaggagggctttattggtgggggttgtatttaatattatttcaaaatcacacttttcaattttctgctttgtaatgaactacagccaattacttcccatcaacactgataaaaagagctgtccaactgttcaacatttgctttgctaattgaatgatcaattattcaaataaatgattttccctatcaagctccaggaaaaccttggtcgttgttccagccccagctataacatactgtggagcaacaaagaaactaaatccagatagaaccctgaaatgttaagataaaaatccctctaattgggtgaagatttatggcaagtgaaaccgctttggcatctcatggattctgatcttttctgagactgctaatcccaccttctcctagcctattttgctgattaattcattggcaagtatctctgtgttccctaagaacatgcactttgttaggtaatgggttttaatgattagtctaaatgcactccttctttgccagcaaagaaagacctctctctaagtcatcttagccccaagaggactttgtgaggagtgggagtctgggtggtgccaggggaattctcagctgacagatggcagatgtgttctgtgttcacgccctacagttaggtggattaatagtagctcaaggtcattctgtggatttggtcttttaaagtcaaaataacttttaaaagagttagacaatatgtataagcagctagtttccatatgttcgcggtattctgaaggattccttctcgataactgacttgctttaaatatacagcaagtagagctcatgtgaatgggcacaggttccttccccaccctccttccaataattattttcaaagacagagtctggtcttattagatggaagctcacattattttctttcactacatttacctatgtctaaaagccacatagttaatagaaatccaagattcagtagtttatatatagagagagtatcctttcatggacaggttatgttctttcccaaaggaatacgctgatggaaatgagaattatagttttaacaattcatgttagtttgcaactgaattggccacatcaaaagtgtacagtaaatgcaaaatgtaactcactttcaaagtaggaattaaaaatcagatccttagatatataatctattaataagaagaacatttactaaattcaacagaattttatctcaaatcaggctaggttgaagtactgaagaaagcctacgtaactatcataatttttatatcttaagggtattgtggctgatgatcatttcagaagctaagaaaagagtcggactttttgcatttacttaaacaaacacaatttttgcaaattctaattagtaatagcctccacagagtaatagcttttgatggatcaccagaataaaagcattataagggctgaggactttgtcccagtacatggcataccatagatctccaatagatatttatttaatgaatgaataattccaggtaggtagaactacttcaaactgtatttgattgttctttcatagtaaatttgagagtagagcaagcatgtggttttaaaatcttgacaaaatcagattaaaaactacaatttctaaaattttacactagtgacttcctatagctactaagcacaataatttagggttatttaaagttgcttagaagtagttgatttactactgtctttgtgaaatgtgtctagaaaaaacaccaagtcttctttgcaaagcttggaaacttgagctaacattttactagtatttttattctaagacttaaattgactggctacatgattatgttctgggtaggaaaaattacatattattccttactttggaagtaggaactaagccctcatactaaggataacttattggttctgatacacataatttaaaaactattggtgcaggggaggaaggataactggggcgaggagtagagagacaataaagaaatagtctgatcaataataaataggatactaagaaacaccccagagactccatgcctccaagttcacttaagtcttaacgtactttacatttcaaatcatatctcacaaaacaagtgataggattacactgctaaatccataagcattgatttttgtctcagtcacagatgcatgctgtgcactattggaaaatttgctaaaataggtttatgccatacaatgactatcatgtagcaagcactctatctataaacttgctggagtctttaacaagcaattatctaagctttagaaaatacaaacaacattaaattatgcgaaaacctctctggacatgttcatgaatctttcccatttctaccatttttcattgttacagaggccttcctattccccaagcggagtatcctgctttctaaaaatcacagtacacatgtgtgagctttcaaagtgtttttaggaaatatccccagtggactctggagagcttgccttccggtcagagaaagaagaagcgctcaaatgggctattattttcactgatagatcgacctcattccttgtggaattttggatttagtttcacatgacttagtttcacatggtggtagatcagctctccgcagccatcagaataagaacggcttggtacttcttaggcgcgataaggagtccgagagggcagaggcgctaagatacggaggtgacaagatggctgcgctgcctcaggctttcgttagttctgtcagctactcttagagaagggttgttagtttgggcttgtaggtgtgttaagacataaatggtggctgaaagacgtgtggctgcatgacgtaaaatgatacctattattgcagcatttgtttcattgattactttgctcctactccattagaaactttctgaaacatcttctttaaggtttccacttccaaaattctctttggtccctactttattttaatgccctctctgttgtcttgattcgctgcttctttgtccacgttgatgggaatcaatcatattttgtcccattttctcatgctcttacttttgttttagctatattcccatatctagctcctttgtgtactttatacgtatctaaaaatattttggatttaatgtttaaaataatatagaacagttcaatttattttaaaaagtcaaggtgatcagtttacattttgtctcattaacatggtcaaatttagagagatagaaatcatacattataaagaatcttgagatcactaatacaattattactacaaattgctatttttcctcatgtctaatacttaagaaacattttttttttttttttttgagagactaggtctcactgtgttgcccaggctggtctcgaactcctggcctcaagccatcctgcctcagcctcccaaatcaccagattacaggcataagccaccacgcttggcctacaaactatttttaacataacttcttaagatcaccatttacccagaaaagacaaaaaacaaaacaaaacaaaaaccctgcgaactaaatcccagattttctataatgacatttttcttacctttctgtgtgtaacaaacaatccccttttgcaaacgtgctggactaaaaccttacatttattcagaattcattaaataatcatctctaatttctatgattaagcatttaccttcagttttgcatgcagctaatagcattgagcccactttaattaacttaacctcattacagaaaggatggctctcccagggaccatgtgacaactgcagtgtgaaagttcatattttgtgcaattttaccataccaatttaaaacctttgttgcaatgaatatttgttaagtatgtaatttatattaaagatgattttactcattacataggagaagaaaacaacgtatttaggatttaatattcttaattcaaatacctgagataattactttgtataactacattcttaaggagctttttgttttagaaacatatacttaaaaaaagtttattgcactatcatcaaacaagaaaaaaatttcttataggtacagagtgagatgtatgcttgcttctgagtatgaacactcatcatcactgaacatcatagtgcatccacgagagccactttgaagagctataccatggagctggatgtgttgattgtgtatttctgtgacattatttatgaatgtacggaatggcctgaagttcacagcagatctggtatgaaaggaaaacgtgtgtatgtgtggggatgccaagtttctagaagaaaactggagtgaaggggcaacaactcctatttgtgtgtcttttaattttatcttttcaaacaaacatgccttttctagctttattaccagaaagaagaactaccagtcctcctcctctaccaccatatatcactgtccgtgagacagtaaacttgagtggtattaaatttaacaaaaaaattaaatttggaatatgtctaaactcagatattagaatgtcacatcaaattgtaccacttaattatttgatagtttgtgtctaaattttgagtgctttactgtcaacaatgaatatctgaaattattgcatgatgtattgcatatacattgattaaatggcaatgtaagtgcttagattaaaaaaaacctgctaaaatgttaaatcagaactatagatctttgtggttattgggatattgagacagcggaggactttcatattggtatgatgccagtttaatagtgattggttattgatcacaaccctggaatgcaggtataggtgtgtgtatggggcagttggtgggtaatagtctcttagaagaaaagagcaaatcccaaactgtagggttactaaggcatccactctcaagctcaggagtcccagacgaagtaagaagcttgtctccaagcttcccagtcaatccacaattggtgctaatgagtttgctcaggtcaagtgtagcaggtttcaataagtgtttgtcctttttaccaggatcattactgtggcccttcaggaacatatttaagttctgtgggacttgaagcttaaaaactttcaggccaggtggtgcagctcacacctgtaatcccaacattttgggaggccaaggagggaggattgcttgagtccaggagtttgagaccagcttgggcaacatagtgaaaccctgtctctacaaaaaataaaaaaattagccaggcatagtggcatgcgcatgtactccctgctgctcgggaagctgagggaagaagatcacttgtggctgcagtgagctgagactgtaccactgcactccagcctgggtgacagagtgagaccgtctgtcaaaaaaaaaaaaaaagagtgttttcattaagatgaataatccaaaatcattttgcataaatccatcttttgagaatagacaatagcttagcttttaatcatgcttatattaatatatgagaaatattaatatatgagaaaactggcactcaaaaggaattgagaaggcataattgacccatcccctcatttgggtaaggacagtatagagtcctcaggtggaataatctactctctgtctctgtcctcttttggcaatgggataaatagccttgctatcatttgattttaaattgattctcctacttagccactgctttatcaatgcttggctgaatgtaaagccagaagtgagcaacttcctcagggtgcactgcttttgatgggttagctgtcaaatgctccattgtccaaattacactgctactgtggatttcctgctaagaaacaatttactgcagcattgggctatcagtcttgtgggctgtgttggttttggggtatcaaaatctgattaacttaaccgcagatacacagcagttcctactgttgctttccccaaatttccatttactgtattgttagcaggatatgataacagaggccccatacaagaagcatccctagaataaacagtaagcaaagctgccaaagtttaatccaatatcaaaactaaagataagcacaaaaataacaaatacaaaaacagaagaagaaaaagtatatcaccaacattttctcatagttttcttcttccagcaaaggacacatcagttatctgagaaatataaatatgtgtgtgtttacacacacacacacacacacacacacacttatttattgttatacctcttttccaaactaatgagcagatctcttttccaaactaatgaacaagcacattcaattatatgtgcatgggttttatttattgttattgttaaacacatacgatatactgggaagttaaaagcaaatctcttctactgattttatgttttccccttttataaaactagtcccataatagccattcttgagatttctgttttggtatgttaagattcaattatcaccttactgattcaatacaacaacttaatgatgaatctgcttaccttttgctaactgcatgtatgtataaatacccaacaacagcaaaccagggagatttccatgatatggaaaacaccaggctgtttactttttattcaatatgagagagttgagtactagattgaatttaatcattgcattcaagacaagaccaaacatcagttttaatattgcatttgtgataaaattgacatccatatttgctaacttaattgaagcatgacaatcagctttaatataaacttcccagtttttaataaatggagacatggacattctcattacattagcaaataactgcacatgtaacctttccatcttaatttttgataagaccaaatggtttcctcttcacatcaggaaactcaaacttgtctctttggttaaaaaatgggaactagattgtctcagaatgttattttacttcaatactaaacacatttgtaaatagtattaactaatttaactcataaagagccattaattagtagtacagtgttcaaaaatgatttactctaagataaagtaataactaggatgctatgttccaagcccaaatatttcattatgtacagatataagggcccaatgtgaagcccatctgtacctacttttttagtttcatgagagaaatatttattgaataactattacgtgctaggttctgtacctggtcttggaaacagaatgcttatggatagcctctatccttaaaaagcacacggtgtcatggagagagaggttgaaaatgattacaaatacaggagtaatagtataagtgtgaagcaaagggaacagatgggcatgcaggggaaaagtttagatgagatcatgttttgcggaaccttgaaagatgagccacttaggtgggagtgtgtgtccagggcactctaaacactcaccacgttccaggagggggctgagcagagcaggtacgaagaacgtccaggagtgtggtaaagctggaccacagtcaacactgcatgagtgtagataaaggctggagagtgggtaagaacctaatgggtcaaatcaagaagcttgaatgacatcctggcaggaggtcattaaataatttttcagggggaaaatgacaagtccagatttccatttgaaaatgactatgctgtaggatatgcggaagagggattggagggatagaagacagaaagcgggtgagtaggcagggggatattgcaaagctggtgagagaccaggagagcctctaccaaaatagcatcttcggagaagagggaacaaaatttaagattcttaaaggctaaattgagattagacctctgattgtatgtggttactagaggggagggacaagttaggaatgaagtgtctccttggaagactggtgctactaacaaattaggtggagaatgtacagataggacagggttaaaaaggagaagagacaggagtgcttcatgttgtatttgtgcccagggggaggtctggagctgatttggaagtgggaatgagaaatcctccagactgaggtgaaatgttctcaaccattagaacaattatgggcaccctgttcatattatccattcacagtgctttgtagacttgcagtcaaagaaaaaaaaacttttcatgctcataaagacttcattttatttcaaacacgttctaagaacataactgtgctgtttatgattttgttcctattgtgtcgatgtgcggaagtgctcgtaacctataaaaatggtagatgactacttgcagaaagatggataaacccgtactgctgtactgctcaattttgttcttgtaaaaaatttgtgttttcattcaaattcatttttgtcatcactaaataagtaacaactaaagccaaatgattttccatttcatagaactatagaaagtagaagagcaattttaatagcacagtgtattattccaagattctacaattaaaagcatcaaaagtgtccactgctatcaagtagatggttcttctgttagagagaggaaataaaaaaaaagtgcttatacacggccatgagaggacttctgtaaatctaacctattcttacaacaaaattactatgtttactgatggctatccatactttatctctagtgcttgccagtggttgaaggtccagtcccatcatgattcttccagtagacagactacatggaggtttgcttgtaacctgcaaacatcttacacatgtttaagaaatatattccccagtcttgtttttctatttaatatctttttgaattctaatatatccagaattcttctctttggtgatattttagtaatgacctgagaaaaatcaagctctgttatagcatgaaaattgttacataaaatgaaacctaaaagttactctgttttatacgaagttaaaacaccaaaaagcctcagtcctccccaaccagtatctcctggcattcgctctcctcaaagtgtctgttaatggtaccactactactgctggtacccatttggaaacttgtcttgacccacttctgaccagccattgtaacctgcagtcagtgtttctcccggtaatttttctaatgtttctcccatctctttgttccttctgtcctagctcaccactgtattattacaaccaatttctaactgagttctttgacacaacttttttttttcttttattattatactttaagttttagggtacatgtgcacattgtgcaggttagttacttatgtatacatgtgccatgctggtgcgctgcacccactaactcgtcatctagcattaggtatatctcccaatgctatccctcccccatccccctaccccacaacaacttttgagcccagataatactttctgcatgtattatgggctgagtattcacttctccacattttttcaatcttatctctttctttactgcaacactgatcttttgatctgctcacatatttcctccttctgagctctccacacagttgtaaagttaagacatgaatggctttgatcacacaccactgtctctacctgaagccttctgttcctctctatccaatgcttgtttaatcctttgagatgcagatgatctctctttctctctgatggtctctaaccagttccgacttgctagtctctctcaggggcaaaaatgttgatagcaggagacaccatggccatatgttcacctttgctgggaagaacgaatgctggagctgttctcacttccccccaaaaaaagcccgagtcttgtgctcctcttatgcttaatttaatgtgtgaagctgtgttttttttctccatgaagatctttttgtggtcctcagtggacattcatatgggttataatataagattagaaacctatacaagatgccaacaaaatatggggtatatgccaaggcttggacatttgctgcaatgtttattctaaagtctggtcttctagagacacttgtctttcatttctggaagaaaaaatatccattctaaatcataaagaagtaatatttaaaaaatgcttttatgttttctttgaaatggtgccctatttctttttctttctgtctctctatctcactctctctctctttttatttttttttgagacaaggtctcactctctcacccaggctggagtacagtggtgtggtcacagctcactgcagccttggccttcctggctcaagccatcctcccacctcagcctctcaagtagctgggactataggcacccacccttatgccaggctagttttaattggttttgtagagatgggggcctcactatgttgcccaggctggtctcgatgacctgagctcaagctatcttctctcctaggcctcccaaagtgctgggattacaggcgtgagccacctcagctgactcctttttgtttgaatgcagtatctttaagaataaatggccatacctcaaaattgaagatcctgacatttctaattttgagtcactttctgccctagcttcacttttaaaatgtaataagggctctgaaattctatccacatggagggctaacaactcaatactaaaggtttttaaaataatgcataattcatcctaaaactctgtgtttctatgactgctgtcccatgaacttttgtaatctgccagtgcaaaaaacaaagtaagatttttttctttttgcctgtaataatacatcttaaacatcagttcagtgtgggttttcatgttagctggcatagatacccatcctaaaatatttttacttgtaataacctgattattttaagctgttcagtggaaactgtctaaatgattgactgctccccaaaagtatgggaatgatttccaagctgttttcaaggcagttaggcagataagtaaaacccgtaagaattctgttcaagagatggatggttctacatttgttccagagggatatttttcatattcaatgagtaagcacatttgctttaacattgaaaactacctagcagagatgaactatttttatggaaatactataaacattaaacatgccacattaataataataatacagaaaagggctctgagaaataggagtctaggaacatgaaggatgatgtaaattaaaaaacaaccaccaccaacaataataggacagcaaaaaagtacagtaatttaccaatctggcactacataaaactagcaaatgtacttcacaatgtttatctttgctataatttgcagaacataaaataataccttgattaaaagtctgatctattactcatagaatggttttagagaatttttttataagttattgtttcacaatataatcaaactagccatcttggaacaggtaaagaaaagcaaaaatcacatagtgaaactgatgaacaattccttttgcttcttgatgtaaagattttgcaccctaattaaaaacaacaacaaataaacaaaccggggatgaggccactggtatgccactctttagggtttatgctccttgaattaacttcacaatggtcacgtacagtatttgctttccttcttcttaactcctggtgatgagtttcaagtgtaatgatgcctgtggttccactagtcttgtagagtaacagttcatattctgagcacttactctgtgacaggtacaaagtcaaggacatattatcatttaattctccaataacttcattgagtaggtcctaatcttatctccattctagaatgaggaaactaaggcttggaatggtaaagtaacttcagacaaattcatatcatttctaaatggttctgactccagaatcatgcttttaatttctttgctatactgtctctctacatgggcctaaagccctaatttttttaaaaagtaatggcaactagtaagcctatatattatatataaaagtgtttcctagagtctgccagttaagaatccattgtgctatttaacatttttttcaaaaattctttgccaggtacaggaaatgctgcaaaaagctgccctaagcatattccatggatttcccagttggcaatttgataggcctgctgttattcaaaaacacttgtctttaaccatactagagcaatcaagtgaaacaaagcaggttaaactgaaagtatttataaagcagggcacatggttatacaaacccacaaaacatgcaaagctgttggaaagaaaatctggtcaattccagtactaacaatcacagttaaggcaatttcccaaggtttatcttcccatcagtgcttataatggatgttttactattcaatattgaaaggaaaatctaagtattaattacagaaggtatgtaggtaatgtttgcattgcaaaataaagcactagtcaataaaataaaatagatggatagatgaactttttatctctcttctacagcaataatcctggtgacagcactgaatatctagaacgataattctatctggtagccactagctatatgtggctatctagcatttgaaatgtggctgatataacttattaactgaatttttaattttaatttataataattgatttaaaatttaaatcaatgactgatgcttatttctgttattggaataattttaagtatctttggaataacttgggtatgtaaatttacttttttcaaatataaattttatgaaatcaaatacagatcatgtatttctgatgaaaatttaaaatccacatttgatgtgctgtaagtataaaatagacactgaatttcagacagtattaaaaaaaggaatgcaaaatctatcattaatagtttaaaaatattagttacatgttgaaatattttagacatattgaattaaaataatattattaagataattttagctgcttcttttcgcttttttagtgtgagtacaagaaaacttaaaattaagtatgtagtgcccattatggttctattggacagcattacgctagaaagtatgactgtaagttcattaattgtcttgaaaatagtgtaatagtatgccccaaaactcactgaaatgacattatttttcgatcataatctccattctagttgctacagtaaaaagtatcatactaattcattatgaaggagactcagtaagtgctaaatcacctgaaataaaagggaaaactgggagacatggggtgtctaactcattccatgacttcagataggactggtaggttaaagccaggatttgttaagatgcttagcctgaaactagctagacaacttttgcaagggatgtttccatttattcaaagacaggcacattccccagaagttctaaacagaggaggatgcaactgaagaaatctctacagcattttcattcttggcttccacatttccaaaaaaaaaaagacacaacaatacacttcttaatgatcccaatggtgttctattttagactacattccaacagtaaatatacaaaaataaataaacacacaagcaaacaaatgaaatgtgtccagaggtctgaattgaggtccaagtcctgcaattgtccccacctccctgggcctatttccttatttccataatggagtcagagaggcttggggtctctacaaacttttagttctaaagttggtgattctacacgaattctaagaaggtgacacttacataatgctttacattttccatagcaccacttccacttatttaactcagagcaacttggtgacaggctttttcttgacacagggtcttgctctgtttcccaggctggagtacagtggaacaatcatggctcactgcaagctcaaactcctggactcgagagattctcccatctcagcctccagagtagctaggactacaggcttgagacaccaccatgcccagtgagatgatttggctgtgtccccactcaaatctcatcttaaattgtagctcccataatccccacatgttgtgggagggaccaggtgggagttaattgaatcatgaaggtggatttttcctgtgctgttttaggatagtgaataagtctcaggagatctgatggttttataaataggagttcccctgcacacgctctcctgcctgttgccatgcaagatgtgtctttgctccttcttcaccttctgccatgattgtgaggcctccccagtcatgtggaactgtgagtccattaaaccttttcttctttatgaattacccagtctcaggtatttcttcatagcagtatgaaaatggactaatagaacccagctaacttatttttaatttttgtagggaccaagtctcactatgttgcccaggctggtctccgactcctgaactcaagtgatccttctgcctctgcctcctaatgtgctgggataaactgacacatttttagaaagtgaagagcctaggactacaactaatctaaatcatttttcagtatattatactgattgtcattttctgacaatcacagaaattatgctgaataattttcatgtattaaatcatttataagagatgagctagaaaatcagatatctgtcatttctttccaatatatcttgtattctttccttttcttccactgtcaataccacattttatatgtgaacttctataactctgtattgatgtattaaatatagatacaaatgatttagtagacagtgtcataactattttaatgatgaccaatcccttaactttgttcaaataccatgctctacaaaatataaagtgagctttgtcctttcatggtaaaaaaaaaaaaaaaaaaaaggcacttttaaagagaggccaaagcactgtggctcacacctgtaatcccagcactttgggaggctgagagaggtggatcacttgagaccatgagtttgagaccagcctgggccatgtagagaaaccccagctctagctgacccctggcacacccctgtcgtcccagctactctgaagactgaggtgggaggatcacttgagccccagacgtcgaggctgcagtgagctgtgttcgtgccattgcactccagcctgggtgacagagtgagactccatctcaaaataaaaaagaggtaatcataatattcttttaatgtaggttgaaaaacaaatgagtattttttacagaaatgtatctttaagccctagaaaagctaaccttaaaaactgggtaagtttaaaaaattacccaatttttaagcaaggataactcccttcactccctagaaacttagctcattattgagtaattatatagttatttctagcatcttctgtgagtcaatagaaaataattatataacagataacatttttaggctaagataaagtattctagttaaaatgcttactcagttttaaaatggcacaaattttgggcataatttatatacttaacaaaggaatttttaagagtttgaagtatcaaaacattttttttttttttaaaaaaaaaacaggtttcactctgtcacctgggccagagtgcaatgcacaggatcatagctcactgcagccttgaacttctggactcaagcgaaactcctgcctcagcctctcaagtagctgggactacaggcatgcaccaccaggcccagataagtttttaaaacttttttttttagagatgagagagtctcattttgttgctcaggctggtctcgaactgctaacttcaagtgatcctccctcctcggcctcctaaagtggtgggattacaggtatgagccacggagcctggctgaaacgctttttcgatagactattccactacagaaatcttatcactacaaagtattaaaaagcatcttaagaaagaaaataagataattttaatttataatatgttttataatccaattcagtaaacatatattattggttcagagggactaaaaccatattgatttacctgtgattatctaaaagtaaaagtctcccataagactataaaaaagacatatacatctcacattcccccagggaaattccttcagatcagcatgcatggtattagatgtctgcaaatgcaccctttaacctggaaacaaaagagaaaagaaacagaggggatttctacccttggggaaagtagtaagtcactggcttaactttattatactgctcttctgctatgtgtcacttcatgataaaatgcaaggtgggagtagggcagatggaggacttagatggttcagaaggaatctaaaagccatgactgttgactgtaatgtcacttcctcctccctaagatattaggagttattattttaaagtcaagggattaaacacaaagtgttgagtgaatgtaagtaatttgaattttccaagatggaactttcgtgacccagtcatactagttgatggtggaacactgttggaggaatcaaggggggaatatcaagtaaagaggcaaaaggctgtcacttggagatgattatgacacacatactatgtgtgataagcccactggacattttctatattttaagctgctcctgaagtattttctaagttagagtaattccacttggcactcaggacttgattaggaagttccactgaataccattgacatttccaaatatttaattttttgttgtgtctaagtattgactgtagatgttatttctatggtccaattatccatcttgaccctgaattacagatatgagtgttattttaccagctttagagaatattcagtgtgctgatacattcttcccgtgatcgcttattcatttgaaattaaaagcctactgatgttttattacagtgagctgttccaaaaattacagagttgctttctttagaaatatagaatccaaatagtaattcttatacaatctactgtttttttttttttaaaaaaaaacagattgctataaatctctcctttagacacaaagcctagaggacagttttgaatttaaacaagattaaagtcatgataatgacactcagttttgtaaacctattctctgatcgttttattaagaaatggaaaaacaaatgaagatgtatggctgggtagctaaggacatcttatctgcaaatctgtactgactattgttagtgcattgcctttagttgtgcttttaatgtactaaagctcatactgtgaaataaatctactcttttctgcagtattgcttctccatttgatttattttaaaagttagctcagcttgacttctgtacccagctgctttctaaataacagatttctatccacttctgaaactttaatagtaatttacaaaaaaaaaaaaccctccaatcccactaacgcaagttttgaaaggaggtgatgaaatctcacgaatggggggtgctaactgtgtagtcagatcctccttattctagaaataaagtgcatctaattggaaaactcctcttgggagaacagggatcgacttttacccaccctaactgccaaagggcgaaaactggagtaactaaacagagttcactttaccaacaaaaaatataaaggagtacttttacattgattttaagagataagatatgaattgggtgagaaatattcaatttcgtgacaagtacttcccaacagatattgttacataaagcaagaaaggtgacaaaattatataattacaattctggcatctgctatgaaaaggtatttgctgtgtgtgtgtgtgtgtgtgtgtgcttttctcattggtcattgcctggtattatttttatcctttgttagtgttcttgcattgtttgctagaaagtatgctttgctgcaagacaccagtaaaatgcaattcagcagcataagcggcactaggattgatgaaaaaaatggaataagaataaaaaaaaaaataacttcactctcctctatctctgacaccaaaaacaacaggctgtgaaaatagtttcattaaaaaataacaagcccatgctcaccaggggatagatcagggcaaactgaatcaaaaattcctcaatcattgctcaagtaggtcaactagaattaactcaaagggcaaagattcagagtgagctgcccatttctcaccagtctgcttcttcagccctcctgtctgcccaggagggaaatgatatggtggagctctccatggtgggcatgtcattttgccaagcctctctcaataccagtgtataaaggtgggcccatattatggatagtattagtttgagctcctccagttgtctagaataaaatgctaatcggatgcaaagttatttgctttttgggaatgtacttctgtgattttgaatttactaccttacttttcaacaaagccattagtctagttgtatggtcaaaatgctggtgaatgtctcaataaagctattttccttttgcacaggttttatcaaagcattattaactttattcttatatgtcaaattatgttctttattttttaaaaaattagaacaaagtccctttaaatagtgcttgagaggaatttgtccaggttaaatctatagagttctcttagtgtcctcctcccagacactaagggtatagctgcctgagagcaggtcttttctcttcctctgtcatatcaaagttaaaaagtcctgttagaaaaaatatatgctgctctaatgaaaataaagttttcatctatattactaatcgggggagtttctagtcctgacttttgttattaaaagcatagcagtttctcccatacaacagtagttccctgagtgcccagggatttatcacaaagatccactatttcttcagcagacaggccaaaaaagctgtagggcagagagaaacatgacaatgtggaatttcattcaaagaacattaagaattttaagatagccacagcagagcattagaccaagcatggggcccttctaaggtccagtagccttcaagccacaagcccatgaagactggcctgttggcctgtctctgggtctcatagagttggagtacacagatgggcagctttcagagcagcacagcttctctggcttcatcataaggaaacttctatgtttctatgtatcagcctttgcagtaagagccttaggaaccatccggcaggctatcattaacagataaccaataacgagggcaaaggtttcaacctagaataaacccagaggatattaataggagggtttgtctttagcaacttcagaagctacaggggaagagagagattctgctgtgtagaaaacatgtgctgacccatagatatcagaacacatgaattcaggatatgttgctcattaattagctctatcatcttgggtaagatattccaaccccctggatttcctgcttttcactttaaagcaaaggtgttagagacatgattcaagggtccttggaaaatttactaagtctgtgagataagaagaggagagaaatgatatacattttcttttctcagggaaatatctctacttgtaatgagtatttaattttatctaaaggcaatgatgatgatgatgttgatgatgatgatagcagcaggagacagacaaatttctaggcagacagggatggcttgaacccgaccttcaagccaaaggacagtttaaagcctgaaaaccgagctggcagttccagatggagtccaccactggagtgaaaacttctatccctgtcttaccctctctcgactggttccttctgaatgatgcctttcacccaatcgaatggtgcttttccaagcccacccgtggacccatcagcatgcatttccccattctaagcccataaaaactcccattactgaattactgaatctacttttcattttaacaaagttgcaaccaagaaaccattatccctgattgtgaccctatgttaacaactgaactaatttagtttgcatttagcttatttaatcttcatgaatgctttatgaagtaggtactgtcattataccaagtttacaggtaggggaatcaaagcccaaaaagcttaagcatatcaacatttacgaagcccctctcatgtgctaggctctatggcagagtcatgggtttgatgcattcagggtcgaggaagccaggaggctgagtgccagagaaggggcagggaaaaaaggaagggtgggcagtcttgtgtgtattgtctgggtgccaaaggaagagtctacagcagggaaatgcagccttttgacaagtgggaattaaaaggaatttcttaaagaacgtaacagaagttccactcatgtttctgaaaaatgtaagtgctttacacaaaacaaaaatgtttctgaaaaatataagtgctttacacaaaacaaaaatgtctaacaaactccaaggttaataaactggtgcatttaaatctgcaccacccttgtattttcaactaaacaaatatggatgtgataattcacatttgatatttggctaatcccattctaccaaggagttttaaatagtaacattaaagaaaagttagtaagaaaacactcaggcatctaaaggatttagttaattctcccctagacaaagaacctggtgtctttatagctctcctaatttcccattaaatattacactaataattaattttttacgtacatcctaaatatattcttccaaagtagaaaaagcacattgaacaggataaattgcaaatagaaacttacataactctttttatatgttttgcatatttgtgtcactcaatacataggacatgaacgtacatgatgtggccaataccatccttaaaattcaatcctttggacaaatgtccgtatactgaaaaaatagcatctaagttttgattgcccttcagactatttgacatagactttacagaacaaagaacatttaaattaactgtgcaaagcaaagagtagaaatcatcttattatacaacatcaagacaactatcaaaacatttctttaaaactcatctatattttagagcagtagcattattaattgtctgcattctgccccatcttcataattcaatgtgtccagtcctacatctgttgcataaaattggcatatttattgcacccttgggacacaatttcccaatgagaagtagccaaatgtagctttttttttttttttttttgcttatgtaaaatgctacagtggataacatacatccttgctcccaaagtacaggaagaaaatttatatcattaaacacatgcaaatgaaaacacaggattccatgcttatcatccaaaccacttacctgattcatcaaaactacttgggtagtagaacaaactattatatcttcccagaatattatggaaaggtatcctctattgctgaataattgagtctacttttcattttaccaaagttgaaaccaagaaaccatcatcccttgatcctgaccccagtgctccccaactttggtggacagattctgcaaactgtctaccaaactagtgagataacagatgcaatgcactaatctaacttcattcactcattcattcattcattcattcattcaacaattgtgtatttgctaagcacaaggtaataaggaaagttctactgtagcagataattctccatgtagtgtttgtatcattctaagccattgttgacttgctaatactgtccatttgaaaataaaaaccctcattttaattactaggttagacaaagcaatgaagatgtatctcctgtttcttgtttctgttgcaaattatgtatgtctagaagacaatagggcattgattctcaaccacaagtaaataaagcatgtagacttagtcttaatgagataaggtttagtctgtgccttctcagtgggatggtttttgctattttgctttttaattggtagcaaaaaacttcaacagtgtgtcctttttctgcctacagtgaattctacatgggaatggagttgctgtagagagcttttggatataaatgctgctttagagctaattagataaaaatcacagaaaaaaagtattgtttcttactggagaggaaatttgaaatattttactccatgaattctctgaataatacaggaaaactgtagaatctagtctctttaattctctactgaaatcatcaaaaataaggtcagtttactttaaacttgctatttatatcacataggtcttcctaatgccttagacaaaattgggataacaaatatgaacagaagtatgccacctgcaatgtttttaagtccctaaaataaaaatgcaatcactagttttaaaaaggacaaaaaaatgacataggaagaagtatcatgctaaaagcagtattctaaaaatgttaactaagacatgattaaataccaattactttaatttcggcagtgtcttccctagagactacctgggaaatactgtcaacaactccacaaaaaagcatcacactacatacaagaggcaagaaccctttcaagttaatgaggatttttaaaaatgcaaaagattgtttctcctttagtgattttcaaattggattatgtcagtcccttgcataaaactcttcaatggattcccatgcagttaggataaatgtaaaatcctcatgatggcctgaatccccttcctatctccccacttttatctatccacagggcatattctctatttacactggtatttttccattttctccgaaagacctaattgttcctgcctcagggcctttgctcttgtgttcactctacctcaagttttcttcctcttgaataacttctaggcattctttaggtagtcaaatgacatttctttagggaagcatgccctgatcaccaacttcaaagtactttttcttattctcttttatagcaccagagtggattttcctcattagtcattttcttagaaccctgctcctttcctcctcagtacttattagaaactaattatgtatgggagtaggatttttgtttgtttgtctttcatgttagtcttccccattagactatgctttacagctatagggactgcatctccactgtttacccctaattgagcacaatgccttcatatattcacaggaatatatcttgaaataatggtcaacttcccagtcattagactttgtttctgacattgttatagataaaggtagccaatcatttgcatatatatagactgtagtggacaacattgtcacggtgaacacattctaagcaggtaataatgagttacatcatcccctctctttgcgtgcagaaggagcctgtgacttgcttctaactaacagaatctggcaaaggtgacataatgtctttcccatcattaggttacattataccttgctggctttgaagaagtaagctgctatattctgagagaggagaaatgtcaaggagcctgtgggagctcagagcagaccttgatcacagccagcgagaaaatgtggcccgtagttccacagccacagtgagatgaattctttttttttttttttttttttttttttgagacggagtctcgttctgtcacccaggctgagtgcagtggcacgatctcggctcactgcaagctccgcctcccagtttcatgccattttcctgcctcagcctgccgagtagctgggactacaggtgcccgccaccacgcccagctaatttttgtatttttagtagagacggggtttcaccgtgttagccaggatggtctcaatctcctgacctcaggatccactcgcctcggtctcccagagtgctgggattacaggcgtgagccaccgcgcccggcccacaatgagatgaattctgcaaacaacctgaggtggcctagaagtggatcaaccttccagtccccaactccaccctgggttgagcctcgaatgaggatgtgcccctgaccaacagctgcattgcagcctgtgagacccaggtaagccctgcctggtcacgtaattcacaggaactgtgagataataaatggatgttttcagctgctaattttgtggtaaatattacaggggagtaggaaactaatacagctgccaaatcacatatggagccaaattgccagcaaacggattctttcttcattgatattctcattttcttttattttaacgactgagtttttggatgttaaggtattctctttttatttttatatttgagacgattttctcactaaaagaaatactttttgtccttgagatataacatttgaggtatttttcttttttattcaatatattttgttaatttggaagcttcaatttgttcttagtagagtgcctaccatgtgcaatacaggaggcataaattaggggaacttcaggggggtattaaagctgtgagcaaaacataggagctaataatgtatttattcctatttttattatttttatttttttatttttttgagacagagtctcactttgtcacccaggctgtagtgcagtgctgtgatgatggctcactgcagcagccttgaactcgtaggctcaagtgattctcccaatttagcctcctgagtagctgggactacaggagtgcaccactgtgccaggctaaggtttttttgtagctttttgcagtgatgagggcttaatatgttgcccaggttggtcttgaactgctgggcaagtaatcctcccactttggtctcccaacgtgctggcattaaaggagtgagccactgtgcctcaccccagtaatttaatacagattgggtaataatcctaagaactcaacatatatgttcagcgcctcttcgtgatattttcagtctaaccctgagaagctgagtcagagcccctacttggggcataacaagtagcccagagcccgaaggaggtgagactcagtggatccgagcagagttgtgtgatatacttccctctgggaggaggccagggacaatattttattcacctttgtaatccccagatgcatagctgacaatcaaacaatacagatttctaattgaaagctcaagagatattacagtacaatggaatgtggaatgtgtcaaggatgccttttcgaaagtggtatcttactgtggttcttgaagatgtggacagtggttattactagagagattggcaaaatgctgcttctcctgtcttcatgcaatttcacatatcaattatctagtttttgtctaaaagctgtttctaaagatgtatcatttgtagttttattcattttgtgaaatgtaatgctactaatacaatatcttcatttaaatccacttctacctacttgtaatttttttcagaatgccttctaattgatgccattatacatcttagatatcatctgttttactccattggttctaatttttaaatggctgctaccctatttatcatattcatcagatgtacattttcagatttctctcttctgcctaggcctgctgtcctagcatgctagaagcactggacagacaaggaagccttatgtttaagtgtgggctctgtgatcaagcacacttctctcagggacttattttgtataatcagcacaatcattctccatttgtttatttatttaaaaagtgcttagccttgaggggaataaaagtgcataataatggttccctctgtttctgatcacacagataaataggagagaagaataaacagataatcccagagggccttaaaacattatggcaccttagtgttacagggtagtatttgaggacacatataatataaagaaaaatattttgcaagctatagcaaccctctatcactatataaatatgctataacacacatttagcaactatgtctcttgattgcagcctatactttcctcctctacactttagcccatgccatttctctagattattatctgcaattagctaaacctttctaaatctattttaaatcctagttccttggcagcaatttctttagagtcccctagtctaaagagattgctccctttattctaaattaagaaactaataagtctctttgagacatttcttctatggtcctaacagtgatctgaattttcagtgattcactttttcatgtatgagatactatttctttaaaaatacattgtaaggtgtttaagatatcttttcaatttgatgagtataaattactgctatgttccataggatgtcaagaacttcacagtcttgggggaagaaagagaaaattagacacgtgggccagtaattactaagtagaacaaggaataagtgtggtaggcaataaaaataaaaaaagagaaaaagcttgcatctacttgagataatcaggagaggcttttcagagtaaggccatgaaataagcctctgagtattattgaaatcccaaaggcagaaactggaatctgctgggagaagaacatttgaagaaacagcctgagcaaactcatgttggtagagcaatctcgggcatgttcttgaacaggacaggtgagctggaaccccgctgctgctcagtagctgggagtcacacttgggaaccagctcagtgtggagatgacaagaaggcttttcatttgatagacagcaggaggccactgaaagtttcatttcagggaagtcaatagtactcaataaatacctgctaatactttcactttatttctgctacttttcaaaaccttgccccactttgggagccattgtaaatattttaaatataatacctttattattgaaataaaataaatagatgttttccatattcgtagcagctacagatggattaccatttcccaagtgcatctcctctggtctttgtccatctctatctggcttactcatccactgcacagttcttcggtgctctgtggatcttgttcaatccttgtttcaagaatttgctttaggtcataattaaagtaacactgatatgtttcctcagtagtgtctcttgaataatcttttacaattctctcttgtaatcaataggagggtatttccgaagaggccagtgtggctcacagatggatcgttttccagccattgaaagctaccttgggggaaggaaactacttagcctcctgtgtggtgagtacattagacatacataacacaataattaaattgatgaacagtcaatagactctaaaggcctgggagggaaaaaccaaaaagcatgtaaactttcttctcttccattttttttgaaaagaatcgcttttattttatatcaccaatggacaaaaaacataaattaataatgcaactgtatacaattcttaagccatttataattgctgcttattttcacaacgttcttggggagaggtccaggtatatcccacatttcagttagatctaaccatcaaagggaaatagaatatttttggacaaaactacccaaagtatgtcagaaacaaaagtagccctgagttattttgattagctgctggtattgatgaaactcatttcatttctgaaagtactggattaaaaaaaaatcagcacccaggtatcgctctccctttttaaaagcattataaggtcaggaaaatcatattccaaggccataatgatatgcaatgaagagaaccaaagtggagccagggttctaggccaaagcccatggatataaatagttttttgcctgttactattcaactgtataataatgggccacatacgttctctgggacacttgttttctcatttattaaatgagtgttggcagggagaattcatcttaatgatctctaagagtgctactgatgtggacaggacacagggaaatacagatacaagagggtggttctctggcaaaggcttcaccctcaagcctgtatatctgcggccctaaatgagaacaggaatttctggttttgtacccaaaaagttgccatttggcccaccatgccctctatcctgcacccatataaaccctgaaccccaaacttcggagcagagcagcaagccagcagatcagcagatggatggtggaacaacgtggcagagaaagggagaaaaggaggaagatctgaacgccgagaggagtctggctgggggcagttgaagaggagtttagccagtgggaggcccgactcctgtgggggatcactttcccactccatgccccccttccagcttcccatccatcctgctgaaatctacctccactgctcaataaaaccttgcattcattcttcgagtgtgtgacccgaatcttccgggatgctggacaagagcttggggtacagaaagcatcatattggccctctgctcttgcaaaaaggcagagcgtccattgagcccgttaacattcaagccatctgaggacagcaaaggtgaaagagctttgtaactctcgggttgcaggcacccacccctagacactactgcagagctggagcccaaagtactcgccccggcctctacatgtgcccatctgcatactccccctcacggaaggggtttgagtggtgggagcactgaacaggtgagccacacctctgtcacacgtcttgtggccctgtgaggggaatcaaagagctcttccttttcactataagctctaaagctctatgagacagttagtctgttattctatcattccagtgatcctcagggggatgacctgggtggttatcatcagctgcttcatgatcttttcctccttgctagttgctgcgaacccaaaacaacctgtgcctatattaagcgcaaagaaaatccttgaaatctcaacatttaagaaatataaggggtttattaagagatctgagctgactcctcattttagatgaggaagtagaagcaaataaaagttacatgaactgcccaggtcatatatttgccatggacagaaccgaagtccaggtctcctgttttattgctgcgtgcctgaacttcccacacgttagctgtgtgtgcaccaggctcacaatttctgatatattttctcactgcctttactattatttgtgaatattttctttgaaatgtattaatgtttttactgagcacatttattataagaggaaactgtatgtcatcacagtaaatggaaatcagaatcaactgtcatcaataggttaccataatgtgaaatgaacatacaactctgtttcatcatttacttagattcttttgcttgccagaggccaggggtccaaggcgtctctgtttgttaaaaatgaagattaacaaatgttaggagttttccgtggcactagcaaaaaattgagatcactgctttaatgtcacgaggactgaaaaaaacaggaacaaatcgacttttatgctaggtaaaggtatgatttcaatatttcttgactcctcaataccatgacttctcacttcatcctgacatgaaaaaccaaattactggtcctgtttcccatgtccctgcttttcagtgttctgcttcccatctgtagcagtgcttcatctgcactaatgttgggttgggtgagcagtgccctcccctccagttaatgttctgcattatacagcatgggcttcctggagatggtgccatgatccataggtaccgtggcaggattttcaaagaccttgacatcatctgaaaagttattgtttgattccattaggtccatccctgatttcatttctctaaaatgaaacctgacaactgtagtttaggcagggcttatatgggatgcaactagggcagacttgattcacagtccaaatttatcagtacatggcaaaaaaataggttgtataacaaaactaggtcaaaacccctgatttctttcaccgtcagtcccttaagccactctacttcattaacaacgtttactcattctttatttccaagtttaaatttctgagtataatttatagagcaaatcaaagactgagaaataagtgcattatatgcttctggagaattaaattcagattcaaatcttaaggtttcaaaatgttaagaaaaagcaatttatatatttttcaaaagctagttcacttcaaactatattttcaacaatttcatgatttaaaaatatgctcactcaaaaatgcaaacatttgcctttaaaatcaaaataattcagtggttatagatggcaaacttaacagacataatgttaaatggacatttttaggggcttcaagaaggaggtataagttattgattatacaaaaatgattgtactttgctcctgaaatccccaattccagtgaagaaatagaaaagctacaaacactagaacaaagagaatgggagagtagacaatagcagattaaggttgtcaaaaacactgaatatgaaaataagatgagttattaaaagctaaagttttagattataaagctcttatctagaattttatatgcagcacagtatcgattgactatatgaagagaataaaggtgttttttgggatacgagggcactaaaattttacctacttattcattttgaggaagatgctaaagggtatgtttcaccagctgtggggagtaaaacatacaatgggatgtgaggaatttcaagcgggagggtgtacagtaaaagtgagagggtagaggcagggcagtgggcagagaaatcgcaggtggacacctcacttgttcaacattcctgaagctaaaaccaatcatgctcagctgagacaaagggcaggggtctccagaaggattgcatccaaagagaaacagacaaattacatgatgtgtgtagtttttctggaattttatggaagcacttagggatacattaattttagtatgtagaaatctaaggatgaggagagagagagaggcacaaagagacaagttattaacttcaattaaaacaagaagtcatacaagaaagtaaataaattaatatgatgattcaccttcaaataacatttgtacaaccaagaggctgtaaacacttaatgctaatttatccaaaaggcgttatattactgtattgggcagctaggagaggggagcatatggaatggaaaaagggctcataacagggtgaaattgcaatttgcaatagttgaaagtcaatcacagatggctaaaaatgttaagaataatagaataaacactttacttaggaatacctgggtaaaaaccagaagaaatgattagagtcaaaagtaagtgggttgctcagcagttagtaaggaattatttggctttttaaaatgtcatgttttactattatggtaaaaatatattacacatttacttaatctataaattaaagtaattccattatgttgttaatgtattgttaaatacattcattttaaaataaattgttaattcaataaagacttcaaagcagatttttataaaaattgaatacaaaatgcagcaagcatatttcattgtcataggatattcagatgcttctgaaatatctaatctactatgtgctttaaatggctggaagtatttttgagacttctgtgaaatgaaaatacttctgattgtctagctaaaattctctgtctataagataccaaaatttttcacctgcaactttccttttctgttctgtatcacataaatgcattcagtctgttttcattagtgcttttgtctttggagtcaatcattctaaatataaaatattaaaacatgatgaactatagaatctttttgaattgctcatcttctgtatgttagatttctaagggaaatcttcctctctcaatagtaaagcatttgttaccaagtattaaaaagcagcacagtcagtattatttgatatatactaactgaacactgaaccgtttaataagaaagagaatcaagtttggcctttcaatacactgaaatatttgtgcttagggcactgaaatatttctaatataaaaatgtgtaaaaatttatttctgggtttacattatacacaagagagcagaaaatatatacaagagagatttttaaagacagaaagacatttctcttcaaatatgagataagggtgatctacagcatgtaagtataaccttaagtataacatggaataaccttcctgaagattagagggttgagaataataccccctttcacttgggagcctatgatttgactcacacccacatcatttagagaaatgaacagactgagatagccaatgctagcagagctacccatgatccgaatttacaaagaggcaggtgaagtacacagtttgacaagttagtttttttaaataacaattgacttatattctagattatttgattctcttatttcaagccactgtcaatgctttatcctcacatagttcaaaacgctttgcaagaactttcctatctatcagattagttccacctcacacaatcattaggaggttaaataacaagcattactattctcattccaatgacaaaaaagactcaaaggaggtaaatgacttctttgctctttgtttatctttaggaaaaaaaatgaaaatatgactcaggactcttgtatttcctgtctaatctttgcactctcatccatcactcccaacctgcagacatcaaacagttcaagggactcaggataaggttaaaatgtccacattcttaactccaaattcaaatccagcattatcttcagaaggaatcaagaatatatcctacacatatgtataactctatttttcaaatgtgcattaatgttgctctgatgaataaaatacacacttgtgtaaaagctttctattgcattcacaattgccttttatctttatgtatcctcaaatcaatggatattaaaagtacaactacttagtgaaggtgggcacaattttttggtactgaaaaaaaatatcctctatgagtccagttgggggatatgtctcttggacaggccctcattgaccaggcaaactaaatcaagcacccactctgcccaccattccctatctcagtcctttctcctcttcattgcattcacaagcattctatctatttcttgacttgtttgaggatctgctctgctccattcctcacctgtcacaagaggctaatgtctgtcagggcataagcagtgctgctcttgtatgcctctatgtgcgcctagggctggcctgacatcaatgaggggctttgtgtagctcagctgacttaacgttaaaccaatgtttccacacccaatctcccagtgggctgatggctctaccctcttatagtagatgatcacagtgtaagcagaaaatcaaccatggcaatgaaaatagtgactgctagtgattttggggtgtttagcatgccatgttagtaccttactatgtattatataatacttgtaccccagcctgtaaggagggtattactccttcttctttgcagatgacaccgctgattttcagagaagttaggcactgttgtcctggactgatgcacctcttaattatatctgcatgttcctaaaaccagccctaatccactgggttgtaatgtccctgtaccactctaaatgcatgatacctcctactaggtcccagtctcattaatgaaaagaaaaaaggaaaaaagacaaatggatttcacccaaggggttacctgccttctcttacttatgcacatttatttaagactccacctcttctttagaattcaacagatgtttcagcgttcactaaaataccccattatttttcagtgaggaagagaagagggtggagtcagagatgctcacaaagggaagtttgtgatgctgaatcagactcagagctgaagtgcaggcaaaagatgctgctaccgcccagagcagaatgaaagagccactttgttagtactgggggagagtgttaggggatgcagcgtttagctagaagaaagtcaagcctcaggcagaaatcagggcaattattgaacagatctgggggcatcacattcactctgaacactagagatgatggccttctgctcagaagcaaatgacagcattcaaatgtggatcctaccccaatcaagcccccaccctgctcgcccagtgtacagaatcaaagggagttggacactcagcctagctctgcctcagggttgacaaatgtgagatcagcccctcctcaccaccacctggttccctctggaccttctaatggtttggagggcagaggaataatgtaatttgtcaggaaagggacaaatgctgcaataacaatgtccacctaaactggcaaatgcttggtttaattgtctctacaagtcaacctagcaggagttcagcaggggaagctgatgatccaaaagaaattattttcttatctgttattgaaaatttcaaagaaaacacatgccacagcccctcgggacaaaccagagaatgaccaggacagggaagatggatgtcttccaatgtcttggcatatctaactttaagatattgagtatactatcataactttctgcctgaaacgtctttattagaggaacaagatttatgtttttggtctagggggcaaaaaaaaccctcagatgtccacaaaggatcctctgtaagtcactcagcctatctgattaggggtacatagtgcagaattttaaagagaaagttatcttcttttgggtggccacatttcccaaccttgcaatttactttatccattcccttgagctttctggcacattatgttacttttttggtttcttttagaagttcctgcaggaaatagtaactctctggtttcctgattttcaaaaatgaatgttcacatatgtttagcatcaggctgttttgtatccaaccgtaaatctgcacactacaggaaaagtgcatgtattttaaataattcacatactgcagtacaaacttgcatttcactggaggaaattaggcagattagaaattcataaattggatcgcaatctcttttctttgtaaatttaaaatcatactagttggctaagtgatatttaggagaatacagttaattattaacttgaaacttttctgatggatttcagcaggggtaactggatctcagactagtcattgtgttccctccaaccggccctctcctgcctgtatccactgctactgtcttcgttaaggaccttctcatttcttgcctaacaactgccagagtctcctaagtggccttccctggcctcttgtcatcactctctcccaccacttctccataatgctgtggaatgtttttttttttttttcctaaaacctaattctagtcatgtcagtgtctgctttaaatctgacctatttctttacaatataaatgcccacttcctggttggcatagtgtcctgcgtgagcttcttcatctcatctctggtcattactcctctcttcctcaacactcacattcaagtcatgccaactgacttgtaattctccagagtgtgctgctttaagccttttaatgttcgtacctgtttctccatcttctccaaactacccttctcaatcctcttcaccacgttaatatcgctccacacaaaattccaatctcatattaatattgtattttccatgaagaatgtgccccctgaacaccttctgtgtggcacagctgtgccaggggaggtttccaaggaccctgcttttcttttctcacacttgatggcaatctcatgttaggtcccctccaatcctagactggaagctccttgaaggaactgacctttatcttgaggttgtttttcaagtattgagagctgtgcctgacacagaatcatggacactcgatagatgtttgttggataaatgaatatattaagaatacactgagaagtcaccagatttggtatgatatgagaaacagtgtgaagtcaattgtctcccccacaaaaaaattactgatgcctgaaaatctaccatttacaatttatttcatacatgatttattgccttattcatgtaagacaattaatatgtaaatattcttgtgagagttaacacaatgagtcaccaactgaccctgaagtagtttttgggttcccgctgtcaacagaaagaatgggagagcatacgttgcaagaaataggtggtaagagaaaggccaggtagcaaaagggtgaggctggcatggacaggaacagtagagaaggattaaagcaactttgtcagcttcctaattttccctggcatgagtacttactttccatctacatacccaggattctctctcgacttccttcacttctgcgaattgaacaaaagtcaagagggaaattttttatttcacaggtacaaaacatattggtaagcaaagaatgaatcccatgtgaccctctgataaactcaccttccctctttaccacactcagttccccaaactcatatgccaaagcccttgccacattccaacctcctgatttacagctttccttgatttgttggagttataatttgctttcataatcctgaggcaaaccctggtcagttttctgcagtggcctctcctcctctgcttccaggatctctcatagcactgtaaatgcaacgcaagcaggattttcctagctctctggagatgcccacaagagtgctgacctatatttccctgctgcctcctcagccttgctttctcaaggcccacccatggtggggcctggctgccagcaatctcctacagaaggccaaactccctttcagaattgccattcatcaagctcatcatccaggcatcatctaacatctaattattctgattatgccacatttgtatggagggtcttattacctttgcactttattgaatataatacgattcagaataatcaactgaattcatcttcccagtggtggaaatgaaggtttgaaagctacacagactgcggaaagtgttttctgggactgtgttctacctcatttttgttcctttccaaataataacacttgttcattaaaaacatgtttctctcaactagttgaaaccatttccgcgtagcctatttgcaagtccctgcaacagccaagaaagcagaagaacataaatattctatagcagctacctgggtcatctggctacacagctccctactgcacaccctgcaaatgtacaggtgtcaaattagctgcagaacagctccctggttgtccttttctatgcaagagacagcctgcaaatgggaaggttgtgtctttaccatcaaagaaaagctgttccataatttgcactcagatccaaatgcagagccaaatatgtcagtatcttattaaatagtggaggcacatgggcaactaccaatttctctttgatcagatgtatgtgttacccccaaatatcacaccaggttaatttattcaatagctcaaatggttggtaagtaaatctgaaattaaggagaggttcttttatcagatatttggaatccccttaaatttcctgttgcagtttctgccctttccttccccttttccccacctcccccccacaaaaaataggtctggtagagagagaaagttaccaaaaaagagcagataagaaaaaagaagatggagggtcatactgacgaagaaattaagcaagggtccaagggtctacacttcctacaaaggccactctatgctgccaacacctcccgggtggcttgccagtgtccccagacacaagctgagtaggccactcgggtggctttcctgtgaagcctgtcagcagtgatttaaattctgttaggcaatgggaggtcttacctgaatttattggcagatgatggcaaaagcagagtataaagaaaatacctagcaacgaaggtccttagaccaagctgtttttgtatttaacatgaacacagagcttattactgtgtggccacagggatgtgaacacttcgtgatgtcagctttctctaacccttagtccacattctattctaataaaatatacacgtacatttaaagtaaattctcctctatatgaggatattaatgcctataaccttatccacatgatgttaatgagaggcagaaacccataacctactattttgaggtaatttattcaggttcaggaaaatgtctttgaacttaaacacattttcttcaaggaggttatacagtgcagtgaaggagagaaaatgatctggataattatgctgaaaagatgaagaaaagaattttggagattattgtgacctttcttttacaagtgggaaataagataaaatccaaatcttcagtacaataatatttactcatcatattaaattcatataactgtaagcctctcccttgattataaatccatttgagcctgggccatcgcagccaaggatttctttcttttcttgtcttctggatactttagccagagctgtcacagactcctttaactcttaaagggatcaccagaagcatgcatgtaaaagaaccaagtaaataattttctaaaattctaggcatgcaaaagtttcatttgccattaatatttgtctcaacatagtctacatttattggcaccctcctactttcttcttttagtcacagctttctacttcaaagttcccaaatacaagagggcagtgatcctcaagtagctcagcaaaagatatcattaaaattgttaaaaaaaaaacaaaacaaaaccctacagcttcctatccctaacgtggctttctgaaaccaaatctcagaggagggatcagatgattcatagcaaactcttggagttgtccttaagaaaaccaaccaaagaagcaaacaaaaaaggcaagtagatgaaaatcatttaatgattgagttgatatttattgagggttgtttatgtgccacttttcttgtctctggtcactatttacacactattcataaggtcaactgtctggttttcgtaagtttgatgactcatttttgtaaagtttgatttttaaaatagggttattatatgcatcagaactcattcccaaaacaacttgatggttagcaaccttcgtggattgctataatttactcatccatgatgagtaaattagaaagtatggaataactagagtaggtttattgcttaaattcagaaagtacaggcgttaaatggcaaccctaagaatgatcctatcattctaaacaaagatctttactttgagaccacatttcaagtgccttgaaagtcactttttaaaattgttgttttttttttcactctggcaataactgaaagacaattatgtctcctctcatcccccaatccccaacttcaaagctaatcagatcatataaaacgtgatggaaatgggcatgttaagataaaattgaaaaaataagcaagggaagggagtctttggaatacatttatttgtgaatgttcggagggcagacaaatagctggagaatggaaagtagaaagatttaagcccatgtgaggaagaacctttaagtgcttattttacagaatgggctggctggtcagcagagaccaaggaaacatctgtcagtattactttagggactagactaagagtttggaaagaatacaggctaaataagaatttttagagtgaggaagtgcttacatcgtgatgtgcactgtagcttccctaaagaactagaaagtttagtttaagacaggttcattcctcagttcatccttgaacagtattagcctgtaggaactgagtggaacagtagggagtatcttggggacagtgactagcataaagtctcaaagaaaaaagtgaggggagaagggtgcgggtatgatggcactcctctgctgtcatattaagtgcgacatgaattctctggctaggaggtagaaagaaaaataatatgtgaaagtgaaaaacaggtattatttgattcaggttaaatggagacattcggacaattaggacagttagatccagttcacataaatatgcttttatcagcattgcaaaaatatgctttcactttcaaaacttctatggtatcattatcaaaatgtccacatgccatgtccaaatcacagagcagcagaaccaaatacctgatataattaaatagcttgtacttcttgaaaaagtcagaatttaatagcgtgtgcaatgtaaagctgtttgaaaggaccctacagctagcagagtgcccatcctgtcaccaggtaaacactcaacaaagatttactgaatgcatatattagagctactgaatgcttatgatagctcacttctggtccagaaatttaaagagtgacaagtctgtagtctcatttaattcttggaatagccttataaggtagattctatgacaattctcttactggggagaaaagggggccaaggaacatgcccaaggtaagtgtgagaagcaagatttaaatccaagtttgttgaacaaaaaactgggctgaatgaactccatatgcttttcttgctcttacatatatttttaatacatttcaaaatgagtgccgtcgggatctctgcagtatgaagacttagagcttcaatggcacaccggaaaatgaactgcacatggaaatgattttgccaggtggagatttaataaatcttttcacagatattagccccgtaagtcctgaatgtgcattaagtttaatcatttgttttaaatatgtctccacacgcacagagctctttgacctatattgttattatcattattaataaacttctagtatttgacatcatgcacttgttgcatagtgattttcacatttagtgagtaggaaaaatcttcctgatgaccattttgtaattctctttcaaaatgtttccttgggatgctgttcagattgattaaaaaccaatttagggaaaaaaggaggcaagcatcttcagttcctaagctaattagcaatacataaaatctctataattgacataacatttcatagttgtatttccttatgcataagatgattatgtatgaggcagagccaaggcaggaaggaacgggggcaggcacaaagggaatgagtaggtgagtaggtgagtgtgcacacataggactgcgtgtatgcttctgacatcgtgccaagtccaactaaaaatgtggttgctgttgtttatcatcaccacatcaattctttcttctcctttgatctgttctcaaacacaattaaaacaactatatatgaacacagataatacaaagcaattgaaattcattttcctgtgcttcctttcctgcacctttactcctgtccctctgagcatcagttagactcttgctgtattttgttccaaagaaaatgacttactgatatattaaggcaattaatggtctcaagaagtgattagaaactttatggtgactccttcttccatgtggtgtgatagtaggttagcgaatgagcaaaaagtcattggggaactgtttttagaatgggttgcttcttccaaattcatcttagggacaattcctccacttaggtgaaggagcagtgaggacctaacctccaggactttagactcatattttcacagccttagtcttgctatagtgaataatttacatttcaaagcaattgcatttttctttgaaatatcagtttgtgattattgttctctttcaatgttcaattctaaaattatacaagtttcattagaaacgcgatgacaagaggtttttcactttgattcattgacaatttttgtaaaccaggagaagtgttacattatcttttaagcaatttttagactaaatgtggttaggaattttaagaaacaaaattaagaaagaaatgatgaaaacaaaatgtattacaagtaatcatgctgtgatctaaaatgtatatttgaatagggatgccattctggggttgagaagtataatatttatagtaacttgaggcctactttttactataataacatgaatatcatttactgagtaagcaccagctgtccatgcctctctgactcctgaccatctatttaaaaactagaaaaagaaaaatagaaaacatgttatcaaatacctctagccattacatagaacatgtgaagctttcagtggtaataaaaaaatatccaactttctttagaaagatgataaacaattacagagaagtccctgttcttcatcacaatcaggggccaataccaatttctcacagcacatgtgcagcccaaagtctaggacgaactccattcctcctcctctgttctgcccttcccctgcctcctgccccgacttcagaatgttttcctggtgctcactttctgtatatctgcctttagtctgattctggaagatccacctcattagatgagacacgatgatcttcaatatttaagcatctcttattttttcccataaagagatatttagaattgaaataatataaacaaaaatatagacttccttagataagtcagtattcgaacagctgaaacactgatatcaaattggtgttaaatgatgggtggagatggagaaagattatccccaggtggttcttttgttggtctctaagtataccaccaagcttcctcagttttgtatcagggaagttaagatgataaggtaaccccataatgtcaacatatatggaaaaaagtaattcttaatgtttaaaatagataaaaacccttaagaattctctaataactgtcataaaacctagcattttactccatttgcctttttgcccatgggttctttatgataatatgaaatttactttctgttaaaccattttacctgtgaacataaagaaatcataattgatcttctggctttttgagaaaaggtgaacactgaaaagagattgtgttccctccaacttcagagaggatatgctatggctctcagcagtcaaatgcagctggctgccagcaaaggatttctggtgaatgctatttatgcctactcaattaaagtaaacatatatttattgagtgctactgtacataaaccagaaatgctgcagtaatatagtaatgcagtcaccaccccactacccccaaacactcaaacttttcttctgtcagagctctgggcccaaggaatccatttatagactgatgcttttctggtccatgttgaacatttataaaatagcaactactcttaaacctgtactggatatactagataatattcaataccccaaacaaaggatcattggcctctagaacttaactcctaaaatgtaagctcggaatagctcagatgttcttacagaaatagacaggatggatattttttacaatggctttttatgtttaaaaatatcttataacacaatacttccacaattttgatggtctgtctttttattacaaagaaatgacattatcaacatttcctcttgagatgtcttaagtatgaatacctataatcagatgcgaaaacaaagcatccataagcaattagtatgtgttaatttattctacacttactgtgtgtttgaaaaacgatggatcaggttaaacgttttattggaaaatattatccacctattccctccaaaatatgatgaaagctcattgaacaagtaccaagacagtaactttaggttctaattcttgttattttttgttgttacattcatgtctaatataaaatccaggaaggtttagtctactgtgtaagcaatttcattgagaatgctagacatatttgtgtcaatggggacacataataaaataatcaatattttcataagtctagagatttaacaaatctaatttgttctagttattagcccttacactcttttatttttaaaagggaattgataaatatgtcccaataaaaccttatgcaactatgttttattgatgcatatgctaaaatatataaaatattttttagagttctaaattggcctaaactcattagtccatttgttttccttcttttaaatggaattgccttttagattttacaacaatgacctataagagtaaacaatttcaacgaaaaactggtttcaataaaaaggtagaaaacattatcttatctttcacagggggcatctgtggctgaatacaccatcactgtgggtgacatggaaaagatacatgagactcaaagaaggactagaaaagggaaatataaataatccaggttacattttaaaagaggcataactttataatgaagaaaagtttccactaaataaggacaaaagctgctttgatcaaattctataaaatcatgggattagcacttaagattatgaagcctaaaaccaaggccttcctggcatttaattccagatctgctacctattagaatttaaaatttgggacctgttctctaagaatcctatcttcaatctctagaatgttcttgttcagctttttcactccatctgggcaaataggaccaagacttctccccttctccattattagacatgtattttcaacctaaaatcccctctccagtcatttctatccaaacaaattatactggatcctcaaaattttacatcagaatcacttccatgtgatctttttggaacagatttttatgactctagttcctctaaaagtttctttactatagaatagctgtagtataactgtagtttattcttcataaaggttggccatgcagacagacagcataagagagaacaggggagaccccaataagcccactgttctctggcctacattgccacccttcatttctaggatacatctatttttcaacaaaattggaaaagtaaaaataaattatatccaacatatttatcgaacatctatttgaatgcttgttgttctttcaggtactatggtagattttttttttttcaaagatttgttttggtttctgctcttaaggagatatctattatttgatatttcattcaaaacaagaatcagaatgttaaaaccaagattgcttcatactcctactatacactctcttttacacacacacacacacacacacactgctaattgttaacacaatagttctcatcagattatgaaatataatcatgtttgacaaacacacgtttatgaataatttactataactatttcaggccctcaaagtaacactcttcttactgtgtttttgagagcactcagtctgctaattatgttgcatggaaaagtccccatcatatctcctattatggattttatggttcattttactgacatattttttcctctttattatcgaagacttagctgcttttctttctctaatactttactactaagacaggaaatcaagttgataatgtcctatggatcataacaacttcatttatttgcactagcaaaagatctgtggtaacagcaagggccaacagagcacatgtcagatgtgctgactggtcccaagacagcaggcaacatgaaacaaaaaagagaagttcaagacctcactgacgacaacaagctgcagcaacagcttcccagctgagtgacaccaagcccataatggaaacgttactcgtttaggtaggcacacatgaaatattaatttcctggattgtctgcatttgcatagtaatattaagttcatcttcttggcatgttatggtctcaattagcaattctattgtcatacctgagatttggggaaggaaggaaaagagtaggctgtagacaatttccctctggaaacagcaacactaatggagcttatcactcccatcattaatttaatcaaaaaccttaaggcagagggctaaagcaatctgttaagaaaacattttctaaaatgagaatgcttcccatttcaattagggtcttgctctttttttctctttgagacatgtttttttctctctatgctctcttccccacctcccatacccgccactgattagatttgcaaccgggggctgtatttttttccaaagaatgttttcttgcaaactgacaattctgcaacaacatccgtcgcctcaaccttcttaactgacttgttttttaagacatctcaattagttcagacccactgtgcaaagataaagtccttgtatctcagtgagagaatgctctacagagaatggagtttgctttacggtgtgcatgttaatacgctattctctttaattagtttggcaaatatggctgccagtggataattctgctgcatttatatgcgtatttgcacacacatgtgtggttatatgtgtttcctcttccagatgcagaaaaaaaccaaacaaaccaaaacatgaatactatgaggaaggtcgctgggattaggcatagcacatataatacaaaaatattaatagcagtctacaatttcagaattttaaatttgttgatttttgaaagctcaggaacagcattattattaaatatacataaagtggtgatggtctctgctcaacaatgagacgttttcccactaccccagggaatacctttattaatgcagacaaatcccttgacaagccccattgcaaccataacacttactatatgagaggattgtatcttttgctagagagaatttcctgagcctaaaaatcatgtgagtagactgacaggaatttctctctgggaattggaggacataaaactgtattttggacctctgtggcattaaagacaacagtgctttggccatgctgcccagaaagcacagggattatccacctgtgttccctggcagctgagcccactggctgtttctgtatggcaggagaaagtaagttgcctgctctcagctcacctttctcaatgcagttatactttaaaaatgtaagtaacgccatggaattacgaggtcatggaattgtatgtgagggattctatccatggatcactacaagatctgaaaaagctgtcacaataaaatacattcaaaaagacagaaaaagttcccatggtattctttaccattccaaataaatacattttgagattttcgtctttcagtatttagaatgtttggaaattggggagataaatcacacagaagacatttaaagaagacttagaagaaatgtcttttaaaatgaagagtacatttccagaggcataagtcatctaaggctttttctgtaaaaggtgcagactctatctgtgcccattcctgcacacatgacagaaaagttcatgtacatgtcagcatttctattggtgtgattaagagccaggctatagtaacactggggtaaacgttctcgaacatctttttaatcttctaaagttaaggatacacacaaaagggaaacaaacattttagtatagtgattattgtttctaaaatgaatagaaatatgcttatggcccaatctagatggtcttaaggtggaaaactatataacaaaattgatcagtttccacaaactaaattaaatattattaaactctaaataaaaaggtcagcattaattcacatgtaaaaatgtgtcaccttttaaatgggggaaattataaagggttctattttttctcactgattcatggaatttttagtaaatcatattgaatgttgaagaccctgatgagtgacttctgaaggtactaagataacatgaaaataaaaaaataaaccggaataacctttgacatccctccctacccccacccctcattccaagtgtatgtgtgtgtgtacacacggaagccaaaattgaaataccaaaattaccatatatacgtgtctgtgtatatatacacagtgtatgaagagtaggaaataccgatttctcacatatttcgggtactggctgacggcttcatatatattgaagtgctcaattctctcagcaacattgtaagtacggttaagtttttacaaatgatatttttctatgtaacagggcttcagaattttttttttcttttctttttttttttttttttttttgagacagcttcttgctctgtggccctggctggagtgcagtggcgcaatctcggctcactgcaagctccacctcccgggttcatgccattctcctgcctcagcctcccgagtagctgggactacaggtgccccccaccacgcccagctaatttttttgtattttttagtagagaccaggtttcactgtgttagccaggatggtctggatctcctgacctcgtgatccgccctccttggcctcccaaagtgctgggattacaggagtgagccaccgcacccgccccagattttttatagatgaggaaactgaggcacagggaagtctagaaacaggaggtgctcctaacttaaattcaaacccagacacttttacccaccaaactattctgtctctaccggaagggaaaggaccggactaggcttcaggaaatttgagtcggctgtattcttgatcattttaagtctctggacttacattttttttcatttcaaaaatgtctaaagttgaaattaggcatttcaatgttacttgtcacttttccactccaatctgcaaaatgtttcaaattgtaaattgcctttcccctctagaaggtcagtattgaaaaggcgtttgagatcaccaaatacaggatcccttcctaccataggaaatctattctatattatctcagatttacagtgattttctacacaaattcttctaatgaaggagacagcccataggccataagacattgttaaaagtataattgttagaaatatcttatttttgttaactttatgtcattttattttttgagacggagtctcgctttgtcacccaggctggagtgcagtggcgcgatctcggctcactgcaagctccgcctcccgggctcccgccattctcctgcttcagcgtcgcgagtaactgggactacaggcgctcgccaccacgcccagctaatttttttgtattttcagtagagacagggtttcactgtgttagccaggatggtctggatctcctgacctcgtgatccgcccaaagtgttgggattacaggcgtgagccaccgcgcccggccttgttaactttatttactcagaaagtctaaataattgactcacttgtttttttatattcattactttatatacctttctgaaaacataaagcgtataatttgaatacccaaagaaattgattaaaaatgatttcttagtagttatttaaatacatatatttcaactttaaaaattaaagtttgatctagagatcttttagtcaacattatattgtgcacatttattcataccattaagtactgttaaatgtaattttaataatttcttcagcttcatgttttaaatttttattataacttcaaagagttttttaataattcagatattcctaatcataactagcagcacttccttttacattttttcattcggtatcatccataccacctccaaaagaagttagaaataggcatacttgattttattgcacttttctttattgtatttgcagatattgcatttcttacaaattgaaggtttctggcaaccctgtgtcggacaagtttatctgtgccatttttccaatagcatgtgctcacttcatatctctatgtcacattttgttaattcttgccgtatttcaaagttttcattataattaaatctgccatggtgatctttgatcagtgatctttgaggttactattgtaattgttttgatgtgccatgaaccacactcatataagacagtaaaatcaatcaaccaatgttatgtgttttctgattgcttcagcaatgagccattctctcatctctctctctcttcaggccttcctattccctaagacacaacaattttgaaattaagccaattaataaccctataatgacctctaagtgttcaagtgaaaggaagatttgcacatctcttacttgaaatcaaaagctagaaataattaagctaggtgagaaaggcatgccaaaattcaagagaggctgaaagctaggcctcttgtgccaaacagttaactgagttgtgaatgcaaaagaaaacttcatgaagccaattaaaagtgctactccagtgaacacacgaatgaaaagaaagtgaaacagcctcattgttgatacacagaacgttttagtggtctggatagaagatcaaaccagtcataacattctcttaagcaaaagcctaatctaaaataagaccctaactctctccaattgttggaatgctgagagaactgaggaagctaagaacttagaaactagcagacattcgttcatgaggttcacggaaagaagtcatcttcataacttaaaagtgcaaggtgaaacagcaagtgctgatgtagaaactgtagcaagttatccagaagatctagctaagattattgatgaaggtagcaacactaaacaacagatttttaatgtagacaaaaccgccatatattggaagaagatgccatgtaggactttcatagctagagaggagaagtgatccttatgaatgactttgagggggttcaagacttcagtggaggaagcaattgcagatgtggtggaactagcaagagaattagaattaaaagtggaacatgaagatgtgactgaattgctgcaatctcatggtcaaacttgaatggatgaggagttgcttcttatggatgagcaaggaaagtagtttccagtggaatctattcctggtcaagatgctgtgaatattgttgaaatgacaacaaaggatttagaatatgatataaacttagttgctaaagcagcagcagagtatgagaggattgactccaattttgaaagaagttctactatgggtaaaatactatgaaactgcattgtatgctatagagatatcgcccatgaaaagaagagtcagttgttgcggcaaacttcactgttctcttatttttaagaaattgccacagtcaacccagtcttcaacaacctccatcctgattagtcagtagccatcaacatcaaggcaagaccctcaacaagcaaaaatatgataacttgctaaagaacatctttctagcaataaagtttttttaaaaaattaaggtatgtacattgtttttcggatagaatgctactgcacacataatagactcaggatagtgtaaacattacttttatatgcactgggaaaccaaaaaattcacgtgactcacttgattgtaatatctgctttattgtggtggtctggaaccaaacccacaatatctttgaggtatgttcgtatttgcttctattttcttctgcagtttttatggtttctttatattttcccacatctgtctctttaatccatctgttatttattcttatgtgtggtttgaagaactataaattttctgaaaactcacaaatgatatttttctatataataggccttcagctatttgaaatttgtattcatgactaccatttctcttccatccaaatcgctagattttctactctatgttaactatgatcaattcctttaaagggcttagggttttgttttttttttttccagagttttcagtctcctctgtatattctcaagcttgctaattttatccaggagtgtgatgttcataactggacataatttttaaaatgtgcaatcagtgtccatgcatcctagggcagaaaattgtaattctatacatgtaactattacgagattaaattgggttgttggccaccacatcgtaatcttggcacatattcaacttgtacttaactaaaacctcccagatctttttcacatgaactgctactgtcaagccctattttctgaaaatgctgccaattaatctgcaagcctttcatctacatagcagtatatatgcatttgatacacattttgccttcaaatggtgattgcgtttcttatttaaataagattatgcaattatccagaaacatggaaaggggctcaatgaatgcctttgataggagtgataatgtggagtgtacagatgctggagtccctgttcagtaatcctttcccataaacagttagtttcactgctgcacaggacatgtgatggccatatagtgagcaatgccttcatttaaaacacatacctatggaatgacaatagggatttcacagaatccctttaagaataccaagaaacaaacttaaaactccccagaattaaaaaggagtttcaggcaccaaaagaactgagcagactacttttttgcaaagtcctttgtgatcttcttaagcccatctattcagagtaaaggtcaagtgggcaaacccagcaattctattttcccacaaagctgctacagttttctatctcctgacagccccgtcactaggagtctattatctaccattctgtttccagcaccacccagatccttaactggaaacccactaaacagctcctttctttcatgggctgactttcagcttcttgtaaggcttcatgttgtacatctaaaagctttctgctcttgctctgtttgtttaaggagggcaacttgagaaagcagaacccaccataaacaaggctttcactactcagtagaccaaatgcaggcaaatttgctaatcaaggcctcttctagttcattaggtagcactttaaaactagcgtttagatgacatgtctgaaactgtctttaaaaactatcttaaggatttgatttttacttgctggagcatttcagatcttccctttaaataatacttagtgattcttaaaaaaaaaaaaaaaaacaaacaaaaaaaacaagccaacaaattggaattttaccatccaatcatacagaccacagattgtgtctgtactatattaagtacactttttcttgccccaatagctgtttacagtggtagttgttttcttgctcagaacttgatccagatcaagaaattaactataagaaaataaaatctagttgttttaagttgacagctatttggcaatcaaaaactcaaatcctcccactttcaaagttaaatggagaaaaaaaagaagaaaaaaaattattcttcctggcaggctgtaagctttccatttcgaggtgtttgtatactgacacgaatcagatcggggccaaagaagcctcattcacaacagtggagtcaacacatccaatttaagctcaagttagcaattttcttacatttctaacatatattcttgtcattcctgactggcagttattgacacataagcacatattgaaatacacacatatccttaaccaggaagagaaaacaagtaggggtagcattgaaaaactcagagcaaatgagctatcaagccttgtaaagacatggaggaaacttacatgcataccactaagtgaaagaagccaatctgaaaaggctacatactgtatgattccaattatatgtcattctagaaaaggccaaactatggagacagtaaaaagattagtggttgctgggggttagtggggagggagagatgaactggtagaagacagaggatatttagggcaaggaaaatactttgtatgatactataatgatggatacatgttgttatacattggccaaaacccacagaatgtacaacagtaagagtgaaccctaatgtaaactgtggactctggtcgataatgatgtgtcaatgtaggttcatcaactgtaagaaatgtaccactctggtacaggatgttaataatgagggaggctatgcatatgtgggagggagtgccatctgtgggatagctctgtacctctctctcaaatttgctgtgaacttcaaaaagtctttaaaataattttcagtcggaaggttaacatgtattcaaacattaatttgtggaataggatgaggatgattatttatttaagtgtcatgattaaatgtacccaaaatcaatgataaaaatgcctggtttaccttcaattacctattagaaaagaaatgcacttcaaaatacacaccacaaaacacaaatggtggaatcttcgaccatttgttttccttttaatctttgtcacatgacattgtctcaccacagttctagtgttctcttcctaatatttatggttcaaagtcaatgaagtaagctgtttgaattattaagtaccaattatcttcaaataaaatatattcacaaagccattcctcttgcatgttacttcatgacctgtttttctctgtagggtctcacccttggaaggtgcagtggaaatgaaaattacattgaaagcagctttccttttatcatgatgatagacccaagactatatgcagcctaagaacgtgaaagaacccatgaatggtggtgagctccacagcttacagaagtcctagtggtgtttagcaggatgttttcctaaatcttgaacatggctttgaggaattcacagtctgacctccactcacttcttcaagctcatctttacatcccacctccttagccactcacacatcattcttcatccagatttatacacttgtggaccctaaaagtaccattttctctctagcccctatgtctttttactcaagtaaacctgagtttaaaatgtcttcaccctctcataccccatgcacttccaactgcctttaggtaactcccatgcgaccttcagctctcagctcgaatctcagtgctaccatcttttaatttaggttcccttcctgtgcagtttcctagcaccccttatgctcacccccataccactctatagtgatggtagaaagcagagttcaaaaatgtgtccaagtaccacaggtatcagaatcatctcgaaagcctgttaaaactcagatttctaggttccatcttggtcttactgaattgaaatctctggtaatggggctgagagatgtgtactttaaataattttcccagctaatacctatgtattctaacttcagaaacactagagtgggaaatatattcttaggaaggataaaaacacagattgaggctacttttcctttcttaaaatatcaataaaataaggggtaaagactaaaaaaaaatgttttaaaagtggactatagactttacatgggagtagaaccgtcgacatgtctgaaggtcacaactctctaggtggttttccttttctagtctaaaaaatgaaatcatgtcctacacatgtcattccattcctccctacaggaaatagagtaatggctctgctaaaaaagaccagagttaaagtgtgtgtgtgtattcaagagaagtacctttagaagagacattttaattaaccccaatttaatagacaatgctgaaacacaggggacttaagacattcctgacctatagcttttcagtgataatgatgatgataaatgaggctacattctccagtctagaaatacttgccacaggcatgatttctgaacaaattgcttccctcatttgtcactgccccgtatcaagtaataatgatctcaagcacaagaacagaaagcctagggaaacaaatgtaagagatgtaaaaggaaatgaatagaagtgaggttatgacgctttggagacattttttaaaaagttaaattccaatgaagatagtttagaaattggaatgaccctcaagtttggttctccaatcagtatttgtgtttcctgaacaatcttggtgttgattcttagattttaattagcaatggtgctacggtaaaaggatcctcagcaatttctcacagactccgggccatttgctctcattataaaagtctactttcatcgttcctgcagtatcattgatcttaacacagttgctaaggccaacactcatgtcattatttttgatgtaacatgaagaataaaaataagttcctctgtaaaaacctaagacatattttattttttaaatgtctgatggcctgtcagaaaaagagggataatcatacagttttccaaatgctaaactatttctttatgtgagtcaaaaacattgattttggcgttttgcctacaccaagaaaaccagtgctttgaaggcaatgagcaagtgacaatttacacagagcctgttataatccctcaccccctaccttcctggaaaagcagaattcacagtggttggtcagaaccctgtttggggctggaataggccaaaaccactcagaagtttctagagccaattaaatacccctgatttactgatttaataaagaaactctgtcttctgacctcaaagggtcaataagaacaaacatcaataaaagggaaatgttttcattgaaaacatggggagatcaagcacaaggcttctaacattgtgtgatgcactaatttatcagcaaaatgctcatagtgggtagcaactcatcaaggaaaagagcaatctgctccacagccttcacactatgctacttacattttcacagaaacaagttagaatctaaactactgaatacactgagactcttgggtacccttagctactttcaaagaaacaattgttctttcttttatgtcagttacgtcaaccacaaatcttaaaaaactttaaaagtagaatcttctgctgagaactgattacactaatagactccagtgtgttcacctcctttctgccacactgacaggtactgggtggacagttgaggattgatgcattctagtctaagagatttgtgtttatacttagtcaaagaaatacctcatcaaagatttgatagtttaagtaatgtaaaatgatgcaaataatttaaaatgatttctttaaagtgatgagatatgcttattattttaaaatgcaggtatcaattccataaaaataaaaaatcacagagcaagaatcaaatggtaatatcctagaataatccttctttttgggttttgggattttgtatgattattatatatctccttattttcattttggagcatttattttttccaaaactgttatgaatattttcaaacatacagcaaagttgaagaaattttgcagtgaatatctgtatatctaccacttcaatttattagtaacttactttactagtttcatcatacttctatatatttatccactcctctatcaattttatctttttgatgcatttcaatgtaaattacaaacccaagaaccgtcccagtaaatatttaaacatgtatatcattaaccagagttcaatatttgtttagatttttttcatgcaatatttacacaaaatagaattcacaaatattaagtttacattcactgagttttgacaaatgcatccaaactcatctcagttaaaatccaaaccttctaccaagtatgatctggctccagcctgtttctctactcacgatgccagcccagcatgcctacccagctcactcatcttcagccttctctctttttctcacacagctgagctcttgatgccttcacagcctgtgcacaagttaatccttccttttgtccctcctcatcttcgatcatcacttttaaatatcacttccttaaaaatgccttccctgcctgcccatatagattatgtcttcccagttatgctctataattattatcaaaatgtgaattatacatgtttatgttttctttgtttaatgtctgtgtgctttgttagtttacatgttccatgattgtagggactatatatttctaatccactagttcatctaacacagggaaacaggatgcagatagcagttgactgaatgaattatagccctctttgatctcttctttcttggacattacttgttcattctacaataatgcatcacattatctcataatcaatttataaatttatcttttatctcttcctcttcacagtaaggtctgagatccaatgcttattcattcattcatacatgtttactaagcacctactctgtacccgacaatgaaacagatacatataatacagtctgaaaagtgttctggaaacgcaagaaggggcaccttacttgaatcggagggaaaggaaaagacggacttgccattgaaggtggcctccaagctgaggcttggaatagatcttagctttatatacttcctttacacactaaattcagaccaccttctctctcatgtgtgaactccctttcacttttattgacatggactgtggagcacttttccctacatggagaaagagagctagtaataataaggtgtcagagtgactctcgcttggtttctggcaagtaaaatctaggaaaagttcaaagccatgactatattatctttctccgcattggtctccttcttgaatatcccacagtgactatgaagtttcagctcaaagaacttattatttttctactctgtacactggagtctagctccagaatatgaaagcacagcagtgcaagggccacagaggcactgcagtttgtcaaagcccattccctaccaatatttgttaacttctctcagagtacagcaacacatcacagaagagttttgctcttgcagaaaaacgtacaacaggaaatggatagttgaatacattttgcatgtcccacactttcatttgctcccttaaatatattcattcattaaatgaatacagtgccatggttgcttgtactgactggttgggaatcacaaattccagagatagagtacaaggaagcagacaaacaaaaggttttgaaatgttgcatgattactaagtggccctcccaattctgatatccctttcaagtaaggtgtcacttctcagtgcaaaacccagtgtgaatgaatgaatcaagttggacagggaggttgatgttcagtttttcataatggtacacagaaaaatcaaaatgttgtcatttaattatgtttatgttagtgacattattaaatagccacctcttttttaccacagctaggttcaccgtcttcaattagaaagttagagtgcctgtctctcagatgtttagtcttctgtcataactcttattttaaaaacatgaattactaacagggaaaaatttgagcatgacacaaatttcccatctaattatgcattactttacttgtgaggaacaatgtgtgactatagaaaactgcatccaatgaaccaagctacatagcaatatacaaaatacatacacataacccttcaaacatctaacaggtatctcagtttgccatgtgtgttagggaccatacccatccacatctggtgttacaattttctgtctgatttcagataaccctccttccacctcttcacagtaactcccaagctgcaactcttccaacatcctcttccataagcaaacttaggtctctttcaaggtgaagtccatatttattgtagcgtttatatttcttaaccatttgcatgtgtagaaatattccatcagttttattaggcttctatatttgtgtgtatttaattcaaattttgcatgttatgctccaatcctatttcccccacaaactcttgtgatttttatttccaattttgcatagtgagataaatttaaggaacatttatgtcatgtatagcagaactgattggacaatttcctgttgttatttatgtgatttttatgaagcttttctccacaatttaaaagtgtcctataatagagatgcaaatttatattaaaataatttttattccaataatatccacagattacccattttcagagttggtaataactggagagatgagaaattataatttatctgatgaaaaaaaaaatccaaagagaaaattcataggatcaatcattaacagctagataaaaagtaataacccatagtatatttttctgaaatggaggaagtacccctctattaaataatatataatattttcaaaaaactgcaagaattattttcttggaggtggactctgaaatatttttgaagctagaaaagattcctccataggaaaaagagtaaaaacaaaactcataattactaaattaaagacaaattgtaaccagagtgattgtccaaatattacactgtgagctgtgcagatatataactaattacagaaactgctatggatggatggtctaatccttgtttgggcactttttttgaggcagtcttcttgctaaaaatgtaaagactggtcactcaacaaaaggccccaggttgtttctcttaattaagtctaggagtaactcagggaaaaatgaacacgttcaagctgctgaaatatcagaatattttgctaatatatataagaataatgctagtcaatctataaccaatagaaatacagaataagctaataaaacaattgaggaagggtgtgggaaagatgccctcatgacattatgctctatttttctagaacacagccaatattataatcttagaaataatgatctttaatggaattttctagcatctaatttctatgacagatgtactatgggattttcataatgcttcaatgaaggcaggagacatttttttgaagtgctcataaactcagaataaactgcctttaatcgaacatagatttttgcttgcctttttctttcttgaaaaaaaaaaaaaaacagagacatataaaacagcaggtctgcaactttctcactgaggaaataaagggaaaaaacctgacagagcaaatccaaaccaattaagcaaaacagaaaccatttgaaagtcagtaaaagcatagctgaacatcaaatataggtctattattgatgtgaatcaattatgcaattctaattgtgagatttacattagtgtatcatgtcaattcttatatattaaatgtattttatttaaaatattacaaaaaattcatatttagatagtcctgaatattgaatttgcatttctatactatcatagttctttttctacaatctaaaattctcaaggattcaaaaagtacacaagattttaaattattaagaccaataattccatttactgaatatctacaaatcatagtatcgtataaatgagaaaaaaagcttttctttatttctgtggcatattgtaaaaggaacttgtagcacttgggaaaaaatacagaattttataagagatgctgaataacctttaggaaataaaggagatagcccttctttcatgcatatacatgataaaataagaaactataaaataaactacagaaaatttttgactatcagacatcacccatattttgtaggtacctactacaactgtaattagctttcttgcaactctgcaaatttgcaagtaagttgaattacctgggccctattattgaaatgaaggtctgccattgacgctgatagagcatcagtggtaaggtctcatgcaatggcacatgattgtgtaagaaaagcaatagccctactaagaaaactttgctaaattgttttgcagcatccaaagaaataaaatagagtggtaggatctttatcagagcccaggacttccgtgtgattaattagctgtggtttatttggatggtaaagataaaggcagagctgcaggtaaactttgcacattcatgcttctaaattcattaatactatgtgtgaattttcttttccatcactataacaaaactcatggtaaaagaaactttgcctcacaggatctccatttacagatatatattggcaccattctaccagatcaggattttaggtaagtcaatcaacataactaaaaatttgttgtttgctgttgctgttgttattgcttttgccagggaccactctagttttaataagatatttctcagaaagatggtgaggaccctggacctgaactcagaggttccatgaccatgtcaaagtactaccagtgaaaattaaaaaccttcttctcccattaaaacaaagctcccaaattaccacatatcaatatttatcagtgcagattagaagaatgaattctggtggctctggagccaagataactttctgggaacagatatcctcttatttaataattcaactataggaacgtctctttttgaaaatatcatataaataaaatgaacacaaaaatacatgaaaagtatagcataatgcaaaagtatatgtctcaaaacagaaaaatttggtttgcaaaaaatgtttttagctttttgctgatacatagagatagcaataatatagttatcactcaaaaatccttaagagctaggcatacagtgtacatagggtttggtactatccatcatttcaggcaactacaggggttcttggaacatagttcctgcagataaggaaggactgctatatgattatttccattctgcatctgatgaatctaagcacacattctatgaaatgtaccagaatataaaatattgtgtgtgcattcctaaacagctgattttattgattgatttatttgtaaactttgcagagagcattgctgctttctgtagatatttagttttccagaaatgagcctctagatacctatcttctccttttccagttatccataatcattgaggaaacccatcaataaacggaggataggacgaggtcttccctaaatgctaagggtctttccttctccccaagtgaagatggtacaaggtagctttgttttcaatctttaaatctcccaaaactctatcagtgatttcagtctctttctaccctgtcatgtagcaggaaaaattataccctggtgcatatccaagttcacaggccacattgagcttatttttcttttacaggcccttgcagtaagcagttccattataaacaatctgctttatcaaggctggccccaacaaatacagataaataataaaacatctcaagcttctagaatggaaaagatttataagcacggctggcgtggatgatgtaaagaagggttcaaaggctgtttgaaccataaactcaagaggaaaaatctgaatcatttagcaaaaagaagtgttacatgaggttttggtttttttttttttgtttcctcttctccttcttatgttttaagggaaagtttatttaacacaaagcacaagcatcccctttgttattggatatggttagagtcacagatatgcttttgatagatgaaagagaaatacttctggaaacaaaatattttatttgaaggaaaccttccaaaaacatgtcacatacttccgtgttaatgtgataagttgaatatgtaattgaaacttttttgattgtataaaaagcatcatttcccaaagtgcattctagaagcaggatgttaatggtgttttgggaaaaaaggtgttctgaggtcaaataaatttgggagatgctgatgtcaatttggatttgcttagaacaatgaatattcccatttagactggctaattgggtgggaaacgtaaacccatatgtcagggcgtgtattgaccccacaggcactaagaaattgaatgtcagtctttttcttctaatttcatggcaccactctgtcaccaactccttcctagaggttgaaatgttagaaaaggagaggaaaaaaagagagaatacaggaagagaggacaagctaagagctgacctactcaatcatgctgtttattttcccttatgcactaggagacatttctctcctgcattttgtgcaaaatcggccacctgttgctgcttctgctttccattggtggttctgcctctgctgttctctggcaatgcagcgaccctcagatacctttgttggttttcctgcagagattataaaatcacagagaggctattgttctgcacggataggaaagccagaagtacacgtaatggagaaagggagacagtagattgttttcagtaggaggtggcttacctgtgtttgctgcctttgttctgtttgtttccctatgtgctagtattagagaagggaataaatgtggaaaagagacaacccagatgaatttagtcacatcttaaaaaatattttgctctccaaatgtaagaaattcaaacaaaacagaccaattttttcaaccttcattaacagcaatttagtatcatataccattcagagaggatgttaggctctctccagttattcagtactttcatgattatttcaaatattggtatgacttttaattaaagtatgagtagaagactctacttacttctttccactcaaaaatactgcatatatagctaatttcacttgtatataattttaaggcattctaggtttttagatagcagtaatggtgataattagtaagagaaaattaagattccgaagacctgacaccgaaaaaaaaagcagtaagtcccaaaaggagggaagattcctggagtgcttgaataacatttggccatgcctcagtgaacttgaaagaaactcggtgaaatttaaaaagtacttatcagcaaccatagctctaacatgcttttctttaataaataatacttaacacttactgcttacatcacaattttcatcttcaatgtactttacaaacattaagtaatttttataatactcttgggaattaacaatgctatttctgcatttatatagagtcgctcatttgaagaatctgaaaggacttcacaaatattaaatataagccacattcaattttaaaaaagagaaataaaaacgaaactggacaggtcattggaaatagagtctatatactattggaattaagaatttctgatttctaaatttggttttgaccacataaaagcattcctttatggaggctgcttaaattcaacggtgtcttaaaaactgcttaaaaaattaatatacaaggacaatttcaatgtcaggccaccagacttctgcttttgtgtcatgtttctattcattcctgaacaaatatggctatgtcctcatttcctagctcaacaaaaggaagcagtggaactgctaatacagaaatccttccaaatgaacttcaaatgaatgcattatgctctttgcgtaaatttcactttcaaaattgtatgtttcaaaagataatattaaaattatttaatgaataacgaaggaggactctgtgattatcagtgaaaaatatgcccaggttgttttatttttcaatcaatatttgactaataaagaaattgctaaattactttggcctaatgttatttgtttaagttagcactcaatttttctttattctaagtaactctgcaaatcaatgttttggagatcttgcaaaaactaggtataattacactgttctgtatatgaatatgtaatacatatatatacatagacacataatatatgtaatgtaactaattacataaattattttatttaattatcacagcaaaagacctgtatcattatcactgttttacagatgaattaagtgaggcacagtgatgtgacttacctaactaaggcaatatatctagtgaatggtacagtcagaattcaaacccaaacagtctgtttcaggaggctggactcttgagcactgttcagaataagttgctctcatgaagctaaatagtatagtaaactagtaagattaacacgctaagcaggtcagttggtggatcacccagcacagagcaaagaaaggcaacctggttagtgtaaagaatttatgacttccattcaggagcccagtttggtgaattgcttgtatagtctactagacatgtgacgctgtgaaccatgtcaactttttgagttttaactctcttaacagtagtagcgcaggggtagagagaaagagattgaattatctttgaagacttcaagactttcaaagtcttgaaggaccctactgttttttgattgtttgtttatttgtttgtttgttttgaaacagggtttggtctgttgcccaggctggagtgcagtggtgtgatcatagatcactgtagccttgaattcctgggctcaagtgatcctctcacattagccccctgtgtagctgggactacaggcatgtgcaaccatgcccagctaatttttttttttttttttttgtagagacagggtatcactatgttgcccaggctggtcttaagttcctggtctcaagcgatcttccctccttggcctcccaaagtgctgggattacatgtgtgacccatcaagcccgcctgttttttagagatggagtcgtgctatgttgcccaggctggcctccaactcctgggctcaagcagtcctctcaccccagcccccaagtagctgagactacaggcacacttatcatttttaacaatatatattctcttctgcttctattattcacagctggaagaattttggtgaggtaaaataatagctgtcttatatagaatcaatcacaaatgtagcctaatataataatgcgccaaataattagtaatgtatgcagacgtgtccttaatttctttcctaaaagtccatgcatgagtgtgtgcgccaatacacacacacacacacacatacacacacaaacatattcatgcaaatatatgctatgtatgtatgtatagcttcttcttgtattatttatcataatggtaacgctggcagatgtttcctaggtttggaggacatgataatgaagaagacagtccttgccttcaaagagctcgcattccagttggggagcatgaggagataagctaattccaaaaaaagaaagagtgagaagctggggatattttagccagactgattaagggaggactagttgatattaataaggaaataatacaaaatctgctataagaacatcccaaggagaggaaacagctaatgtaggaggctggatatggcaagcaggttggatagtctaaacaattagacagcaagaaagtcagtgtcacacagggaaaagaatactacgtgatcagatcagaaaggacacagccaggcaagggacatcttagagatcagggagggcctcagaggtctttgtgtatttttgtgttgttatttttcaagtataattagaaactaccagagagtaacagggtacctatttttgctactcacagtatgtattagtatgttaaatactatttctttaacatttcttaactttcaaaagatttcttcaaatgactgagggtctctgttactctaaatgcacactgatattatatgaacaatcaaagcaatttgccaatcatttgctgcaaggatgcagaggaatctaggacctttgagaatgtaataaataattcttttatttggaactcactgaaaatttgacatttaaaaatgttttccttttattatttaaccatcttttattttcagtttgtgctttttttatagatacaacatgaaaatgatgttcctatacagaattctatcaatattaaggggtatagaaaagtttatttgaactatatatttattgtttctttttattattattctttattgaatttctgtgagattacagaattttcaatcaaagtactggtaggatttgatctactctctcttgaataatacaaacaccctattttttcactaagataaaatcaagataatttacaaacactttaattaaaccatgaatgttttattttatatacataaacatatattaatccattaagactccatcaccatttttgaatactgacagagtgaattccttagtcttgtaccatggagatggctattaatatagcgcatctccatatatgctaatggtctcctgaatatcctttgagagcatgaaactaactccatagattatactgggaatggacagatggacaacagacttgagctcatctctgctaatgtggggttctacagtgaaaactgcactggcagataaagacctgctcattgacctctttctcctttattcaccatggggtcttggaagttcactgtgggcctcagcaatcccacttataaagtggggatacttgcttgtctgacagcaagtaaataggcagctggagtgcattgccttttttttttttttttgagacggagtctcgctctgtcgcccaggctggagtgcagtggtgcgatctccgctcactgcaggatccgcccccctggcttcacgccattctcctgcctcagcctcccgagtagctgggactacaggggcctgccaccttgcctggctaattttttgtatttttagtagagacggggtttcaccgtgttagccaggatggtctcgatctcctgacctcgtgatccgcccgcctcaacctcccaaagtgctgggattacaggcgtgaggcaccgcgccgggcctgcattgccttttaaagcactttaggaacctgtatgattggccaaggggacaaagtaccgtaggtacaacacagtaaaacagtcctcagaactggaggagcaaatcaataactttcctccattgactccctgtattcagagctcttgggctagctctgaaagtcctatatctgcaggggattatcaccagtctgcaactccgcgattttgcttccattaaaaaaaattaactgaaataccatactgaaacagttttcaattatatttagaaatgtacagagaaacatatgaagagccacttttggtagatttattccaatggaagcttcattgcagggtttaataatgtctgagggaactaaactgacagctgtggaggcagagtcttgagtgcgtcatttcagaagggaaggagagcgcgaatccaattaaaaaaatgacaaagctgtcacctcacccaacttattttcattattagttgccttttgcttttctatttttgtaatggagagggcatagagacaattcatataacaaatatatatcaattttcaggggatgatttgtaaattaaattactaaggtttattttgtccttccctacttgcaactatacatcatttccattcttagtttttttctcctgaatttcatctgccctccaaccctttttttcctagatgaattaattagagaaatgaatcttttttttttcttttagataaattgcagtgaaaaggggagggaatgcagctgaatgcagtttaggtttctgttccgttcggattcagctggcatgttttccaattccgctcttgataacaacagtcctgtagaattggctttttaaaaatagtacaccctgtgatagaatcagtaacataaagtaaacaaattcagtaagataaggatactcttgtttatgttgctttataccagcgaatcaagcaacaaatcggtaaatatttattggtttggcaataatatgtctagtatgaaggaaagcatttagaggagaaagtacaagtaagttcttgacaattttgttgccgagaagcctcaagttactgcgaaacaaatgagtatgcaaaaaagcaataaatgaattttctgagcaatgtgagagaaatgtagatcgagtggagtcatcaagacacatttttgaagaggtggaagaagtaagtcttcagctgctcagtgaaacacaggtgttcagtgctggagcggaggagagggaaagcttgcgatgtgactccctgttattattaagatagcaccaccggaagttacttactaagaatatcacgtttctggaagataacaaagagcctgcaaaaaaaacaaaacaaaacaaacaaacaaaaaaaacaacgtgggggggtggagtggtttttataaaggtagattttataaagtacctagaataaaggaaggacacactttgtctcaagagagtgcctaaagagaccggcctcattcagaactcatctgttcttaagtaaccaacgattcaacaagttatttaatctgatttactatgatacaaataagtagcaaataagaagaggagagcatagcaagatgtagccagagagcaaactgaaggcaagctgtaaagacagagggaaaggctgtaggaaaaaaaaaatctacaaaatggaagacaagaattcaaaaatagttatctgactcgatccacggaaaatgagcattccatatggtgatagactctgagggactacttaatattacaatacaaattcttacatacagtaattgtgcaatactcagtaagctcataatgatgattatttagattacatttatatgacattctgggaaagaaagaaacttcagggcgaggaaacaagtaagtgtgaccagacaatgggagcaagggtagggattgacggaaagtagacatgagggtatattttggaggtgaggaaaatgttcaatgacaagcatctaatgaaagtggcagatcgcagatttaaatttaaacctgcctgatttcaggttcactggcacacaacagtaaatatcctacatcttgattgtgttggctacacaactatagtggttacacactgcgtttcaaaactcataaaactgtacactaaaatgggtgaattttactcaatataaatttctttaaaaaaatccgttcattttctgcgattatctggtttttcaataatggagcattaaatacgtctgttgattgtgcatgaccagtataccactgttttatcttggctatccatgcacaaggtggtctccacagcatttctctatcattccctatgcacagcttagtagactggcagaatcttaccattatctattcttaagtttctttctctgtttgacctaatcaggaattgactgcatacaaaaattattcatattcataatacttggagttatagaatcaagatgtgttcctctgtagcatgatcataatgttgtattttatctagatacatcttcttagatctgaatctattttgtctagtaaaaaattgaagagctagagattagaaatacatatatatgtattgttataaaattctatattcaattactattctagattcataggaaaatgaatatctgaattaaactccagagagatacgaaatccaaaaataatagcaggtcccatttattgagcactttatatgtatcacacattttgcttaactatttacatgttttaagcttcaaaacttcactgagacaagggccctgatttatagacaaggaaagttatattacaaaatgtaacaactagcccagtgtcacatagctagttaaagtgacagttctgaaaataaaagtcaggcctgcctaattttattatttatttatttttttatttatttgagacgaagtctcactctgtcacccaggctggagtgcagtggcgcaatctcggcttactgcaacctctttctcccaggttcaagcaattcccctgcctcagcctcccgagtagctgggattacaggtgcctgtcaccacgcccagctaacttttgtatttttagtagagacggggtttcaccatgttggccaggctggtctcaaactcgtgatctcaggcgatctgcctgccacggcttccaaagtgctgggattatgggcatgacccactgcgcccagcctgtgcctaattttagattcattaagacgcaatgataggaaataaatagtctaccgtaaggcagactgtaaagaatataataacagaggaaacctgtaggaaaggggatattctttcaggaagaagcggcttgggctggcaccataggatagacagaattttgacagattaataggaaagggctttcatcagtagagcaaacaatctctttcctgctgacactttccagctaatgtccagttgagaaaagcaacacttgtaacgtgctaacatgcatcgccaccattttctctcagctccactctgatagtctcaccctgatatgtcagggcggggctgagagaaaatggtggtgatgttagcatgtcacaagtattcaagttttgctaatgtgtgtgtctctgtgtgtgtgtgtgtgtgtgtgtgtgtgagagagagagagagagagagagagagagagagagaaagcctgatttgtggacactgtcttctgtgggaagaacaatgaagcatggttgtagccacacatgcaacatttgaaaagcgaaaacctcatcaccagaggcaacccatacgacccctctgggccttactttcctcatatgagaaagaagttcactaacaatacaatccactctgtctacctcttgggattattgtgaggatcaaattaatttaaatggatatgaaatcaattttaaattctagtgatggcacataatggatcgagttaaggaaagataagcaaaatgtctccaaatcctgggaaaagcagctttaactcagggtggagttgagagaaaatggtggcaagtgtaacatatggtggtgtgagaaagaacagagcaataacattttccacgtatgttcctttaataaattgaattacaactaccaagcctgcagaattttgacatgaaagtatatgctaatgtcattacacctgggaaatacatttttacacagaaaagctctaagtaatggatacactctctttcgagataaacattttatatcacttaatgattcattgtatttggatgctaaaattgttttcatgtgttttctggccagtttaacttgaaaacagaagtagttattaatctgttctaggtgccccttttctttggggactctaagtagactcttctaatgtcatggggccatttgatccaaggctacgccaggtaagaccccatatccattgccttccccttactccccacacatccccacatactgattatgcaaacttgctcctactgggaaaaaaaaaacaaattatatcaacaaaaaagacacttgaaatattgctactttgttctagacctggcaggacccagagggaacatccatacctggtaacaaaaagaaagaccactgttacctggcccttctcaaaacagcaaaccagttaagccctcaacttgatgaagtttttatctctggaattctatttatgtacatgcttggtacgcaaaagcaatgagagggccattgcctgtcatgaccaccaaaattccaggcctttcatgaaaccagcccctttaaaaataatcacggacacttatggattgaacacttaatttttaatatgagattcatcaatgaaaaataattctaaatttgttataatgaatattgacttcctgtaaggtgtatggtggtatgcagcatccacatctcacatagctaattttctcatgctcataaaataacaaaaatctttttctctcatgaaaaatgtttccccagaagaatgccaattcttcaagccattgacaggaatgaggaaaacataaagacatctaagaaagtggtggcagttcttagtcagaaaatagaagcttgtataaagagtggaatgtgaaattctgcaacgtttcaaacttgtaactgaacaaatctacatataaaccctgtacagaactcttctagtaaatctgccaactaagatatctgttagtgactttattaagaactttagtcttatatttattgaaacaataaagtcatttaagttttagtcttacattttattgtttgtatgggaaagttctaggttctagtagtgtttaaatattggagcatttgtcaaattttggtgacatgcatttcaagaaatcaaagttcttcagactgcagtggaaaatctggcccgtacccaagtttcttgttactgtcagcagggacgaacaatccctgaactattcaagatttatttacttatgtcaatttaattttagtcagcaactcaccaaggagaattctattttataagaatctctctgtttctatctatacatcatttccctttgagagaacagataacagatctgccctttccaccatgtcatcactgcatctaggcattataggtaattagcaggatgtaaattgtaaggtggtgcttcttcccccaacccccttgaagatgggatcttgctctgtcacctaggctagagtgcagtagcacaatcataggttcatagctcactgaggcctcaagctcctgggctcaagtgatcctcacatatcagcctcctgagtagctgggactaaaggtgcatgccagcacaccaggctaattaaaaattttttttctgtagagagtgtgtgtcactatgaaactccttgtctcaagcaatccttctggtgtggcttcccaaagtgtcagcattacaggcataagccactgcacctggccttggtggtacttcttacatcaaagatctaatggttttgaactgcactgtgaaaaactatttgagtggtatcattctttcagcttcctttctccgtcttatttctctgagaaatttatttcttcattatctattattagtaatgctgcttaaataagagtgacgtgtttccacaaactgcagtgcatggcatggagtaaactaaaaaagtcatccatttaatacatattttccaagttgcttatttgaaaaaggtaaattaaaatgtttacatagatatccttgtcatcatggcttaagtaatgtcttaaatcattcaagaaatatttattgaggtcctatcaatttccaggaattaaactaggtctggggcgaatgaagaccaggacaatcaccttttccctcataagcatgccccaaaagactaatgtagcataaagaacatatgtaaaagtgcctataattttgttagcacataaatcttcaataaatgttagtgattaaagtaaaggtattcatactgattccatacaatgtaaaaactacatttgtttcataaaaatatgaaaaatctatgacttacgtagcaattagttgagcatcactagtagagtgtttgtagcatttagaagtcactttaaatctcaacgtggaagtcttgttaatctgatcttgtcagtggcatctgaatcacattacacatctaaataaactgatctacagggaccttactcaaaatggcaggcaatgctgatttaaattaggtttgaagcccaccacagcagcttgaaacttttcctgcttacagcttagtaaagtgatattcatttccagaaaggaaacttcgacagaaacatataagaaaaagtagtctgtcatttctgaaatgttactgaaaaacctcaccaagtttatcccttcatctccaaatgcttcaaaatgtaaaatctcgatatcttaaccataagtcaatagtgatatagtaataaccctaatagttactatttggtaaagtagagaaattggaaattctcatcataaatatacattaaggaaataaaaacatatcctaacatttgctaaatttcaagttgtttaatcttttattagtaagaaagaatattgtcttactacttttgttttgtctgagatcagattgatgaaaagtaataaaattcttctacagacactgtattgtttcacgtcttagtcaaaacagaaagcaactatatttttcaagaaagaattcttttgataaacacctctctttagtgaaataataaacattataacaaatgagataaatgttaaattatcaatgtaactatttcagaaactgtatttgttttctatcttatactatatgtcttaaacactaaaatatctgacccaaaatttccgtttccaaaatcaacatgaccgtgatagctcttgaaacatggtcgtgtctgtaagtcagaaaagaatatgttaggtggaaagtaacaaaaagcaaccaaacaatttaaagataaccttttaaagcaaatatttatgactctatagacatagcatattggttaaaacaaagtggtaatgtatatggtacattattttaaatttgcttcaatgctgatacattttgcttccatatattaatttttcacacaaaagtatttttccctagtgaaaagtactcgttaacaagaaatgaatatggtgtaacaatttatttgaaatcctgcagtcaactctttgcatataactttctgataaaaaaaaaatcccacatacttcattttccctaaagagcagcatgagatttccaatcctttgcttgaacacataaaatattaagagccaattttcagctgcacctctgtcacttccattatcattctacacgtccagaggtgataatggactctgtaaattgcagtctttctccaccccagaccacggagggtttcaccaggggacagttccacacaaagggtggcccagatgtatgttaatggcactgagaagcgaacagcagacactaccatacaagataatgtgacgtgttatccagaggaaagatgaaatgagcagaaaacaatttccttagaaattctgtaaaatcaacaaggacccattcttctccacaaatcaaataggtagcactatcttcacagaactttggaaacaagattaaaatacattcctaatgcctcgtctatgaaggaattgtttgttcaagccaacagagaatgaaggcacatgagcattgaggtttaaagaattataggggaggcttttgtttaccatttgcttttttcagacatacaacacagatctaccagcattcattatcttcaaacatgaagtgaaagaaagagggtaaggtaaaagaaagtgcttatcttatccattgctgaaatgatactcactactctttgttgtgggcaatctgcccattaaaaggaagctgtcttataggaaattgaatgtggttgacactgggttttcatatgatcatatttcctactattccatgcaaaataatcagattttacggaaaatatacaggaaggaagggatttgaaactagtttttctcccttttccataggccgtcatctaactagttatctcactctaacactgggtgagtgttcattgactgaacctaccagactaagcaccaatgctttgggcaaggtgctgggggtgggttgagagacaagtgttgtgcaagaggaaagaaagcctagtgaaagaaaacagacagatcaaaatcagattgcattacccagataattaaacatagctctttaccaattagataataatacatgacacataatcattgcttatatgctaataaagccaaatgttggataagacaaggtaaggtcaattttaatacaataagtatattctggagccaattccatagtcttcaaactaatttcaggaaaatcagacatcgggaggaaaagaagaagaaaaagaaaaaagagaaaaggaagaaaaaaaagaaagaaaaaacaaaaaagaaacagaacccagtaaaatcatttcttcatttattcatctagggtcaaaacatcactaatgagctccacctcttctcttcctgttccccttcatttccttcagcaaacaccaaggactgaagcatataaaggcattgtgctaagcattacagtttgaaaaaaagcccaccagtgattactgtcttgaagagaatacagacaaataagcagatcattacagtagagggtgatacttgttctgggagagagatcagaaggctgcttatggtgagactttaccatcttgtcagagtttccaggaattattactaggatttcacatcctagtcctccatgtctcattcctcaagaaaaatgaggcatacaatcaatgcataagcagaatttgtaatttgtacatatttaaaattaaaacgattgaaatccagaataggcaaatccatagagacagaaagcacattggtggttgccagaagaagggaagagggagaagtatggagttactacttaaagggtagaggatgttctgcggggttaaaaagtttcaaaactagatggggtggtagttgcacaatattgtgagtgcacaaaaaaaccactcaatttcaccctttaaaatggttattatgtgttacgcgaatttcacctcaattaaaagaacaactgacactcttcatttgatactttgtggcagtttgaaataggcattctgacatgtcgcaaaaatttagagtcaatcagactcttcactctgattttctgtttcttattctccatatgcagaaaaaggtggaagaattttctgcatggagaatatgcagaatatttgagaaagaaaaatcagcaagaaacttttgatttaactagatacctagagcaagtttaatgtctttgagatagtttttaaagttcagaagattgtaatagtatagtagcatagcaggaggtactgtgattacatatgagtattctccaaaacgttattttctatgaatttttaatgatgcaagcaatttttcaaggtcactgagagagcaatcagtcattcagacagtaaatttgttcacagtttcttggcagctttgcaagaaaacaagcaagtgggatttgtggaggaggggaaatgatacactgaggaagaggtagattaggagtactataaaattagctacaggtatacttgattcactctttaacctaccaggttcttcactaagtgttctagaaggtagaatgagactttatgactcaatgattttctggttgtcattgtggttaatagcataaactgttgacacctataaaactcattttctaatgatttgatcatatcagtatccaaagatcgctgaacatttctaatttaaatttaaatttaaaaattaagttagattataaaaattaagtgcatgggaaagacattaagaggtatatatttatcaatatttacagcccagaatgagttatttctcaaaaacttgaaaataataagaaattatactgctctcttaatgttacattataagactgaaacagaatggaacaagagagaaatgtgaaaaatgtatagagtacatgtattaaaaatagtgtcccaatccctgggaaggcagaagagtattaatcatccatgagatcatattgaaagagtcatcacagaggtcaatattcaaagtatctttcaaacattgtagaaaagtatgaggtttgggcaataaacttcaggaattctttcccattggcaaagtgatgtctaagctggagatagaggtaaggggttatgttgttccctccccattaacaaaacctcgattgcatttggtgtccatctgtaatggcccaaaaccattaagcatgcaatttaggccaagtgtggtggaacacacatagaatcccaacactttgggaggttgaggcaggagcattgcttgcatgagtttgagaccagcctgggcaaagtagcaagactccatctctacaaaaaattaaaccacttgagaggttaggctggaggattgcttgagtccaggagtttgaggtggctgcagtgagttataattgcaccactgaactccagcctgggagacagggcaagactctgtctcaaataaataaataaatatataaataaagtggcttatctaattatccttattctgattctgagcaacctttattacttatttttccatgtgcatctgcatacagagagaaaatgctttcatcatacagaccttgatattcttgtccttgagatattagttcaagttattaataacttgacgttctacataatttgacttctcatgtatttagactacatccaccatgtccataggagtattccactcaggtaacaagtatgtttttcattttaaattgcaattttggtttgatacatcagtattcctatgaaatgagattaaatttaccagtgtctgaaaccacaagtttgaaagccagctggatagatggtagttgatatgccaaagaaatgactgctacccggtgaggcctgtgagtgacatctagggactttgttccatgtgaaaaacacacagctcattatattgctgagtggctgcatgtaaaggtactcccctcaattgtatctttcgtgtgtataatggtaataattataaggcaatgaaagccttaatatggaggaacacaccaccgactaagaaagtaaaataaaaaaatgaaaagagaaaatgtgttcaagtaaaataaaattacagtataagttgatttcatatttaaatcctctaggtataaggaaagtatacaagttggctattaagactgcaggaaagtcagttgtgggaatggggaattcattgagttaaaggaacttaatcatagtggtgatggaaatagactaacttgctttggtaaactcaactgtaataattctgtacattttcactgactgtgtcattagaaccttcttaattctggagtgcaagagattaatttggttctagtgttcaatataaatcctgaaaatgaagtgaatggctgcctttacacttgattttcagataacagatattgtttaatttaaaagaagaaaattcctgaagccagacatattaaggaaataacaaaaattcaaggacgtaaccaaaatttggacattggaaatgtctgggaagttgaagaaggtgaagttatgtaccaatgtgtaaaaatgaaagtttttctttttaaaaatataattagatattccatacttcatgcatagaacacattcattgatgagacttatacaaatactattaaaagattcagttccctatgcaaatatgaggttgagatttatttgtttagaaaattaaaagcaaattagaacattttctatgactataattattttcactgaagaaatgactgacttttaatattttaagtaacatgggcaataagatgttaatactatgttcatttctaagttcaatgttcccagaaaattctgtgcatttgcagaacttattagatactcttaagtgaatcaactgacataatgtttcaatgaccaagttaaaagctaatcagaaatttcccacaatacctttacctatatgtttacacacattaatattttatgtcaatataatatgttattcaatgttgttttctgaattcatttcaatttgaattgagaaacattagcaatatccctatttcctgttattttccttttttcaaacctgttatatgtactgattgcaaacaaatatactttaaaaaatgaagaagggaaccatttttcatatagggtacagatttgtctagggtgttttacaccatattaaaagcatgtttcttgaaaaaaagaaaacaaacatgaacattaaccccttccctatcttctctatccatctgccaaattttgctttcaaagaattgtggtaacaatatcaaatatttctaccacctttgtcacttttcatctgtctgggaaaagcacaagagattctactctcaggaaccaacaaaacaagagcacacggctgaacggcttctggtctacactcacgtttcccatttgcccgcatttaatgctgttaatatttcagcagctggagtaccagggtcaaactgaagtttttaactatttaattctgaatcctcagtcacagatcttggagagagagaaagagagagagagggagaagtgacagagattgagataaaggtagacacagaaatagaaaaagaaatagaaagactgatggtctttttaaggacttacagcaagaaaacagcgaattctgctttacaacacaagaaactgaattctgtctacaaccacaacgaaagcatgtggacaaggatctgaacgtcggatgagatggcagccccagctaacaacttaattttagcctgaggagattggacagagaactctgctaacccattctgttctatagaactctgagaaatgtgaacagctttttgtgtggtgctaacctaggagaatctatccttagaaaagagtccacaatttccaatctaagatcagtttgtgtagtgtgtgtgtacatttcctccgtcacttaaattttttattacataatttcaatgcaagtttacaaggaaatgaggctccaagctgctcattattaatatagggccagaatatttttaggcgtttagaagtttcaaatgaaccaaaatggagctcagcattggaaagagtgagtctgtcccattgtagtatgatatttttacttctgttttgactagaaaataggggtaactgagataaaaacagggtttggaagaggtctgtatcatatctattaatagaattttgctgaatatgattgttctgtcaagtaaaaaaattgttgaaaaatacatacagtagaattttctgcttttcccgttagatatctctttcttttttcatggagctgacaaatatatagtttcagtttgtcttttccatctcttttttctttcaaaaattttaaaatttgtttttcatttctttcctttgaaccacaaaaattgatagccttccttaccagagctaattgaagaatggaaaagacttcagtgagacctcttctaaggtctttcaagattaaaactcattttcagggtagtttgattattaaaatatattttctctgtcacacaggtaataggtacttatgaaattttggtgtaaaggaataaatgaatgataataattatattgtaattgagtacttcctatagctttgcatatgcctactcttttaatccccataatgatccaatgagtaagtgctgttattactattatttaatagaatattgaacttcatagtaatcccatattttaaatggtatgatgggaatttatatatatcactttaacttaccccaagccttatcccttaacatataaataaatgaagtatagaattataatttattggtgattgctctaaaaagatttctagttactcttatcttgaaattctgaactaggtatatgtggatattactagtatcttttgatttacacccctgttatccttttaggaattttcctgggttatttgtccactacatctatttttagaaagaacataaagttacaaggaactctgaatcccactgtatattttctttgattagaggcaaaagtactacagtggttccaaatataagcaactcttaaatttcttttcaaattgctcatcgcttcctatgtggagcatagtcaagtacatctggaattcaagtattttcatatggcattgtgattgttactcttaatgttccttcctctaagaactttcttttgtacctcaagagtttaaaaaaatcaaaatatacaaagtcattcagtagactgactattattccagtagtcagtgtattaaaagtctctaaaggcccattaaggtatcagactagactggctccagacctgccattgtctattttggttcaataatgattatacacatgtaattgactgagactatatcagactcataagtcacattgtagatggaaaaaatgcaatcaatgtatacaatagactataattacaagccaattcaatgcagtggatttgataaacttttttgtaagttataaatatttgaacaatggggcaaaagactgttttatcaaggacaacatagttagaggaagagcagttagtataggttccaacttcttcaaaacagggagacttgaatgtcattctaaaggtggttcaccacatgatcccagaatggcctaaaagaatttccctaaaaggctctcattatagaatagcactcatttattatgataatatcattaccataagtttgaaacaagtattcttcataattttataaatatatagcatatttgtcactcactcatggattaagaatgtgcatgaaatataattcctataacattaagcacttatgcattattttaaatggcaacagattattattgataatagcgagaatcaaaatatactgacaggtacttaattcagattccagttatttcttgtggaaataaatttttctttgaatcaaatagaagaaaacagcacttttaaaaaggagtaggagtcacaagttaccagcaagtacctccactgggattgtctgtgggtaactgcattttatgctcttgttggtggatggaactgtccatgtggtgttttttttttttttggtgtttttcgtatttctttataacttgaattttcaagaagtctatccatgtatatgtatgaattcataatactaaattttaaatagccattctaataataacttttctctaagcaataacttaaatagttagcaacatgcttatcttccttttgtccaacacagtgatgtggtttggctgtgtccacaccgaaaagtcatcttgaattgtagctcccataattcttacatgctgtgggatggacctgctgggagataactgaatactgggggcggtttcccccatactgttctcatggtagtgaataagtcccacgagatctgacggttttatcaggggaaacccctttcacttggctctcattctctcttgcctgccaccatgtaagtcatgccttttgtcttctgccacgattgtgaggcgtccctagccatgtggaactgtaagtccattaaacgtctttttcttcataaattacccagtctcaggtatgtctttatcagcaatgtgaaaacagactaatacacacagtgtcaactgtttatgaaccttaattatgtctacaaaatcccttttgacaaacaatgtaacataaccatgggagtgatacttcatcacattcctgggtccacccactattactgggataggattacacagagtttgtatatcaggaggaagccatcatgtggtccatcctagagttctaactgccacataggtatatgaaagatgcttattattcacaaaaattataaatagcatactttctatgtaggcacaatggatggtttaaaatattttctgatattttggcatattaaattctacaaacattttattattgtagaacatgttcataaatcataattttaaattattgacaatgatagttattctgcttagttaagtactctgaagatataaatagatcatttactttttcagaaagacttgaagggaagacttcttaatgcaaagtatctttttcctccaaggatagtgcaaggcatgcaatgtataataattcacttaatgtttgattgattcttcccatgaagttaagatgtgatacagtccttttccaacatgaagcacaaggcaagagcaagttgaatagatgacaaaggagagaaatcaaaaaaagaagatgttatgctctgttactaaaatactgtattgtgaacatattgtaatcaaatataattagaaaaatattcccaaagtaaaattataaattattgttggcttgtctaaaatacaattacaatccaaacaagagaatcaagtatttacactaatctaaataccatttcaattttaccttacaaatatctcaagctgattaatagaattaactgttaacaaagacacattttcctatattttctggccatttgaattgtttctgttacattatccttagtctttttctatgaaaataacaacaatgacaaccctgggcttggggctttaatttggcaagcccaccggcagcatgctgttgcactgctcaaactctgtgttttctaatccagcaccaaccgaacctggtagcaagcaggaagtcaatcagaggtgatgcgtggcgatgatagtgaccatgcttgcaaagctgctggtaaagtcagattgctttccctgctaacccaagatattctttcatatgtggaaatttacccaaataaaatgaaacatgtatttgcctgttttgattttctttttttatcttgtggttatatgattggcagttggaactatttattgactttttatctttttagtgattcccacaatcctttcctcaatcaagttgatagagccttgggtttttttttaggtgagtgaatagagaaaaggctatatgctgaaataccataaaatataaccgcgttcaagaaaatccattgctgttttttaaccattaccgcatgggcaaaacatttcctcaatgctcactttccccccctttctctttctaaatatcttctgtttgacatatgtatgtgtacacatattataccaaagtagatatacagtaaatagttataaatgtagacaacaaaaaaatgggacattcaaactagtcacaggacaagagcacaatgtacattaggaatttatactaacaaattcaagaaatacttactgagtggtaaacttgtttcaggtgctatattagatattacgggtaaaaattataaataagatccatcctctgctcataaaggaccttatcagcctaaaatcactctagtgcagaatatagtcaagttaaccctgactataaaaatgaaaatttcaggagaaatgcctagttctagggtaacttcttgtaatatggcaacatacaggaggtaattcggttttaagggaaagtcagataaagctttctgaatgaaataagacttaactgctgtaatgttttagacatttcctaaaaataaaatatagaaactacaaccatcactagcatgtgtcctgggtttatgtagcaaatttaaaaacaacatatgcagattactttcttccagtgtattcaaataactaacaaatggccctattcttgttgatattcaagacagaatactaagtgtactagtatttgattctctagatcctttgattaaggtagacaggcagatcacatagtgcaaagtcaccacaaacagtgaacagttaggggtcatgagggggtgatggccttgaggctgctctgctagtcttcaaatctttgagggtgacagtgtctttgatctgtctgccttttaaacaaggaaacctggaaatatctcaaatgaccatttgatctgtttctggtggggaaggtagtcttccagctgccgccctcaaacatgctgtgctctctccactaactaaacaccgggctttcatgttggagaaaaaccaggcttctagccacatagagcactaaagaaagggctgatgaatatggccagtgattggagtgtcagccaggctgcagtgcctaactgtgacctacacccgcagacgggtggctgcggggactgcagagccgctgaatatgtggacacatccctaacagggagaacaagaaggctctgccgctaagaggaagggcgttcaggaagaagtcgtggtaagagcagtctcagcttaggaagatgccaggctctcctgatttaaagggtaagaagcccaaccatgccatgaatggtgaacactgaacgaagcacaagcagagactgaggctcagagtccaaaccatgaggcagaaaatgaacccatcctaatggaaagcagagcacagagcagatggccagaggaggaaacgtgggggtttcaggtctgaaacatcttcctagtaaaaatctatgagtaacctgctttagttaacatgacttgtgagacaaaagagaaaaaagaagaaaagagaaggtatcaaaatagtagggtattttaattttcagattattgtaaatgtaaatctcagaacactgcaaatctcagcatatgacttttagcaacatttatatccatttaaccatcaattcatttattcaatagaactgttgactccttattttcaacctactgtattgggtactccatatacaaagatgaataagaaacaggtcttgccccctaggaacagtctagagagggcaaaagatatgtgaacacaaagaggtttctgtccttagtatttttaaactctccaactattattaagtcaccagtattcaccttaaataatgaagcattttaataaaataactgcgtatctttactgtaaaccagtcttctcaggaagtgcaaaatgaaatacaacggtataaatacttttgcgtaagctgaaagaatgacataaggaacaatattattcacaaggtaccatttctattacgtaacagaaaggtgctggatatgtagatggagggaaacatctcattttcttgatccaataaaatcgatttggaaactattgatactgaaccacaccacaagactcactcaaaagctctgtattgttttacttttaaaggaaaaatatttggtgaaggctaagttggcatgctgggaggagttggaacaagagcatcattggcaggctgcataataatgaattggttcctacagaaatgaaattgctactgctgtttttgccatctacaattaaaaatgacaagtattgagaacagcgtcattaagaagagtctgattagagaagtttccaagctttaggaattgttattggatggtatcctggttggtatacgaaaggctttttttaagtcagaaaagtaggagcatctaaaatagagctattttaaattccttaacttaagaacataatcacagggatttatgcattatcaacaagaatgcataattaaatagaggataacattttaccgatgataatttccgaacatcatagattgcttaattataaataatttcatatctatttgtaaccaaaatggcttttgagaattatttgtatgatttttgtaaacaaatcactgtcttattttcttatcatgagcatgaaaaaagtttctaataggcttttgtttcaacctgagggtgtattcccacctatacctcatgtaagttttgaaactttatgaaaaatcataattctttcccattttcagaacttagaacatttactagtttttagaacggtattaggtgctacattttcactttgggctaaataagtgaacctgaagatcaaatgttcaaataaaatacgacaagtgggtgttaaataatgaaaaagatattcttgtggagcttttcacagagagatgatccaggctgaacgtgtgtccccagtgatggtgagaaccgtgggactgctgcctaacatctgcagggtgtcataaaaagcctcactaaggcgcatcgttccaaatgaataccgtatgggtcacttgcaggctatgttaagtaaacaataaaaaatttaaaacaaacagccacaaagacagaggaatgctgaggaagggaagcagatgagttattttgaagagactcctaacatgactaatccctgccaggggatagcctctcaaggtatattgcagccagtccctcccatctctaaagtaggaacaaaagaagtgcaatcatcaaaaccatcgtgttgacatacttgaagtggaaaattatccaaattatctaatgttgtaaggggaggttagaatatgtagtctctaaagtcactttgaacttgacaagtatttgaatcattgtgttatgctacaatatcgtgtagggttcacaaaatgtcctagctcctctggaggtgtttcttttcttccatgtaggaagaaagccaaatagtctttctcccagtgccatcctttctgaacagatttggtggttctttaaggtagatttgcccatcattttgggtaacatatggggtgcgtaaaaatgaatagagaatattcagtagcttattttaggatctacagcaatttgtatcctagaaattagaaaagctaatgatgacaaaatacacagatggatccaaagcagtcaggttaaaaaaaagtttggatttgcacatgctatttcatttctaatttcaggactggtattacaaacaagcaatttccccagtgacctttctcctttctgcactcctgcccgggccttggaacatgttttctatcttcaccaatattcagagcttttctttgccatactttgactgtagagattttctgcccattatcttaccctatgctttccaaggtatatagcgacaagctagtcaagtaaacctggtcattctgatgagcctgtatactggcaacagcaataagtatgtgtttcaatcatatgtttttaatgctgaagtcttcagcccagagaaaaaggagagggattttgaagatctccaagtaagtatgacaatgtataattgtctaagcaaaatccctgcaaatgacaaggttctgacatccttagcttagtgaaaattttaattaattcatttaataaacattcatagagtacctactcatagagtcacacaatgtcatagtttggggatactgccttacccaaaataggcaaaaatcctggccgttgcggagcttaaaatctagtgaaggtaacagacaataaacaagacttctaaaagcagataatcaacatatatgaaactacatataaacttcacatacatttggacagtaattaagagataaattatgatgcttgtaactttttaaatcaatctttaattaaaggaataaataccctcaattccattttcccctgtttaacattattagaagcagagcaagaggagcaaatgttggtagtaaaactccaagtgtttagaaaacatatcccagcatttgaagacattaattaattaattaatgctatagttgttcagtaccagctactatctgccaggttctatgcttgagttgagctatggacatagggtgaatacgagaaaaaaaaaatcccaggcctcaaaggagatactcattgttttacttttaaaagccattcataaatcacattatagtgttattgaagtgaccagagatattttctttcttaagaaagatggtgattttaaggtgtgtccatatttctttgatacgacgtcatttagccattcaagaggtggagtctaacttcattcccattgggtgtggcctggatctagtgactcactactaatggtgtgcagctttagagagtgggtaataaagggtactgtggcttcctgcttgcaccttgctctgtgttagatcatttgctccatggaagccagctgtcatgtaatgatgacactcgagccatgatgagaaactgaggcctcctgccaacagccacaggactgacacaacttgggagcagatcctccagccctggtcaagctttcagatggctctggcccctgctgacaggttaactgctctctaatgagagattctgagctagagccaactatctaagctactcctagattccccaccctcagaaccagtgttgaaatgaccaatgtttttgttttaagctgctaaatgttggggtaatttgttacgcagcaatagataatgaatgcaatcactttttttggaagatagagaaggaatagaacaacaggaaatgcaatcagtgtgtgtgtgcagagggagagagagaaacatataaagatcaacccacagataaaaacagagagagagaatggggctgggagaagcaggcacaacccttgcagcatgcatatattttcttttcacattatcactggaagttacaatcatcattatgtggcaacattttctgtagttaatgaaaattactacatggattccaaagataagaaataagagcgtgaaattatttgaaaggtaaatgatgccctgtgtctgcatagtcactgcataaaagtattgattccaggaaagtctcttaggaagggtcaatacagttagcccttgaacaatgctgggcttagggggcaccaacccttcacatagccaaaaatctgagaataaattttcattctccaaatcttaactactaatagcctactggtgactggaagccttaccaataacataaacagtcaattaacacatatattgtatgttatatatactttatactgtatttttacaataaggaaagctagagaaaagaaaatattattaagagcatcataaggaagagaaaatatctttactactcattaataggtagtggatcatcataaaggtcttcattctcattttcttcatgtggctgaggagcaggaggatgaggaggggttggtcttgtagtctctcaagggtggtggcagaggtggaggaagtgaaagggaggcaggagaggaaggcatacttggcggactttactgaaatacatcataatatctgttttttgggttttttttttttttgttttttcatttctttaaaacttttgtataaagtaccaatcttccttccaccatttgctttagtttcatatcacataaagatccatgttgtaaaagaagtgaaaagcagccttgaataatcagaacccttctgctagattgtctaatatcaacttattttctggtactgcttcttctctgtctttttttattatctggcactggtttggaagtgctcatctccatcaagtcctcttctgttagtttctctggcatggtggctattagctattgaatttctccaagatctatatcttgaaatgctttaccctccatcttttttgctatatccataatatctttcatcatttccttgattagctctgtcataaattccgtgaagtcatgtacaacatctgggcacagttttctccagcaggaatttactgtttgaggcttgatggctctcaggattttttctataacaatgatggcatattcaatggtgtaattcttccaaacctttataatgttctctctatggaggttctcttccatatcattgacaatctttaccatagaggactatgtttaatgagccttaaaggtcttaatgacacctgatctagagactgaattacagatgttgtgtttgggggcaagttgaccactttgacaccttcggtgttgaacttatggggttctgggtggccagcaacattgttcaataaaaaaagaactttaaaaggcagtccctttttggcaaggtacttcctgactttagggacaaagcatcagtgaaaccaattcacaaaaggggttctctttgctcaggcattattgtttacaaacaaaagactgtcagctgatgtttttctttttccttcaaggatcaggggttaactgctttatagataagggcagttccagtcataaccctgactgcatttgcgtgaaaaactggagttagcctattcctccctcccttaattgctggagctcacttctcttccttaccagtaaatttcttttgcggcatttcttcgttcccagactaggtcacttttgcctgcattaaaaacttgttcaggcagatattgtttcttctcaatgattttcttaatggagtctggacactgttgccacctggtcaactgaagctgcttctcctgttatcttgacatttaaaatctttctaaaattatcgaaccatcctttgctggtattaaattcttcagcttcagatctttcaccttccttttggtttaggttgtcatacaatgtcttcatttttttctcaaatcatatgtgagtcaaaagtatgcctttcttataataaccctgcacccacataaaggctgcattttcagtacaagataaaaatgtattttgcaaaaagtacaaggttttcatgcctgctagcataactgcagtgacggtttcacatatttcctttctttttttttacaatcgtccttaaactgtattcatttatcttgaaatgatgggaaattgcagctgcaggcctcaagctatggtatatatcatgcaagtcaactattccttgtaatgtcatgactttttttctgcttcttgggagcactttcagcattactagtggcacttcatgtaggtcccatggtgttaatcaaagtttactgtattgcactaaacaagaaaataaacatgtgggaacccagagacatcacttttaccgtggtacacaatttactggagagacaaattgctcatgcagatataaatagcatcaaagagtgtttttagtggatcttttaacactggagctcactgcaatagcaacaggaggtggctacaccattattacagtatgtactaaggtgaattttatgcagctattatttaatactgcatctttatgttcgtttacatttctttggattgcaaatagtactatgcacagactgtatttgtgcacataagttttgatatattttatgtttttcgaatgggtttgtgtatattttatgatagtaaatgataaaatagactagtatgtatgtatactttttacattcattacatacctaactttatcttaattttttctacatttctaggctactcgagttcacctgcaatgttttccaaattgctacaatctccaaaaatgtttttccatatatttattttttaaaaatccaagtataagttaacccacttagttcaaacgcatgttgttcaagggtcaaatgtattttaaaaagaagaataaatgaacaaattaacatggttctgttgatcagtttaccttgggttacctggtcgacagagaatggacggcaccatgagtatacaacatctgggaaggagatagggactgtgcctgtgaatgagatatagccttggaaggggcagcccaccttgagtagctctagtgttgggggagaggggcaggtagtggacaataaagggcagagtgaagagtcagaaaaaaatagcagtatgtgatggcaataaacttaagcgtgaacaaagtgcacactcaaaaggctattgcaaaatgcttttgaaataagtcagatgcacatcaaagtttatacttaacaagcatttataactagaggaggaaaagaagcaacattttgatttgataaatatttttaaacgataaagaaaagccatttctcacgagcctgaattactctcgtggtctatttgcttagctaagcagaaattactaattattcattttaatttgtaagggtttccttgataaaaacaaaaaagaagtatgaaatatttaatttttcaacaagattaatggtactgaaaaagttctagccatcatgagtgtcaggatatacttttgaagttttttatccttatgaaagaaaaaaaaatccaaggatggaaatcactatccaagtaaaatgagcctaaattaggaaatttggaaatatccttcatgcaacttcttaaatttaaatataggaagactggctggaacttaaaattccttatttctatgagggcggggtgggggtggtaagccgttactgagaaggctggaattaaaagtagaaaaaatgattttccttggaaatggtgatttttgtttgaaattggatgaataaaaataacctaaatatattacgctaaaagcataacaatgtgtggataagttttcatggattatatacttcatgtaagtgtaccaacatgtaatttacaagacctttgaatgtactaggaatagaaagatgacaccactcaaaaaggtcattagaaattacgcagtgtttaaataaagggatttcctgggtaaaagaatatcacagcagagaaaattagccactgaacacagcatttcagagataaacaagaaagcattcctgggaacctgcagtttacatgagtacttggacccccctgacatgcagtttaccacaccctgacccaagactcactgcctgtcaacatggccctcaaattcattgatatcatgacatcttattggaagagtaatttttttcttaacacagtttgcttttctatatttttacgtcaaatttcctttcatgcataggcatataggcacatacataactttaacagttttgaggggatgcccctgttaatttctttatgaatcttaacagcacgtgatgtaaggatgagttccataaacgcactgtcaaaaaactttacgcctgtatgcattttgtctttttttttttaagtctgatttcttttctctttttaaattccaaatagccttaaaacatagagtaagaccagctaggttagaggtattttaggcctcaagtgtctctgttaagtctgaaaataagtctagctgtgcagaaagaatcacattaagaggatgttttctgtttattttgtaagaataagggcgtgaacttttatttacaggcttattcaaaatttccaatgcccttgaaattcaaaaggatagatgtgtgttaaaatacccagtgaagaaatatcaaacaagatattaaagagacaaactagaaaatatttcataacttccatttgatggctttgctgtattaatctgtattattttaaaaaataagttttccattttaaagtattttaattaatttgcagaagtgtaaattaaattcttctcatgaaggagaagcctttcatttcacatttccatcatgagttttaaattaaagtgtccaaaatattcttatatgagatagattcaaaggtatttaattgatatgccctttttgccactatctcccaggtatgaggatcatgagggggagaggaatactcatctttcaactacataacttttaattcattaatgcaatgcaaagttgtgttttttaagtaatagttttgtctcattctttttcatgtatttaaatatcatctgtctttaaagtgagcacatgaaaaccgaggtaaaaaatgaatggttcattttatcctttgcagcctcatttcactgaagcctgttccctgtgctgagccccatggtacacatataaattcacctttcaatcatttgtgtgggttaatgacactgagtaatagcacattagcaaagtgccattccagacaccagccaggcatgccaaacagataatctgacaatcgtttcagattcattttcctcaaacagaaacactgttcaggcttattaactggcaaatttgcataaggcacaatgtagagcacagagcctccattaaaagtagcaatctgtctcattaatgtaatttacaaggatatttggcccgttctattgttgtaaaatctaaaaaaaaaaaaatgtgttcctgttcaacaaagctgtcgtttatttgtagcaaatttttatcatatcccttatgctccactgaaataaaaagatcacaaattagttaataatgaaactgttactcaaatatcttataccttgctcccaacagtacagggcatttggaatttaactcctaatgtgttcctcaaaatctaacctcatgatacactcacccaagggtaattcatgccaactcttcttttgtgttttgactttctactcaaaagtttcattacaacttcctcttggaatgtgtgattagggacaattatactgaaaatatctgcaacctgattttaatcaattgcttagattttgattacaaaaccaaagatacaatagcttaagatttctgccatatcttcatccatggtaacctggggtcctgttttatttttacatctgtgaatggaaagcttaagttcccactttgtagttaagcaatctgttctctttttgtctcttgagagcttgctgcttctttgtattttatgaacaatgtgttgtatccttttctcttttttgctgagaaatttgcctgcatttatctttagactttgtgataagagcaaattccacttaaaattgatctgtcctttacaatggttaaattttctttcatgttgtcctgatacaggtataatccatggtaaattgaagtgtgttattcttaagtatcttatttgcaaaaagcctatcataagatgaagttttattagagatggtcacacacaggcagattttcagtcagtgacctatgtggaatttagtcaagaaacattaagatctccactcctctgtgccatgttccaagtctaacaccacttgcactaaaaacttctacagaggggagatggtagctataaatgacttaattatgagagaccagcacagtttcagaaggatggaattttggaagagaagtgtttgttaggataatagtttccacctgatttcaaggtccaaatccctgagatagatcacagggccttctaacattggtaagctataatcacaaaacatgtttttcttcagccttcaattttctctgtgtggagacagtgatatttcatataatcaaattccttgcttatatcacctaaactttcaatgataaattcttccttcaatgattctatacttgatattttcctttcattcagaaagcattagtattattttttcccattttgtctatattgcacaaaaatgtgattgcatttctcagagccaatttgccttctgtgactgtcccactgccacaaagttgagatggaatcaaaccaggcttgagacatacacacacacgtgtgtgagttttattatacattgtcatacatgtaatttttcttattttttgagatgaagtctcactctgtcacacaggctggagtacagtggtgcaatctctgctcactgcaacctccacctcctgggttcaagcgattctcctgcctcagcctcccaagtagctaggattacaggcgcctgccagcacccctgtctaattttgtatttttagtagagatggggtttcaccatattgtccaggctggtctcgaactcctgacctcaggtgatctacgcctcggcctcccaaagtgctaggattacaggtgtgagccactgtgcctcgcctatggtacatataattttaaaagacactgactaacttgttaaaaactaatacctttgggaccagataatgtggaaacagaaatacaattatatgcaaacaaagaataaaataaacataacggagaataataaaaacttagacatgcatgcattataatgtagagctctttgaattttacaaattgtaaccattattcatccagcacatagatcaagaaagagattttaccagaattccagaagcctgtcttgtgctgtcttccagtcactactcaccaccctatgcataaccactcttctgacttctaacaccacagatgactctttccacagttttaagactttttatgttcactttacagtgccttggtatgaaataaatatcaattaccctataccatcaagcacgtttatattgatcttctccccttgcttgcaccacttcatcccagagagcccacttgccagagcctgctatgtagtctaacaagcagctccatctatgagtggtcctagggttctacctcctgcttcattcacttttagcttaggtcaaatgcctcaactttcccaatgatgaagggataatctagtcttaaattaaggggtgtctttatactctctcctcttgactaagatgatgaaaaccactggggaccccatgaaagatccacattattgaagggaacatgtgagaacacggaatctgaatccaagacccattttgggtcttacttaattcattacttgggaaattgggaaattgaagttgcttcaatttcccaatttacaaagggagggtaataataacacccaatttttaaagggttgctgagagaattcaatgatggcgtatattaaaaacaaccagtgctaatgactcttcagttgatggatcctctctctttgcttctgtcctgtgacagtcaggagagaaagacagacagatagacagacagatggatagatagatagatatttgaaatagatatatattcaaaatataaagtcagaagacatccagaataaaagatattttgcatgaccagaacaattaagtccattgcccctttaaactcacaaaaaagggttttaaaaataagttctcccatactaaaacaaacagctacccacctgggaaaacttactgctaaacatcacatgtcagcttttcctatcttttagcaaaataatttaaaaataaatctgtttctggcataagcctgaataaaaactattaccaaatcattcattacctaaatacacaagctgtctaatgataatcagcaggtcctcgctacatcttatgacaataaagtgttttcaaaagctcacataattatgtcaggcacacattatgcttacctgcattattataaaatatcaagtactggtcaacattcccagttagataagtaaatattttggaatgaagaccatatgatgaactgtaataacttaacgggcccattttgttcactatgattaatattcactcaagtcagtttgttcaactccttacttcaaatatatcatttgatctaactccatttcttggcctttccttttaaacacatcctttctagaatgagagaacttccctctgggctcattgcagattgctccattaatgagccctattttcagtggttagtcatgctctctctcttcagatctctgatacatggattagcttctcggtaaatatttctgtttgaaagcagttggcctccagtctttgtaaagtcttaaaaagcctggcatctaccatctccacagggtactttgcagtcataaaaggaatgtcacagtttggggatgacagactgagctatttttttctccccagaaggtgacagtagattatagatgaaatattgcacaaattacataaccaaataaaatataactttttagaactggggtgtcctttagtttttttcggagaagacttcctttgtccctattacctttgctaaatttaaaaacacgaattcatattttgtgatagtttccaaaatattgttcgttctgttctgacacagaatttcaaatatttctgaaaaaacaatgctgctttgaagaaaggcatgcaactacttcaaataataaaatttatagttgtttagtattaaataatacatattattgcagtaagaatttgtccattttttttgcttgtttaaacttcttaactctattaggtgtatactattcttactcccagtttacagataagaaaaccaaggctagcagagattaagtaattcttcagtcactcatgatttttagctcaggtctgaatgcctccagggtctgtgctcttttccacaaccttgtatggggagaaagaatctcacaccaaattcattcatttggacatatccagaatctgaattatgattgtttgtgactatgtgcatgagtgtgcacgtttacacacaaaagacacaaatatgcgacagagacagcaagagaaatggaatgttcattttaatgtaaataaaaatgtctaaagataaccattaggatgattaaattagactgcttatatatattgggaaggagaagattttgcctactggctatgacatatattaggttccctcttgaggtcctgtttagccaagtgattttcttattccttttgtatcatatatatatataggcaggccacatttttggaaataagattacacggtgagggttaaactatatgaaatgatcacaaaatggatcagaggaaagaaattgcaacactgaagagatttctgatttccaggccaaaggctcaagtaataataacatatctaagaaaaaatgtcagcctaatgggaaattaatgtggactggagaaagggccagctctgtgaaactgaagttggtggagccattctaagcactgtctaaaggggaggggcaccattgcctcccagacagaatttttcctacatgagatggagagacaaagttgttagagctcagcagctctggaacctaaattactctgatgtgctcatccctgtccatgttcattcacccagcagccttataaaagggttgcctagtagacaacatattagcctttgttcagcaaactcctgttacatttaaactttcctacatccacaataatgatgtgcgtgtaaaaagcaggattttcatgaagagccatctagacacagatgcctttagttgttgtcatacttcagagcacaaacttaagtataataagcacatacctatacttaagaggacaggctttggagttggctcacttgggttggaatttcatctctagtgtcaccctaaccaaatgaggtagcctgtctctgggaccaattaatagtacctactttacaggttgacatgcaaattaaataagttcatatatgtaaagtgcttcgaacagtgcatggtgcataataagtactcaacaaaatgttatgaatattgttattatcaatattattactaggttttttagctcactcctaccactcccaaaacccaataccaaatttgaacaagtctttattagtccttacacccactcttaattgacaatctcctcttcatttttatttttgcttctcaagctcctaccaccaccctatccattatggatagcatcagtttttttactctagtaatccttgccagtaaaggctgaaccttctgtgtgcctcggttgtctctaagctccatgattgacaggacaagaataaggacaaggattggggtttttcatttttcttgttttcagctgccactttctccaagactactcaacaatctctcaatctctacctgacatttgctttgcatatcagctaatgagattctaaacgttcttccaccgatttcgatggttcagggctgcttcaaattcaccatatatctctcttgttatctttaggaacagtagtatgatgttgatgcccctttcaatatctgagtggttatttctattccacacccttgttgtaaatgacactgatgtgtatgtatccccacaagcaattcagttagcctagagtgactcttctttaatcaatctgcattttattattttgttttttaactctgtcaatagtagatacaattgactctaatgtccaaaatccaggttatagtttatttgaacactgatatagtttgaatatctatccctttcaaatctcatatgaaaatttgatccccagtgttggaggtgggccctagtggcgggtatatgggtcatgggagtggatctctcatcaatggcttgatgcctttatcatggtaatcagcaagttctcgctccattagttcgtgtgagaactgattgttaaaaggaacctggcaccttcctgctttctctcctattccccctctcatcatgtgacacactggctctcctcgccttccgctactagtaaaagcttcctgaagcctcaccagaagctgagaagatgtacgatctccagaaccatgagccaaataaatctcttttcttataaattacccagcctcaggtactcctttatggaaaaacaaagcagactaacacaagcatctacctttagaaattgcatgcctacctgctctattcttatgttgacttgtataaagagttatatgaattttcattgtccagatttgtcttgatttcaaatattatattccattaactttatatgtacattcttcctcactgtgtgtctctatttttgattaaaaactgtgatcaccgtttctatgtgggcttaggtgatatggaattttagaccattggatagatccctgggcatgtgattaaaaatcatgccagaagcaagagatatgtttccttagatgatactgctatgcacccaggattgagatcttgtagtataaaccacaacagtgggtagaaattgggttattatttgagtagacagtttattcctctcagttaactaaatgaatatctgaaacatacaaaggttctgaaactgacaactatagtacccagtggaagatccaaaaatggcgaatgaaccatctttcgcagaaagaaaatcctcataatcataaggaatagcttagtttataagatacccaagatagtgaacatatattttttaaccagaaaaccaatccccataaaaaaaggaatttatttttcatgaatacaatagttaattttatgtgtcaacttgactggaccatggagtgcccagatatttcattaaatgttattactgacatatctgtaagggtgttctggatgagattgacatgggaatcaatggaccgagtaaactatattgtcttttccatagagaacgggcctcatctaatctgttgaaggactgaatagaacaaaaaggctgagtaacagaaaattctgtctctttcctggaatgtctttgagctgggacattagttctgccactggattctgacatggacttagactggaaattacacctcgggcctgtgtcttggaacctagactggaactatgccatcagcacttccaggtcttcaacttgcttactggaaattttgggacttctcagtctctataactgtctgagccaattccttataataaataaataaatgtgtgtatgtatgtacatatatatgtatacacaagtatacatgtatatatacattcataatgtatataatgcatatatatttataatcatatacatatatgtgtttgtgtgtgtatatatagatagcctattggctctggttctctggagaaagatgactaatagggctttagtttatgacttctgcaatacttaatagtttaggaaagagttgtctaaaaatactagttgtcatgtcctcagaaatgagcaataaatgctaccattttcatgtatacataatagaatcttgtgaagaattttctcaaagaccaccctatgtcattttctaccattatacacagcctacttattacacctcagataaaaacaaaaaaggagcatattaagatgatcacaatggaattcgctgcaacagaagcagctctcacaagttagcccttgataagaatccagcagcacatcaaaaagcttatccaccatgatcaagtgggcttcatccctgggatgcaagcctggttcaatgtacgcaaatcaataaatgtaatccagcatataaacaaaacaaaagaaaaaaaccacatgattatctcaatagatgcagaaaaggcctttgacaaaattcaacaaccattcatgctaaaaactctcaataaattaggtattgatgggacgtatctcaaaataataagagctatctatgacaaacccacagccaatatcacactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagatgacatgattgtatatctagaaaaccccattgtctcagcccaaaatctccttaagctgataagaaacttcagcaaagtctcaggatacaaaatcaatgtacaaaaatcacaagcattcttatacaccaataacagacaaacagagagccaaatcatgagtgagctcccattcacaattgcttcaaagagaataaaatacttaggaatccaacttaaaagggatgtgaaggacctcttcaaggagaactacaaaccactgctcaacgaaataaaagaggatacaaacaaatggaacaacattccatgctcatgggtaggaagaatcaatatcgtgaaaatggccatactgcccaaggtaatctatagattcaatgccatccccatcaagctaccaatgactttcttcacagaattggaaaaaactactttaaagttcatatggaaccaaaaaagagcccacatcgccaagtcaatcctaagccaaaagaacaaaactggaggcatcactctacctgacttcaaactatctacaaggctacagtaaccaaaacagcatggtactggtaccaaaacagagatatagaccaatggaacagaacagagccctcagaaataacgccgcatatctacagctatctgatctttgacgaacctgagaaaaacaagcaatggggaaaggattccctatttaataaatagtgctgggaaaactggctagccatatgtagaaagctgaaagtggatcccttccttacatcttatacaaaaattaattcaagatggattaaagacttcaatgttaaacctaaaaccataaaaaccctagaagaaaacctaggcattaccattcaggacataggcatgggcaaggacttcatgtataaaacaccaaaagcaatggcaacaaaagccaaaattgacaaatgggatctaattaaactaaagagcttctgcacagcaaagaaactaccatcagagtgaacaggcaacctacaaaatggaagaaaatttttgcaacctactcatctgacaaagggctaatatccagaatctacaatgaactcaaacaaatttacaagaaaaaaacaaacaaacccatcaaaaagtgggcgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcagtcattaaaaagtcaggaaacaacaggtgctggagaggatatggagaaataggaacacttttatactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgctgcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcgtgttctcactcatagatgggaattgaacaatgagaacacatggacacaggaaggggaacatcacactcgggggactgttgtggggtgggcggaggggggagggatagcattaggagatatacctaatgctaaatgacgagttaatgggtgcagcacaccagcatggcacatgtatacatatgtaactaacctgcacattgtgcacatgtaccctaaaacttaaagtataataataataataataataataataataataataataaaaacacatgcagtaataaaaaaaaaaagtaccagcccatgactaccttgttttcaagaccttctgctaatcgtatatgcctgggttttggctctggtatattagactgcccactggcaaggaactcaagttccattcaggcataaaaatcctcagtctcacaccagcaaataattcacccagactcccttctgtctttccttctttgacagttcacctcctgtcaagtgaacttaaaagggtattaatattcttccttttgcgactattaaagtcagatcagcactttttatgttatctttaactctttctctttattttgtaaatattcacccctttactaatagaaatgtgtacatatataataacgtgtatatattttcatctgcttttcatgttaataatgagtctgcccactagaaatcttaaatgtactacaatttttgtatataaaatggcattctgataagcttttctcacttcaaaaatcaaatacaatcccatcctaagaatgaatttagtaaggctgagaaacagacccttttatggttctatattgtattctcattaattcaatttgactcagaagccatccttacaatcaccccaaatcaggcctctgctgacctgaagggttccctctccttgataacatctcttaatagagtagctgttccccaggtttggctgtaatctcttatttttactgttttcaacctggatcccattaagcaggacaagtccctctacgactaatttttgtgatggcctcaagaaacaagggaaaaaagaaagtaagttcctccagttcttgaggaatacgataggacaaacaagttaactacacagaggaaatgggattcacaatacagtttttagggcatttcattcattcattcatattctaatatgtcaggcaccattctaggcattagggtttaaatggtgaatttaagagtccttgcacttttgaggtcacattccagtaggaagagacaaacaatcaacaaaaatattaaaaaaaccatattggttagaatatcagagtggtgagtgctatggagagaaataaaatgggtaatgaggaagggcttctctattaagcagacctacaggaagtcagggaatgagccacatgggtgggtgtatatttgactttgtgcttcataataaggacactggtttttcctctgagtgaaaaatgcatccattcaaagattttgagcaaaggagtgatatgacctaacacattaaaatgaccatttttggctgccccattgagactttcttgtagcaaggaaggaatttggattttccaaaccagtgtgagagatattatgaatgcccagtagtatcctgttcccatttctgcctgggctcacgagcaggtatgcttcccaaccactgtgtagatggggttgaggcaacatgactggtgttgggtgacaacctgtgggcattagtgacatgtgtctcttctatactgaggctacaagattctccggtctctttcttccctgctgcttcaactggtgaccttatacatggttcagcctctgtcagactggatccctgagtgacaataagaagctcctctagtatccttacccatgcaaacataaagtagacatttgtgaagaagatgcataatattttggtgttaagccactgaggtttggagagttcagagttaactgctgctaaagcctagcctgttccgaagaaatcaactaaatgggaagctagtacagtaactcagttctgagatgacagtggcttggaccaaggttaaagtagtgaaggtgagattctggataagttttgaaggtaaagtcaaatcatttgacctattcatgttatttttataggaaattatttttgaacctgtaaacacttcataaatttgtatccttggttaaaacaatgcttaaaatgacaaatataatctatccaagcatatataaactctttgggcttatgtaacataattactataagtggtctcaaaaacaaattcagtgatgaatatctgccatttatattctgcctttctttctttagtaatgtaatatcttttgaaaaaatataaatttccatatagtggaaattggtatcatattcattatgtgttctggcaacaatttctaataagaagacatgtaattttttaaactcactgaactaaactgccttgggaattaccagatatcttatgctaagacagaatatgacagtctgtactattttaatgatactaaatgagttgtgcttcaagttgtcccaaatgttaaagatgtgcctaaattgaaataccacaagctatttatttaggaaacgtgtagtaaagagaaaatgatctgtaagaacttgttgtaggcacttgaatcatcatcaaaggaagaaattcttcatctttctaaggtcaaatctttatgtaaaccactttatagtgtttttaagagcatgatatgtaagaaccttcatgtggcaccaaaggaaactaacattaacaccacaaattagtcgaacaccttatatttgctctgtgcatttaacaatataagcacttgaaaactgaatgatgatgatatgtccctgaattactacagtcagatataaattatatcttgatattagttatcattcttaaaggtgaaaagagaaagataagttgttttgatcaaagtttgtcattttttcctataatttatttgtcattagatccagctatagttttaaaatggtcaagcctatcaggtagggttctataaactacatttatgctctactcagatcgtcacttttatgagtattaatagtaacacagtatccacaggtccaaccacgcatttaattatacaactttccaatatcttttccattaagaattaagaaccctgcgatcatcaaaaaaagttgcatgacataaaatgattttataaatttatgttggaaatgaaccataaaaatatttttctgaaaaatattaggttacttaagaggcaacctttggctcaaataatttatatgatttaatcagctttgattaaaaaaccaggcttatctttttagtttctgatttgttcaaggttaaaagtcaaatatacataaaataaaacatatatttttagaatttatgaccattacagaaattattattatattaatcttaaggcacaaaacatttctgaagttactgcatgttcatcactgagaatattgaagtcataatatcccctttgactaagacttagattatatgtatgcatcactttctgggctattgtttcctaatgtataaatataggccttcaccatccacaatcccttcactttctaaaattctttgactccaaatcattgctgtgttgatactctggcatctcttcttgacatttctactgtcactgacatagttcaggttctcattatcctacacttgacacactggtttcccaagtatatggtgtccatatttatactatccattatcctacacttaacacgctgatctcccaagaatgggtgtccatatctccagtctggccttattcccaacagcctccaaactgctaccagagttattattccaaaatgcaaatctgatggcttgagttaccctctgatgaaaatgttttaaatgtatttcttcttccagaaaaacatcctgaatcccatcatttgattttgatgcttctccaccaagaccctggcacccagagcatttctcttttatagaacttatcacaatgtactatgaaaattgatatactgctacatgctatggtttgaatgtgtcccaccaaaaaaccatttgctggaaacttaatctccaatgcaatggttgggaggtgaagcctaatgggaggtatttaggtcatcagggctccattctcatgaatggatcaaggccaattataaaagggcttgagaccacacattcatatcttgctctttctcgctcactctttggccttttcccatggaatgatgcagcaagaaggccctcatcagatgctggcccctggatcttagacttcccaacctccagaaccatgaggcaataaattcatgttcactataaattacccattctgtggtattctgttatagcagcagagactaaaacaccatctttccctctagtctccttgaggataaatagaacatttgatttgggatccttggtgtctagcacattgctttgtagctcacaatgaacagtacatgcttgttgaataaacaaaggagtgcataaatagttatctctaatacctgaatgtgaggttttattaaaggatggaggtagcatattctctaaggctctataaatatttatgcccagttgaaaatatgctcataaatttctagcacctattttgccacaagagatacagaagggaaataaacattaactctatggtatactttttaatactcatactataaaatcatcaatcaaaataaaactgctttttgcctaattcattttatttagactgttttgatttatgatctggttaaatgtgctgtgtattgacttacactactataaatacttatgtgccaccaaaaagtttttcattttgagcaagaaactacaaatgtgaagttattagagaactctctcctaccacatcctagttattataaatagaatctaaatttggggtctaaattaagaaaatacacgtaagtttcatacagcataatttagaacaggaagttactctggtaaccatataggtaagttggcaagcagcaagtcaaactatagccttagtttcttataaggaaatagaaagtatactttatgaccttgcattccttatcgattaactccttcctcctgggctatagtatcaaaattttaggctcgtctttttaatttaagtagactgtttacaagaaggttgaagagaattttagtaaatcccatcccattgtcttcaaaacttttcggatgttttgtataggactaacgatagtgataacctttcaccttcctttggttaacacactggtccaatcaacaaagcaatttagtcccattcagtcaaactacggtaagcccaaatgacattttaaacagtctctatcctggaaatattctgaaaataaccattgagtcaatagcaggaatactgatattaaggttatttattttatgtaaattctttgaatataagtagatacataaaatctgaaagtgctatgtacacaatatactgacaatattattcataacaacaattaaacagaaatattttctaagaaggatttgcatgaatttacttgatataaatgcaaaagaaaaaagaaaaacgaattacactttatatcctccttgacagcaatagtccagctctccgtagctttttaaagcagattttcaactaaaatttccttaagataaaacaaagcagtacttccatagcttctgagaactggttctttaacaggcacactcaacatgttttaagtattttaatatcagttctttggtatctgtaatttcttaagaaccaatactctattatacatgatttaaggagaaaaatgcacactcaggcaaattctaccattaacaacaggaactcgtaatacagattaatggtagcacatgccccttagtggttaatataacatttccaaaagctttatgttaactgccgtaatgtgctgaaactttgggaccatctgagaatagttctattcgcagcctcaggaggaggcaaaaattgttagcatagaatatttcaaatatttagataactttagataaaaataatgttagataaagtagcagctcactctcacacaactatgcgtgctctctagctttgggctgtatcctcagaaaacataagatcagttcaaaaaataagaatttgactaaaccatccaatttggcatgtatttattctctgctatgttaaattgtgttatgcaccaaggggatgagggtatcatgacttaataaaaatgagtatattccaaaagaagacaggactaaaggaagggaagaggggaggcagggagagagggaggcaggaaagggggagggggagaggaggagggagggaggagggaaggaagaaagaaggaaggaaggaaggaaggaaaaataagaatatatgttataagatttcagacatgacgatagggtgacacaaaacaaatgcctgtaagaaaggacatgttcaatttctgaggttgggacactgcaaacaggaaccaaaggccctaagttggaaagcacatggggatttttaaggaacagaattaaggccagtggaactcagtgatagtgattgcggcagaagatgtgacctgggaggcagagagaagtgggatgatacaaggcattgcaggccacgatgaagagtaattttttaattttattctgaggatagagatgaggtattagaagatcacatggtagaaagtcactgacctactatagatgttaaaagcccatcctcactgtctggggcagaatgtgttttggatgggcaagagttgaagcaagaaacagttagattactgccatattatagatgtgagagtcctgccctggaagggagcagagagatggagagatgtatgtgtgggagactgttagtagatggattctacatatgccgtgaaatcagtctcaggacatgttgataactggagtacacagtgagaagctgacgaatggaatgggatgcagaggaggaattttggggtaacggaagaagggggagaaacaacttttgttttatggataggttgtatgtgaggagcctgtttcaagtggagacattaactatgcagatgagtgtatgattctggatttcaagtggaaagttagggctggaactgtgaatttaggagtcattagcatataagtcaaatttcagtccatggaacttaatgagattacctaagaaggataatcagaaccatggcacacaactggggaaaatacatgtgtacacagagaagagaaggggaccccagatggagtcctgaggcctggacacttaacagttgtggagaagaggaagagccaggaaaggagaaagagacggacagatctgagaggaagagaggcaaaagggaagcggaacacgatttcatggcaatcaagagatgcacttccagaagatggaaggggtcacattggccaaaatcaaatatagcaagttatcacaagtccttagagaaatcactgaaagaaaaaaaggcattaaaaagtgacaactctaaaaagtttgaacttttcaagacagttctgccaataaacctaaagttcatagtaaaataagcattcagtcacattttattgcttagctgctcccattgtgaacttttaattaatatataaaaaacccctatgttaatttattctaatcactataaaataattaacatcttgactatgtctcagattctgcatgtatatatctatgaaataaggcataagtaacacacataatagattcatctgcattttagtgagttaccttattgcttcagtaaaatattactaaaagatcagcataaccacaaatataaatggaaaaaaattatcattcagtagttctctctcaataatcctcctgctaagaataaaattttgtttctgaatacatttaactctttagtcacattgattaagggaacatctaaagataggccgttaactctgaagtttttcacttgtgctaaaggacaaacagtaaagtactttaaaaggtataatatgctgtaacaaatgatttaaaaattgaacaatttatcaaataatttatcaagttattatatagccaggcaggtctcgtttcattgtactaggtcaagtttagaatataattgatttctttaattctatatagttcctgttttctgctagacagagagaacttctggtagggaatgtttttatctagtgtaatgccttgcacatggaacagagtaggcgcttaatacatgtctgttgaatgaacaaatcaatgggaaggtggtagcagaaaagtaagatgagggggatcacaaaattgcccccttctaaaataaaatatttgcaaacaaaactttttcaatgacgggccaaaaaagtgggtatatatgagaactttgcatgacacaagtaagaaaatgtgaacatagtaaattgtttaactagaggctgacaaaataattacaggcacaaatggaaaatcgcctcaatatagtgctgtattgctattttaaagatagaaaagaaacaatattttgtaaaagtgatcatattcacttattgatagaaagaaatgtagaatttaggataagaaacatttggtgttaggcaaagagactaaacaaaagttattttaatgaacattttaaagacttacatatggaaaaactgcccatctatatatagacaagtcagtaaaatagccattcagttttcttggataattcattctgcttactgtgcagttagttgttacttggagaggaatccactggacagtcacaaggaacagatatccaaatcctgattccttcacccgctagtgaacccacttagggttacaaatgctagtaattaccacatcagatagttccagaaatcagatgagacaatgtatttgaaaattatgaagcaatagtaaaattataactatcaattataaagcaatagtaaaatatgttgtgttccaaataaaatgatgattttatttctgcattgtgtttatttattttttactaaggcattcttgagtcatttactgatttgttctattctcaaacagaaaattccatttaaatatcaatatgtgtccaaactctataatgtcgctgtcactgacattgtttgggagcatcaaggacagccagaccattttggcttatatcaaaatgtatgtgtaaaacatgggaaatatactgaaattcttgaagtgtggtgtgttagttatctaattactatttattgtgcaaaatgttacaagaaagcttgctttgtctgtgtgtgtgagggtgtgtgtgtagttgtgaggaaaagaaatagggagatggatgataaaaataaatctctaatataaaataggctatatttcctatgctatttaaatagcaatgtatagtttggggaaggaattataggtttattttatgaatagctacactatcttaattaatttattgttttcttgccccgagtagccaagattatgatagctcataactctttatatgtgtttgcttctatcatgctacttccgccatttattgttaatttctttaaaaattagaatgtgcttagcgttttgtcgtatcaatttttgaatatgtttctgcttcctgttaaaattaacatggaataatcttagcagaaagcatccagttactaagctgctctcttgcagccttagaagactgaattattatctgtcctttgtttttatgataaccacgcataaaatatatactagatagcttaaaggtttatctttatgttaccttatgcattaatgcttttagctgtgtttaagatttaaaagtatattttattcaaggtccaaaaggaaaatgtaataattccacacaaaaattcacgttatcacacacacaaaaatcttgacttcacctttaatggagattaagttactaatggagaggcctgctgtgatgaactttactcttactctgagagaaatccattatctaatgagatcagaagagcaaattctttcaaatgcagtgtttaactaaacagaaaaaacttttgaaataattgtgattttttgctttatttgatgtcattttcacctaggtattaatcagaggagttatccaaagattcctatttgttaatatttggatagctaggcatatattgagtagtaaataacatttctttaaaatttatagacaattctgattttgactgattcagactacccttttaaactacagaaaagctaaaaaatatttattaaacaccgattatatgtcgggattcatgttgtagagcactcaacatatgacatatttagaggcagctttaacggtaaccaacattattataaataatgtaagcttaattccaaattaaaataaagattatgaatgcaataataaattcaggtaaatgtgaaatgaccatgggctgcagctattagggatgagatgttccgggagctagaatctgaagtcataatggaatggaaaggagttataaggaattccaggccagaaataaggatatagctttgaattaggaagtcaagagacctctttggaaaactgggagcacaacaatccaattacaatgcggaattcatggttggaaagatggcaggaaatatggtcaggaacagacttttaaacactgaattgcgaaccgaagttttattgtgtacactctatttttaaagagaattttctgaatatttttatccaacaatacactttttagtcagtggatggaaacactagatggtgagctttattaaactttaacaattttttttaatctgggaaaaaatggtactacaaaacacacactaagttttaaaaaaaatttctttcaaattttctttccttcaaatttaagtgtgcttaagtactcatttctaactgtgtactgtggggcaaaagttgtctaggtttttaatggcatccagtaactgggctaggaatttaagaaatactgacaaaagctggctgtatattcctgcttgtttcagcaggttttgcaaatcattaagtcaaaagacagcggactgatcaacaatattccaacctaaaggccaattctgctatattaataaacaatctgaaggcaaatgatagataggaaatctccactactatgtacagttaatattctctatcaattacaacgccattttttcgcttttaaaaattgtatctgccaaagatgccaactatatgatacatttcatgattaaatttaaactatgatatcaaaattcaataaggagatattaaaactgcaggaatcagttatttcggctcactccagggttcttaaaaatgttccccaggttgaaaaggacaagaaagaaaaatcattcaaatgatcaatgagtaaaaaaggaaagatgttcagctgatactgcttaactcagtggaaaggcttgaagagtggtgctatttggcaaatgtgaagtgtgaatcaaatgatatttaaatcagtttacattttataggaaagcaagccatttaaaatacaataacaatgtccagtgtgttggatatgtaaagatattcaactggcttattagtaatggcaacttgttattcattcaaaagatttcagaacctttaaaaaagttagtgctgatgaaatttttcagctgttggaaaattagaccaagaggccccataatttgcactggagatatttttcagatcttgttgtcctccccaccccttaagtatagccaacagaattcaatgcttttatagaaagaaagtgcacaaatgcctctcaaggacatatctttgtttaaaaggccttcccatattaaacacaattcttaaaattggagaagtaaagttcacataagaaaaagcaaatctggtcaatggaggacagaggtcttctgtttctaagaggcaatgctaagcttaaaacttattaaactaaatcttagctaaaattaaaacatttaaatatacaatttaaatgatgttcatgtaacatatttacatgcctttaaagagcagaactgatacaaatttttaaagttgcaacttactatgaaattttcactattgtaagtagccagaagtaactcactattgcctttaattgaaaacattaattggggaaaaactgatttcatgataaattttaataacatttaatattttatatgaatatatatggccaccatatatagagaatatttggaagtaggatttatttctccaaatgtaaccaaagtgatacagttatatacagttgtgcatgtgaatcaatataggcatttctaattattttaatgaagtcagctagtatttaagttggaaagaatttttatatgtttccctagtgcctcatatctacattaatttttctcatttcaaagggcaaattattgttctctatttttttctttctaagtaatcacttattttctaaaactaactgaaaacaagattctaacacactccccactcccttctcttgggaatgttctcaacagcactatattccttttatcacttgtaactctgtcagttttaagacaaattgtacccagtatagaggtcaggatctattggtctataaaagctgcccctgaaattgataaaaccattgcctctaacaccagagggaaagagattgtcagtttcaaaacaaaattaagcacagtatctttctgtggcactgatgaaacccctgaggatagcagatgttatttggaattgagttgcacatattataataaaaagataataattgatatgtacttaacatcataaagatcacattaactccacatagatgatttctctgaatcttcacaacaatctcagtgaataaattaggacatgggttaaaatccatattttatggataaggagccaaggcttcagcaagttaaataactgtccaagttcaaatggctattaaatggcagatctaggatttaaaatcccatgttttgactccagagctcatcttcttttagaggccaactctatcatcctcattttaaaattatgaaattagtggaaaactctgtcgactacagaagcaacaacaatctgaagggccaaaaaggagaagaaaattcaaagatttactaaagttcaaatgagtaacaaagtacccagattttaagcaatattcaattcatatggagaaatagaaattattcagagacataaattaatagcaacacttttcatatgtatagcactttgcaattttaaggtgttttacatacgttatcctatctacatggcacatagaaacatatgttttgttaatgtcaaaatgtctacaactaactgaaacatctgaggactagaagattacactactctgaagaaaaacagtattattgcataaatccttactcattaacttagcaacaagaagagtggcatcctgttctgacagtgtatatagtatttacatattttagctcttttctgactttcaaaagaaacatttactgagcctcagaaattaggatttaaccaaaaatgtctaataacttttttcttttaaacaagtgaatgacctagattggtcaagaagactatattagtatctgatggaaaattaaaagtactgagtatgtatttcaaattacactatccctaaatttgtggtgtataatgtattttaaatatatagaagggaaaacaattatagattgtcattttaactaggaaattatgaacttcccatcctcagtcatttgtaagctttaaccttaaaatattttagtatgtgccactaacaaaagaatcacttttagttcatcctaggttttaaaacagacattctttgtatccaagagaaccctaatttgatcaagtaacataaatattgggtactaaatgacagtagcattgaggacaaatataacaagaaatagatatttgtacttttttaatttttatttttatttcaatagtttttgaggtacaggtggttcttggttacatggataagttctttaatgatgatttctgagattttggtgcacctaccacccaagaaatgtacaccatacccaatatgtagtttttatccctcaccctctcccaatcttcccctcccacccaccaaatccctgaagtccatgcctttgcatcctcatagcttagctcccacttagaagtgagaaaatacaacatttggctttccattcctgagttacttcatttagaataacaacctccagctccatccaagttgctgcaaaagacattatttcattcctttttatggctgagtagtattccatggtatatacataccacgttttctttatccactcgttggttgatgagcacttaggttggttccatatctttgcaattgcgaattgtgctgctataaacatgcgtgtgcatgtgtctatataatgacttatttttctttgggtagatacccaatagtgggattgctggattgaatggtagttctactttaagttctttaaggcatctccatagtgttttccatagtggttgtactagtttacattcccaccagcagtgtaaaagtgtctgcttttaaccacagcttgcacttactttaaaatataaatccatattgatatatgctatataagccatttaagagcagttaaacttattaattctattctacacttacttcacaaactctttattattaataagttttaagaaagatccctgtttattcaatgatcattcacctgggatttatttagcagacactatagggcaatcactgtgctggtcttcacgctgtgtagataagacatgggctatactcatgtggaaatcactaatggtctctcagtggtgtaaacaaataacaagacttaatgtaatgaatttaatacactacaaaatgcacacagataaaataatagtattttccacatactcatttactacttgaccatttgatccatttattatttaaaaatagatgtttttgagcaatataattataatggtattagagaaagttaagaaactgtagcaaaggtgaaaagcataataagaaaaccatttttatcttgtgtttttcccagtcttttaaaaaatacgcattttattgagaccaaaattgtcatttattcctcccaagtattttcatataatcctacataattctttaataagcttttaaatagctacatgatattcaacttagtgagcagatatatcatagtcatggcataatgcacaagctgcacagcttccaaatctcagagacttgggtttagagttaggtaattgctctaccacttcacattctgttttcttatctgtaaaatggggataataataagtagctttaaggcttttcaagcatcagagactattatttaccaaacatctatcatggaccccgaaagtcagtagagaacaaggaaatagcaactactgcttataattcccttaatgttgcagaattaggtaacaatattttgaataatcattctttttgagttgttttattcagccccatgcacaactttgcttaccagttgtaatgatctttgagtttcttattttctagcctcaaatcagaattatatagtattaattattttagcaaaaggaaagatcattcagtaagccataagcaaaggaaagcaagagtagctgtacttaaaattaaacattttcctttgactagttgaaaagtgttacataaaaaaggaaaacattccatcttttctaaaaacactgaatgagatactccttaccaaagtactctaaaaagtaaaaagtgtatacaaatgttagctgatgctaacatataatggtacgattttttcttcactgatttgttgtatcccaaactttaagccaatctctacatatttataaaattttaaaaacagtgaaaaaccccttctgttttatcgttttattccttccaaaaatgttttcagattggaacatacagtgttttttttttttccttaggatcatatatcactataactgaattcaaattttgcctttaaaattttattttggagttgatttgtatgaaatgacatgtaaaacttcataaggattctaagtttggtcaagacacatataatcgctatttcaactactgatactttgctatcttttgctgcaacaaatctactgtcttattaaaataaaaatgtacttctccaaacgtacttgtgcttaattttttccagagcaagtttaaaatattcactattagaagagtcttgataatgaaacctctttttcctcatggacatggaagaaaactaaagctttacaggagacctgatgaaatgcagactcaagtaagaaaaatattttaaggtataaagttttaaaatatacttcttattctaggacagctatcattcattatgtaacttccaacttgagaaaaggttggaatctggttattcttcaagtccaagttagaaggaatactctggatataataggtggaggtttaaaagttggcttaacacccttaggcaactgcagacctggtcactgtcccatcaggaatgttttgaaggccaataaaccactcagcccctgccctgtctttataaataattctcaccggctgtggagcaatgctggatgtggctttcagcttcaccatggttacttgagagcattctcaggtattgcttctatccaagcagcctttgcctctgtgggaaaccccagtgatattctgggagaagtggcaagggcaggtagcatgaccattctcttctctggaaatctcactcccatgcacttttcatgcaatcaatcatgaagaaaaggtcaacagacagctttcaaataatggatttacttacctactgacactgatctggcgagagaagtgaagttgtggggagaaaaagggaggagcacaggagtcaattacaggaaacctaaaccccttcagtcttccagggagaccaaacacactccagtaagctccctccccttgatcacaggtatctgccaaagctattaaggtaagtttacattgatgtccggttagaagttggaggtatgtatgtgcacatatataagatgggagcactggggaggaaaagatagatattaaagaactgtcattcactgtggaaattaacaaaaaaggataggctgtgtttcagggaggttaactgtctatacatcctaggccattcagtgcagatttaaatttcaggaaacagtaggcacatgaggataatccctccatccttggaagacttaatacacctttagtgtctgactcaatagtagatgaactaaaggtagtttgaccagtaaaaccaattgacatggaaacttaatataaatgataaaaacgtaggagttttgttttgggatcagccagtcctataacacccagttcacagaagtgctgcaggattttctttttaatattaatagaacataaatattatttccattttggtttcattcttagcaccttatcatgccacaacgaataaatagttagatggtctccagttttgaaggagtttaaagtcctacaaaccttattctacccatttggtttcttgccagacaataaattccatgagaacagggactatagaagtgttttgctcaatatgatggcccttgtgcttatacaacaatgtctggccatattaagttctaaaaaaaacaagctagttataaaaaatggatgagttcccaaaaaactctgcctgctagagccacattaataagttttttcctaacctttctaaacattggtcatgtttatatggattacttttgttttggcatcgaaataataaaatcagcacccttgatccaaggttcctcagctgcataaacaacaacttgctcttattttgattaaggagagctattatatgttcttcctcaagctattagtctactaggaacatgttgtaatttataaggcctatcaaaactttccttttactaaaatgaatagaaaattaatgcagccaggcagaaagctctgttagctaatagtttttagcattttctcctttgagatgctagagagcaattttcatttactggttatttaaggaagaaaaattcagtcccactgatatcaccttgattgggtttatgtacaaataccgtatattttttcccttgggcatatcatgtgctattacatggaaaagaaatgttacaactttctaacatcaatagctattttagatactactgcatgatcattagtcgaaaaactcttagaataatactactccctgtgtgttaataaatatttgtagaatttaggtaatttggggtggaattaaaacaccaaactcataagcactgaaagagatggaattctacttctgcattaaaatacaggtacaaattaatgttcttacttaagttcttggaaggtgctttatagacgcaataaatacatgatagtacaattaggttttgctttttaatgacatataagcagctagccctctgttcagtgtgggcttgtgttctttaaaagaactagctagaggcattttttttattggctcagaattctgaaaactagactataatttagggcttttttggtcagcaacaagtatcaatcattccacaaatacagtatttacacataattttgctatttaattaagagaagttaaaagaagtttgctttttaaggaggctaacaatgtccatttgcaacatattttttgttactaattagcttaacaaaacttttcatagggcaaaggtcattttcaacctaacaaatatgaatattgttacatgctaatgagtgcagaaatctccatcactattgttaaattaataaattatttggctcctcttattacatgtgtatggattagatgctgaaatacaataattttgaagtaaagtggttttaaaaataataaactatagcttgtgaaagtattataaaggcaaatcagagaatccaggaacacatataaacccaaggattcttttgtctgttatagttcttttttcaggattcagttttgagggagttttgaatttcacgtctgatgctacctttgaaaatattcttacagtgatgaatgacctctttcatgtaaaacagtttttgaaaaatatatacatatatttaccaaagcttccttcctcttatgttggaaatatttattttttgattggaagcctgtggtgattcagccacagcagaagaagagaggacttttcttttcccttagtgttatgttgacaaatcagcctctgaagaagtgaccactgttttatttcttctaaaagtatggcccattagttgaggaatgtttaaaattcgtatcatggtgctgtgttcttacttcattactagttttgacaaaagtaaaggagcatttacagttggtcttttaatgacgaacatgttacttccagtgtgattggttgcaacaatggattatgactggcccccaatcaccttgtaaaaactggattagaaactttattagaaatgtaacagaaaataattatcatataaacttttttttaaagaggcagggtcttgctctgttgcccaggctgcctgcagtagtgcaatcatagctctctgccgccttgaactcctgggttcaatcgatcctcccctttcggcctcccaagcagctgggacaacagttgcacaccaccatgcccagcttatttttaaaattcttttggtagagatgtggtcttgctttgttgcccagactggtctttaaactcctggcttcaagccggcctccagcctcagcctcccaaagtgttgagattataggggtgtgctcggccaacattttttgacttatatggacaaacattttgtgctagacttacatttaatctgagcagttacacgacaatgcatataatgctcagcacaggcttgacacacacgtggaaagcactcagtacatgtcagttaccattttcattattactaaaaatgaaaatagacagttttattgtatgaaaatcttaataaaattgttccctgtaacttcctcttagggaaaagcacagatttaagttcaggttatattgaatattatagtggtattaactattaccataatctttaaaatttctctcccgcaaagaatcgcacagatatcacatccaagattattcaaatgatgttatcctggactctgactaaccttacatttgctctttgtccattacaaaatttactcttttaacttttatttatattcactaagtgtattccatatcttaacttcctattcagtgaaaaagtttggttcatatgtgctatggcttgaatgtgtctcccaaaattcatgtgttggaaacttgatcccctatataacagtattgacaggtggtcttttaagaggtgattagatcatgtaggctcagccttcatcaatgaattattgttgttactctagagtgggtttgttacaaaagagaggccccttcttggtttctctctcatgtcctttctcaccctctcccctttcaccatggaataacacagcaagaaggccctagaaagttgccggtaccttaatattgaacttcccacccttcagaactgtgaactttttttctttttaaattggccagtctgtggtattctgttatagcaacacaaaatgaactaagacaatatgtcacccattttcttcaagtttgtaattattggacaatacatctcttcttttgtaacattaataagttggcttttattttgatttgtaattgtaatttattgtctattagagagtcatttgacataattttctaatgcaacaaattcagttccttttttctaatatcatctggctgccatcaggacacaaaccttctgaaagaatagatgtcaaataaaataaaccctttagcaactttattaaaagatgctaaaataatagaataatcaacatgctttatgtactttttattatatttctgtccttttacttgaagaatattcaaaaccatttagccaactctttaagaaaagcataaaatagcatggcccctcatcactcctccaaattcctcattgttggctgtcagttaagaccgcttccatctgctcccccaccatttcacttatattcagtgaaaatttttcacttgtatccttgatataacaaaacaaattctagtttcagaattctatggcattttcttctctttcaccacagtccctaattatcagttcacatcagtccaagaggaatttcaaatttatgtcattaatcaatcaccactatgtaatatcactaagaatcctaaacacttatttcctacagttttgtaatgcatgattttatcttaactccacatatgttagcagtaaaacatgactcctattcttgaagtcccaccgacattttctatgaaataatgaacattcagtggatggtaatataagatggcacttcctggtcctccagtttttggcaaatgtatttcatttttctttgtctttgaacacttagggcttctgcctcttacttactgcaaacagcactcccctctgaacaagcttacccaccgctcagttctaaatacagcaaaaaagcaaacagcacttttagcatttctttaactttctgtcttcaaattcctagttgtccatttggggcaactatcatttcctcttgacccaagtctgtggcagatacatgtaaagaacatatatatgtgttatatgaatcacatctttgtaaactaaacttctcaatagcactcttgaaaaagctagcataaattataatcatgatcaaggtactgaataattcagggggtatttcattacggattttgtctattatttaaaggcaaggagaaaattcttttaaattggagaaaaacacacgtcacttcaggtctacaaatatagtaacaaaattgagctgtggtttcaaaaaaatgctgacacattataacaaggcacgaaaaattaacctttgtgccaaaatcaaattaacagctctttaaaaagcttttgcaaagatattacatatgcatatatgtgtgcataccctcattaatatgaatcatcaactaatgtctttgccctatgatgtcattcattgcagtttaaatttgggggtggtctgttttatagtttttatgatcttatgatattaatttttattttttatacaattgctttcattaaaaaacttctatatttttaaggtgttcaaatgcaacccatctaaaataagagacttacgcttatttacccaagtattccaataatctcttactaaataaaaatgacaacgctatatatgacaggggctcaaagagaaaaatcaacaaatattcacttcttaatttcagaattttgctccctgctttaactggtccgttatcagaatttgattctaattattcattggcaaggaacaatttattgattaagaacagtagcaaatgaacaacttacggcctccaaagtgtaaccaccctggtacaggtcaatagaactaggcaaacaagaggccaattcaagagttcctgtccaatttccttccacagccaggtctttatgagcgagcagtcatggaaaagatcctagaaaaataaactgtggaaacatttcagcaacttaattgagattttgcaaggctctcaaagcctgcattgttataacccactctcatcaaagaccatgattcagctttagaaatggagctattcaaaccctgctgtattagccatatatcttaggaatttacttcctaattatgcagtatgccttataaacactttttttggttctgtcattgggtgacataatattttaagcaactaaagcgaattggtctgatcattattttgaaaagttcttcctcaacacttgtcagatttagattatgaagcacattgcatttttgttctagaaactttcatgctctccataagaatttatcacttgcttcactactgggggaaaatatgtgtcaatatagccttatatctaactgtaaaactgctgggactgtcaatttttaaatacaggagatgttgaaaaggcaaacaccatagtttctgaaagaaatgagaatctgtcttctagaaagagtaggagtaaggtcacaactctgatttatcttgtctttgaggaagaccaagagtagatacaaagaatacaagactgaactcatttcaagggtaaagagtaactctaaagggttttttttattgaaagtgctaccagaagactagaaaatatgctgacatgtgccttttctcttagtatctggaaaaaagaaaaggatgagaaaacatgttttttaaaatttacatcatccatctgatttttattttcattatgaaatctcaattttcatcttaatcttaacaggtggggccatttatttttattactttctcaggaaatgtagataaaagtagacaagattctatatatcatataagaataatcaaaagtaaattggaagtaaaatcacaaagttgttgcagaatattcaactctgcggcaaccagttcagggcaatagtgctatgacagtatttgtatttaggatgttgctttcttatctgcctcagatgagtaattatcataaattaccacatttgactgatgcccaatagcacagcacattccagtcaaaatatgtcaccaaaccaccaacactgcatgatggtttttggctctaggtgatagtgatgttaagcataatactcggtagtaatttatcctgtcactcacatatttaaaagttgctattttgaatggtctttgatgtaataatatatgacgtgttactttacatttttaaaaaagtcgtcatgttgagtaaggctaatttttacagaggcggggaagaaaaccctagcaaaatggctatgtagtcagcccagacagatggtaaatctgggaaaaattaatcagtaacaaccttagcaatctggggttgttaaatagctgtactgcattaagaaaactaataaatactttcatatatatacacacaatatggtgataataatatatatattatatgccaatgataatatccaggatacatctgattttctttcactattactctcttctaatgccttcactttttgatgttgagggtacatttgattttaagggttatttatattaataaatgtaagtaagatattaataaatattatacatgcaaggtataatacaaataacaaataataaatagtatgtgcatatacacagaaacacacatatacactaaatgactagaaattgcacttaaatcacctgaaaatcattacaattttagaagcagagtaggaagtcaacaaacgtccaggaatttgataaatgtgttgcattcttcagttttccaagtttttactctcatgaatttgaaactatcaaacatacttttttaaatgatgggagaataatcattttcaattcttctttaatataatatcataccaagtaaattaatcagcagatacaaaggaaagtgtttatctatttaaactgaccagaaaaaatgagctaatgaggcaccattagataattaggatagataaacgacagctgctaactctggaatgactcactgaattctttttaacaacatctaaacagtccaaaccaatgagatggtttaactgccacccctcttcctggttctcttttttgtccttttttacagtgttgcatgtcatcattttaaggatatttgtctacatggctctgcaacattacaatttcctttttaaaatattagtttcctctctgatttttcttcctctacacacttgtagcacttagcggatcccaagacccattctctagcctcagctcttcctgtctcatccttgtcctgaaaaaattcgtagcctcccctgatcacaaccatcatgttggtgctgaagactccaagtctctatgtatagccatttattcctctcgatatagagtcacataattctagtatgctgacatcatttccaactaaagatcttcaaaactcagactcatcgtcttcccctatgactgtttcttctgtatgagttcctcagttttgtcagtggtatcataatttctctgtcatcttgttgttaatgctaccatcagctaaaacgcatacagggaactccacttccctggatcaatgtgaagccatgaattaagtcaaatgtttagtatcaatgttaccttctttgaatctctaaacctcacccttttctttccattcctcttggcatcccattaaacactttaggatctcacacttggtttattggaaaagcctcctgaccaaccaatttttcttccagtcttctgcttcttggatccatccttcatatggttccagattaatctccctatacaggatactctttataccatagaatagggtttaaaggcaacaattctggaattacactgcttagggatctacacatgccagctccaacatccactaggctatagaccctgggaaagttaattgacattttgttccgttattctctacctacaccaaaggactgttgagagaaataaatgagttaatacagggaaagcacttagaaaagcttctaagacaagtgcttaataaatgatggacattatcatctattttattaaaaacttgtaatggcttcttgtacattatatgataaagcctaaatcccttaacctggcaattagactctgtacaatctgatcttgttattggctcaaattcaataaacagtatttgtcaatatgaattctctgctccagacaggctgaactaaaaaaaatgccctttgaaattatgtttttattcatgctgtgactcattatgtccctctttctttgatgtgttttcgtttctctccatttttactgttactcatttttcagtgacttactcaagtctagtttgttcccaaaaaggaaaaaaccagatcagcatttggtattggtcaaagtttctagaaaaaggaatcctcaaataacttgagaatgagctgtatgttataacccatcttggagattaatattacacattaattttaatgggccttgagatgtcctacagtaaagaatatttttaatatagtatcccaaatttattggaggagtaaacatcttctttcttccagaaactattagaaatctagacatgaatattctagattcaggaagagaactgaaaatcattttaattttgaaactggtgttacagtcacaatttcctatggaaatgatatgtagcattcctacataatgctgaatttcaaaaatgagtttaagtaaatctgggagaattgagtgaaaagcttaattttctaacaagtaggaattttgacatatataagtggaataccaaaaataaaaaatatttaataacatctgattaagtttattctcgattattatcacaattaaaaactttgaagcccagagaaaatttttttgtagtttttttctagtaaccatacatttttttgcagtctgtacctatacttttcaatataactattaatgttatatctgatgatagtaagtcagagtatagtgcaatacagactaaagttttgattcctcacagaatcttagtctataattctatgctcctttgcacatatttcagccctcaactcctaatttctaggccctgaattgtagctagaaaaattccacctttatttctattatataaatcataaactaaaataaagaaagatgctaaaatcaacaaataagatgaagaaatttaataaaaaatctgaagcttgacatccattcttttacataactgattaaatgcctgttgcttaaaatattatttaaaatgtgtgtaccctgttattaattcatttaaaaataactgcaactacctagactgaacacaattactagataattagtgaattcttgagagaaaaatacatttcgtgaaatgtgtttatgtatgttcatttaattgtattctcagtatattattatatttgatgttagagtagcaggccattttaattcaaataattatttgcataatagtaatcaaatataaacaatataaataacatgaaaaggtaagtattaatcagccacactagtatataaattgtcagtagtttcctaagtagccataattagaacattccaaaagaagagtgcgtttgcgtttcacgtcgataattacaatattgttagatagattctgttttccatctgtgaaacacttgacatgtaatagaagacaggaaaaacaatttaaagtcctctccgtattttacgtaaggcacagaaattggaagtataactaaaaaacaataatatatggcttaaaatatcaatgtcatatattaaatattttcatttttctaaaaggtaaagtccttttatttctagttttccaaattctctttgatgtttcaccataaaattttaaaatggacaaaagaaagctttattagacatatgtttattaaaaatgaaaattattttaccatccatttgtaaatattttactataaatactttactattatcaagtaaatatttatctttcaaaggccaggattaaagttcgctaaaacagaccactagagggcaagccacactctgctctcagttataaatacgtgaatgactatagctgccttaaaaacactagctatagctaataatcattctttttttccttaattttttattcaaaactattttttcagtgcccactgtgtaccagccactgagaatacagaattaaagcaagtcatatacatatatctctgtactagttctctcttcatatacacataggcatatagatttgaaaatggttttaatacattcctttaatgttatttagtccttcagaatttattatctttaaatttttaccttaagggtagtgtgctgtagaaaaatcaaataaccagactttcccaggcaagttgtcatacagtaacttggacatctctgacactgaaaatcaaggaacatcttttggtataaagtacattaatgaatgttatataatctccatagaatgggagtttaataaaagcctgtggaatattcttcaacactgtccgaaatttgcctcggcattttcctaacttggtttgtcccttcttttactgggcagaacaggatccacatatgaagaaaaaagtggttgagttgttgtcagagacaattaaagtcttcttcaggtccccattagctagtgccctgagaaacgggtggaatgatttcataatttctgttgaatataaaaggacactgataccctggggatattgattcagaaagacagaaagaatagctgggaagctctttcagtgatagagaagttaatgattttgtgattcatccaagagaaatgccttacaacctttgataatggcaaggcagatagtgccactgctgaccttgtcaaattagcagaagctaataatatcagggcagaagacaaacctaagcaccacaaaggagagtttagcaacacttgcatatttttaattgtatttgtcggggggttctttaacaaaagattgcttttgttaatatcgggttaatatcaggatcaaagtgttaatatcaggatcaaagtgttttctgacgtcaacatttttatggcaggctagacataatagaaatgctctgctgaattattaggaaaaatggaagctgcctctcctccacatgccattagtattaaaagtgttaaatgtccaacataattaaattacatggaggaaaacaatgaacaccaagatacagaaattgatagagaaatgttgaaccaccagaacacaatccacatctcttcacttagtaggtacactgattcattccttcagcagatacttgcataacctctatttaggtttcatggatacaacagtaaccagatctgctctcaacgcagctttcattttagctaggtcccctgctagatgcataggagataaagctgatcaacactcccttcccttgaagggttttctcgtacatgtgggagaaagatgtcgacattcagaccaatgcaatggaaaaaaaaatcaatacaaatttaaatatgtaccaattactgtggaaatgaagaggtggaagttttcttctgaggaagttggggaaggggctacattctgggtattgtctggaagaagattcaagggaagaaggttgctttgttcagatcatcttgttttggcagaaacttgaagggtatgtgactacttgttagatgcgaaggaagtagcatatcagacactgggcaccaagtgctgggagaacatggcactgtaagtggaatatggaaatgaaaatgggtctggagaaggaggcaggaggcaggagcgagaaggtggaggacctggcatgccccattcctacagggaactgtgatttcctttaagttggcgataggaaacatttaaaggttcaagctggaacttgatgagggaacacacgaaaattgtgcaaaaataaagtaaaaaatcattacttttgtattttacatacatattcatacacacaggcacaccactctgatgaaggtatgagaagtggattggagtaaggcaattattcttaggcttacagatcatcgggatttttacaaagaaactggatggactattttcaaccaaacaataagaattcctcactcacagctaataattgtttaaccctcttctcccagaacgatgtgttatgggaaaccaggcatggttctgaaaagagagttcatgtataaaataaagcaatgagaggccttcacctttcattctgccaatctttgggcattcaagttaccccagggaggagagtttcatatgaataactaaatgacttaagtgcatttaaattgatatcaattttacataacaaaatctcctaaaatttaccatctctgacatttcaatggggttcaaagatttattatatgcaattatatgttttgttaatagctgtgataaattagattttcaacatttttatgccaggtttatggagacaagtttatatgtttgttactactaagcaaaagtaatttttttatttttaaaagtttgtttaattgataagaaactaaaacaaaaattaatttccaggtaatgaaaattattaatcagaagtattaatccagtaatgtagtaaatatttttaaggacacaaaaatacttgataaattaattaatttacattacagatgctctgcatctacgtgcattaccgcctgcaaagatgtccttcaacaacaacaacaaaaattttcttggtagcagttagcatcacaacctccacaagtggtttgacaaatctaggtctcgtcatggttgctaaatatgtaaatcatactgaatgaccgaggctaaaagcaaagtgacagttgactgtgactgccattaaccatggattacatcccggcatgtaatgcaattatatggcaggaaacaactaatgtgggctgctctggtgggagaagggagaaaatattgaatttttctttgtaatctatttacatcttgcaatgggagcattagtcagattaaggttcagaatgccaggcgcacaccagcccagtgtgctaagtggtgccttcattcctaatgtgataagaaggtaatggttggataaacaaatacattctaatatacattgcttccactgatgtagactgaaatcttttagaaacataaagatctgtcagcattattaagtatgacctctacttttcctttcccctcattaatagacaaattttgctgaaattttcttagtaaatcatattaatttcctcacaaaattcaagcttaatatatattatcaagacacatgaagacaacacattaaaatgtaaatttcaattattttatttgtattgctgaatatatagacatacatagatagatcacatcaaatttaagagagaaacaggtgaaggaggggcaggcattaacgcaacagctttagagcaggctggcaaaagccttttgaatattctgggagtttgaaatattcaaacttcgatatatttttcttggacgctcatgtattgtcaaccatcatgacaagtctcttaaatgtatgtctaacttatttgggaaattcatttgttttgcgaatacatagattttaattttagagctcataaattgcttaacctaactttcttttaaactttaaagcccatcacttgaataatttggggttatataaaatatgtgctaccccatgatctgggcagatggtatacttcagaatcaatatcaaattcgctaaattagccataaataaactccctgtttctcaaagaagctttctgagaataaccagtgttgtcatttccacagtaacattttcctcatttttccatcgtctcattccacagaacatgttcatacaagataattgttcaaaaattgtcaatagtaaataacaacccagtatcaaatctgttatagataagcttgactggttaaggaatagtaacaaaatttgtatttatatttaaatgtctatattcagtttgtgcatataaattaagggaagaccagaaataatctaggctccttaattaggtataaatataaagtaagttcagatatttcagagatgtgggtgaacttggtatgctttgaccaatttacaaaattttatagttctattggccttaattctttgaactctcttagaggttaaatcatctctgagacgccttctttggcaatctccaccagttattatatacttctataatttactgtatctttccttcaaggtacttatcacaattacaattaaattcctttctatatatctctttagtgtttatctcttacattagcctgtgtgttctataagagcagcaatataaatatatttatttatttattttatatatatatatacatatatacacatatatatatatttttccttgagatggagtcttgctctgtcatccaggctggtgtgcaatggcgagatcttggctcactgcaacctctgcctcctgggttcaagccattctcctgcctcagcctcccaagtagctgggattataggtgggtgccaccatgcctggctaattttttgtatttttggtagagacggggtttcaccatgttggccagactggtcttgaactcctgaccttgtgatccacctgcctcagcctcccaaagtgctgggattacagccatgagccaccatgcctggccctaaatgaggagatatttaaatggtgatatattccttgatatttctccatctccataatgaaagatcttaaatatatctaatttgcaaaggactatattatttataacacttaaatgacaggaaattaatcaactgttttacacatactttatatatgtaacatggaaagctaacaatgattagaaatagcatcaagaatatctcacttcttatacaatatatgcttctagtagtatatatgtaattaatttaataattgtaatttatttcttaattatagtacatgctgctttcacatgtatcttctcaaataattgctagagtctttgggtaaggtgttactgcctctgtttcacagatggacaaactgaggctcagaatgttaagggtttgcccaaatttaaacacttagtaggtaatactgaaagaattgaatctgcacagccctatagtctgaatgaaatcccaatggcagaattcttaattagtattttaatagcttgaactttaaggtatttctgcttaacgtattaggttttccttagtgagcctcagtttttgttagctgaggaaaatggataattgaaagcatgtaaaattttcccttatgttagagagtgaatgttaagcatggataatgcagctaaatagctgtaatcatccactatgcatagccaatagtcaacagatgttcaacatagatccaacagatctaaggggaaaaaacacctaccacatctaacctaacacaggactttatttgcaataatgcatcctaaaacgaaggtcaattttggcacacaaacaacaattttggcaattcttactttttgacatcatattttcctattttagggctgtatgctggcttcatccaaagaaaaacttggcagtctaaacagtgtatatagatgtcatgaaatttgtgtaaacattaaccaaacaatccctaatgatgtggtattttgtatgtatgcatatattaatgctctatgtgcatgtatgtatgaatatattaaatttcatataaaaacgttgaagtgaactgaaataggacaaatcaagtaaaaaattaactgtaactgtacatgcttttggactggatcatctgtgtaggaaacaaatatttattgtcattttttctcagtaatatggtagtaatgtttacctatgttttcagattgaatccttaaaaataattcagttatagttaattatactgcttgaataaaaataaaatgtgatttaaattagcacatatttaactaaaatatgatatcttcatttgtcccagtatatggctcctcacagacaattcttcaatgtgaaccttgtggactggaggttctaaatatcaagcaaatgaaaacagtattgactgggacagaaggttctttggtttggaatatcctccatttcttcaaccaaaatatgctgagcactgagtgtccaatgaagagtgaaagcacacatgatctccaatttttgtgaaactgctcgaagctgggctgacttttcagattacaaagaccaaattccctgttttcggagacatttgattggtgtatggtgaaagctgggggcggagtgtgtgtaaatgccagtggcagtcggccgccctcttcatagtggacgctggagcctttagagtggagggagtaatggatttgcaaaatctcctgctgctcccgaagctttcccaagtcctgcttctaagtccatggctcttgtaatcaaagtaacatgctcatcagcctggataatcattgttacatcaatgtctgcatctggtgtttatcatcttggagagccaagcaacagaaggcctcatttcgaccaggcattttaaaatctcttcttggaatgacacttcctgtgtgccctaaaggacctacagcgagtgccaagttaccgtgtttcctgttgtacatacacatggagagcactacgaaaagggaactgaagtccccaggatagaggcttccggggagcatgatgtcatgcaacagcacagactgggaaggatgtgttcatggctcagtcactcactgatcagtttcctttctgtaaactagggataacatcaattttgtttctttttctcaaaaactaactgtgaaggccaaatgtcatagcatatgaaccgtgctttaaaaattgtaaagcgagatacaaacaacgattaatgataataatgataaaaatattaaactgttatttaaatgcaagatactgttatcttattcctcaaatccaactcagaaaatccctgcttcctccaaatacaattcttacttcttgaaatttgcatcttcttcatctgttgttcaattatgttttaatccatgaattaggggatttctaactcccagtgaccttatactggattcaggctgactatgcataaatatcggactacctgaggtagggtgcctagcacacacaatgaaaggaaaaagagggagtcccatctgtatcataaacacatatacacaaaactaaaaactgaaccaatgcatgcagaaacttaaacaaaaaaggataatcttattgaaatgctcctaaaaaatcaggataaagataacaattttgaaaattaaacttgtaacccaatactgcaaagatatactcttccaggttgggattacagccttcccaaccctgtactgaaataaaggaaaatattttatggccatgaaaagttggaatggaggcacagtaccaaaaaacgggataccaataagaagagacatctggtcattttggcatgatcacgtttctgttacaaagtgcaaatacattctttatgagaatgtgccattgattacatactctgcattttagcactgtttctaaacacgctgtaaattatgttaagtaactcattgagtctctgatttagatttttttttctcaagcagaaagataatgtttgctacaaaaaggaataaaccagtagacaaatcacatttataaactctgcaagtgacgtgagtgacgttaaaacatctgggagacgttagagactgcattaactctaatcatggatcacattatggcagatttcttttttccttaatgaggagaaaagactgagatagtgaacgtgttattcaacataacccttcagtccttgtccaagaactaataaagcaccagagagaaggccttgctccatcagaattccagaactaagggtaggcaatctcctttatgtttggcctatgtgtcactggggatagtgtctgaaaaaacaaggcccattttctcactccaaataaatcatggactatctagcacccaatatttacattgaacaaaaagatgatccttgttccctttcttctagcaacacctcatttatctgttaattttgtaacctaaagaagaggtcactaaagacaagactccatatacaatgagaagatgtaaactctgtaaaactataatataaatggaaaaatctgatttcataattatgctgcaaaatatagtcaaaatattttttaaattgactttaaatatgcatatttatacagaaaactatctgaagtcccaatgttacatagataaatacggagaaaggcctaggaaattaactgtgactccagtagttcaccttggaagagacttatacataattttcaatatgcagaataacaatcatttcactttaaaaatgcttttcaggcatttatctttaagatacatgttttcatttcatttgtaaagaagcaatcaaacaagatctactttgtgtgaggtttacttgatttcaaagtataattaaataaaacattaacatctctttgatgaagaggttgctctccaaagatttaagtccttataagtaagcttatacaatattttttaaaggaggatctagtgagaaatacgttgacttggataccttggtactacagaactagagagattggaataaagttaaagtattacttcccaaagtgtcttatttgaatttcattttgaagctcagagttggggttgggagggacttgactagagaaagtctctattttctatggattattaggtattacacccttcaggactagtgttccatggaccatactttgggaaacttgcttcatggttaaatcaacatttgggaaatgttgcttcaagacatagagtatagagagttaaagagaattttattatgatgcttgagtagtctgctaaactgcaagcatgggttaagaaaaaaaattctaggggagtagtaattgacatctgaggcccattcagcaataggacctggtatctagctattacaataaggtcagcatgaccttgaagaccccagaggaataagaatccatctggaggggaaaccagagacctctttagaggccatcacaccactctgatcattccagaatgattaaatgatgttcccccttaagagacccatagaatggacccaagtttatttcatcatcactgccaacaccattatttatgaccaacggcccaaaacactgcattgttaactcaaaaaacttcaacagaaaagctaacataagcacacattagcacatttaaaaaaaaaaaacaaacttttcctacttcagctgctgattgggcaacattttgactggaactcattggactaaagtaaattcaacttacctgcttaactgcctcacagcaaacagtttcttttgtcaatactagtgatggaattaattggaagagtaatcaattaaatgtgttttaattgcccagtgtgcataagggaacagaaagggaagactttttatggatttcccatttctcccactgtctgccctactttccttcaaacctaaactgcaaacatagctgaaggtatttttgtcttgcataactgcaaatgcctgcatctttaatagagatgatttataaagacattttggaacatgctgacttcataatgaagaagctgtactcccaaaagagtcattaacccagacattcagtgcctgaaccactgggaattatacaaaaccattcaatgagcaaagcaagatggattcttatgctttccgctaagaggaagtaggtaggaatctctcgcaacactccaaacactttgagatcaatgaagaaattgaagctccaaaaaggtaaaatgactttcccaaggtcacagagcttatcaagtctctaaatactcaacctaggaagagatctctagatctttctacagatcatatcacctctaaaaatagaatataaaatatatttgtaagtatattgatattttgtcgtgtcattctttcaagataatacaattaattttaaaagataaggattatctaccgtaagattcaaatataagtcaagagtaaaattcaacacttaaacatttttcattttttaacaccgattgactcattgtacttgtcaggttatattagttggtgtgacaagctccaaaatgcataatggtgaaaatatgatggaagtttgtatctgaactctgatataaatactttcgcctaaggagatattcattatctctttggataaatgactgaaatggaacaaagaagctgcaatttcttgagccatcaagaaagccacatttaaaaaccatttttcagaaaaactatctagtattttttttttttttttttttgagacggagtctccctctgtcgcccaggctggactgcagtggtgccctctcggctcactgcaagctctgcctcccaggttcacgccattctcctgcctcagcctcccgagtagctggaactacaggtgccggccaccacgcccagctaattttttgtatttttttagtagagacggggtttcactgcattagccaagatggtctcggtctcctgacctcgtgatccacccgcctcggcccccaaagtgctgggattacaagcgtgagccaccgcgcccggcctagtatatcctctttattgtaacctgggtacctgttgttcctatgtagcctgggaaaataatgatgcccctctctatcttagtacccctccaagaaacattgtcttaaatgggttcaggctgctataacaaatgagcataatcaaggcagcttaaaacaacatttattttttatggttctggagaccgagaccaggatgcctgcatgattagattcttggtgagggctctttctggttatatcctcacattgcttttccttggtacatacagaaagagagatctagtgtctcttcttcttcttttttttttcttttttcttttttcttttttttttgaggtggagtttcgctcttgttgcccaggctggagtgcaatggcgtgaatctcagctcactgcaacctctgcctcctgggttcaagcaattctcctgccttagccttccgagtagctgggattacaggcatgtgccaccatgcctggctaattttgtatttttagtagagacggggtttcaccatgttggccaggctggtcttgaactcctgacctcaggtgatccacctggctcggcctcccaaagtgctgggattacaggcatgagcctccacgcctggcctcttcttctttttataagggcattgattcccatcatcaggggtccatccttatgacctcacctagtcctaattacctctcaaagaccccacatccaaataccaacacattggggacttaggatttcaacatacacattgtggagagacacaaacattcagtccatagcaaacatccattggaaaaatgtgagaaagctacgtagatattcataaaccttccaaaatacttgccaaaaatgtggactctaaaaagaaatgactgtatattttttaaagttcctatccatttttatatatcacagaatgcaagggataacactaaatggtgcaattatgaaaaagtaaacataattttctatttaattttatcattcaatttggtcttggcttggtgaatgagaaaactggcagttacaaattgtgtaattcaacttaatgaatatcaaactgaaaataaatgtcagaaatgtgcatttcttttttctgaaaaaaatatgaccatatttcttccactaatttatttctagtttaatataattgtatatagtaaatcgtattcaattttccaagatcatctacaaataagtccctggctgaacagatgcatgtgacaaaagacattatttaaacattgtataaaggtatagtttatattatttatttctatatattaagtaatactctaatactctatattttaaaagtttggaaaatacccttcctataaaataatttaaaatataaaatcctcaattgttcatacattggtaccctccaaatgggcaggagctttaaacaatcgattttaaagtgcaatgctaatatttctttcagtaaaaatagattaggctggatgaaagctattctgaatgaagatataaaagtaaaagcatacacaggtgtgcatgagagagagacatgagggagagagagaagaggtttgggaggaagagagggagagaaattacagaatgagaggttatattaaaattttaacaatttcatctttatgaagaagttaacatgaaaagcaacctacacacaaaaaaaagcttaaaaaaatcaatggtgaaaagaaagtatcctgactttttaattagtctttaaaagttcagagttgagagtcaacctctaaaatcacagtaaattctcttatcaccattaaccttcaatacaaagggctttatagtccccagaataatttttgaaatcattacaatattttaatcttaacctcttctttctttttctcctaatagtgagtttttatctgtgcttggaactgctggggagactatcctgtattctatgtcacatgttctcgtaattgttctattcaaacactccaagatctgtggtttctggtcttctgcaatgccagggaccagagcaaagcacaagaaacgaaagtgccccacagttgcaggcacattttctagaaaattacagtgtgtttcatcaacactgatgggtaccttgtcttatctttgcctggattccctaaaagaagagctccacagagggagtctgtgaatgtgactcacctagggacacccacaggaaagggggagagtgagatggtcaggatagggcagaggaggggctgagcaagaatgtggtctccaccagaggcaagcttcagcctcaccaagcctctggaccctctggagcatgaactgcccaacagaattgttctcaccttgaggaaacctaccaggcaaagcagctcttgcttcagtcaaaggagattccttggagaggggagaagggggcagctgtgagcctttagccgccaacaggacagcagctgggggatgtgtgcactgggccagtaaaggagataggacaggaaagcaacagcatccactgtgtgtccattccttagagatttcccatcacctttcttttgacataactgatcatctctgcacgtagcagaaacgggcactaggatagatgaaaagttatgactgtagttggaatgaaacgtgtctatgcaactgattaggggtatagcttgtgaaagaatgcatggctgtactagagagggagagagagaaaaaataataaaaatattagaaatcaattttcaaaaaattattctgctagtttcaccaaagtgactaggatgttgctatattggaagttgaaagaacaagataattaataacaaaataatttttacaattgctgttaaaaccatgtactacaaaaaaacacatgtaaacgtagtcacttagcattccaattaccaaatacataataaatcaaattcaaacaatgttacctttagaaataaatgtcaaaagtatcaatcccctaataaaaattttaaaagctttaattccatttctataaaaggttcacaaataatttattgattttttttcctggaagaaaaataagaagaaatagatgtcagcccaagtagaagccaacaaaatgagcagttggaagtttaatgcacgagagaagtgatttaaattctagaaattatcttggtcctcttcagagcacacaatcctttttgcatagtgatgattcaatacacgtttaaaaacatgttggaaaagttgaattgaaatggactttgaaaaactctatagatttttggtagctttaattcaaccagcaatggatgaagcatcaggaaggctaagggtgttagggtaagattgaaagctgtgggatcagacagatctatgtttcaatcctaaccctgcatttagctaagtttgactttggtacattacttcaaactggtagagcctcagtgcctcatcttcaacacttctctgggttattgtgaggattaaaagagataagacataaatgatgccttgcatgttttatgcaacaggggcgattattattgctgctgttagggagataagaaacatgcacttaagtggaggctgcaatctgtcaggcagctggcaaatatccacctgcatgcatgttctttggcctgtcctgcataagacatttaaaataaaaattgagatctgggttttcttggaaaactggaagctgccaccatattgggcccatattcctgcagtgagaacctggagtcttttgttttagacgggacatgtgctctccagatcaccacactttccagcagaatctgttgtactacattcagcccacttactcacgtaacctcattggtcccagtaggcactggagcttgcgactgcctggtttgccaaggaagcataagactcagaggcatgcaatataaatctgcatgggggcagctgaagatgcagtgctgtgtggtagaaagcagctggaaccgggagccaaggaacatgagttgtagccccagttctacattaactcctgtgtgaactctgagctctatgggggtctgtttcctcatctgtaaaatatatgttctgggtaggtcaagtttctgaacacaaggcaagtcagttccccatctgggtttcagtttctcatttgttcttttttaaaaatgatgccaaattaatgggtcaccgaagcctggttgaattagagaaagccctccctccaaatgctcctgtcaaaaaaagaaacactgcacacagagttgatgggatacatttggaagctcaaatgccaaaaggaagtttaacatacataagagcagcaattctgagaatgcactcccctgtgttgctggcctaatgcattagttctaactgagtaaatagaactaattgtttccctcaagtttattcttctgcctaaaatacctaggaatgctcaagtactaaaataaattatatctgctttataattctctttgagcaaaattccagccatatactcttataactttgcagaactacgttttgaaactcatgactccaggtacttatcattattcactctttctattcagtcaagatttatgctggtgtttttcattctagaaatttttaatcaaatgatttttgtaaatcccacaagataaaaagatgtgaaatacatgtaactcgaaatgtgatactcaagttctcacctaagacagtacattaaaaaacccatattcaattttcatagcagtgtgcaaagcctatttcttaaaaaaaaaaaaaaaaaaaaaagacatacacagctaatatatcttgccaaagtccaagatactggatgtggaagtgtcaagcaaataaactttacagaaagttactgtcaaggttttctctgttttgtgttctgttgttgtatagagtaactactctactcaaaagtgacagtcaattagtgacaattcccagtggtggaataagagctaacaagaatgggaggtaagggggctatatcaactctggcaaaatagattctaggtttgtcttgttcccggtttaacaaatcttaatttctaggctttttgaaaaatcatctgtcataagaagccaactgtgttactttctaaaacacatttaattttaaaaattcgaataggcttaatgaaagactaaaggtgcacaggtaaagcatactctgttatttgacatgggcaagaagataactgttctgactaatcaattattttcttcaaattcatgaaagggcaacgacttttcaaagacacagaatatagtacatttaattctaaatccactgtgagcatgatctaacttttcccctagtgattaagaaggtattacatgatcttgcagtgtcctggtagggtgattatccatcttgtttacccaggacaatctcagtttatacttgtaaaggaacaattattaataactttccctttcctgcacaaaaatgacccaatttaggcaataaattatgtggtctccctacctctgagtcactataatgcacccaatctttcatgcagcgctgtagatagacagacatgtaggtttaataagaatgaacctgttgaagaaaatgctctaaaaggaagatttacaatacaaagtgtaaataaatattcttccacactaattttagtcaagctatactttaaatttaagtctactaagcaataacaaaaaatggccagaaataggttaaaattaccaaattagtaagtaatacaaatgtctcatttccattatctatcaagtttttaatttgtgtcttcaaaggcaaattaaatcccagagtatttaaataatcaccacaaaaaactatattctaaacattgtataatgaattaaagttaaaaaaaaagttgaatatggggcctaaatggtcttctcatttcccaaatttaaaatatgtttcacaatgtgaattttgttctgtatttctatgaaactactcatgtggattgaaaaaaaatgattttaacatggttgtgttaccaatagtacaaagtaacaataaaaacacaaaagaataattatttctactaagtccttaataaataaaattagctgaaagttgaattttattaaaagaatatgtagcactaaaagaaaccaataatacaaagcaaaacatgtctttaatacaggcatagtatgatagctttttaggataaagtttcaagttaagtgacaatattttaaaaatcaaacgcaaaactctgtatttaaatgagttaatatacccatgcatttaccctattcacaaacttcctaaaaatgaagatcctcaaacaagttacttttacaatccagtgacaaaaattaactgaactcaagagatgctgtcaatttcaattcccaatatattagtaacaacaaaaacgcatcacacacgttaatagtatttgcctaattttacttcacttaggactttgaaacattttttcctgcctttgacattgttttatacttcatgcttaataaattgcatttactgggaaataataaattaactcactttaaatcacaaaaatatacaactgcaaatcaggacttctgatcagtgtgaccaaactgatttgataaattaaagaaagactcctgatacttaattggtaagctgtgcaaacttgagtttttttaaatattggagtatttctcagcctccgtctttcctcatggtctttatgttgctatcatatagctgtcaattcaatacatagttgtgtgcatatatatttaacatagtaaagatttataattgcttttgtaattactatttttacctatttaaagaaaaatgaaatttatttttatggacatataatttccatgccaaatgaaaagaatgcaatttcataggaattatgcaaactttatttgagagaatgtggggtgattttcttattaatctagaatatgaagtttctttacttttttaatgcaattgatggagaaatttttaataaaagcctaccacaggcatggctctgacactatattgcaaaatcactttacactattcccctatattcctcccacatttttgttttcaacattcctattcctaaaactagaaaataccagagcttcagaaatattcatgggcatcctatacactgtttactctaaaaatactcttagtttttccaaatgacaaagacataagaaaaagttcaaaaagcttttactagtgggaggattacagagtaaggaaattgcagttctaaaaattattacatgatcaaatttaaaattaatatatatctcttaacaatctgtttatgttttgaaacttatttgtgaaagctgttaggcaaaacattcttatgttttgaatttaaaatctaattttcagagtccttcatacaaagtcctctagcccctttgatttgaacttacctgaagaattctagttaattatagaaatttctaaaactgactttgaagtagttctacaggctgcttgtgcttaactctatcaattttcgcacccatggagattcatgcactggggtctccctcccttcatacggccttcaaggaaaaggagaaatatctaacgttgccaccatttaccttcaagcactgacatcattttgtaaacatcagaggaccaatgagaccattactcaaaatccaaacaagttttaaaagacgtaaaactgtattttaaaggagacaacaaatgtgcacaacttgacaaactcaaactctgttgctgagagatgtggtaatgtctggcctaaagtggcttagctacagagtatgtaataaaacagctaaatttggattggaggcccattttgcactgcagaaatgtagtataaccctgggagagccaagtagagagcgactcaagaaattagagacagggactctgtgcagctccccacttcaaggtaaagacaagagctgttaaaaggagaggccccagggaagataggctctcaagttgaaaggtgaagaaaatggaaagaggcgatgagaggatataactgtacatggctgtaacaaaacacttccagtagcctctgtgagttaaaagaacagttcttattaaaggcaatgaaagttgttacttgatttttttttctgaaaattaggtaatagttcattccagcagaaagttaacaaagcacatttatctctcctttaatctcttccaaaatatttttattcatttttttcatatccgtttaccagcttatgattttatacattttatctgtaatattttatcatcctgacaagattttaagtttcttaaaggcaggtaccatatgttatgctattctgtctcatttctctctatgggatatactaactaatacttccagaattggattcatctcagctgtactgatttttttcctccattaaaaaaactaaactgaattgtgatttgagagaatacattacatgtatgtatttatatgtatatatgtatatatatttatatgtatatatgtgtatatatatttatatgtatatatgtgtatatatatattatatatatacataaaaaatatatatatacaaagttccacatctatacttctagtcacatttatcctcatataaattttagaataccagccaggtgcagtggctcatgcttgtaatctcagcactttgggagcccaggcaggtacactgcttgagaccaggagctcaagaccaacctgggaaacatggcaaaaccccatctctacaaaaaactaaaaaatcagctaggcagggtggtgcatccctgtaggtcccagctactcaggaggctcaggcaggagggttgcttgagtccaggaggtcgaagctgcagtgagctgtgaccgcaccactgcatttcggcctgagtaacagagcgagaccctgtctcaaaaaaaaaatggtaataataaattaatttaaaaattccctagcgagaattcaattactttgatgctttgttacaactacataaactgtgtgcctaatgtcaggcttagtttaatttacttgacaatgtaagaaaaaagaattccaaataagtcaaaatatgcagacaaatgacaaatcataaaaattttacactccttttttaatccaccgaagtttaggtaattcttgaatctgtcttccatatttggtgtccactttgaacaacaactgaaatgctctgcaacttgcatatatatttttagatggggctatcttaagtgtaatgcatcaagtgtgacttaagtttatttttatttagctacagagatattttcctttacatttttgagggttggtctctcctggtaaatttccagaataaattttctgtcttgcttttaagtggggcaagattctgacatataactattgtgggagctgaaggcatttctggcaagtgcagtgaatgattgacttttccatttgttttcataatgataaatatatagttagcattaggcaggaaaataagtatttccaaaaatatatgctaagcacatctggtaatgaatggggtcatacagatatatcatgactcccctctccattaggaggtgttcagttccacaaagttcattcactcccacaacagaaaaacaaacacaaaagtgtattcttacttggaaaagaaagaaaaataaaattcttcatttaaaaatgcaaaacactaccaaggcaattatgttttgttggctttctttagtctatgcctcatacaacagaatttcctgtaagttaatactaaccacagtagtgcatagcttgagagaaatattgaagtatattgcactatcaaaataacaacgctaagtgcatttctaaaagtggtgctggcatcatcaattgacatttaacagttcctttataacatgattacaagtttctatcgaagatacagcatcttatcatatggcttattattcttcataagttgtatttagaaaggacttttcagaaaaaaaagtgaaaattgaaaactgctgctgaaaggtgcatttttgtgcagcacttgacaagtaaatatatttggtcatatatgaatatgaaatcaagattcgatgacctttgaaaccatcaaaattaatttaaaaaaggaagtgtgtcattcatccaatatattcatgtgattcttactaaaataaagaacaaagctttgtttacatcataaataaaccttttaataaccggaaagtctaatgttgttaaatcatcccttttctgaaagtggagtccagccttgttttagacttcataatttaatagtatttaggtgtatggaagaaagactaagttaacttgcattaatgggattcttaaatttttctttgtttccagagaagtattcttttaagactgttttcaagccagtttttccttaaatgctgtttggtctaaattgacagtcttgaagtctttcctaaagtaatgtttaaacatctctctggcattccattatgggcacctgctgctgataattacaggtctgtctcctaaccacttcctctgctttatgtcaaagcaagattcaggctgcttgattacaaacaactaccagttaaagaccagtgcacagctctctgcggtaattatgcagggcaagttgggtctgtgtttactgaagtcttaggaaacaagaagcagttacttgttataatttcctctttgctagcagtgtagcataatccacaacatattttggttaccttaaaagtgcttatgagaatattttattcaataacaccttataatgatacatttcactgtactatttccttgtcaaaaaatcaaaatatcctgcccaaaaataataggctgtggtcctaccaaaagaattttcagacaatagtcaattacagggaaacactgggtttaatatgtactccaaaacatatttatttttctttattttactactctacccctgttcctataggcatcctttcccaccacctcacactcacaccattgtgccctgcacgagacttgttgactttatagtggagaaaaatgaaaaatacaccatagggtgatttttggcacaacaataaccccaatatagaacaaaatttcatcactcaacttgaaagtcaatgtattttgtcaatattccataagatagaattctacagttgaataaaaggaaagattctctggcagtactgcagtgctgtttgacttgtacacctctttaattcccaattctgtctttaggtaaattgaccaaatcaaaattgaccaaaccagttagagcccaaccgtgctcttaatgcttacacatcaattgtctggggtttatttgctcaactacaacagaatccaagttcttcattagttaatagtcccaaatcacagggtagaaagtctgaagttagagatggatctctgagggtgaggagattggccttttagctagaatctaagagatgggaagcactcactcctgagatagtcttgatttccacctacaacttcacattcaccttgctctgtctagtaactctcaaagtgggtgatgaagagaacctgggaagtttcaatgaactttaccaacctgagtcctcaaagtccttccaagatgcgttatgtatgcatcaacaaaatatgcattcacccaacatcattaaaaaaaaaaaaaaaatcccgattacattctggctgtgtgccaaaagctgtatcacatcctggagacaccagaatcaactcatcaattcctgtactcatcatgctggcctaccaactggggacacagggaaaagaagagtgctcctgtgagatgggaaaggttgctgtaagaaggggtgaagatctaaactagggaatctgaggaattaacacttgttcatagcaaatgaaagagcttaagcgaaagctgatagtaagtgagcaaggtggcttgtgagaaaaccctaaaggatgtcacctactggggctgcactggaacagcctgtgccaaatttgggagggttcatggtccgggagattgtaatgacagggaatagagtcagagggtagcacaaatactcctgtcagtcatggtaagatgttcagatcatattctaaaggtaactgtttagtaaagctaaaaaaaaaaaaaaggttttaagaaaaaaagttctactgatggtgtctcttagaattttcctgacttcagtgtggaggtttgaggagagtgagaaaggacaggaagcaggaagaaccttcttcagtgaaccagttgagagaaatggacatatttttaaaaatatttaggtaacatcatttaatcattaagtaacaactttattttgaaaaataatatgatggctcacgcctgtaatcctagcaatttgggagaccaaggtgggtggatcacgagatcagcagttcgagaccagcctgaccaacatggtaaaaccccgtctctactaaaaatacaaaaaaaattagctgggcatggtggcgggcgtctgtaatgccagcgacttgggaggccgaggaagaattgcttgaaaccggaaggcagaggttgcagtgagccgagattgcaccactgcactctagccagggcaataagagcagaactccgtctcaaaaaaagaaaaaaacaagaaaaataatatgaataatattattttattaatattttaaatgataaaataatttttatcatttaatgtgatatcattaaataatacatcattaaatataacatcgtcaaatgtttgaatatgtttacattttttgtgaacatgtaaatatgtgggactccaggaaataatttaattctttatttgtttgaataacttggctctctgaattgctcttctacatcctcgatgaagtaatagcaaataaataatacattatggcacaaaataagcatcgttcttgttagtttgaaaacaaaaacaaaaaaggcagtaatcattcaatagaacttcctaagacagtttaatattcagaaaattagtttttgagaggcgtgtttttatttcagaaaacaacacagatatagcctgaaagaagggattctaaatagtctcatattttttgttgttttgttttttcctccctggaaatcttcaaataaaaattcctacaaattcaatgttctaggtagcataaaaccccacataagcagtttaatcaatcattaaaagcattctagttgcttctgttggattctttagatggaataatatcctataaagataaaacatttttataattatgtagggactaaaccatactgttgactgcagagttttaaacgtggaacgttccctacagcacagcacttgaggaagttggggaggagggttgggctaaaaaaataaaagagtgttaacctgattttcggacaaagaaaattacaagtgaatcagttttatagacctacttaaagtgtttcctgtgggggtatcatcctgaagtggtgactgagttgtccttgtttatttagttagttaatgcgtctattacattatgtttgctaaagatccaccattgcattaatttgggttataaatatattgggttatgttcttcctatcaagttgacacattctgaagataagaattttttacgttttgtcttgttttaattttacaatgacacattttaaaaaatataaaagaaatgtcacagtgaaccaaaacaaataagaatgagtattctttgtagctgaaaggttttttctttattcatattatttttcaaaataaagttgttacttaagcaacagtacactttcattttacaaatacacactagaaaacattttcaagtagaactatgatctttggatattttttccattcccttctccttaattacatcatgattaacacatatatgcttgttagaaactatagagtttaactagtctgttcattagtccattttaggaatattttattaaatgcaatatgtgtcagtcaaaacatatatatttaagagtagggtacctaattaatttcttttttgcttatactataatgtgtcccctcgcaaatgtagaactttgaccttgcttggaaatttcagtttaattaatttttgcttttatactagtatcagtaaagacttcgttgtgttaaaatttctgatacagtgaggaaggttaattgtttctgttcctttataaagagtttaaatgttagcaaagggtaaaaagtttgctaactattcttcctgctttctaattatttttgtctttacgaatacagcaaatgtacagtggagaaaagcacaaacttatttttttcattaaaatttatgaagtagtagttttatagaaatatattctagattcagaacctggcacaggaaaaaagaaatcacctaaacttgcttattcataaaactggaacaaaagtgtgttgactttccaaagagttttactgtaaaatcagaatctcataacctaactgggtacaaaaaataatgtgattttaaaacataccaatttattttaagaattttacctttgacaacatgcttttattggtccatatgacattctttcacctgatggtaaccctaatggaatgcaattttgtcattcttatatctaattattttcatagtaacgtcaagtgaaaaatcattgtatagcatagacttacatgataagaataaaacggcacagcaacaattgctaatgtgcattaagtgttatttggtgccaggagctattctcagttcttcacttttgatgacgctgttaattacaattctatgatgtaaatactattattattggaatcttcgccttgaaaatatgaagtgaaactaagattttaacttgtatgcaatttgcaaaggacatattttagcacaatttattcatctttaccaagagacttagataaaggctgccattagtatttggccagtacaggtgtcagatgaatatatttggttgtacatcttaatatttttttcaaagtaatttgattcatttcctatatcaggaaattatcagatccaaacacgcacacacgggtgcacacatacatacaaatatatgcacacatccagtacatttttaattctctagcaattaaagaaagattgagctggaaaaaaagagacttaaagcattcactcaaggaaacacagccatgatatactttaaaaaatgaaagttattaaagactattttaataaaagttttataagcataaataataaataatcaagtaaggatcaatccatactctaatgtgttggcagtccatatacatacatacatatatatatatatatatatattttttttttttgagatggagtctcgctcttgtcacccaggctggagtgcaatagcacgatctctgcttactgcaacctctgcctcctgttcaagtgattctcctgcctcagcttcccaagtagctgggactacaggtgcatgccaccatgcccagctaatttttgtatttttagtagagatgggatttcaccaggttggctaggctggtcttgaactcctgacctcaggcgatccaccggccttggcctcccaaagtgctaggattacaggcatgagccattgcgcccagccactcaatatatttttttttagtgtcattcatacagaaaaaaagaacacacttttaaagttatccatgaaagtaacagtgcattaacagtgcagggtaatttttttctaaaacctattccaaaatctaatgtaataattgtcctatttcagtcagtctggcatcatcttgttattttcaacataattcagtttcataatactagttcatagatgtgtgtaaatttattgtgtggccaaatacaatgacattctttattcatttcacaatagaattaagttttatgcaatacaaaaggaaaaacatatggaaaatagtcacttttaatagatatttgagtctgaaaaaaataaaatgggtttagaattaaaaatcaaagcccatggcttgaactgaggcatatttccttctgttattaatgtttgagttatatgctaaagacgagattattcatcaagtccctcatgcaatatgttagtaaatgggattttggttagtaatttaattgcttaaaccctgaccatgtaagctcccaaatcactcaaaataagcttttacaatggcctgaactgaattaaaacagttaacaacaccaaagagtacctcttgattttattaagaaatgcatgtatgaaaatctattaacatagggggaaatctctgccaccccactacggttaagagtaagcttttccttttcctttctttgctttctctttttccaacaaatgatgggttatgtgagagtttttttttaaaacccatataaggaaatatggacttaattttaaaatataaataaataaaagatgtgatgcctctggttagaatattgaataaataattctgactactagaaagtataatgagaattcaagtgaccgttgtgaaaatgctcacaaagcttatccacaagctattggggtcatatgcttaagcagggctccactgttgttacttgtacagagcttcactaatggtctgataataggggaggggaaggtcggcgtggaggttctcgtaatactttatagtggtgtaagcacgacagccactgattaattactgccctgttctcaacacacattagattactaagcaatctcgtttgtctccacaatggcttcatagttgcagaacactgtcctagagaatatgttaggacgacttactaatgaactttggatactagtgtaaatttgcggtaaaacttcttgcctttcagatgattgaaatgaagattagaaaatattcaaaagatgaaaaaatgtatatataagcaactcttttgggggagataatatgggtgtgtcaaacttcaatttcatttcagacagcaataatgcatcatactactttcaaaaggattattatagtgatcaccttaaaaatattaggacacattcctgtttttacttgctctcttttctaatttcgttactctctctcccatttacacacataacagtgtttggggtggggggagcgtcgtatagtttcaaaatacactgaaaaaccagacactcagctaaaagtaaaaaaaatcacttcactttaaataaatttctcaaagtagctcatgttaatatgtgcttctatggaaacaactctttctgaatgtcagcttaagcttctccatatgatttttctcaaaggctccctttaaaaaccatcactactatttattatcttcttgttatatagactgttacttttgtttcatcacaaatctctgcctgtttattagcagccctgccactactatcagatgacatttgttttacttaatgtatgtagttttagggaaaaaaattatagaactgctattactgcattatatgaaaaaattccaatgtacatttagctgacactgcatcagctgctattgaaactgggcttagctaatggacttttaatgtcagcggggttatgtgcagttactggctattagcagaaatggctcctttctataaaaatcacttttcctcaagtgtgttgtttgaacattcctttccctaatttagtgactgtcactgaatgcaaaacaaactcaaggactctggagtccgctgttatctttaagaccctctttttaaacttgcattcagcattaaacaggcaacctccctcattaggatttagacttgtaatctgaaaactttgtaatgcattattatttattttgctgttcttagcagtgcactacatatttcactatgaaaaccccacatcatcaatgaatggtatatgtatgaaagaaaacattcaaaacagtttgcttaatcctagaatttacttacacactttaaaaatcctagttcaaaaatgccaagtgatatgggaatgtatgacaataataatcaatatatgtttatatattgatgtattatgtaaatattcatatgttaacctgtatttaatacagtagtgaatataagtaaggaagcatatatcactatatcctgaataaaattatgtttattctttctttagtaacaagctttccttcctcgcaattgactttatcttcatccatttaaataaagctttaaatggaagtaatggataaacctggaaataaagccaccaatatggcatatgagggtgtccaagaaaatcaaacataactccatttgattaagagcttgaaacaaaccatcactttattctggtcagagaagaacagtacaactgacctcttcttcaatcagcccacatgagaggtcacctcatgtagggtgcttaccagggacatgctgtctcttccagagagcacccagagaggggttcataaatgtgaagaaaggattttactcctgcgtgcactgcatgcataaaagtcgacagtctcctttggtcaacaaattatagtccaccgtgtaggaaaacaacagcagttctcctccacggctttgaaacaagtcagtgaaagtggagatcccctagtctctgtcacttggatgacaggagagaacttgtttccatcagataagccactgcactaatgagacaaaaacatctctttggaaactggggaaatgacttcgcaatttgccaagagcaaggcaacttttctcagaaaagtaagatataattcttcattcagaaatcagtgattaaatccaagtttcaagtccttgactatctttatgaatttgttttataagttaaaaagttttttccattggtttgatagactccattggttttttgaggatattgccaagtctgtttgaaaatgaactcttgctcctaaaacataaaaagctacacaaacacacacactcacatacaatttgtgtaagcacatatatgctcacagggaattagtgaactatatttgtcttctccttgtcattcttcatttcgttaagaatcggcctggaaacaccctcccaggaaatatttccatatttatttaattcaataaaaaatggcatgtgtatctttcatgtgatcaccacgtctaataaatccaataaaatgatctcctctcccttgctaccgggaaaacatacttactgccaaaacttatcctagccatccttctactttttttttttttaccatgtaatagtaaataaactataatatttttcactgtggtcattttaattctatacagatttatatatgtgtgtataaatataaacaaaaataaaaatgacaacaattcttaacggagtagcttaggaagtagcattttataaaacccctggaggatactagtatagcactgatttaaatctagatttctcaaacaagcacatcctgcccaaatagttccaataaaattcaaacttcttacaagtttataccttttaaatacttcccaaattcttttgctatattaattgaaataagtgcaaatcaagactctatttaggtaaaagtttcaagtcagagggcctgttgaataatattatgatgaaatactgatctagggtctctattccggatagcacaaataaatcatttgaacatgtcggtttttcctcagcttctgagagcagttactcaaatgggcttctgttttccaccaccctgcatgctctgtgggtgatggctgtgggaggcagggcggggaatgtctgagcctccttcaatccttgaatttgatccctaacacatttttaagctttattctttcatcatcttacagaggagatccagaaggaaaaaggaaagttgctaaataaaatgacaggcaccataatcaatgtttcatttagaatgacttcaagattgctgcttgctaaacttgagcacttccactgggcggctacaatgtgtatatttgccaaacactttattcaatgagataaaatatatcattttcccttaatcaaaaacgaaattcaaatgtcaatgtatttcacatagacatacagttcaaagtgaaattaccattatttactttgtatttccaatcataaagtttttgttgtggtaataatttggttacttgtttgattttgattagtaataatacagatctccaaaaatcatgtataataacatagtgctcttttcactgactatcatttttagtttctataaaagttatggaataccactggctaaaatataatctttgatctagttcttcaaagggtttttaaggccatatgaaattccaaaaagatattagaattatttaaaatattgaatttgaatacaagtaacaaatatgcaaattcatagagaatagaagagtcccaaattgctccttttacctttagtaaaggtaaagtagtccccctgcttatctgcagttcactttctgcagtttcaattacctgaggtcaactgtggtccaaaaacattaaatggaaaatttcagaaacaaacaattcgtaagttttaaactgcatggagctctgagtagcgtgacaaaatctctcagacatgaatcactccttcatccaatgtacccatgctgtatagactccccacctggtagtcacttagtagttatctcggttatcagatgaaaaaaaagcagtgtagatgggagttccatactatctgtagtttcaggcatccattgggggtcttggaaagtatctcctgcatttaaggaaggactgctgcacatgaatttcttttacttgtaattataagtggatacttttatatcacgtaccccattagattgcactaaacttctattatctaagagaatgtattttatgaattaatttaaaatgatcacttttatctacaaatgctgtgctttacttctgtactacatatttatattttatattattatatactctaagtttttttaattttgagaaaacctgcatttctatttatggatatatttctatttatggatatatcccttacaactggactgtagatgcattttaataaacaagcactattctgtttttattggaaagaaatatccacatataaggtggttcttctgaacagaaataaaaagagagaaaacaataaataagaatagagttcaggcagtccatgattaaataatcaattaagagattgactaaaactgagaaatactagcatgcatcaatgaacttgttaagtgtgctgagggagtttctgttgtttcacatcgtcagttagaagaggatataatccatggtcatctacatgaggcatttttatagctctcataattgctgagaaatgaaactagccacaggatccacatgacaacatgattaatgaagataaaaccccctatcctcacaacattttaaaataagtaagactggtaactctggtgttaaatctgagtaatcaatatcatctgttaatatgattattgtgagccctggtatttaaaataagaactctaacaggcatatctatataatgaagtttcacccggctcccctcacgctcacattccactaccacgttggcaataagatgtgtttagttatttaactaaaagagggtattcaccaaacatggggattttcagatgttatacttcacttttgccacacaaggcacttttgaatcactgctcattgctaataaaagctatactgacctaaggacaaatatctgcatatttggcactttcaaagctatagctcactttctaaattgtaacttcaacttaattaatgtcatggcaactttaacactatgtactccatgtagaaggggaggtatgttttaaatacttataaaatctggaaacattcttctgtgtatttcaaaatctcattatatatgagcaacattttggggagcagcaatgctcaaaacaaaaaaccacagtacaacttcaacacaaaactatttttttaattctgaaatttcagctcaatattttcaaacatattgttcataaagagtccaaatatctgcaacatgatatatgttttgggttttcatgaaaaggcagaaattcttctggtggctccatacaggtagacaggataaaaaaaaaagttttctatttctgatcttgttagctcataaaagtgttcctataaaatgtttttattaaaatctctgtaagtttgaaaataacaaatatttaaaataagagaaactataaattatcccattactaagtttctttttttaaaactagaaaaaagggaaacactagtgtttgaatatcgctcaaggcaaacttactctacttcaaagtagcattaaaaaacagcaccaagtttctgtgagtaaaacatccttgagctaagagatactggaataataccaaaggtctcatattcatgtagccctcctccacaaatacataagcaataacaaatccaagtaagaaatgaaaccaaagaagcatccatacataggtttaagaaatcaggttaaaaaagaaagagtgcagaaccagaaccaataatagaagcagaatgacaattttgtaggagaaaaatctaaaccgtaagtaatataaaatgccctacaaatctcttattttatctcaaaagtctgacagaaaacatttgctccaaacatgcaaagaatggcaataaccattaaacaataagagttagatgcaaatatttcaccaaaatatatgtcatctagattatctgtgctgttttaaattaggataacgaaacttcctattgcaaatatagtttgaataaatgaaagttctggtgaattttctttgccttcgtgttgacctatttttatgtttattttgtttgaacagaaaaccaattatgttctttagagtatatacttgtgtccattttcttttaaagaaaaactgtccacattcacataaaggtctgattttccccaaacccttatcagaaatcctggggtgtaccttttttctgtaatagtgttcatggatttatgaaaagttatctttcagtatcccttgagaaaatagaaagtcaaggacgagcttcttgcaaggacttaactgggagtgacttaacgtgtcatttttagaactaatattaggttaattttcccagagagaacagaagggaagaaaagagactgtggaagggaatgagattcccacaggctgttcagagaactgtactctgtccaggagtttacaatgatctactccgcagcatctcttcagatagctccatttcttgcttttggggaagcagtgtcagcagctatcatcactctgagttcaaaattattgacctttagtttcttttacatctagatttctttgccaacggtttgtagaattgaaagtcaaggaataatacttattttctatgagctaaaagctgctctaattgtaacctgtagtatatattatcctcatttttacatatgaggaaactaaggcacggaaacgttaaatgtcttgctcatagtcacacagctggaggtgctggaagcagtattaggaaacattggtaatcactatgttaactgacagaatgggcatacaccattaacagctcttagcctgtgcctccccagagccagatgaaacttgcattaaatctaagtaaaatgctgttgcaacgcaaacttagcttcaagaacatacaacttccagccaaatcactgctcccacgttcttctgtgtagaaattttagaaccccccacccaccactcacattagaatcctagcttcacctatgtttactatcttcggatgtctgaatccagaaagtactatacctgtgtccgcttttatacttaagaaagtgaattataattccatggttctacttctgtcttcctgtagggcttaaactgcctggttacattccgtttctaacaaatagcattcagcctaggatgcaatatgagtgcacaataattgcttaagaactttacttctaataccatactctatccatagaagccattgtttctaatttgtgaggaaatgtgaacaggtttgtttttaactgccacaaatataaaagtcaaactaaaaaaatatgtaggctaaaacttcaaggcaatagcactggctcaatctcaacccccacaattttccccattatcttcctaaagtggttgcagcctgtaattttaatgtttcttctgagagtgactccctctgctgcttctgcaaagccatgacctaaatcagaaaagtgttaaacgcagttaaggcctaatagagcacacttgctgttggcactaattggagaacctagcatacattagagaacagttatgtttaagtctcaacaataattctaaataagctaacagggtttacttagcagagctcatgccttgttcatgtccttagggggggttgcttaaaatagacccatacaagttctgactaggacaaccagctccaaactacaataggaggtgttcgaggaccctgtcttatttaactctttaccctcagtatccagaatacaggagtccagggagtcaataaatgtcagttataatctaatgattcctaattctttgcaagtgtttgaaaagtttattctttgaagattttaagcattctctaagctagaatacacaaaattatttttctaaacagaagtaaactagcctacttttccttattgcatattcctaatgtgaattcataaactttctgtactcctacaatgaaaaagtatacgatagaattgtaatgaactttagttgtcttcactgttgactgtctatttgtaccacaccaatatgcaaacatgcataaaggaatttttactcttttgtaggaagacatatgttatttaaaaaaaaaaactatgaattaagataatagggaattatcccaatctaattagagacttcagtaattttttgtcctgagtttggtggtgttaacactcataacactagttggagctagataagcagcatatcaatgctgtgtagcccagataaaatgcatttataaaccaggagggtcctaattcagaagcacactgatctcacacacacgcgcgcgcgcgcacacacacacacacacacacactgccttttactagtaaaatctttcattcttggaagtcacaaacactacaaattccctggagctaggagttcccagcaatcctgaatgaaacaattagggcatagccagaaaggagaaagttgttgcctacagcctagagaatttcccaaggacctattgaaaatgactgctgcctaaaccacagttacaaaactcagtacactcacaaataatgcctattctatgttttatcttaaatatctgttgtttccttgattatctctgaagatatatatacatacttctaatttttgcagtacttcagcaacagaataaaaacctcatccacattgtaaagtgcttaaagtaactttcccatgttaattgctcttggactttcattcataagaaatagttcatttggatctttaagtcatcaccacaaggaaatcataccttgagggtatgggctagtgttctagtccaaggaaaggagaaagaagaagaataagaaggaaaaggaggtctgactatcagaccatttataaaatgtgtgattctgcaaggaaagtgttaacggtggctcaagataaacaggctgggttactgtactgcagtgatgaaggtagtagctgatagtggagtttggtgctttatccttcctttgataactaacagacaacacaggaagagctgctatccctggaacatggaggataacaaagataaaagcggtggaatagtgcattttacagaccatgagattcaaacaaaaattttactaatcaaaaactgaaggaactaaataaacgaaatggacaagaactgcagtgaaatgcatacacccaacggagtacattttctttttccacttaagatgagaatcagtccccaatctttaacttgcctacgctacaaaaagtgcaagagaaaaagtctatcctaagcatcttttctttttaatctcttctcccttcttctttcaatattaatccatttacaatctgctgtttgattatctttattgatcctttttctacccagtctttttaatttggttattgtaagctcttagcaggaatcctatctcttgtttggcatctttggggactttaacttgtctttttcccaaacagttctctcaccgtgccccgtccccctctcccgccacccacccccatggctcagtcctttgtatgcccagtaacagcaggcgaattccacagggagtcgcgcggttgattccacgactattcataaggttgttcacttaagcttccaaacacccccctctaagcacccttggctagcgccctgagaacttcttatcaattttaggaaatccacaagctatgattctcggtggagattcctttttaaatagacagacagatgaactctggaggtgtgcataagaaaaccagagcagaacctcagggatgggaggcatctggcgagaaaggaaggaaggatttatgagcagggccacttagcagggcagcaggaaaatttacttccgaagaagctatcgctaattcacaaagccttgctaatcacttacctctccacccagaccgcactcctatgctaggcgctctcctccgcttccaacacccccatccccacccccagcgcctctctaagatcagagggaatgctgtccggaaaccctagggtgtctgaacatcacctggggagttggggctatcgtaaagcctccctttactctccaaatttggaaggaagagtaaccgagagtgaagggagaatccctgaattgcctctgaatgctgcataagcttccttcattctctcctcttccaggaaaagctgagctgcctcgcctgagccggctatcaccactgaagtgggctaagagacccaagtaggagctgggcttggccagaagttttggggcccaggtgacctgaaagagaccccggaggggacagccttggctctttcttctgcgctcccttccagtcagctttcccggctttgaaggctgggagctgctgctaacacttcaaactaggcggacaagaagggagccgggcgatcagctccggagcctcccctcctcccttacccatccccaactcccggccacactcttcccaacccggcttcgcccagggccccggtcacttatgttaaagttcacaggcgttaaattaaaatgtcagagttataaactggtcgactaccccggggagtttcggatttggtttgaacaagcagccggttcccccagagctccgggattttcatttctacatcccctggtgggaagcaggcatgaagcggggtatgtatgagtgcagaggcatgcacatcccgggcctgcctccagccgggtacgcggattcgggtgagctgtgtatttccacagcacctgaagcagcaggcgagggggacgggtgcttttgagtccttgacagtaatggacacatttccttagctgagcgcccttcggggtctagtgtgctcagagactcagtgaagatcctgctaccccagtcttggcacagcgcggggagcctctgcgcatcatgcgcttcggggtgcatctacggtatgtcacacagccacccgcaccgagagtctttccaaacctccgtgtgtgcaatatgcaacaacgtgcgcgtgcggagctgaaagggcacaagacactccaggctcccacacgtatggagacggatcggctgcgtgtccacaccccgttcgtccctggtccattcgtgcccatctcagaagatagattaaacataataataataataattattattattataatcaaagcttcttgactagttgggaaagtggaatttagagtggtttccagttgaaagcaacgaggcaaattgaggaagtcaagagaactggggaggaggagaggaaggagggaaggaagaagctaagggaggtggccgcggagcttggcggacccccttaccttgggcggcggagccagtgccgctggcgctgagcagggccagggcaggtagcacgagcatttgcagcaagtatcccagtcccagtccgcagcgggccgctgtcgcccgcagacctttcctcatcgtagacagaggtgtgccggggggaggggagggggacagagagacgcgcaaacagctgaaagccccactgggcagaagctgaatccgtgcaccgcgaagcagtccgaagaaataacgacaaccaagcgccacactccactttctccaaaggcaggggccaaaagggggaggagaggagacgccgaggaggagtttgaaggtccctctttcccaatgccttctaactgacgtctcccgcgagcgactgctctgcccccacttgggaagtccagggaggcgcaaggcggccacctccgccgctccccccagcagcaggagcagccgcagctccgccgcacgccgaagtctggactgctctccgggtcccctcgcctgtgaggaacacacacagacaccgggggtgggggtgggggtgggggttgaagtggggggagttggaggaggagggaacggagggaggaagcttgggcaccgtcaggcgctctggtctccaatctcagtgttctcacgccggcggagagatgtcccggctgtcgctgctgggtggccaaggaggttcacatcctagagtagggcgcacgggtgcgcgaaggcgctcgccaaggaggcgtagagggcgcagcacaactcctctggggggtaaccgggggcgggagcacgcccgcccgccttatgtaagcaaggattgcagggagatcagcgcccaggagaccagctgtgggtttgcccgctgaagccgaggcgagacagaccaggggacgaagcggctgcggagagtggcagcgcgcctgcctcccgcggtgcgccagacctggacgccgggagtgcagcgggcgcgccccgggccactaggctgtgtccagtggagctcagcctgccgcctgccaccttcttcgccgcgccggcaaagcctcagccgaattccctaggactggactcggtctacgacttcgggtctcgcggttgacgaagccggtgcgggctcgaactgaagtccttcttggttggggaagaaggcatgaagcttttgcactgccccagccggctgctgtcctggggttgtcagcgccagtcagactgctttatgttctgagcgcgtatgacccctttgcagtggaacagaaactaaaagctcgacggaaactcattctgcaacagtgctttctttgcgtgcatgttggtggctgacaagggtggtgatgcgataccgagagaaactctcttagaaaaaaaaaatgcaaagcaaaatttgtagatactcaaagtgatggtggagcctataacatgtttttcaaatttctaatagtgtgtgtaagaactcgagctgctatgaatttgtttacctttctacaggaaataattgtctacgtagctgggttgtgaatccctgtggtcatgatggagggatgcaagattgggtgggtaaaataagactagacaaaaggaaagtgaatttattaaaaggtcaacacacagacacagacaacattttgggaaaaagaaaatcacttcccaagattagcatgtctttaaactaataatacatcagggaattttatgctcttggtgccaagggggccatgtgtaaacacgcatgcacacacacacgcaggaaacatgaggtctaattttggctgtggtcataactactctgttaccctgggtaagtcaggtaacctgtgaatgtctcagtttcttcatttgtgaaatattttgatagtttcaaagttctcttaagttctaacattctatgattctgcctgcacagccccatctaggcaataagacctatctcggatgaatcagggagatccgaaaaggtagtatttgccaaagacattgacaaaactggccacttcttatttctgtggagactctgtccaccacacaaaacccttcttcactctcttcatcttctccataccaagacatcaagatatttgacaacagggtgggtgctggcaccagactgtctgccttcagttcttagcatttcttattacttgactgatattgaacattaaagctaggtgcctctcttccctaatttgtaagatgggtctagtaacaggaactatctcatagggttatttgaggattatgtaagttaaacatatgtaaaatgcctgacgccaaaattgtaaactgctgttcttaccattgatgaaaaattcccattagcctcatgctatctacaccagtgctgttcagcagaaatttctgcaatgaagaacatgttcatatctgtactttctgaggtcgtagttatgagatacatgtggctacttgcatgcaatgtggctagtgtgaattggaaatttttatttaattttaatttaaatagtcacatgtggccagcagctaccatattttatggtgtatcgaggccactaataacttgtcaagtattttgagaatgacttcacaagggattattattatactttatatttatatgtacaattttactaagaaggacaacagcttaagtactaagaaatctccacacatactcaccatcacatcaacgacatccaaaagttatttatttacaattttattgcctgtcttcttaaattagaatttaactcttttaagacagagattttgcctttgttcattatttcaaccacagctcctaaactgagcctgatatatagttggtactcaatcaatattgactgatttcctgccaaaaaagctcaatggggaagactcctcaaagtctaggacagctaaagaaggttgaaattgtcgcctactcctgtttggggtattgaggtactcagtgacagataccacatgcaattagttccttaaaataaagaatacgagattaaaagaggaaatgtagttaaatactgaaattcagcctaaagatggcaggagaatggtttgagaagtggtatagagtaatgaggtggaaaagggggaagagagtgagagcaccacacaaaggacaggaaaaacaccagcaatacatcagctttacacagcaggcaagtttcctgctctctacaagtacagatggaacttgtcttgtgaattaacatcctgactacttttgttgatcatcacattttttcctcatgagagaaataatagtgttttataggctcctgagaataggtttactaaagtcatcgagatctgggttcaaatgacactgcttagggaggcattcactgatcaagttacctaaaatagcaacaatctatcatccaaaatatcatttgccagctttgattttgcatataacacttactttatatatgtacatatatgtgtatatatatatttgtgtgtgtgtgtgtgtatacatgtatatatatatgcagtctgcaataaaatgtatgcttctcaggggagaaatttttttctaatacattcagtgctctatacccagaacctggaacaataccttgtacataataggtgatcaataaatacttactgaatattgaatggattgaatcagaaccaatggatttaaaattgagctaagtccttcattaaaccttcttcctctcctcttcagcctctcaagttatcaaattatgagtaggcttttctagttgttgaataaaatcaagttttgccaaattttcaccaaaaatttattggaatttgactttttagggttggaatactgcaggtgtttaaggaacagacaggaaattcatctcatcttgaaaaatgaaaagcttcatttaaatccatatacaagggctttctttttcttggctgcagtgagtggagaattaactctaggataataaatcccagtgacaggtgctaatgggaattaagcatgcaaatcccctgcatatccctccagaaatctacaccaagaaaagtatgctatttagcatgtaggctgcttcataataatatcatttactcggaactagtactgaaaaagtttccagtttaaagcttaaatcaaaaacaattgatcatatattttaattatggaaatattttctttcattgtatctctctccttatatgtttgattcctcactttttatattttttgtgtaggtttaaaaataaatcttcataccagggatattattaactgcattaactggcaacataggagaaagaggattttagtgaataaataggatggtgatgaggaaaactcctttcctacaagttgggagttcagagacctcacataatgttactgatagacatcaacgaaggagagccagatggtctagattcagttgattcaatcctccttccctgccttagcccagagaaagagatttaacttgtcataaaccaaaactctctagggctttctgctttttattaattctattagataagacccatttggttgcaagtgaaagaaacccaactcgaaccagcttaagcaaaaagataatttatcactgtgcataactcaaaaactatggataagaaatatctatttaataatagataccatttactatcactcactgtgtgtcaggcactttctaagctctttacatgtgctatctcatttaatcatcataactgaatgaaagtgccattattatctccgtttcataaatgaggaaacagagtggttatgtaactttgcccaaggtcacacacagttagtatttactagcgacagtctgatttgagggatgatgtcttagacccatgaatttaaatatcactcatgggacttagtacttccccccaccctcaatatcttggttatgctctcctctgttttggtttcattcacagacttatgatctccatcctgggattcccagcagctccaggtttacattgtctttatcattgtcaatctcaacacaaagcacactcgtttccaaatggcaaaaaataaatacagaattatggccctggcctatcttgggccacatactcacaactgaggcaattaccatggccagatgtttggcatatactgaatggcaaggcctggtcatgtgccaatatttgccaactggaaacttggattgaaaatggggataaggggttctccaaaaggatacaatagaaaatgattaatacaaaaaaaaaaaaagatgccaaagagaatggatgtagggcagacaaaataacaaatccctattctgtggtatatgaggcaagatgagttctccaggcttttgtgcaacaacacatcactgtagcaaaagaagagcactagttaagaaaggctgaagagcagccagccccctgtggattgcttttcccattaactgactggaagaattaaatccaattcaattcagaaaactttcacttcccccctgttatattgtggttccactctaggatccctagggaaaaatatgcatgaggtatagtccttgtgtagcaatggctcagaatcttacaggcaatataaatgaataaacaaaaggattttaaataaacacaaaaatgttgtgggaatataaggatatgggagcctgagaagaagatttacctaaaagtaagacacacacttgtgtatcagcaatactgttcttcacacaatgggtgtatttatctctaacgataaggaacctgggagtagacagtacatggccactgtggaagctcagttatgctcttttcatgtcttggctccatgctccagaatgtacagctttcattctcacagttgcttgatagcttttccacctccaggagtcatgtttcacttttcaggcagaagaaggtggaacagtcctgaggggctgcatctagcctagatgccttccaaataacttttctggaagccctcagcccaagtagtttccatttccttgacggtctgtcaaatagccccctaagatcaatcacaaatggtggataaggagaagggtgttgtgcatgttggccagatcatctgagttggacacaactctgttggagaggagcaacaaggggaaggcacagaaagaaagacattaagacagggcatttgagggtgtatttgaagaattacaggtaaatgaaaaatagttctatagttggttgagaaaaaaaggagaaaagggaggaaagtgttttcttttttcttttttctttttttagagatggagtcttgctatgttgcccaggctggagttcactggctattcacaggtgcaattatagggcacgacagccttgaactcctggcctcaagtgatcctcttgcctcagtctctggagtctccaaaacaggggaagggtgagtgtgttttctatcacattgggaaatagaaagatggaaaggactccattattcagttcactaaagtgtatttactgaacttttggaaattgtgtagcattgaggtagagtttcatggagtttatagttggactgtagaaataatatttataaaaaagaagcaaagcaaaaaataaagaaagataccaggaaagatggagaaaaaagaaaggaaagggagaaaagaagaaaggatgcaggggacaaaggaagaaagggaaagaagaaagacaaaaagaagaaataaaggaagagataaataaaatccagtgtgatttctgcattggtgtagcatgttgtaactgctattagagggagcaaacaatgaaaaggtcaataaaaacttaaggaaaataatagaatatctaatttagaagagtattactggggatagagattataattattgcttaccagagcttttctaatatctcattttattttaaatttatctgccaagttagaccatagtcgtttttctcattttacagatggaagaaataaaatacataatggaatggtgggaagactccggatcaggaaacatgaatttaagtctccatttatctaagttatttgctcagaaatccctgtaagttctttgcacgtatttgttataagaaatgataacaatatgaatgcacaaagttcctgtgactataaaatctgtgtgaaagtgctttgtaatatgtctatactgaagatgtcattatggtaagatatgctttacattgtctattgtacttaatttacataatcatctgaagaatagtattagtgatgtggctttctatacatgaatgataccaccctagtataacctctggagctattctcagtatctccctcctttgcccacatcacctattcaattactattttataagtccattcaatttcactacttaaagggctacaggatctatcccattatcaccagccctacagactcacaatatatttgcttgttaccgagaggtcttgtaattatttccttagtagctagtttgcctttacattctaatccatgctctccacacctcccagaaagaccttctaaaatgtaaaacctgtcattttactgtcctaaaatcttattcaatgattcctcactgccccagacctgcttttccaaagaccattacagggaactcctgtccttaaaaaagcagttctagaatgaacagaggatgataggttgcagtattctttattctttactcctttccagttaatagaattacccgattatttcctttgcactatgccttgcaggaccacccactgcactgtgggtcgtactggcttcctctctcactgatggtagcttagccatgggacttgctttggccagtgatcttgggcaggtgctacagtgtgccagttgctcccattgcatacctctactcattttcatgtgctctcaccattagtcctaaggcattagaacattttccaggtaaccaccaaaccaaggtggataagagacacatggagagatgggcagcctggagccttgtgcttgctgtgtggagcccagagcctgagttgcatcagaccaaatgactcatgagcaagaaaaaaaaggtgcttgtgttcagctaccgagttcagggttaattttttatgcagcactgttgcagcaagaggtgtctaatgtgcctagtgtgagaaatcgtgtcctcagattaagctcaagataaataaaatgacaatctccctgatagtattactaagctaatagaaaataagacagactatagaactaaataggctgactctgaaaagtgcggtgagagagttatagaaacatcactatgggagatgagaggaaaggacacttacttcacattgaggaatcagtgagatcttaagtgaaagcacattagacccaggtcttgaaggataaatagaatttgcttttgctgagttggggagaagaaagaactggagccacggcaggcaaaaggagcacaggaatagcaaatactgagtgacttaggttggaggccagaaagcatcatgcttaatgctcttatcattatcattatataaattataattgttaacatttttgaacactcattaatcaaacacgttgttttgtataaagagagatattcatttaatacacacaacaatactacatatgaagtggtatcattattatcctcattttaagcatgaggaaattgaggtttatttgggttaacttgcctatgctaaattagtgtcaacttaggatctgaagttgaatttatctggatgcaggcaaatactggcaggaaaatttggaaatgaagatagagctattttttcaaaggtgttttgtggtttgctaggaagtctgtcccacattatgcatagaataggaagtgaccaaaggtctttgggcaatgaggtaataacatgaccatttcttgcagcaatgtgcaagctggactaaagtgggaagaaaaatcatggagtatccatttaggagtatattccaacaatcaagatgagaagcagcgagagcctggatgtaagtagtagtaagcagaaaatgagtgaaggctatatatacaagatgccggattgggatggtggttactactgccagaacacaggatgagaaatttatgttattaaatattcatgatataattaagaataaactatgtaaccctgaaaaactacttgtaacagtaagccaccctcaacttaattaaaagtcattaaagaattaaaaataagatttaaaggaaagtgggacacattaatttcttaggattactggtgttcattgggcctttaaatcgtttattcaagaaatactgtaatgactcaccaacattttggatatatagccatattatttgtttctcaaagtccctaaaactctacctggcacagagaaggtaatcaataaatcttttaaaaataaataaataacttaaagtaaaataataaataagaatattttatagtatgtaacctaaatcagtcattataattagaaatcttttactttcttttttttctaaatttacttataactttattgttagaaatgtgttgtgctttatcctgcagaaacatgccataaattatggtttggaattcagcccacacaatcttgttaatcatctgtcattatgtggaaaacaatgctattacagcatatataatccaatccaaatataacttaaatgaaacaaaagcaaaacatttgatctctatacttgtagaaaaaataaagaagaatgaggaggaaagtgtaaagtttttaaggagatttctaagttcatttcatgttatttccaacaattccaaacgtgaagcccctcttcttgtttcatgtctaatttcaataggaaatagaaggatttttttttaacataggtgttgcactagtgctaactagccttatgttgatcatagttgttttttgtttgtttacggtatgttaagaaattaaattaaaagaacaaagaaggtaaaaacggaaataaatttttgtcatcacatggaggaaaacaaatataaaatacagagaaagaaagaaggagtaaaacaattcaagggagaattttctagaggtattttaaacagaactgtgtgaaatacaagtccccaaagaatgagatgaagttaaatagtaaggaagcaatagttcagataatcacccacaagggccactaccccactagccaagaacagccaggtattatggagcaggattcagtgggcgatccaacactataatttatgaaaatattacaagttagatatttttaagaataaatgccttgcaatgatttgcctgcttgtttatatatgttactattctagacttttagctagcttctcaagaaggattttactgtgttatagtaatatttaaatcatcatcacctactccaatgca

SEQ ID NO: 565 - DNA, 32106 bp, Homo sapiens
aaatcctggctctggctcctagagataggaagtggggtagacacatgaggctgcaagggtcaaacaagtggggaagcttccctacccccgtgtctggcaaagattggttcatctgaagcaggaagtagatggactgacagagatgaggagatgaaaggttcccagtaccagactcagcagcaaacgggaccctccacccccacaatttacctccttgaagtcagtcctctcaatgaagacaatgggtgcaaagggaacctgatggaagcctttggtctcatcagctgggaagttgggcacctggatgtccaaggactatagcaggagacaggagacaggtatgagtcatactcagcattaggacccccatgcccagagccaagtgtacccccagctacacacacacatgtgacacacatgttgaggcaggcccaccttggcagcaggaaagttggtgatgatgacccgtagtgactccagcacagccatggctcgtggggctgtgtcattcagcacatcacgcacacaggcttctagaagatgtggctccattgtggtttgtgccacagtcactcccacctggcaggaaagttcagcatcagtcacagctacaatcacaaactgccacactcaacccccaatgtatctacccaacctgctgggctatacccgggcacagaagttgttgatggcctcaggtgggaagccccgccgtcgcagggccgtgagtgtaaagagccgtgggtcatcccagtccctgtggataagaaggtggtgagaaggcctttgggagcatatgccattaacctttcataagccaaacagccgcacctaccgcacagcaccagttgctacaagctggaggatcttcctcttagagacaacagcatagtgcaggttgaggcggccatactcccactgcacagggcaatagacgtccagtgcattgcaaagccagaagtaggaagagcgtctggggtgggagagtagggttagcactggccagctctggaaccaggcagagaccacaggaagggctgctggaattccactggccctaccaccccatggacccagctccctcaccgggcctggaattccttggtgcagagtgagtgagtgatgtgctcgatggagtcacagaggcagtgtgtgtagtcgtaggtgggatagatgcacctgtggggcataggcagtgggccctaccatccagccctactctgccctaccccatggcccatcgccctgctcggcagccccaccaccccaccccattctacacccaccatttgtcccctgtgcggtggtgtggtgtatacttgactcgataggctacagggtccatcttgccatcctccatcaccagcttcatccgtagtgtggcctcgccctctgaaaacttgcccttgcgcattgcctgaggggaacaaggactcaggctgtctctaagcacaggagcatctcattctcagcaccttggcccacccaaacccagatgctcctctaggaccccacctcaaagagcagcagtgactcctccatgggacggtctctccagggtgaaggcagagtattatggcctttgagctcctctcctcgctggtggcacacataagccagacccctgtggggaagcggtgtgagtgcccagcatggctgtgacctagtcagtctgcctggctctacgtcatggccctggccttacctgcggatgagctccacagcccacgcatatagctggtcaaaatagtcagacgcatatgtgactttgtaaggtgtgtagcctggggcaaaatgaaacaaagtatgagcagccagccacaaacacccagtgggcaggccatggcccaaggagaggcccactaaccaccagcccttctaggctttgcctagtccatacctagccaggctaccatgtcacagatggccgtgaagaactttgcttcctccttctcagggttggtgtcatcaaaacgcagaaaacagatgccattgttggcctaggaaagttgcaccatctgtgaactcccacatcatccatcagccccacaatcctgtttatcaaactaggatattcacagagcactctcatgtcagaattttctttttttttgagatggagtcttgattatcttgcaccatcttggctcactgcagcctccacctcctgggtttctcctgcctcagcttcccagtagctgaaactacaagcgtgtgccaccatggccagctaacttttgtatttttagtagagatggggtttcaccatgttggccagattggtttcgaactcctgacctcaagtgatccacccactttagcctcccgaagtgttgagattacaggcgtgagccacccaacccggactcatgtcagaattaaaaatgtcttcaagagcttctctcaccttcctgtatctaacctagcatctttctaagcctagggactgcactggcaactcccccaaatttgaactcactgactcctcagagggagggagctatttattccaataagctcaatagattcctaggtatctgtcacacatgtggttcctttccatggcctctgcccacctgggtacattattgggagcagacagcaaggcagggatatggtatccactcatgggaacagcaagtggtcatcttgcttgccaggtccctagacacatgcttaccttggcatagccaaagttgaaattgatggctttggcatgtccaatatgcaggattccattgggttctggcgggaaccgggtacgtacctaaaataagggggatgggaaaagagaaataaagtctgagctcagatgaccttaaagaaacagatgttccctcccaggaaggccatggtgatgggtgagatggggcagtatggacgcagcccaggcactcaggcaggtgtttgatggcacaagctcacatggccacatccccacacacctgcccaccagtaatctccaggtgctgctttagtagattcatggtgtgtggagtgaccacatagcctggggtcttgtagttctcacctgccaggaccagaataagcctaaggaccaggctgcagccaaagcctctgaccccaggggcctgactataggagctgctgccaagatccagccctccccagggttttgacatgcccactaaccaggcttgtggaacttaagggcctccccccggagctgctccatcagagacagggtctggtcagcagtctcgcctgtggggaacaaaacaaggaaaacttgtcctctagatacatttaccatatcctacagccagaacagaactgagtagacccctattccctcaattccagagacaagatatctagagccagacatctgaggcctctcatgccagtctctgggcaaagggaacaaaagaaacaccaggaatcccagtcttgagacagaagtcagggtactgagtaagccaagggcctgaggagcctgtaaggactcttctgaggaggttcagaagtcagggagctgaatgctgtgacaggagtctcaagcttctcaccattctccaccacatcctttgccgtcctccggtctgtttcttctagccgagcttttgccacctgaaagaagccccaggtgcttcagaaaatggcatcaaattttctcttggatagggtcttgggatccctgtggtcagacacttccttccccagcctgaagtctcaccatacctcacctcaccctcagggactcagggccatgcccatccctaccttgaacttcttctccagatcagcctccaacttggggcccagaaggtggaggacctgagcagagaccagaatcaggcagaggcaggagtatcctctttcaaggagcccctgactgatcctacccaccaacccaaggcttcctggcctatctaccagcactgactgaaaaaacctacctagcccatcccatctcttctcatgtgggtctgctagcttaaaatgctcttgctcttgttgcccagactggagtcttgctcatgttgcccaggctggaatgcaatggcacagtctccgctcactgcaacctccgcctcctggattcaagcgattttcctacctcagcccttctgagtacctgggactgcatgtgcccgccaccacacccagctaatttttgtactttttgtagagatggggtttcaccatgttggccaggctgttctcaaactcctgacctcaggtgatctgcccacctcagcctcccaatagtgttgggattacaggtgtgagccaccatgcccagccccctcccacctttttttattgttgttgattttgagacagggtctcattctgtactccaggatggagtgcagtggtgcaatcagagcttactgcagccttgatctcttagattcaagcaatcttcccaccacagccccacaaattgctgggactacaggtatacaccaccatgtctggctaatttttaaattttctgtagagaggagttctcaatatgttgctcaggctggtcttgaactcctgggctcaagtaatcctcctgcctcagcctcccaaagtgctgggatcagaagcgtgagccaccatgcccagccctcttcctgccttttatcccttagtggattccaggctctgttcatgccagagtctttgccagcttcagcttagtgaagcacgctcacctgcatgtccacttcattcttgatcattttgccatctgcccacttcagcacagcccgagcctctcctagaagcataggcacaaggagctgcagaaaggcaaaaaagagtactccccccacctctttcccaaggaaaggtcctggctgaccaccagaaccagagcctgagcccagccagaccactttaagtcactcctgttccttcccccacctccttctcactcgtgcccagaagaaaaggcatgaccagagagaacaatatagccccgttccaggccctgctcacccatcagcagccccatgttgaaatggtaacgttccaccaggagctggggccggtgcctgttaatagcagcctccacctgcagaaagccaaaccatgtggttcaggaaagccacctttagagatattctgggaacccacaccctcactctgggtcttcctgaggagggaaactgagccactcctttccatggccaggactggggaggcagacgatgcctggggaaagactcacagcctcctcaatctgctctggggtcacaatgacacccacgccacattcccgctcgaagtccacagtgtcgatggggtccaaggggtgactccgcacatactcaagggcagctgagaagaaagagcccgtgagtttgtggcatctctgctccaagaagtggacagacagggtcctaatctcatgaaactccaaggatagtctggcctcctgaaaagttaagccctggcaccaccaccctagagaacacagggaagaaagaagcacgtgtcgagagtggatcccccctcagaccctgacagttcccgtgtcagtctcaccataggccaccccttccatgcctcagtgcctgtgcagaactaggtgtctagaaagaaactggaggacttggcaaaaagggaagacaggggtcttggctgaagggaggcattggtgcgaactggcaggacaggtaggggtctcaccgcttagctggggctcagtgtggatcttcttactggctatgtagcttacaaggaaggagagacgccgggtatccctgagtcgggaggccaagccatataacaggatcccggtagctttgtcaatggtggaacccagggtctgctgagcctgaggtcagaggggtcaagagagaagccccgcgctcagtgagaggaaagggcgggacaaacggggcaggtcgggatctggaccccgccccgcgctgcgttgcagcatggtctgcaaaccaggccgggggcagaggggctcgcacctgagtagcggcctcgcgcagctgcgcgctcagagccgagttcttgagcgtctcgcgggccttctgctcgctcaggccgaggctagtgaagagcgacagggagtctagagccgccattgcagagacaccggaaactaaaagaaacttaggccccagtctgcaggtcggcattcactcgctgaccaatgagagtgaagcctccggggagagccaatggggtccttccttggcgggagggggcggggcgctccaaggtcgtctatcccctttaaacaacacagggcggacaaaccggcctttccgggggctttgcttccgcctccgtggaactgggaacttgaaggggtgttggcaggcggcagggcttttggagatatttgccacggacctggaaggaaggtgttcgtccctgaggcaggaggaagacacaggcgtggttttgctctgacttttctacttcagccctggtaactccatctcaatatagtaattgtcctcgggggcaaatgcgagtccctgtcacgcttttgacgccacagctttggagttgtcatggaaacagttgaacaaatgaagcccaggaaatccctcatccagactccatcgtagagaatgtgtggaatgaccgatccaggggccccataagtccgccggttttcaggtgcccacttggacacagctggccaggaaagggaagggacgggtctgggccaggagggacctcacataagttctatgatgatttggtttaaaatcttggccgggcgcagtggctcaggcctttaatcccagcactttgggaggccgaggcgggcggatcacttgaggccaggagttcgagatcagcctcgccaacatggtgaaaccctgtctctactaaaaatacaaaaattagccgggcgtgatggcgcacgcctgtaatcccagctactcaggaggctgaggctggagaatcgcttgaacctgggaggcggaagttgcagtgagccgagattgtgccactgcactccagcctggtcaacagagtaagactgtctcaaaaaaaaaaaaagaaaagaaaaaaaaatctcatcccacacttaccctcttgccaaagcattatcaggaaaaccacaagcaaattagaccttgaaatccctctgcaggcctttgagaggatattttattgagcttgtgagagggtgggacaaatgagatggttatagcttcatgattatagctgttgtgcttggggatctttccacagtctcactggacttccaggacctgctggctgaaacagaacagagactttgtgtgtgtgtgagaaaagggactaaggtagtaagggactgaggtagggggttgcagagaatgagcagctggtggtgggatggtggaaatccccacatttgagattggagctcttgcaggaattggtgatgctcatacttctggaccttcaaggaataggcaggatcctgactagtctttatctatattctgtgtcttttgtgcccacatcccattattaatgaccaacctccaagtctgggcctacatctggataccacctaatgatcacatgccaggtgcagaccagggccacatgctgtatcgctatccaggtccaatgctgtcctggggcttcccacatctccatggccccgtggccccagccagatgcctagccctgcagtgtactgcatgagaaaggccaggtgcaggaattaagcaggggatgcagaccagtggtgctaaggacaggtaccaagaagcagagccatagccacaccagccgtgcaccaaatttgaagctgcaagtacccagcccaccataaaggtgcccatggtgagcaaagccatgcagagtgcctgccactgccactatttcctcagtacctgatgctgccaatagattcactgtagcaccatcaccaagtcctacaggtctagtgatggctccctcaatgagatcaagatctgcactcccttccctggttacttcatggtacactgtggacgccatggctacaagtcatagaatgaggcagtagccccaccagtgtcaccaagaatgccacaagtggtagcataccagtcgatatccagctagtgccctagatgtctacgacttgcacaaagcagaaatgttaaattgtatgggcccagtctggaggttagcttgcctgcataagcccctggcactgcttccaggaaaagtcaagacaaagatgaccaagtggaaaaaccaggcagcagccagcaaggcccagtcgtggaatggacagaggtagggtccagcaacctcctgggctcaaacgatcctcccatctcagcctctgaaatatttgggactacaagtgcataccataagagccagctaatttttatatttttggtaaagacagggtctcactatgttgcccaggctggtcctgaactcctaggctcaagctatcctcccacctcgccccaaagtgctgggattacaggcataagccaccacacttggccagtttcagcaacttttttttttttttttttttttgagacggagtcttgctctgtcgcccaggctagagtgcagtggcgcgatctcggctccctgcaacctccgcctcccaggttcaagcgattctcctgcctcagcctcccaagtagctgggattacaggtgcccgccactgcacctaatttttgtatttttagtagagacggggtttcaccatcttggccaggctggtctcgaactcctgacctcatgacccactcgcctcggcctctcaaagtgcggggattacaagtgtgagccaccatgcctggccaaagaaggaaggcttcaggaactcttaagggaagactcttcaggctggcaggccccagcaccctccctccaatagaagtcagacaagattcactctggtcctctctgcttgtcctcttttcagggcagcaagatctgccccacagcagttttcctcctgctctgttacctgcagggatgcagttagtgttcaagttacagcaaagaaaaagctgaggacaggagaggaggaggaagatctcccagtacttctgtcccccaagtcctccctgacttgtcagccccaggctgctctggtgaatgcaccttttactccacgctgtcagctccagtgcttcatatactcctctgtcccttggctatattgagatcctgacgatgcctaccaagctgcctcttatgtaggatccagaaccagtgggatgaaagagcagcaggtaggctccaaaaagctgatagcactgggggcttcatgacccataggacatgagctgggaccccatcatctcccttcagactagggcactttcagggtctctcatatataaacacacatacacacacatacacaccgcaaatgatggggaggggaggtggccccagcatgtggtggatcacagtcactaagtctacttacttattatttatttttaaaatatatttaaacagcagcagtcacttccaaaatgcaaaaaaaattacaatttttagaataaaattataatgtttataatgcgggtcagaagaattgaaggtacaacagaatcaaatcacgcagcactggaggcggctggagaagccaaagcccactggtcaggggtccaagctgacaagaagtcccaacctgagaggtctccacacccaaatcatacccctcagcttcccattgacagagccagtgtcctctgggttagagaaggagaagcggcaaggagctggccctctgtgtgggtgtcccaaacccagtcccccccatcagccagggacctgctaatccacctcctccatgttgctgtaggtgggggctggccgatccacagggggggcgaagcgttcaggggctgtccgcgtgggggccacctcgggggcctggccagggcctagtccctgcaacagaatacgaggacaggggttgggggctgcccagcatgccgcctggcatcccgggggtgctggcttggagccctggcacccaagggagggtcccaaggcaggcgcagacagcagcggcgttgagacagagagacgagattgggcctgaatagtctggttttattaacacttttaagtacaggaagtagcttgggcagggccaagcctgaggccaagggtcagagcagcaggatgaatggacagacagccagatggatacacaccctaggatactctgcccctgcaggggccacaacctccccaccctctcccaccagatgcataagctgaggcccaaagcccagaggtgttccccacaacaaaggcaggcatggcctggggcaggcaggtaggccagctcacagcagctgcctgcaggcgagctcatctccagcgactctgggataccagaggatagaacacgttgagcacgagggccaccaaagccgccacggtgcccaggacaaagtaccggaggcagccctcatctggtgtggtagggccacgtggtagggggcccacccagtcttggggcccccagggacccaggggcccagacccctcaggcaccggctcctcctcagcctccagctcctgccaaatccgggaagcctagggtatgtggaaacggccatcagcaccccgggggtggggaggacccagtgtccctgagacccttagccatgacagtcccacctggggtgactggggctaacaccctgcattctagatcaaacagcaaggaggaaggcaggcagccaacctcagggctgtccagagtaagagcacaagggtaagagaatcttgacagcattttggcctaccctaaacagctctcaatccacatgcagctccgcatggaggtgggaggggagttatctggttagtatttcagtccaggcctccccaaaggacaccgattcatagagaacaggactgccaatcccagagcaatctccttgctccttcccacccatacccagatcctgaccagtcttctgcaaggatttctctaagcttgacagagaaggctcaagagaggatggagccagaaaggagacggccagtccagaaaagagatgtgcctacgcccactaactgggcctatggcacaccatgtcactaaagagaagatcctgaaggctcagcaaagacagatgcttacctcaaagagtataacagccaccagaggccatggccagcccaaataggccttgtcttgagtgcacactagaactcagggacatcacaagtgagggtgtgtgggccagcatgtggggaatgtgcagaggaaatctaggagagtgtcaggtatagttcattcacagcatagtgcccagtgaggttcagagcagttgcctgacctgtgccaagtaggtgccaatgtgcttgccagtggcagcatgttagtgtacttgtatgtttgttagtgtccccaaggcatggggatgcctctggctaaagctttgatgttaagagaactctgcaattctcatgaatcccaaggctcaatgggcctgtggctggaggagaggaagctatatcccccaacccggccccagtctgtgaactgtcccccagtattctgtaaagcctcccacatgcctcacctggctggcagcagcctcagctgcagggcctaggtctgggtggtgctcagagtgacctgccctggggggcctctccacaggagagttccgccggcggtagaagagtacataggcataacgcgtcacaacctggctctcgtctaccgttgtcactgtgctgtcatcaaacaagcgccagcctacagcagggtgggaagagtgtgaacaaagtctgcaccaccacccctaccacctatcctgctggctgtgtgtgccctcacccacgtcactgcgctgactgctacgatcattgggcaggcgtgcacaggcagtgtagtggccaccaatcatgcctccatagtggttgatgacagcatatagatcgtagctgggcagctgctcctctttctgaccaatgcagaacttgctcaggtccaggttcctgcaggtcaggtccagtcagggaggggtgagacaggcaacaggcgctcaggatgcccatcctggtcctcacaccccacccacagttaccaaggtccactgcttacctaacagggaactccaccaagtcattgatcttgtcacgccagataaaactacgaaaggagaagcgcttgagctgcacgatgagaacatttggcaggcgccatagcaacagctgcttggaggcctcacggtgctgtttgcactgtgggcagtacctggtggggacagagattgggtcaggaccagcaagtctctctcttctccatcctgcccccttatctacttgctgctctgttctcaccaggcctcctcgggtgccagcacctcaggccgtgtgaagaggttgaggcactggtccagggtgaagtggccggcccgggcagcctcaccggcagagcctggatcctcagcacattccagctccttggaggctaccaacacaaactcctgcaagcgctcattgttccgccagacgagagccaggctacagtcgtcacccagctccagtggggtgtctcctggagattcgcagggagagaggtcatgcagctgtggagaacagccagctcaacccaccccatggctcccacccacagcctcagacacctttgtcctctagccgctgctctcggttggatgaatcaattttatagatgaagaactggggtgtgtgggcattcatagcttcacttggatgctggtacccaggcacagcagctgtgtgagaacatgataatcaaagcttccctgcccatcagggcctcaccaggcccaccaggccctaaacaacagccccctccatcctcccttatcctcctccccagcttctagagcctttcactggatcttaccttcgggtcgggacaccctctcgccagctggcaaggagccaacctcaatgggcccactggccagcatctcagaagaaattccactggtgctgggcacaggaccccggtcaggggctgcccacacccggggaagccctgtgtccccctcagccataggggtcaccagctggagctcaggtggctgaatggggtctctctcgctgtccccagcctccagggaacctgtggagagcagtgtggtgcagccagggctctgagactccaaggccatgcggcctggctgaaagggtggctggaatacactcacagagtacctggcaacagagaacaacgcaagtaagactcctgaccagcccatctagcacctctgcccccacctacaccactctagtccaaccactgggcacttaccgggcatagccctctagcaactgagcgaggcgggcataagtgaggcgtgaggcaggtacactgaccaggaaggggtagccaatgttctcaggtcggcagaggcccttgtggtcaggccagtgggttttctggcagagcctgacgggaagaggaagacaaggataggcccttagccccatctcctatgactccatactgggggctagtcatagtccctgggaactgggtacgccagccctgcctcccccagagcctggtaaagtagggtggcaagtagaaagcttaagcatatgtgccttggtgtgaagggaaggagcagggtggcacatggaaggtggaaagaaagggtaggggagaccatgggggtcctcactggttgcagtagcccacacggtagcaccgggtacagcgcttcagcttttcatcctccgactgttgcttccgctggcaggctgcacacttggagatggggacgctgggcacctgggggcgctagggtgggtcgtctggctcagcaagaccaggaagaagtgccccacccaccagggcgctgtgccatcaggttggcccccactcacctgttgcacctctagcaccactacccgctccttagccaactctgaggatagcagctcaaagcagaggagcgtatcagatggggacacagtgtccagtgagtgggagggtaggaacacacgatgaaaacgattcttaattacctggggacagagaacacacagatcccacgtgaggataagccctttccctagccctgccccagagtttaagaaggcttggccctgccttgggtctatgtgggcagtggtgaggtctgtaggcccaaataggcttatgcctctgctggcacctgtctcagtgcccaatgccataaggagcctggtgcatcagagggcctgaaagaccaggtgtgaggcagatatcaaccacaccagctctccacactgagggactctgccctgctataactagcatagccttataagactgtaacatattatcatggagggtccacattcaaagagcctcctccccactcttacccctaagaaaaccaacactgtcaggctaaaggctaggaacccctggggagagctagcacacacaactgggataaaaggagagagcagcaggatagagggagaggcagagcgaacatagggatagtcctgcagctcaagctccttgtctaaaaagggaaatgcagttgggatccaccaccacaaaggggaataaaccctgataatggctaggaactgagggcacttctgttgcacagaaaaaataacagcacatcgcctgtttttgtacagtcacaggcatactcatgtgtatgtctatttttattttattttattttatttttgagacagagtctcactctgtcacccaggctggagtgcagtggcgcgatctcggctcactgcaacctctgcctcccaggttcaagcgattctcctgcctcagcctcctgagcagctgggactacagacatgtgccaccacgcccggctaacttttcctgtatttttagtagaggtggggtttcaccatgtaagccagggtggtctggatctcctgaccttgtgatccatcagccttggcctcccaaagagctgggattacaggcatgagccaccacgcctggccctatttttatttttttatctatttatttatttatttttgagacagagtctcactctgtcacccaggctggagtgctgtggtgcaatctctgctcactgcaacctccacatcccgggctcaagtgagcctcttgcctcagcctcccaagtagctgggactataacacgtaccaccatgcccagctaattttatttcttgtagagacagtgtttcaccaagttgcccaggctggtcccaaactcctgggctcaagtgatctgcccacctcggcctcacaaagtgctgggactacaggcatgagccactgtgcccagcccatgtgtatgtctgtagatgccaatgactgtacacacgtctgtggtgagtacacacacacatccacacatgtgatagcccaaggaaggacaaagatacctccgccaaacgcaggttctcaggcttcacatgaacactctgagagagggagtccaatacttcgctcgcagtggagttctccttgctgacgctcaccaggaactgtggcaaaaagggcagtcagtgagggaggtgggccacgttctctagaacagcccagagggtaggggcttactcctcaccttgatgggcttgctgtggggctctcgggcaaaataaaagacagggagaaccttttgcttttgtggcaagggcaccggcagataaagaaacgggtcaaaagtgatggagacctgtggatgtagaggtggcactgggtagctgcacacagagtgggagataagatgctcatgctcagagagcccattccggggcttctgatggctctcagggcccccacagccaaccagcaaactctcaggcttcaggacactagacagggcaggaggaccaccaggaaataacaatccttctttctggcactcaaagccctactcagcttagccactttacgaattggcctcacacttgcaccccatgtgcccacaaccctgctacaacacctttgagctctaacatcacttttccctcagtcaggaagcctaccctgagtgggctcttcagcccaaatagaatcctaaggcctccctgccagcttctttgcccaaaccttgccctgtagcaccttaagatgcacatgcctctgaacctaatgtgaccagaatagctgagctgaactagggggtctctttccaggggagcccatcacaccttggcacacacagggcacaccagcttcgacttgtactgcccctgaaataggtccacgatgaaagagtcattcctcatcttgtgccgctgccatgcttcctcagctaccacctgagaggcagagtggtgagaaccaaagagtaccaggggctgggatgctcatgagacatgcccaccctctgtccctaaccctgacctcatcgggccgcccatctgaatccacggtctctgtgtagggcttgttctgaatgcgattcaggtcctcgtgcagcccatccagcaggaaagccatgaactcctgggcatcatgctgtgcatagcctgtgaactggctggccttactcgccacaatggcctggatacaggagccaaggtgtgaacatgaagccctagcacccactgcacacccagctggctggccctccccgccccctccagccaagggtgacagtggtcacagatcaccttcaacttggaaggctggaaggcatggtgggtgcccttccacagcgcccgaagcagcacggcaaagccaatggccagacgcccaccagtccctagtgggttgttgtagttgatctcagcctcaaaggagcggtctaggaatagtagccgagcaaaggtgtgaggaacaaaggcactctctctgcccataacccaggctccaggccctgccctcaccatggaagaagtcccggagttcccgagtgttggacagagactgaatgacgctgttcatgaagcaggtgttgcctaaattgacaaggccagtgaagcctggcagacacaccttcttctcttcctcttcctcctcctccacgctgtctccactaactgggctgtggggcatgggaggcaccatgcatgtaggcttgggctgcaggagcaaagacgacatgagagaacagccccaagactctccagcctccattcttcgtccttcccaccccagaattctcaccgaggccaggtgtgtctctggctttggggttacatgctccatgggtgtgcgggttgccacactgtctagccctgtgtcctcagatcgtgccttggatttatccttctccacagcccgggcctcctcctggcctgtcagggggtggggagcacctcctggtggggttgaatccagaggggttggacctgtcggcacggcaacctttgcaccacccactgcaccttaaaaagggggaatgagagggctggtggttagcagcatgtgacaggggtttgggtcctggtcacgtggaactgggcaatgaagggagctcgtgtgcagacctcgtgcagccggggcctccaggcccccccagcgctgactctgcctcttacgaaggcagatgtcgatgcgagaagccgtgaaacagaaggtgcactgctctggctcaatcagattcctgtgggaaaaggctgaactcagggacttaggaggaatgagcatcaggatagatgagccagggagatggagcccacggggtaggacaggcacagtggtggggccgggcaccacccacctgagcttcacctgccaacggaaggtggtgtggggcccacagcccgggtgcagcctcaggaagtttccatccctgcagaggcacagcaggataggaggaaggacaagaggaagagcatgagacatactgtcccacctgaggcattgtttgccccatcatctacccacccacctggtctggaagatgagcgtgaagtcctgctcacggaaaagtactcttgaggtgtccctgcagatctccttcacgtacacgtgcaccaccactgaatccgggcccttctcatacgagtcattcttgacaaacgccaggttcaccatcgactcgggctctatattgagaccatggctcagccccaaccaggacaggttccagcctattgctactctctatccacctacaaactttgcaacccaacctagggctctgcctgcccacccccacctttaccatccaccaaggttgcagcatctgctgccactgccatctcctccttggcacagtcatctttcccagggtttctgctccggaccatggctggagagactgggtcattcccgggaggcactgctttctctcctgccaaaggggctaaattctcctctgagcccaggaggcaggtttgggagttcagcggtggtatgcaaagctgttcatcagcctcaacctattaatggcaagattgtggaaagaatcagccctgggtctgccaggtggctcccactccagtgcacaccctttccccccatctcctaacacccaaacaggtgcccagctctcacctgggtggctgggtcagccacgaagggtggggcatcaccccggggtccagggtcatccctggacccgtccccctctggccctctgcagagatgcacagccctcttggcgctgggccctgcctgggccccggggccagcccctgcgcctacctcaccacggccctgggcccgcttctggttccgggcctcctgcttagcccggtggggctcagggcctggctccagggcaatgggagacagttcctgcccattctcctggcaccgcagccccggcaccagctcctgggtccctagaggtttcttctgccaaagatacagcagtcaggccctgtcgactacactggtatccctacccaaccctgtactactagaactcaccaggagggagggccacgtgagcataggcacctttttgggcagtgtcaggtgcaggagactgcccttgcgggtttgcactttagcacaagagctttttatctcagcatagaagacaccaccccactgctgaccacctggggacagagcagggtccatgaggtaggataggagatatcagaagattcaaacatactactgtgctcagggcagatggacacacctgcaaaccgcaccacacagtctgtatctgtgaaagcagcatctacatcctccagctgcaggggacctactcccacacgaagcttgacaatcacctcttctgcactctgcctccaatcgagcaacaactctggagtgggagtagccaagagatcatgagggtcttcacaagctcctgatggtgataagcaggtaacagagacccagcctaatgaaactgcttcagatgggagccaaattgcaagtgccccctccccttccctagcaacaaaaagcccattcgttactgaccctctttggtctgctcctcttgaggagtggatgctgaccctgacgatgaaggaaagaacagccgggtacggtggcgtgagcctgtgatcccagctgcatgggaggctgaggcagaaggatcacctgaggccagaggttcaagaccagcctgggcaacatatcgagaccctgtctctaaaaaaaaaataagaaaaattagtcaagcatggtgaggaggctgaggtaggaggactgcttgagcccaggactttgaggatgcagtaagctacgatcacacctgcactgcactccaatctgtgcaagagtgagaccctgcctttaaaaaaaaaaaaaaaaaagggacaggcacggtggttcacgcctgcaatcccagcactttgagaggccgaggtgggtggatcacctgaggtcaggagtttgtgaccagtctggccaacatggtgaaaccccgtctctactaaaaatacaaaaattagctgagtgtggtggtgcatacctgtaatcccagctacttgggaggctgaggctacttgggaggctgaggcagcagaatcacttgaacccgggaggcagagcccgcagtgagccaagacgccactacactctagcctggatgacagagtgagacattgtctcaaaaaaaaaaaaaaaattagccttgcgtggtggcatgcacctgtaatcccagctacttgggaggctgaggcaggacaatcacctgaaccaggaggtggacgttgcagtgagccaatattgcaccactgcactccagcctgggctacagaatgagactccatctcaaaaaaaaaaggaaaaaaagaacaggttcaaaaaaaagaaaaaagtttaaaaaggaaagaaggcaagccccccaacagcaccatcttctggatcttagccaagtactcaggcttcaaagctgaggctctactgaggttatcatgggtccttcttctctcatcatcaaaccaggacagagagaagaacaagaaagtcatctcccaaaccccaatctgtataccaataagatgggaggcagagaaggccacaattactctgggaatgccactcccacctttcctaggatctccatccttgctctcctggtttgctcgatccttctgcttcttcttactagtggtgtcctccagtcctgggggccctctccttgggcctgtggcactggccccgccagacatcttgagccgcttggtcgacagccagagtgccccggggtcggcaacagcgtctgggtcagggctgcggcgctttcttcctggcccagctatcttggcaactctttgtggccaaattctccagcaaggaacggacagcctaatggaaagaagccagtgatcactgccaagacccaacaacttgctctttagctacacccagggctcagcaacacaggacactaatgctacagagctgtatcttctcatctcttaagtacccctggacactctcaggatattctgaagaggtaataaataatgcaagtagcagcaaccacttctggccaagcctcatagatacccaccataacagtcccacacaggtgaaagcctcactgagggggcaccaggtcaaggaagtcatggcctgggaccaggctactccaccaatctggagaggagccacggctccagcccacagggctggcactccgagcagggtgctcacttttccttcactctcactggctgcttagtcaccactggagaaatagaaggtggaggaggaaggcaggacaggagacaagccgcaggagaaccaggctctgtggctgtaaacaggctcaacccaggttctaccattgcccagaaaaagtcctggggctaaggcactccacctgcctcctgccagctcccacccttggcaagaacctgctcctatgtactgcttggtccttcttcatttcaagagaaagtcctctccccagctgctgtcccaagcagaaagggactgaaaagtgtatctagatgtcacgctacctcttcagcagcaaccctgctccagtactaaggcaggatgggcatccagtttgagactggaacagaaattatcaccttccttcccagatgccttcactcatgagctctgagccacaaggaccactacagtttcccacagacccaccagtggattctggactgtttcctcctccaaaatgaaggtcttgaaactagatactgagatgaggctggggaggaccacagatccaggactcctggcagcctcaagcctggcctgaaccagtagcaggacagataatgactagtctgtgttcccctaagtgtgtaaaggaggaaggagggatggcaggatacccttctacaggtcagatgtggtactggtgggctggatctttaatgacacctgccaccggcgcctccttcttgcacccaggccccagccgaaggtcgcgtccctcccccatgccccagggacgtcgaggcgggtaaggggctgtttagagacccgagccggcctgaaatggcagcgcggggttactgaccacagatcagcgccccggtcgagctgcgacccagcttcagcctctgaaccccgagcccgccaccacctctcccacgaagttgccctcgctggccgccagtcctctcccaggtgggaggctggccacaggcatagcgtaacggccctgccggcatcagtgggctggcacgctgcggggcactaggggtagggactggcacggcccgtgaccttgaacaggccgccgcggccgcgcgttgcggcctccccgctgcggccaagccagcgagttgcagcctgctccactcaccgagcgagaccgccgcagccagccctcttcgggccctggcaacccgctctccgttccggttccggcgcaggtcggttccggttccggcgcgcccctcccccgtcccggcgccgccgccaccgccttagcggcttgttttgtttcgacttctagctaaggccgagggaggcggagcgccaagctggtgacgcacttccggcgggaatgggctcggagcgacccgcagctccggggcgggcccgagcggaaggaggcggtgctcgggtggcttagcggtgcatgggttctgctgggggcaacctcgaggttcccctggagactcccccgcccgccccaaatcagagtccagacaacacagtgggggttcacactggtttattgggggccctgccgggccaagagctcttcagtgcataggcagacatgcatgtggggcagtgctaggaactggggtaggccttgggcaggggtcactggcaggtgttgtagatctgcacctgcaagttgatggcttgaagcacgctgcgcatcctggcctccaacccgtccaactgggctgccttactctccagtgcccgctcattttcctcataggtgccttccaattctaggaagggcaggtgtcagtttagggggggtttcccgcagtcttgtgtctctggtgccccatttcttaccctgtagccgctgcagcttgtcctgagcggcttgcaacaggtcccgagcctcatcccgcagttgttctgcccttgcctgtgcagccagcacaccttgggccttgcgctcagctagggccttcaccgtctggtactgatcacccagaggaccgcgtagcagctgcagatgtagagggttaggttagcgtggtagctcagtggaggcccatcttccacccctaccttctccagctggctctgcctcaacccacctgctcagcctcctgggcacgaccctgggcactgcctgccgtttcttctgctgtagaggctgccagactatttcctgcccgtttcaatttcagagcctccaggagagcatccaactgccgagccctttcacctgcagagctcagtgcccgctctgcacctgccatcctctcctgtacctgccatgggtgagccaaaggttacacagatctacggttcatgcccataaccttgtcccactgatgtcctaggaagacctcacctggtacagggtctgctctgtgtcccgtgtgtcagccactgccccccggatggcaccctgggcaataccctgtgcccgctgggcctcctccagtgctgcctgtactgtctctgccttctgtttctcatcctcagcccagctcctggggagaagggggaatcagaacctggaggtatcaaaaccaggtgtcagggataggggccagggatggggtcagaccttgcccgccgtgcatcctgcagtagctgctcggcacgacgcacatctcctacagtacgtgccaggatcgcatccacatctgccaggctccggactcgctctgcaatcgcacccgccaggtgctggatctgctcagctgaagctgggatggagagctctagcacccgtgtggccaccatttcaatgctatcaggatcagccccctcctctatagggacacagcaagaacttaagaacatagattctccagcatgggcatgaggatacagttttggggtatggactcaggacatgtacatgggataggggtttgttaccaggcataaggatataatcacaaggacagggactatacaaggggctcagactcaagaacatggacctgggaccacatatgggcaataactcaggagccagtcaagggatcataaacactaatccagtgtagtccctgaggctcaagtatgaaccaagggagatacagacaccgggagttgccaaaggggacaaccacatggcctgggacacgtgggaggctcacggttgaggaagtccttcacactctggataagttcttgaagttcctggttggcctgttccacctgtcccctggaagcattagccttgtccagggctgcctgggcccgctgctgtgcctcgcttgcctgccgacgagtctcagccactctgctgaggatgctaccaccttctgccagtgcccgctgcagctctgcctgtgtgtgccgggcccggcccagtgctaggtctgctgtagccgctgccccattgcagctgaggcccccacagcgcggctgcccatcctcatctcgacagccggcacccccacaagggcttgtagcacagggtgcatcccctggtgccccacacacctgccaggcacagaacaagtcagggccctgtgagaggaacatctacacccacctgccccacccaacacttcaacctcaccagctcatttatgtctgtcaggctcagggtgtgggtatgggcagagagcttgccaagtgcccgctggttggccatgtgtttgctgttgaagtcctccttctgagcatccatcagtgcctctgtccgatgccgagcacttgccgagttgctcacagggctaggtactgccagggctgaggtattggcacgacgttctgcctctgcagactggctatgggcatgccggatgctgtcataggcacctaaattgggcagaggcagacagtcagctgaagactgaccctggtccacctgcctagttggctaacaactcacccaggaagtttgaatgtttgagcaagtcaagatgctggtcgagctgccgcagtgtgagattaagtgcaagcctatctcgctccagaccacttagtgcatggttggcattgaagttctcatcttgcacatctgtcaggtctgcctcgagctgagtcaggtgctcagtggcctccccaatttcacgcctgcaatgatggagaggggggtgtttagagaggcttcagccctggtccactgggcctctgccccatcccaccatgtattcttaggcccttccgcaccgcagctcctctgtggcctccacaagctgtgcagtggaggcggctgaggtgttgcgggcacctacgatgccctgcacaatgcccagcttctcctgcatgtgccagaagctgctctcaaaggcacccagcacacccgtctgttgcaactcctgcgcccgctgctctaggcgctgtgtacgggctgccaagtcctgcaccactcggtcccaatccccgaagcatgcatggcagggatggcaggcaggaaagattcctgagaagccacgggcacactggtcacagcgcacaccagacacccctgggcggcagctgcagtgacctgtgaagcggtgacactgaggtgtatctattccacgagagtcacaatcacaggctgcaagaaagagcagagcacagagttagggtcactgtggggcattctgggaagtcctccatctaccctggccccgctggctccctcaccatggcactgcaacccagggtctccccagtggagctcttggcactcagaacaagtccgccctccaaagccggcacggcagtggcactgccctgtgaactggggtgggaacaaggcagggtcagagcctctataagaggctaagccctggagataagacagacacctggccccatctaaccagggatctgcaggagggtcccatacctcgttgcaggtggggcctctggcccggcttgggtggcaggcacaaggctggcaaccatggccactggtgaggttccagaagttgggggcacagcggtcacagctagggccctggacattggggaggcatgggcactgcccactgcttggatcacagtggcactggtcaggagatgggcactgctgcggatttgtgcccagcaggttgcatgtgcagcctgtgccaaccaagatgagcacagtagtcaagaggaggccaagaagcagaaccccaattcagccatgccctcccacactcatactcacggtgacagctctgtcgggcagcctgcccatggaagccaggcttgcagtgggcacagtgtggaccctctgtgtggtgtaaacagcgcaggcattgccccgtgtgggggtcacaggcatcaggatccattgggtcaatgttcccactgcactcacacagttggcaccggccacctggccttgatgggtccccaaagtgcccaggggcacaagcttcacatcgcagccctgcccacggttaagaggaagctgtgagtgctcagcccagccaactcaccctgatcccacgcctgcccccatccactcacccgtatagcctgcccggcagtggcacacaatctgctgggaatattcatcctggtggcaagaagtagcaaagtgccgttggctcccagggccttcaggacagggacagggccggcactggcccccatatggcagccgtgggtccccgtggaaaccagcaatgcacctgcagggaggaggaagaagaaatgtgtcatccctgggaagcctgcccaccaaccaacccactcatagctgctccagtctcacctttcacagtgctcaccccctgtgtgatcacggcagcccaggcaagcgcctgtgtgggtgttgcactcatctgcatgcccattgcagacacatggccggcagctagggaatccccactggccacgctggcagcggtcacagcgaagcccaaaggcaccagttcgacagagacattgcccactggtcttttcacagagactgctgagtgccccctcgtggctgcactggcaggctaggagcaaggcagagctgagccagagccaggggagggggtctgaggggagtgtgggtgggggagggtctcaggggagtgtgagtagtgggagtctaggtgggaaggtcaggaaatggaagagaactacaactgacccaggttgagagtagagggtccaagacttagtttgaggaaaccagcagcaggtccagaaggaggagagagaacagtaatgggaaggagagagaagcataggagggaacaaggggcagaagagtaccttgacagcctgtggggccaaagccatagtagccaggggcacagaggtcacagcggcgcccaaccactccaggcttgcacaggcactgaccaccatgagggttgcactcagaactcagtgaaccttgagggttgcactgacatgctgtggggaggagggttgggccaagtcaggctgggtccccacctctgccccatcaacccacatcacagacactcacgcagggcaccattgtagatgagggtggacaggctgatgaggaggggtgcgcaggcctcagagggagaagtcttgctgggcaccagaccctcctcatggcattggtagcgttcaaaggtggcctggcgctccagggcagcagcatcacccccactaaacatctctagcaccaggacacggggcagcagcaccagctgaaggagtgagcaaggaagatcgcagttcagacctgggaccacgtaggcattgccagagcacttgccttagcactgccacaagcctgcccaccctggcaccaccatgggcctgcctcttctgccacagacccctgctatccctcaagtcccacaccacgggccctgccatcttggttggtgtgggcaagaggagattattcaccgagtcaatgagcaggccaggtccagagtagggagtctcaggctgggcacttccccctgtccgtaccagcttcagatgcagcttgtaggagataccaggctcaaggcagacaggattaggaaatatcaagtacctgggggcgagtggggacaggtgcagtgggtcatctaggggccctgtacaaatcatctgggcctcccccatccttctcccagcaaccaggccattggccaaagcagagactatggctgggttgcgttgggctgcgctaggccaacaaacagctgggcagcccaacaaagaatctgcacagaatagtctcataaaggtggccctctagaatcatacatccacctgtgcagactcactggaaatactcataaagcctggaaatcccaagaacttgccaattctcctcaacaaccacctcacgcttcctctgaccccgacctacaacctacaatggctgctcctcttcatcaacactatgtcgccccctctctctttgtctccaaggctttcctttcccattgtgctgcaaactcatacttgggttcttttatcccatcccaaaaattgttcttcaatccctcatcttttttctttttattttctgatttatttatttatttgtttatttgagatgcggtctctgttgcccaggatggatggagtacagtgcgtgaccttggctcactgcagccttgacctcctgggttcaagatatcctcccacctcagcctcccaagcagctggaaccacaagcacacaccaccatgcttagctaattattttattttttgtagagacagggtctcgccatgttgcctaggctggtcttgaattcctgggctcaagtgatcctcctgcctcagtgtcccaaagtgctgggattacaggcatgagccaccatgcctggtctagaggaattttttttctaaacacaagtcacagttggcaaaatgtctataatgggcacagccaggttcaatatgttattctctttccttctgtttgaatatttacatggtcaaaaactaaaagcaataggtcaagtgcagtggttcacgcctgtaatcccagcactttgggaggccgagaaaggtggatcacaaggtcaggagatcgagaccatcctggctaacatggtgaaaccccgtctctactaaaaatacaaaaaattagcaaggcatggtggcgggtgcctgtggtcccagctacttgggaggctgaggcaggagaatggcgtgaacctgggaggtggagcttgcagtgagccgagatcgcgccagtgcactccagcctgggcgacagagcaagactccatctcaaaaacaaacaaacaaacaaacaaaacatgaaacaatgaaacagggctgggcacggtggctcacacctgtaatcccaacactttgggaggccaaggcgggcagatcacaaggtcagaagatcgaggccatcctggccaacatggtgaaaccccatctctactaaaaatacaaaaaactagctgggcgtggtggcgtgcacctgtagtcccagctactcgggatgctgacacatgagaattgcttgaacccgggaggtggagattacagtgagccgagatcgcaccactgcactccagcctggtgacagagcgagactccgtctcaaaaaaaaaaaaaaaaaaaaagaaaagaaaagaaaaaaaaaagaaacatgaaacatgaaacaaatactacccaaaatgtaataaaacattaatcagaccaggcacatccctgctcagagtgctctgatgccacaaccccaccactaccaccctctaccaccaccactgtggaccctcctgatagtgacaccaggtgatttcccattaattcctgccttggcctctgggccttagacccctgagagagcaggccttgatctgtctacttcctttctgtgaacagagccatgcccaacagggcctggcaaccagcattctggaggtatttgaaagaaggaacagatgaatgagctgtggggtcttccaggtgccctgcagggagcttagggctggccccacaaccccctgccattgtgagtgctaccaccagtgccctcacctggcatgtggttgcagagtcccttggatgcgatcatccttgggcaccaaatgcccacacaggctgtgggcaggcacaggccctggacgctgcacaatcagttccaactctgcccattgctcagggacctgggaaaacgggatgatggaggagatgctcccacacccagaggttcagccccagattagataacagggtctaacctggggctctaagcgcagcagcaggtcatagtccatagccttcggcacagaggccaccaggaactccagggtctgaccttcctgtagccgcacgaagcctgagccagtccaggatggagtttccccgggggtcaccaggcgctccaccacatcgagcacctgggagataatgcagccagggatggaggctcaggtgaggctttgcctcttctgccacagccagccccaaaccccatttctcctgccaaagctagatatcacccctatcccctcaacaaggtactgcccataaccccacctctccagtcatagacgtgtccacccacatccagccctctgcttagggggaggccccacacctgccctcgggtgtcctcagcctcccaaattaggtggtccaggaagggccggaagtagccaggttgcacctgctcacagcgtcgcccaaccatgtgctggcggcagtggcattgacctgtgccctcatcacacctggagggaactctgtggttactcaagaagaaccttctcttctgctcaggatctttccccatcccttcccaggccccctttacaacacttactggggatccaaagcaccacccacgtcgcagtcacaggggcggcagccgagcaggtcgtggctcaggccccagtggccaggctgcacgaaaggagttgctgggggccagaaacagacctccagaccccatcaccacccagcaggaaatcccaaccacacgtcttagcctcaatcacccctcagtgaaaacatgccccccagaccactggcccacatccttggcctcccagacctgaggcttctcagccaggactggatcctaagctctcagcacccacccactggcatagatgtgacaccccagccctgtgctctaaggacaaatcatgcccctagaactccagccccttccagtcgcaccaggcagcggtcacatccacgtccagtcactagacgtttgcagtaacaggatccactgttggggtcacaaggagtgctcccaggcactgtgccccgtgcattacattgacatcctgcagggaaggagaaccatcagcactttgggaaactgtggcagtgctcatgttcagctgagtcaggagtaagaggacaggggttaaaggtcagcatagaagttagggcaggagacacatacgccggcagcccagacggtcactgatgctgagcccaaagaagccatcacggcattgctggcagcgagtgcccaccacatgttctttgcagcgacactggccggagaccagtcccagtgcagggtcatcatgggaatcacagcgaccaccgtcttgagaacccatggggtcacaatcacaggctgacggcaaaaagagatacagggtcactcaccctatctcaactagctcactgccagtcctctcctaagcctaagggatcccaccctggatccctggtcaagttctatcccaagcccctaaccccaatttcctgcaatttagacagcagtccagctctctagttcctgccccaggctcagctttctctccccgtgcccaatcccagcctcacagcggcacacagccggatcccgcaggtccttggttgggtcacggtagaagaagggccgacagagctcacagtggcgcccagctgtgttatgctgacatccatcacacacacctccactcacattgccagatgccaggtatacggccatgtcgaagtggcagctgtgggtgtgcccatggcactcacactctggcaggggaggaagggcagggcaaaggccacatgaggaaccaggtcacaagggtaagaagtaggccaccttagatccctatcacaggccagaatttgtgggtaggggctcagggacttcaaggcctcagcatcatactggttccctacccagagcagactgcagaggaggattgagggggtcccaaggggcatcaaggtctgcatactctttggatacagcctgggttttaggggcttgaccaactagctctaggttctacccagggcacagccaggctgcagagtgctggagctatggaggccaagatctcactcactcctacaggcatgactatggccgtcctcagccggacgccag

SEQ ID NO: 566 - DNA, 88228 bp, Homo sapiens
gggtttctccatgttggtgaggctggtctcgaactcccaacctcaggtgatccacccacctcggcctcccaaagtgctagggttacaggcgtgagccaccatgcccagccaattttcctcttcttataaggacactggtcattggattggagccccccaatccagtacgacatcatgttaacttgattacatttgcaaagaccctatttccaaggaagtcacactcccagatactgggagttaggacttgagcacatctttttgggatacacagttctactcactacatggggttaatttactttcactctttaatgaaagcattcaagaatatacatttacctttgaggatatcttaaaggttctgataaggatgttttcattttcctgctttctaagtagtgtgttgtattattattgcctctttgagccattaattatttacgagaatgatttaaaggctctaagtagcttgagattccttcaattattattattttgtttatttgctttttctttattcttttagttcacaaaaattcaataatatagaatacattaaaatgcaaaagtcatcccctaaccaatagtttctaaatagtggatttagaaactattggtttctaaatttctattgttattgataacttggagtctatctttgcaaaccattctttcatgtatacagaagtacttggcttagggacagtgggaggggggtaagggatgaggaattacctaatgataatggacattcttcaggtgatgattacactaagagcccagacttgatcaccactcaatacattcatgtcacaaaactgcacttgtacaccttcaatttattttaaaaaacaaaacaaaacaaaagaagtacttggctgaattatgtgcttcaaatactcatggagcgggagaagagcagatcccaagaagtgaatgcagtaaaaccaggaaaaaatggaagatagtcacatctaattttcctaaaccaaatttgctcctaacatgagtacaaattaacagcagatatattcacactttggtgaaaataaaaacttttctcctcaaagctctttggaatctgtttgcttaaatatcaaagtccatcaaacttttctacagatacaaacccaaactcagcttttaaaaattttaacctcagctgcatgagttacttatttaactggaggtagacctacccccaccctcaaacatttgtcctgctatgggttgtagttcgaaacatttattttcacttgtaagagcgtcccactgatcttacaaagaattttactgactctggtatagaaaggacagaagaaatattcatttccaacatatcacaagatgaaatcttctatatgtgtacatgttatagaatttcagatatatacaatccattagtgaatctgaattataattgatttgtctaattcattccctactttcagatttttttatgatttatttttatttcattttttagaggtggggtctcactatattgtccagagtggtcttgaactcctgggttcaagcaatcctcccacatctacctcccaaagtactgggattacaggtatgagccaccatgcctgccctctgattatttttaattcagtaattttatctttgtcttggaagtagaagggataaaatttaagctactaatatactgccaactttttacttttaaaattactcattctggcccgtcgtggtggctcacgcctgtaatcccagcactttgggaggctgaagtgggtggatcatttgaggtcaggagtttgagaccagcctgcccaacatggtgaaactccatctctactaaaaatacaaaaattagccgggtggtagtggtgtgcgcctgtaatcccagctactcaggaggctgaggcaggagaatcacttgagcctgggaggcggaggttgcggtgagccaagatcatgccactgcactccagtctgggcaatagagtgatgtcctgtctcaaaaaaataagtaaaaacaaataagataaaattactcattctgaaaaatatatacaagcctgagttgtttcaatagttatcaatattaatgaatgcagatttaggaatgtgtgagctaaaaacaactagcctgcaattaatagaataaagcataataaagaattaacagaataaagcatactggaatttaaaaataatgcatctttatgaagaaagcacattttcttaaggacctttgccaatataaagttttactttgagaaaaattcatgtttcacatggctacaaacctcaaagaaatgttctgatgttgtttcactggagaccagtgtataagaattggattgatgtttgtcccttttttcttattttgcaatacgttttcattattatatttactaaatgaaaagttttttctttctctgaaaagcttacacctagtgcttttccttgaattcattttcactgatttctgttatgatgataatttattcagctgaaaaatgcctagattcaaagaaaattcaataatgcaaaattcaaagatcttgctaatagaaaaaaatgtgagctaatgtcttgtagaaaatataggattatatatttgttgactgaggttggggaagcacttcttaagatcaaataacttggacaataaggcaaaaaattgatggattttattatattcaaattaaagatttccagtcaacaaaaggttagttggatcaagttaacagacaaatgacatattgggagaagatagttgcaacatctaaaatgaacaggggatttatatcttgaaacatccagaaattcctacaaatccacaagaaagagacaaaaatattcaactgagaaatgagcaaaggataagtatggaatttactgaatgagaaatcctgagtggccaatgagtatatatgaagaaatgctccaattcaacaataatgagaaaaaacacaaattacaacagtaagggaaatcacttctcatctattaaaccggcaaaaaattagaaggatggaaatgccaagtgctaaatatggggggtagggatggggtagcctcatgcattccaggcgggagcattgactggcacagccattctcaggagtactccagcattctctggtccaatcagtcatgcacacatcatataaatcctactctcagacataaagcccagaaacattctctcacacaggtccatacggccatgggggagggggatccatgcaatgctgtttgcactgaactggactccacccaggtgtcactcactgggggcctggataataaaatgtggtgttggctcactaacaaatatgatcgaatatgatcaactagaccaggggttcccaaacattctcacttcatgcaccaatgtcttcacggtgttcctaggccaaaagaaatggctaacagctctggctagccattctgttctgttattaagtagatggtccaaacagcttaataggtatttatgtcccaacacactagtacctgtttgaagaaatttatacacatacattggaggaaaaaataatatttcattcttaaataaccagaattatttactgaggggatgtgatgtgtgtgcctgttgggcaccgtgtggcttctcaaatgttggggtcagattggacatgtgcccttattttgtttccccttgattttcatgcagtatctgcttgtcactacaactgctaaaaatacagcttcgcaaaaataagatgtcatggaaaggaatgtagcagtctaatgctggaactgtgaactacctcaagttagtggttcacatgatgcctgacagatgttttgcatcactgtgtttcccaccaaaatggaaagtatcccaaagcacctctatgggttccctgaagctacccagagcacgttggtgcagtttgggaaccacaggattagatatatacatgaatattaacaaatcttcaaaacggtgctgaattttaaaagtacttaaactgttaggggctgaatgtttgtgtctctccaaaattcactgaagtcctaacccccaatgcgatggtattaggagatggggtctttgggaggtaattagatctagattaggtcaggagggtggggacctcatgatgagattattaaattttaagaagaggaaaagatgagagagctttccctctccccacatgcatacttggagataaggctgtatgtgagcctacattaagaaggctgctgtctacaagccaagaaaagagccctcaccaggaactgaatttgctagccccttgatgttagaattcccagcctccagaactgtgggaaataaatacctgtcatttaagccatcaatctgtggcaatttgtgaaagcagctcaggctaaaaagcacaaagtaaggtctatgggcttgctcttgctgttttgatgacctgccctctttactgctaagcctgagggagaggctcctaggcagcacttcaccctgtcaaaagccctacctcccagaaaggttctagtgcaggagtgtccaatcttttcacttccctgggccacattgggccacacataaaatacaccaatgatagctgatgagctaaaataaaaatcccccccaaaatctttttattattattattattattattatactttaagttttagggtacatgtgcacaatgtgcaggttagttacataagtatacatgtgccatgctagtgcactgcccccactaactcgtcatctagcattaggtatatctcccaatgctatccctcccccttccccccaccccacaacagtccccagagtgtgatgttccccttcctgtgtccatgtgttctcattgttcaattcccacctatgagtgagaatatgtggtgtttggttttttgttcttgccatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacgtgtgcatgtgtctttatagcagcatgatttatagtcctttgggtatatacccagtaatgggatggctgggtcaaatggtatttctagttctagatccctgaggaattgccacactgacttccacaatggttgaactagttgacagtcccaccaaccgtgtaaaagtgttcctatttctccacatcctctccagcacctgttgtttcctgactttttaatgattgccattctaactggtgtgagatgatatctcattgtggttttgatttgcatttctctgatggccagtgatggtgagcattttttcatgtgtcttttggctgcataaatgtcttcttttgagaagtgtctgttcatgtccttcgcccactttttgatggggttgtttgtttttttcttgtaaatttgtctgagttcattgtagattctggatattagccctttgtcagatgagtaggttgcgaaaattttctcccattttgtaggttgcctgttcactctgatggtagtttcttttgctgtgcagaatctctttaatttaattagatcccatttgtcaattttgtcttttgttgccattgcttttggtgttttggacatgaagtccttgcccatgcctatgtcctgaatggtaatgcctaggttttctcctagggtttttatggttttaggtctaacgtttaagtctttaatccatcttgaattaatttttgtataaggtataaggaaaggatccagtttcagctttctacatatggctagccaattttcccagcaccatttattaaatagggaatcctttccccattgcttgtttttctcaggtttgtcaaagatcagatagttgtagatatgcagcgttatttctgagcgctctgttctgttccattgatctatatctctgttttggtaccagtaccatgctgttttggttactgtagccttgtagtatagtttgaagtcaggtagtgtgatgcctccagctttgttcttttggcttaggattgacttggcgatgcgggctcttttttggttccatatgaactttaaagtagttttttccaattctgtgaagaaagtcattggtagcttgatggggatggcattgaatctataaattaccttggacagtatggccattttcatgatattgattcttcctacccatgagcatggaatgttcttccatttgtttgtatcctcttttatttccttgagcagtggtttgtagttctccttgaagaggtccttcacatcccttgtaagttggattcctaggtattttattctctttgaagcaattgtgaatgggagttcactcatgatttggctctctgtttgtctgttgttggtgtataagaatgcttgtgatttttgtacattgattttgtatcctgagactttgctgaagttgcttatcagcttaaggagattttgggctgagacaatactggcaaaccgaatccagcagcacatcaaaaagcttatccaccatgatcaagtgggcttcatccctgggatgcaaggctggttcaatatatgcaaatcaattaatgtaatccagcatataaacagaaccaaagacaaaaaccacgtgattatctcaatagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaacactggcacaagacagggatgccctctctcaccactcctattcaacatagtgttggaagttctggccagggcaattaggcaggagaagggtattcaattaggaaaagaggaagtcaaattgtccctgtttgcagacgacatgattgtatatctagaaaaccccaaaatcttataatattttaagaaagtttactgatttgtgttgagctgcattcaaagccatcctgggccacatgcagcccatgggctgcaggttggacaagctcggtctagtgaattccaccattacacctctctcatgatctctttctgtgtctttgatagccttcacagctccctatgtgggttcatctgtccactctgagccctttctgtgcaaactaacccactcttattgggagctgacatctgctgtcaaaagacaaaattacaacaaatttaaagatcctaaatggattttatctgtgattctagaattggacaacacctcattctgtacaaaagaaggagtgttccaatgatctgagcaaaggatgtataaccacccgacaggttcaccttgcccactgcctagacagagccaatttatcaagacagggggactgcaatagagaatgagtaattcacacagagccagctgtgtaggagaccagagttttattattactcaaatcagtctcccagagcatttgggaatcagagtttttaagaataatttggtgggtgggtggaggccagtgagttgggagtgctgattggttgggtcggaaatgaactcataggaatttgaagctatcttcttgtgctgagtcagttcctgggtgggggccacaagatcagatgagccagtttatggagctgggtggtaccagctgatccatcaagtgcagggtctctaaaatatctcaagcactgatcttaggttttacaatagtgatgttatccccaggagcaatttggtgatggtcagaatcttgtagtctccagctgcatgactcctaaaccttaatttctaatcttgtggctaatttgttagtcctacaaaggcagtctagtcacaggcaagaaggagatttgttttgggaaagagctgttatcatctttgttttaaactataaagtaagttcctcccaaagttagttctgcctatgcccatgaataagcaatgacagcttggaggctagaagcaagatggaattggttaagtcagatctctttcactgtctcagttataattttgcaatggcagtttcattaggccacgttaactaacttctctacacctcagtttctcactctgtaaaatgaagatggtaagttatacgaagttcaaagtgagtttatactggtagacatcagaatagtgattgccttgggagtttaggaagggtcatgaaggaaacttctggagtggtggaaatgttctgttttgatctcagtgtttatatgggtatatacatacatttttaaaaagtcattggccaggcacggtgactcacgcctgtaatcccagcactttgggaggctgaggcaggtggatcacatgaggtcggagtttgagaccagcctgaccaacatggtgaaaccccatctctactaaaaatacaaaattagagccatacgcagtggctcacgcttgtaatcccagcactttgagaggatgaggcaggcggaacacctgaggtcgggagttcaagaccagcctaacaaacatggagaaacctcgtctctactaaaaatacaaaattagctgggcgtggtggcggatgcctgtaatctcagctactcgggaggctgaggcaggagaatcacttgaacccagaaggcagaggtttcaatgagctgaaatcacgccattgcactccagcctgggcaacaagagtgaaactccgtttcaaaaaaaaaaaaaaattagctgggtgcggtggtgtgcgcctgtaatcccagctacatgggaggctgaggcagaagaatcagttgaaccagggaggtggaggttgcagtgaccggagatcacgccactgcactccagcctgggtgacaggagtgaaactctgtcaaaaaaaaaaaaaaaagtcatcaagcagttaagattagattaaaatgcagtaatctaatcttaattagattagatacttagatacctttatttaaaattttttaaaagtggagataatagtacctacttcccagcatcattgtgacgattaaatgtgctcagcaggttgcataattgtttctgatctagctagtatccagtatttgtctattgtcacaggtggtgactgctggaggggctgagtccccaataagctgtgaatgtcttggaggacaagtatgttggccccttcttgttctagcagtgaagaggatcccatgtagactccaagcagctcaagttcagcaagggagacagaccattgcaagtgcatgaaaagggcactggtgggctgggaagttcgtaggaggagcctctcacatgctgggtttggggaggaattctggaaagcagttagtcttagggacgggaaggatgtagctggtgggacaggcgccctcagctccatgaataaaaggagtgggtctgactctggttctcattcccctttaccatgcctggcacacattagaccatcaataccaattgactccaggaaggagtgtctccccgtgggggcatcaggagccgctgagtttaaatacacaggtgggatgtgacacactgggaaccattcagatttgctggatctggatagggcttgtcaggactcagtgcttccaaccccagggcccatttccctgtggcccctgagtcaccaccatgggtggacagctgctccagtgccaagatacagccacagaggacggcaggcccagggcctccagaaggacaggcaggctccctctgaaagacaagccggcttatagctgaaacctctggcccaggcgtcctctaagggaagccaggcggtgtcagggcacggcccatgaagacataagatgaagatggggagaaccagagggggtgcgcttcgaaggaaagcgggctgcgtgggggcaccgtcgattgcacaggacgcggtcccggctcgcgtagccccgcaggcggcgccagagcgcaagcccgcctcgtgactccggtccacagtccggccgggcggagctaggggcgggcccctgcgtctctgggcgctggagcgcggcgactatcacgccgcgtggcggacggacggactgacggacgcgcagccttacccgaaaggccatggcggagcacgcccctcgccgctgctgcctgggctgggacttcagcacgcagcaggtacagtcgcctggccgcagggccacggggccgcctcctccgcttcggtgggggtagggggcgggctgtcacccggacgcgggaaaacatgggcccggccgcgggcgcgcctacctctcgggcttcccggggcccccgcgcccctgccctgcgcgcggccgtggggcgccggtgccctcgcccggagatgccctgccaatgccacccgctcgcaagatgcggcctcgaccccgcctggacccagctaccccaggaaactgcaggcgctcctcggcaggacccccggtgcccagaggggccggaggactcggcgggttcctgcgctgttctgggcacccagtgacggggatccgaaggaagtcagctactgtaaggcaggggaacagacaggcgggtagccctgcgcacatgcacaaccagtgacctggaagcagattatagcccaaaacctttttttaaaaattgaaatggcccaggcctggtggctcttgccggtaatcccagcactttgggaggccgaggcgagtggatcgcttgagcccaggagttcgagaccagcctgggcaatatggagaaaccccggtctctaccagaaaatacaaaaattagccgggcatggtggagcacacctgtagtcccagtttttctggaggctgaagcggatcgcttgagcccaggaggtggagattgcagtgagctaagatggcgtcaccggtctccagcctgggcgacagaacgggaccctgtctcaaaaaaaaaaaaagaaaaaagtgaaatgcatagtgtacaagtggactttaccctgtgaccgcccttcgttgacaccagcttgcctggtctgtgcacccaggactgctggccagaggagcagtgtgctgctgccaacgccctgcagacaggcaagcaaatcaaaatttgccttcaaagagggcatggggtgaccgggggcaccttttcctttaaagtacttgggaaatatacacagttgcagtcaaacccctcttctcgaatgggtcaagggaggcaggcctctggccagtccttgggggaacgtcctgtgggactctggatgactcgagttgccttgctggacctcagttttcccatctgtccaggaaaggagttatactcccaagcttggagattgcttcagtgggacattaatgtctctggaccacaatcatggcctgtgagaatagcccatggccttgcctggtctcaggcctctgcagacatggatccccagagatgcctccaaaccttgcttcccattccttcctctctggcactttctcccgcctccttgtcaggtgcacgaaccaactcatctgtgaacatcttcctctagagggtcttggctttggctatttggggaacaaagattccttgagacatgtgggtgttcctacttagcctcagtttcttcattttactaaatctttgagtgttaccccagatgagtcctctgttaccacgattacggtgaggcagccctgccttcaaggaggtctctaggttgaactgctcctagggtgtggggcctcatctggtgacgttagtaccccctggaccagtgtagaagctgaggaaaattctacacttccttttttaaaatgcctttcaggtaaaggttgttgctgttgatgcagagttgaatgtcttctatgaggaaagtgtgcattttgacagagatcttccagaatttgggtatgtacttgatgtgcatgtgtgtgtgatgggggtgttggttttggggtcctcccgcaaacttttgtattcgcagaccgcactgttgaggctttgccaaatacaggagtggtggtctcggcagacctttcaagcatctttttttcctatacctagagtgccatctcccccatttcttcctaattccattcatccattcatgaagtaagcatcagttgagacctactttgtgccaggtgctaggacctgatggcgaaacaaaaagagaaagctctcccagagcttcccactgagtagtggagactggtatcaaacaaagaatctcacaaaagagtgtttcattataaactctgagaaggcctctgaaggaaaggaactcacttctccaagtgcttattataaaggaatgtgactcagacttgggaggggaagtcccagagcgtctctagggaagtggtgcttaagctagagatcagagtgagtgaagttagccaagcgatggaagggaagttggccaggtgatggaagagcattccaggcagaaggaacaacatgtgcgagggccctgtggcaagaaagagcatggttcattccttcatgcaattgaagaaagccaatgatgctggggagcagagagaggcggaggctggtcagagctccataggccatggtatagagtttgtctttattctaaaagctatggtcagccactaagggccataaggggtaggggtatgggtgaggtatgaatgacaggttgtatttttgttttgaaaatatctctctgggggcattgggagaacagattcggagcattgctggaatggacgtggggaactattaaagaggtttttgctggtcattcaggtatgaaatgatggataggagagagctgagtagtaaaatggacaggtcctgttacaaaattgaatgtgagatgtaagggtgggatttctggctgtccttcagagtggatgttggactgtgggaaagaatgagttttggagagaaagatcatgagttcagcttgggctgccataacaaggtaccatagactgggtgggttaaagagcggaaatttatattctcacacatctggccgttaggagtctaaaatcaaagtgctgggaagattggtctcctctgggacctctctccttggcttgcaggtgaccactctcttgctgtgtcttcacatggtggtcactcggtgcaggagtgcttggtgtctctgtcatctgtatcctaatcttcttataaggacatgagtcatactggattaaggcccattctaatgacttcattttaacttaattgcctttttaaaggccctgtctccaaataatcacaatccaaggccctcggggttaggatttcagcatatgagttttaggggcagagggggcacaattcagtccgtaacactgtggacttgctggttttgaggcaccctcgtgagggcctggtaaaagtgtccttccctgtctgttttagacacacttcctctttgaagccttcccagctgaccctttgtgcacctctcattacccatcacattgtgttgccaactctttgcccccagctaatgcggccccatggagccgaggttagaagccatcttgctttctcacattttttattattgcaggccttgcatgtttgcctttgggtagttggtatgtttcaaggaattggtcttttcaactaagccatcaaatgtgtggccatagtgttgttcataatattcctttatcctccttatgacatctgtgggaccagtaatgatgatctcttgctgttggtcatttctgatattggtaatttgtcttctctctttttttctttggttatcctggctagaggtttatcaattgtattgatcttttcaaagttcaacttttggttttgttgattttcccctgttgttttcttcaagttgtgctctaatttttattacttagtttcttctgcttgctttaggtttaaattgctcttttttccctagtttcctcaagtggaaacttagaggattgatttaagaccttcttttctaatatatgcatttaatgctataaatttctctgtaaacacaaatgctttttatgggatgccttagcagcatcccatacattttgataagttatagtttcattttttttcgttcaaaatattttttagttctcttgagacttctttgactcatgggttatttagaagaatgtttttaggctgggtacagtggctcacacctgtaatcccagcactttgggaggctgaagcaggcagaacacttaaggtccggagtttgagaccagcctggccaacatggtgaaaccctgtttctactaaaaatacaaaaaaattagctggacgtggtggcaggcatggtgacaggcaccgtgtatgctgcacgcctgtaatcctagctagctgggaggctgaggcaggagaattgcttgaactgtggagagggaggtttcggtgagccaagatcgcgccactgcactccagcctggacaacagagggagagcctgtctcaaaaaaaaaaaaaaaaaaaaaaaaaaaaggaagtctggaagtgtgttgtttaatctccagattttccagttttctgttattgatttctagtttaatttcattgtggtctgagaacataccctatatgacttctagtctttcaaaattttaaaatttcctctccctcactctctcttccacttaataagtcagtcctctccactggacatttaaaaaaaggtgtccataaccaaaatatggtattgcttttttccattatattttcaagatattttaaaccagatgcctatagatttagttcattccttccccatcacctcaattgcattgtgggttttctttttacaactttattaaggtataactgatgtacaatactgtgcatatttggagtatacagttaaaagctttaatatctgtattctttcatgaaactatcaccaaaataagacaatgagtatttccatgtcctaaaaatttcctcctgcctctttgcaagcgatgcctccttccccatacccctacccactggcaaccgctgatgtgttttctatcactagtttgtattttctagaattttgtatagatggaatcataattatgtatgcttttttaaaacctttaaaattttacatcacagttttgagattcatccatgttgctacatgtggcaatagttggttcctattattgccgagtagtatttcattgtatgatgttgtatggatggactacaattggtttcacctgatgagggatattggggttgtttctcttttctgttgttataagcaaagggctatgagagtcacatacaagtcttttcgtggacatatgatttcatttttcttggaaatgacataccaggagtacagtggctgagttatacggcaggtatatgtttaacttcttaaggaattctcttccaaagtggtgattttaagaaaaaaaattttatattgttaacaggcattacattgcacttaatatgtaactcaatgaaaagtatacagtgaaaagtctttttttttctttttttctttctttttttgagacagagtctggctctgtcgcgcaggctggagtgcagtggcacgatctcggctcactgcaagttccgcctcccgggttgtcctccattaggaaatggtacatctacacaatggaatactacacatctataaaaaagaacacagaagtttttatgtattgacatgtaaacacagccacgttactgtgaagtgagtaaagcaaagtacagatcagtgagtatagtatgctttctcttgtatgaaaggaggaaaatcagaatattcataccttcctatatttccatgtaaaaacactggaaggagcctggcacagtggctcaagcctgtaatcctagcactttgggaggctgaagcgggtggattgcttgagtccaggagttcaagaccagcctaggcaatatggtgataccctgtctctaccacaaaagtgcaaaaattagtcatgtgtggtggcgtgcacctctagtcccagctacacaggaggctgaggtgggaggatcacttgagtccagaaggtggaggatacaatgagccaagatcataccactgtactccagtttgagggacagagccataccttgtctaaaaagtaaaaaaaaaaactagaaggatacacaacaaattaaagtcatctgtagagaagggacggagaggagagatgagctcacaggtgggattaagacttttcactgttatatggggtttcaccatgttagccaggatggtctcgatctcccaacctcgtgatctgcctgcctcagcctcccaaagtgctgagattacaggcgtgagccaccacacctggccaagttgtcgctattattgccacgcacagatatttatgtcattgaatttcccagtctcttttattgcttctagattttgagtcatagttcaaaaggccttcctcactccaaaattatgaaggaactcacctatgtttttatctagttcttgtaagatttcagctttcttacataaaaatatttggagtttatccaggtacgtagtatgacatttgtatccaactttaatttttcccagatgattcttcagttgttgtaacaccaaccatgtttttatttaatttattttttttatttgagacaggagctggctgtcacccaagctggagtgcagtggtgtgattcagctcactgctatctatgcctcccgggctcaagcaatcctccctccttagcctcccaagtagctggaaccacaggtgcgcccctaccatgaccagctaatttttttgtattttttttgtagagatggggtctcactctgttgcccaggctggtctcgaactcctgggctcaagcagtccacccacctctgcctcctaaagtgctgagattacaggcgtgaaccaccacacccagcctcaaccgggtttttagaagcccatctttacctttaagaggctgaggtgggcggattacctgaggtcaggagttcaagaccagcctggctaacatggtgaaaccctgtctgtactgaaaatacaaaaattagctgagcatggtggtgggtgcctgtagtctcagctacttgggaggctgaggcaggagaatcacctgaacctgggaggcagaggttgcagtgagctgagattgtgccactgcattccagcctgggtgacaaagtgagactccatataaaaaaaaaaaaaaaaagaagtccatctttacctccatgatttgagatgtgaggcttatcatgtgctactttctgtgttcacttaggtccatttttgggcttttgtttttgttccatggtttggtagatctgttcataagccagtaacacattgtttcaattatcccagctctgtaatatgtttgtttgtttgtttatttacttttgagttggagtctcgctctgtcgcccaggctggagtgcagtggcatgatctcggctcactgcaacctctgcctcctgggttcaagtgattcttctgcctcagcctcctgagtaattgggattacaggcgcccgccactggctaatttttgtatttttagtagagatgggtttttgccatgttggccaggttggtctctaactcctgacctcaggtgatccgcctgccttggcctcctgaagtgctgggattacaggtgtgagccattgcacccggcctgtaatatgttttaatatctagaattgttggtcccctctgtttgtttttttttccagagtttccatggctattcttgttctttttcaatatgtacttcagaatcagcttttcaggttccagaaagccaaattgttaatttttttttttttttggacatggagtctagctctggagcccaggttgaagtgcagtggtgtgttctctgctcactgcaacctccacctcctgggttcaagcaattctcctgtctcagcctcccaagtagctgggactacaggcacataccactacacttggctaatttttgagtttttagtggagacagggtttcaccataattggtcaggctggtctggaactcctgacctcaggtgatccacccacctcggcctcccagggtgctgggattacaggcgtgagccaccacacccagcctgttgttaatatttttattgagatcatattatctttataaattaacttggcagaattgacaactttatgagattaagtcttcctgtctaagcacacgttatgactttccatttgttcaagtcttcttttgaatacttcacatgtgttttaatatgtttaacatacagcttttgctcactttggtagattgcacaaatgaccacaatactccacccatccctgtacccacaccctttgcaatgtgactgtaattcctcccatcaaggagtcgtttccctacctgttgatttgctttatccagtagaacaggggaagtggcattgtgccagttctaagcctaagcctcaagcagccttatgtgcttctgctgtcattcttggaactctgcctagccaccaaatgaacaagctcaggctatactgctggagagttggacatatgtggcctagttgccccaacttcttcccctaagagccagccagcccctagctactgttagctacctatgaagcagagccttctagctaccgttaactgactgcagatgtatgagtgagcccagctgagccccatccaatgatagcaagtagaattgtgagcttaatggttttgagccactaagttttgaagtggtttgtgacaatgcagaaattacccaatgtagataattatttttaagtttatttctaacttttttatccttttactactgtaagtggggaagggaggtttctagcagaaacttatcagctgtcttccaaactcatttccctttcttcctaggcactctcctgccttccttgtagttatgttcagccatgtgactgagttctagccagtggaatataagaaaatgtgatcaggcctctaaaagacctagtccatcaaaacctccttctctgacttttctcccatttttggctgatgtgggtgtccagagcaaccttggaagcacatgtggaacatgacagagccaccatcaacctggttcctgaatgactgcatggagcagaactccccactccccactcatgttcctaaccacctactgattgtgctttacatgaggagaaagaaacttcagctgtatcaagccatagaaatgtgtttttccttaactaatataattttttccctcatatcctttttttaaagaaaatactggggccaggtgtggtcgctcacgcctgtaatcccagcactttgggattacagaggcgggcacatcacgaggtcaggagatcgagaccatcctggctaatgcagtgaaaccccgtctctactaaaaatacaaaaatttagccaggcttggtgccgggcgcctgtagtcccagctactcgggaggctgaggcaggagaatggcgtgaacctgggaggcagagtttgtagtgagccgagataatgccactgcactccagcctgggtgacagagcaagactctgtctcaaaaaaaaaaaaaaaagaaagagaaaatactgtttctattgaaatgtaattcacataccataaaattcaccttttaaaatgtacaatttgatggttttagtatattcaaagaacaatatcactatcaccactatgtaatcttagaacattttcaccacctggaaaggaaaccctgtattaattagcatccactgtatagtccccctcctgccagtagtggcaaccacaatcaactctctatctctggatttgctgattctggacatttcgtagacatgaatatatataatatgtgacagccttcttttacttagcataatgctttctttttaaaaaattttcatagctttttgtttatttcaaataccaacttgaaccagatacctggcataatgttttcaaagttcatccatgtcatagcgtgtgtcagtacttcattcctttttgtggttcagtaatattccattgcattgatatatcagagtttgtttttccattcaacttttagacatttgagttgttctgcttttttgctattgtgagttattctgctatgaacatccacatatgttatggattgaattgtggccccccagaattcatatgttggaagcctaccctcatcatgacagtatatttggaggtgaggcctttaggtagataattaaggttaaatgaggttgtaagggtggggctctaatttgataggacctgtttccttataagaaggagagacaccagtgctatcccacttcatgcgcagatgcacagaggaaaggccttgtgagaaggcggctgtctgcaagctggaaagagagccctaaccagaaactgaatttgctggcaccttaattgtggacttctagcctccagaactgtgagaaaataaatgcctgttgtttaaaccatctagtttatggtattttgttatagcaacctgagcaaactaatacaatgtatacgtttttgtgtggacatatattttcatttctattgggtatattacctaaaattggaattgcggggtcacatggtaactctgtgttcaacattttgaagaattgccaaactgttttccaaagtggctgtactattttccattcccaccagtggtagatggtgcctctagtttctctacatccttttttttttttgagatggagtcttgctctgtcacccaggctggagtgcagtggcgtgatctcggctcactgcaagctccacctcctgggttcatgccattctcctgtctcagcctccctagtagctggaactacaggcacccgccaccacgcctggctaattttttgtatttttagtagagatggggtttcaccgtgttagccaggatggtctcgatctcctgaccttgtgatccgcccgcctcggcctcccaaagtgctgggattacaggcgtgagccaccgcatccttgcttaacatttattattgactgtctttttaattacagacggcagccatcctagtggatgtgaaatgcaatctcactgtgcttttgatttgcatttatctaatgataataatgatgttgagtatctttgccatttgtgtatcttctttagagaaatgtctattaagatcttttgcccttttttaaaaaaaaactgtgttatttctcttttattattgagttgtaaaagttttttttaatgtatattctggaaacaagtcccttgttagatatgtgatctcaaaatttttgtcccattctgtgggttgtcttttcactttcttgatgatcctttgaagcaatgtttttaattttgataaagtctaatcttcctacttttttccttttgctatttgtgctttggtgcagtattggttaggttttggtatcaattttatatttacttcactaaaataattggaaaaattttccttcttttcaggtgctctagaacaatttaaatagtattagaaatatttgctatttaaaagtttggtataatttttctgtcaaaccatttgggcctggtgcttttggggcatggggtggctctggtcttccttcttagctggaaatgccagttttgttttgtgtgtgtgtgtgtgtgtgtgtgtgtgtgtgtgtgtgtgtgtgtgtgtttgagacagagccttgctctgttgcacccaggctggagtgcagtggcaagatctcagctcattgcatcctccgcctcctgggttcaaacaattctcccaccttagtctcccaagtagctgggattacaggtgccctccaccatgcctggctaatttttgtatttttgtagagatggggtttcaccatattggccaggttggtcttgaactcccgacttcaggtgatctgcctgccttggcctcccaaagcactgggattataggtatgagccaccgtgcccagccgaaatgccagttttaagttgttaaatacatggcagaatgtctggttacagtttttatctgttttgtgaaggcaacattttttggtgagcttttattgtctgtagtaaaattttgttgctctcttcctctttttccctagtagtatctttttaaaaaatccatattattgagtataatttatgtacaaaaaatgccatccattaaaaatgtataattaaaggtactttgccagatatagacctatagctgtgaaactaccaccacaatcaagatacagaatgtttatatcaccccccaaaagatcgcttttttccctgcttaccgagacaagctcggttgtggagactccaacgcaccagcactagaggaatgaagacaaagacccagaaataaagtgcagtgtgggaatcggctaaaagcctttagagctgagagccacaaacagagttttgcccacatatttattgacagtaagcctgtgataaacattgtttctaaagattatagattagctgaaagcatttcttatgggaaacaaagcattcttttcaagaagcagagaaacaggctgtggctgattatctgcagcaggaacatgtccgtaaggcacagatcgcttatgccattgtttgtggtttaggaatgccttgagtggttttccgccctggatgggccaggtgttccttgccctcattccggtaaaccagcaacctccagtgtgagtgtcatagccatcgggaacatgtcacattgctgcagaaatcctgtttatggccagtttctttaaggcctgtttatgacaggcttagggcctgttcccagcacccactagacttagacaaccactgatctccttttctcagtatagatgaatttgcgtcttctagtctgttcctatataagttataattgtgtacatatgaatagttcatattttttcttgctctgtagtatgatatcacaaatatacaccacgatttatctgttcacttgtttagggacactgggttgactccagttaattattacaaataagtctgctatgaatatttgtgtacaaatctttctatgggcttagactttcatttctcttggctggatacttaggaattgaatggctagatcacatggttatctaatagcatcttggtgtggattctgagcctggttttctctttcctaacacatagttaaaagggttggattttatcagatcagctctttgcactagagtcttctaggggtgaggtgggtggggagagggttccagtcaaacttccaaagcctgtagtccaaggacttgttggtctgttgtgatagtagagacactcttccctccgacgcagcatctctgtgtggctgcccctcctctacctctccaaacctatggggcttgagagggattttataatccaacactgcactcccctagggtgagcctttcttatctagaaggcttctttagaagatgcttctgagaattgccacatctgggccactctgggcaatttgcctgtcttctctttccatctttgcagccctcgtgcctgttcaatcaacagttcccacttggggttggggaaggttctccttcatctggacatttccagagtcatccaccatagggtttctcctggctttgcaatggtctgcctgccctgaggctctggtctacattctctgttgttcttgcaggactcagggtggtgttcatgtgcacaaggatgggctgacggtcacttctccagtactaatgtgggtccaggtaagcgcagggattcctattctccttctatccccaggctgtctcactggcagactcggtgatttgctaggaagtccaaaggtggcagccaatgagagcatctgttgtcaccaggtcctcatgggaaggtggagttggcatgactcctgggatcaggctcagcctcagctggtgtcaacactcccaggctcagaggacttacaaaaaacttccaggtactggagctacagcagatggcaagtcctgccattaaccacctttaaaataacacagagcaaatcttttccaaacatctgcagtcaggccctgtggcctcccttgtaccatgaaatatacaaacatagactgggcatggtggctcatgcctgtaatcccagcactttgggaggccgaggcaggtggatcacctgaggtcaggggttcaagaccagcctggccaacatggtgaaaccttgtctctactaaaaatacaaaaaattagccgggcgtggtggcccatgcttgtaatcccagctactcaggaggctgaggtaggagaatcacttgaacttgggaggtggaggttgcagtgagctgagactgcaccattgcactccagcctggataacaagagtgaaactccatctcaaaaaaaaagaaaaaaaagaaatacaaacatagcccttagggtcttagtgctcagcctccaagatcccttagctccctaatcacctagaatggcaagttatggcctggccagtcagactcatatcaatgccaagccaggcctgcctgctgaggatcaacaggaaaggagaatgcctgtagcaggatctggtgacctagggggccacaggagcagggatgtggacagcatagacaggcgtggtagctccaggggctacctcatcatatgctgcagggtccccgagtccctgaaactggaggccagctaagtgtgtgtcttccaaaagcttttttcagtcctccaatacctatctaaccaattccctatattacattctttttgttcaaaataactggtatgatttcttttttattggtgtaaccctgattcatacactggagaattggggtaaaggatggattttatccagataaactggctagaatgtacttcagagggggctgagccagaccaaggggcagagtgggagggtcgggggttagagacaatggtcagtgtcaggaggtcccagtgatgatgtcgagggcatctcataggccaaggccttcacctggggaggtgagcagtgggtgagaaccaggcttgggggcagggccaaggtgatttctgatctgacgcagcctccaggaccaaacttgatcctagctctgccagcccctgctccggctgcaccccactgcctgcccaaggtttgatgggcacagatagagatggcagccacagccagggctgaaagaagccctcccagcaaaggctgggggtggtggagtcaggcaaaagtgagagagtcttctctgccctcaggaaaacacaggtcagagtgaatctctaattcctgccatgaaatcttaggagggtggtgccaagctctgctgggcaccaccatccatcccactcactgggttttgctagaaaggagggtccaaccagacagtggaggctggaataggggcctggaacaggtggccatcatctctatccactccctccagcctctggctcctggacacagggagtctgggcctgatgctttgctctcacgggagctctctcctttgctcttcacttccctgttgcagtgaagtcagatcactaatatagagggttgaaaatgcaaataaaagaaggcaaaagttggctgccttactttgttagtttttgagacaaggtctcactgtgttgcccaggctggagtgcagtggtgtgatcatggctcactatagcctcaatctcctgggctcaggtatcctccctcctcagcctcctgagtagctgggattacaggctcatgccaccacacccagctaaatttttcattttttgtagagatgggatctcattatgttgcccacactggtcttgaactcctgagctcaagtgatcctcctgccttggcctccaaaagtgctgggattacaggtgtgaggtgatggcatgcacccgtagttccagccacttgggaggctgagatggaaggatcacttgggcctgggaggttgaggctgcagtgagctgagattgcgccactccatttcagtctgggaaccagagcgagaccctgtctcgaagaaaaaaaaatggagaagtaaaatttgaggattggtggtttatgattccatttatttaaaatatttttagcatagttgacctttttatttgattgatgcctacttgtttaattaatgtactctagtgcttacaaatcccaagtcatgagtttcttcatcatctgcccagagtactctgctgtaatggcaggcacttgcgtttcaattctgaggcttgcgtgtctgattcagtggttctgtacagtcatggtgggttctgtttttcttcttaggcactggatatcatcttggagaagatgaaggcttcgggcttcgacttctctcaagtcctagccttgtccggggcgggccaggttcgtttgcagcagactctgtctgccatgtgagggtgactgtcctgggcaatggtgtgggtgttgaagagatggcaacccttggatggggagcggctcattcttgacagccactgcacaaatttcactgtgaataaaaatccctacaactattttactttggagactgtataacttgtctcgttgcaaaaggatctgagacagttcttaggagtaagtattatataaaataggacgcttggtgagagaactgagttcctctgaaggggatggaggaagcaattgacatgaatttattatgactgcttgggggcaccacaattgcttttctatttcctgaaagtaaaagcaaagtcaaaaatgatcctaataatgatagtagtttcagtagaaggaagagtattaataatgatatcagaggacattgactgagcacttagtgcatgccagatacaactctgaggcctttccagatgtcatccaacttaatccttatgattctacagggtggtgctgtggagtgcttggtacacactcagggcatactgtctgggtttgatccctggctctgccatttacaggcagtgacctgggatacgtcatctggctttctggtgcccccgtattctcatctgtcatagggtcattgtgagtgtaagtacatagcacagtgcctcctattaatacgcagtaaacattattaaagcttgggcttctgttattatcgttgatatttacatgaggcacggagaggtgatgtcacttacccaagatcacacagtgctgggagtgggagtcaggacctgagtctatctcattcagtcccttggctgtgctgggatcacttttctccatgctggattactgtattttcaaatcctcactaggatgtaactaatttttctgaagatgcttcttcctccatgacctaacaggaatttattgttttggttcttgttaaacacaacagagattccctgggtgatcttgtccacttctctctcccgaatcccaggcctggacacccatctccctcctagctaatccccgacccccatggctggatatcccacagatgcctcagacttagcatgtcccagactgagttctgtctcccttcagacctcctcctttctgggttctctttctcagggaattctccccatccacccagggcacaactcaagtgtcatccctgcctcctccaccttcccaccccacatccaagggtcctcacgtcccactgatttgtctgtgactcttgactctaccatctcttctccagcgctatctgcttgtcattcttctccaggtctctaccgcagcctccttgcctccagcctaccttccccgtgactcccacaagcctttaatacattcagctctgtgcacgctgctccccctggtaatccagggttcctaccacctccaagataaaccccagcctcctgagcatggtttcaggctcagtgctcaggctgtcccctctctcttcagcccatcacccacccccgacccagcctcaggcccactgcttagaatgccactcatcccgggacttgcctggcgcccctcacctgcagattctctgcatgcaacacacactaggaccatttcctgatactcatgaccacttcctctcatctgtacccgagttggttaggtgcctctgttcccacgaccctgtcactgcagctccatagggttttatagttgtacatttgtgtccttttccctgactcaactccagtagcctgaagaatagggatgaaagtatcctattcatctgtcgcaagcctggcatgatctatgtgcttaataaatgttcattgaatgaatgaatgaatgaatgaatggggtgagtgaataaataaatgaatttcaggtaatattacaagcaatgtctttaaatgcagttttacaaaaggcattaaaatccagaccaataattagttcttggaccttttctataagttgtagggtagacagggcagagttcctccccattttcttgaagtggaaaccaagtcccaggagggtgatgagctctgtgactaagaagtggcaggggcaggtgtggagcccagttctttggcatgtggtctggggtctttctgtgtcttcaggaggctgtgacactggtgtgtggtcatgtgaccatgtgcttgggtttcccaacagcaacacggaagtatatactggaaggctggagcccagcaggcactgacaagcttatcaccagacctccggctacaccagcagctgcaggtaactgtggctacgttgtgtgagtgtgagaaacttctgcagagtcccaagtcctgtgggtcctgaagcctgctcatctcagtgttgcagctgtgctcacgcgccctcaccagaagagctttcaacctcaggcttttggggagagaccccactgggccagttctaagttacagcacaaagggctggcccatgtgtctccaaccaaggtcacctgggaagaagcgtcatgactgccgtgatgggcagtgtgaccgccagccctggggcagatctccaagtcagcggatggagcttaagcctgtgcctttgccctccttcccaggactgtttctccatcagcgactgcccggtgtggatggactccagcaccacagcccagtgccgccagctggaggctgctgtgggtggtgctcaggctctcagctgcctcacggggtcccgtgcctatgaggtaggctgaggatgcggggggtgcagggggtggtctggttgcaagctccggaggcatagtgggtgacctgcctctggggggatcacatgaggtcatggaggtgttgtggagccagcaacaggcactctggcccctgggtcctgatccaggccacctgctgccctgtgtgttcccaggccaggctgggtgtgcacatggctgtgctcctgacatggaggtgctgtgcatgggggtgagggtaccccctcaatgagaaggcacctcctgtcattatttgtaacccggggattacaacaggacttacgttttgggtaggtttgaagctgaaagaagtcagtgcatgtaaggcacttagtgtagtgcctggcaatgttaaaaaaaaaaaaaaaaggaaaaaaaataatagtgtctctgttccacaggttcaaccttgtccccaggggtgattgtgattaggccagcttgggttacatgacctcgctggagtagaagttttggggatagggccaactctacttgggccacctgaaataacaatatgtgggtggggaaaataccccgatccctcacctggtggcttggtcagaacagtcaccgtgctgtgtgaagagcaagggttattcactcagggttgtccagtcctgatgtgggagaggccctccaggaaggcccagaagttactcacttctctatcctgtgggtgcagagccattgtttactgcctgagtatttgattactaaggacattttaaggattcaaaggccaagatcacattgttcagtagatatcaaacagatttaatgcttatttttaaaatatttaattattagaaacgaggtctcactgtgttgcccaggctggactcctgggctccagagttcctctcgcttcagcctcctgagtagctgggattacaagcgcacactactgtgcctggttggggcttacttttaaaagcttttatggtacctactcctatccagagcatgctacattaaactcactttgtggaggtaattgttcattctgtgtaggatttgggttcctaagaatttatattccttttccagcgttttacagggaaccaaattgcaaaaatttaccagcagaaccccgaggcctactcacatacggaggttggttaaatgttcctgtttgattgaaagtcacagttgaattcttttcataatatgttagaatagatacatcttacgtgcagtgactgaaaacattgataagcagacattaacaaatgatatatttgatttgcttttttctcattgtcaggacatttccaaagaggaggggaagaatggaatgtgggaaagagaagtcaggggttctcctgaccagaagggtgagggtgagggtccaggtgggagcactggggactgacgtgttcctgaggccacctgaatggaagatctgagtgtctgagcaggctgtgtctgctcactttcctatgtggttaacgcaggagggctaccaggcacatgattggcatagagtcagtgttttctttggaaatgtataggactgggcatttgtgtccccagctgtggcccttcagccagagcctctgtcacaggaacccaggttcattcctggctccacagttgctgaagccagcacttgttgctgcctgagaaacagccccacgccctggctagtgattttcatcttgtgataaggaaacgatcagctcacattaaaccaaagcacctttttaatcttagaaattaacatgtggtttattatttaatgatttgaggttccagattattctgcagcattagccattaatgtaggctttgggtagaggggtgaaaaccctccctaaattctgtgtgtggaacgaagtttgcctgacagaggacaggaggtgataacattctctccacagttccaaaggcccatgattctcatgtggaagtacagacccttagggtggcattgaaaatccatcatctatttctctggctagtgctcagggtctgtggcttctgaggagccagctttcctgacgccctgagagtgtcctggttggttctgaggccacacatccacttcccttgtaaccagaaggaaatgccaaggagatagaggaaggaaatcagggcacacattccccagcatgtggattccggatggaaatgcagcttccctaagccctttctcatagggcttttggtttttgtctcttttgaacttggcagttttatggcccatcagaaactgtagagaatgaatgctctcccgaggagtctgctcatggtattccagctgctcctatctgagatgcacagtctccaccattacttgggccttttgttcaaagtttccacttccctctccaattttttttcatgctttgtgtgtgtcagaagcattcagtagcgtagggtatgtggaagtgaggcacctctcactgtttctttcctttacagagaatttctttggtcagtagctttgctgcttccctgttccttggctcttactcccctattgactacagtgatggtgagcctcggggtatggggtgggtgcctgggcagtgtgcatgtggcatgtgggtgtgcaagcagtgggagccccacctaccccgagtgggtgccaatcttgtagccctgtcatctgttgccaggaaggaagtgtattcattatcttttaccacataacaaatgaccccaacacttagcagctgaagaccaccgtgtttattttctcacctagtgtctgagagtcaggaatgtgggggcagcttagcttggaggtactggttcgggatctcccacaaggtggcagtcaagctggcagccggggctgcagtcatctgaagggttgactggggctggaggatccatttccagcatcatgcacatgactacaggcaagaggcctcagttcctcacatgtggctgttagtgacactgcagagagggagggaggagacagaggccaagcagaagctgaggagtcttttataccctaatcttgaagtgatgtgccatcacttttgtctcatcttactggtcacacactaggtacggttgacccagtataatgttggggagaacctcacaaggggtgaacaccaggaggtggggatcagtaggggacgatcatggagcctggctcctgcaaggagctattaaagtttttgtttcacatttggtgaactcatgagatttgtgagcttctagaatcaaaaccccgaaaaaaataaattgcagttgatgccagtgaggagggaaagctgggaggaggttgctgcaggaactcttggatgagcctaagtgtgagaagagtgtggacagaatgggggtagagaatgcagggcaggagcccagagccgtggatatggcttcagaatggagcctgggatgctctgagcctcgtgggaattcatgggaagttttcgagggctgttgtatgccaggctttattctggtttcaggagagagagtgactaaggagtgctgttaagcttccctcacaatctggaggaggcaacagggttccctacagctagttctgtagaactcagacaggcagaacagtcaacttggagtagcctgcatgtccacccgttctgcacacctgccacagagctgataaccgcagcagctgttccggggggcattccagaggtttatgttccttagccacagctgggccctccactctgccccccttcactcacctgagatgtcacctcctcatttcacctgggcaggtgacaccatcagcatcccagcccacctctgtctgcctccaccttggcccagtggaggaggagttctctccacccatgctctgggttccctgtcctttcccatcctcaggaaagccttgggagaaggaggatgttttaggaaagagctagtaggttgatctcagtgaccagaaggaagtttagaggactctgagacctttccttgaaaagttagatgagattgagaaatccctgggagctgacctggaaacctaagggacatggagagtggttcctggtcagtgtgttgctgctagttccaggccccctgggaggtctttgagcagcagatttccaagctaactgtagtgtttgagttgatgaggaatatttggaggaggtgtggtgccgtgtgtttccaagggcccctcttgtctctggttctctggttctagaacaacacaagcatatataccttccatgaagaaagagctccaggtacaagttgtggcaagagaattatctgctctgtgccagatttgtgcattttcacaaaaggtccattttcaagattgtctgttgtttgtttccttccttcctcaggttctggaatgaatttgttgcagatacaggataaagtctggtcccaggcttgccttggtgcctgtgcacctcatttagaggagaagcttagcccaccagtaccatcatgctcagttgtggtaggtctcctttctggtgatgtggctcatttaagagctggcagctaccagggaagcactgtagcgcacacacacacacacacacacacacactctgcacacacccttatttgttcactcacccacaggcatacacatgcagggtcttcagtttagcctaagatgtaagtcagtgtctggatcagtgccttgcacacagtaggtgctcaggtacatgccttatggtcagcgggactttggaaaattccactagaaatttattagaatagggataaaaatggcaggtgattgcatagctaaagaaaaagtgcacagagtgctgaaattctagggactactgatgaagcttgaaggaggcagccttggggaaaatagaaataccagcggggctggcacagcacaggccctggcactggacagcatgggactgaattctggttctatcagctttgtgactttgtgtctcggtttcctcatctggaacaaggggaatgatgctattcatcttacagggctgttgtgcaaattagatgagttaatacttttaaagcacttaaaaaatagtgcctggtcccacaggtaatgggaaaaacatttacccatcacagcggccccacccatttgcagtggacactggctgtgaatgccctggggtgttctacttggccagccctgttctccattgtcctgtggggacagtggagtagagagagagagaaaaagatctgggtgctgcccctggggccctttggtgggaaatgcttaccacagagccagaacaaccagaaggaactctgggtgggacagagtgctggtgtgaagaagggacaagggcaccctgaggcctggagggagtcgtgtaactgggaatcttgggccatgtggaggaggggctgctgtgaggacttcgcgttgggagtctcagccacagaagcacttttgttttcttttcagagacagagtctcaccttgtcacccaagttggagtgcagtggcatgatcatagctacggcagccaccaactcctgggctcaagtgatcctcctgcctcagcttcctgagtagctgggaccataggcttgctccaccatgcacagctaatttttttttttttttgagacagagtctcgcttttgtcacccaggctggagtgcagtggcgcagtctcggctcactgcaagctccgcctcctgggttcacgccattctcctgcctcagcctcccgagtagctgggactataggtgcccgccaccacgcctggctaatttttttatatttttagtagagacggggtttcaccgtgttagccaggatggtctcgatctcctgacctcgtgatctgcccgcctcggccttccaaagtgctgggattacaggcgtgagccaccgcacccggcctaatttttttttattttggtagtgacagggtctcactatgttgcttagattgggcaattctgcctcagtctcccaaagtgctggaattacaggtgtgaaccaccgtgctcggccgtttttcttgtatgattcacactgacatgctgaaaacagcctctgccaccatgaggcagaatgtcaaagccaaaccatcagcatccaaagtatgccatgaggccagtgcatggagctgaaggaacagccatgtggccctgtggaagctgacagcacagctttctgacccgctttctgacgcaggtcagaaaggcagagaaagggcagacagaaaacagccaagccaccgggactggtaatccacacacggcttttagttggatgtgaaattcagagcaggctttgtttgccttgtgcgagaacacatgcctccaagaaggagcctgtgcagacaagcagcttgaggatcgggaaagaactgactctgaaaaggcattttcatttgtcacgtaggtgtcacatgtgggggaaccactcaagacccatgtttttcgtcatccctctttttgcaggtagtgctcagatagccctccctgcactctgtcttttttggattactttccttagaacattgctctctgcacgttcacgtccaattattgttaatccagtcactggggtgatagagtgagtgtgtgaggcattatctgctcccatgagtttgcttactggtgtcctgttacctttttttttttaatgctatatccagaatttggagcttataaagcaagcacaagttaggggttggtttgttctctctatcttaaatctcaagatcagcagtttttgaaatgacctcatgctcgtggtttccaaacctgcactggacttctctggcgatttgtgaacaggagggacatgcccagtttgtgacaggaagtgatgtgactccaggctctgcaaaagattccttcaggtctggtgacctggagactgtagcgttttcgtggcctgaagggtgggtggctgtgctgggcaggcgggatttacctcaacagagcacctttgctttgtccccgtccctcagggagccatttcttcctactacgtccagcgctacggatttcctccaggatgcaaagtggtggccttcactggggacaacccaggtgagtatctcggggagtttcactctccagtgagcctgactgggtccatgctggatgtttgagaattccagtccagcctcttggtgaaaccttctgtggtcattcctcaccacccccacccatgctggatgtttgagaattccagtccagcctcttggtgaagccttctgtggtcattcctcaccactcccaccctgcgatctgactccttgtacctgccccatcttagctccgactctgccctcaggagctggtcagtctgctctctctggatgaaaactgcccaatgattatggaaggcagtcgtgcccaccccatccctaacctgtcttttctgtttcaagatgaatagctcaattcctccaacccttcctctaggacatggttttaagtctctgccctgtcatctgatctgcagcaatgacttgtttctcgtccagacacctcatctccttccctagcctcttctcttcctcctcctctcctctgggtagccctgaagccactcctggaggggcccttggatctctgaaggaaggccaggtgggctacactgaataacaacctaactactacccctcaacctcacccccaccccaggaaaagtaagtctttttctaacgatccaccagattagggttacatttaacagtaactagaaaggttaattttaaccttaatcagaaagattaatttctgtcctttcagtcttctttctgtgctcataaataagcattgtttcttttaatcaacctgggcagtatctttctcattttaacagttgtctagagctcagttgtcccagcatttatttcactggtccctgatggatggagggtggtgttgcttcagtgtttgggcagtgcagacgatgttgagattcacattcggtctcgtctctttgttgttataggataagttctcaaaggtgggattcctagatccaaggcttctgacacacacactgctgattgaacctcagtggcagtgtttgagtgcacctgttcctcactcccatttcacctttattcacatgttgattcactcagcatttagtgagtgcctattatgtgccaggccttccttcagtgctggggcccttcagcaatcaaggcagataaagattgctgttgtgagccatgtgtggtagtgtgcacctgtagtcttagctacttgggaggctgaggtgggaggattgcgtgatcccggagttctaggctgccgtgagctatgatcatgccactgcactccagcctgggtgacagagtgagaccccacctatatatctcttaaaaaaaaaaaagattgctgttgtgggctttgtgtctaaggcagggcacagagagtgaacataacctcacccccttcttttccattactgcctttgtctttctttgctgtatatccttggtgtcttgtcttggcctccttgattctctgcactctcggaagtgcctgacagtggagggatgtttggaccccttcagggaagagacttcacagctcaaatcagcggccctgctaacagagacttcaccccgtgacccctatgaccttctcctcttagggcctcctgagcgctcagctcccctgctcctgcctccaccctagggtgtgggtgggggttggaggtgggggctctgcgcctgcctggagagccctgtggtttgctttgtggttcccatgtggccgccagctaaccagaagctcccctcccattctcagcgtcgctggcaggcatgagactggaggaaggtgacattgcggtaaggcgacttcccacacccataggctctttctgtttccacactcacacccacactctgataagtagcagaggtgctgctgagacccagatcccagggtcccagggtctgggtcccagcaggatctctgctacttatcagagtgtctgccggttccaaaagacagtggagggaggggatgggggcgcacatctttctcagaaagtcattgttctttgctagatgggcaggacccctgcctgcttcacagtggccagtcttagtgcatgcagtggcagagggtcagatgtggggccaaagggctgtgagcagcgcagatgaataaggaagacataacccagacattcctacttctagtgggaaagtcatatggggaaccagccatcacccaaaccattatttagatgcagttgtgggaaatcagcacagaagatccatgagatctgcatctggggagctaactcctggctcatctggtatgggagggtcagaagtggctcttagaaagtggccttgcatctgaggtctgcagcatgagtgaagtgacagggttaaggtgggtggagtacagcgcgtcgctggcagagggcagcgtgtgtgggcaaagcccaaggtgcccacctctgcctatctctcctcaggtcagcctgggcaccagtgacaccctgtttctctggctccaagagcccatgcctgccctggaaggccacatcttctgcaacccggttgactcccagcactacatggcactcctgtggtgagcttgggtgttggttggcaccattccctgggtgaggaggtgtgggcaggtctggcaccatcttgaggaccccaagtcattccactaagctctggaatgactccctccactttcccgggctctgctgggcaactgagacccccaaggactcaccagctcttgctgacagcagagctgggtggggaataacccaagaccctgtgtccttcaagcccaggttcaaattctatcctcaccagctatatcctgtgtgaccttgggcaaactctgtagtgtggcatgtctgagccacactttcctcatgagatggggagggtaagagcatttacctcacattgttactgtgacccgtctggcatgtggtggaccctcagcaaatggcgggaaggacatcctgcctcccgacggctctcatggaagggacatgctctgtgctctgaccacaggcctttggagacctgtccaaagctcctgagggaaatggtttctgagctcctaagccctaagaaccattggagaatgtggctagttaatctagccctccctgcctcattgtgcccatggtagaatgtgcagaaacccaagctccctgtctctacctggggctcctctgtgtcagcctcctgtgtaaacagcccaagacaagggcgtttccggcacctcccagggacattcaggggcctgaatctgaggaagagcctccgatacctaagtttcaaagcctgctgtgcactgactaggggtcgtggtccagcctgacctgcagttcctctgcctgagtctcttcactgaaactcatgggtccagtcagcaagcaccagctccctccctcagagctatgccctcttctgcagctttaaaaatggctccctcatgagagagaagatccgcaacgagtctgtatcccgttcctggagcgatttctctaaggcactgcagtccacagagatgggcaacggtggaaacctgggtaggccagttggtggtgcccaggcctgtgaagggtcagcagctgccgactggaggggcagagcctggggccccatgagctgggggagaggagggccgtggagaagtccaggggagtcctgtctgtctgcacttatattccacacatcctacaagctggtgtggaaccctgtgttctgagcaagggtggggctgtaaggctgtccttggcttctgctctgagcagaacatcaggccatagctatgtcttctgtccccaccaagcccctggtgacagcatcagagagggcagcctctaccctggtgcatccccgttcacagcctctgccccaggcacaaggaaaagtccccagtgtctgggcaggcctgagcagggagggtctgtgcctcccttggtcaaacctgttttgatattttaggattggctgggcagctgcttcctattccaggctgccaagtgagagcaggaagagttgtctttgagaaaagctagctcagggctccctggttcccttctatcctgttggagagaaggaactgagaatattcacaggtctcatctgggggatgaaagagccaggggacccagggatatggggtcattttgtcctgttctaagtctgttaagaagctgatcttttgttttttgactaatgacggctgatctcttcctggttttatttcaggtttttattttgatgtaatggagatcacccctgaaattattggacgtcataggtttaacacagaaaaccacaaggtacatgtgctgttggtgttggagttacattggctccatttgtgagtgtaaaatttaacaattgcctatcaaattatgttacttttagggacttcattcattcactcatccattaatatcatacacacttgtggtgtgccagggtgcattctagatcctggggaatctgcaggacctaagacagacacggtcctttccctcagggaggaatgcagaaaacctgagagttctcttcctatttaacaaatgctaacactatcattgtgtatcacagaacttatttccttggcgagttttatcctatacccatcaagaacccatggatcttgagatcatgaatttcctcctggttgaaagagctgctgagcccaggaggtactaacgtttattgagcccatttggtgccaggcattgtgctcatggttttctataccttcctcatttacttttctttttttttttttttaattttttgagatggagtctcactctgttgcccaggcttgagtgcagcgggacgatctcggctcactgcaacccccacctcgtgggttcaaacgatcctcctgcctcagcctcctgagtagctgggattatagatgcaagccaccacacctggctaatttttgtatttttagtagataggggtttctccatgttggccaggctggtctcgaactcctaacctcaagtgatacgccccctcccaaaatgctgggattacaggtttgagccaccatgcccggctatcatttacttttcaaagcaataggcactattgttcctctttctagatggagaggttgagactcagaggctcaggctaaataatctgcccagagtcacaaggtcatagatggtggagggggctcaaacccattcctctctggctctgaagctgctgttttctttctcctccacaatgtgacctttctcgggaaggatttagttggttcttgctcctcaaaattgacattgctgctggagagtcactggagagtcatcaccacattttgggttgtacctgagagatgtttctgaccccagtaaatggggggtttatgtaagacactctgtctggaaactgtaactgtcagagttggcgttggattcagtggcagatgatggcactacatgttggattatgaatggaaagctttgtataaagtaggaagttcatctcaatcttctgatggaggatcagtttggtttcttttgttagagtgagaagctatgcctgttctctttcatgcatatcaatcctagatttgtcaaggagaaagtagtgttcttcattcattcattcaaccagcagatatgtatgattggtgccaggcaccggggacacaaaggagaacaaaacattggtggcccttgctccccagagcctgctgtctaggagggagagggacagtagacgactgaatgagcatgtacatgaatgcagcaggtgctaaggctaggttgcagaagaacagagtgccgcaaaggaaagcagctggtgggcgggttggagacttaccctgggtggggtgatcaagcctgggcgtctctgagaaggtggcctttaggttgagacctgaaagtactcaggatctcaccatggaaagagtaggatagactttcaggcagagggagcagcttgggaactagaagaaggtcagtaaggttagagtgtagctgtttatgagggggatggcggcaggttctagcattggtctcaggtgccagagaagcaggagtgagcctggggttgatgcccatcagtgctagcttgaaggacatgccacaggggtgggatctcagcgtaagctcgtggctctcacttatctagtatgtactgcattttccaggctctgttgtctaatctgatcattgcaacaaccctaaaaaacaggcgccactattacctctgttttgttaagaaaaagaatgatagcaagactaatgtaacttattgaagattgcagagctgaatggtagacagaacttgaactctcagctgcctgagactaagttctgtaatgtctcttgactctcttcaaagtgacatgcatgtgaggctgtgagcttgtgtgcttgagtagtgtgtttgtgtgagtgtgtgtgacaggcaaagatagtggttaaagagcccagctatgagtttcaaatctgggctgttgtttaaaaagatcacacacagacacacacatacacacacgaatggacaatgagagttccttactctgtgcccaccttttcctggagacaggttgcagcattccctggggatgtggaggttcgagcactaattgaaggacaattcatggccaagaggattcacgcagaaggcctgggctatcgagtcagtaagtgagccactggcagcatgtgtcccggggtgggggctcagggccagctcactcgcaggggccagggctagtggggcaatatctactaaagttttcttacagggggacttgtgcaggagggaggtggagcctgacctcagggatggggtgagaaagtgtcaattggcacttgtaggcaagcatagaatagcagacaggttgttcccgcttctcagctgtgtccacaatagcctgaccttttggccaggacctgtaagacttcggaatggtctttctgaaaccctaagctccaagctgcagatgagctgtcctgagctctggactgcaaagacataggcagtgcaaggtctggggacatgaatggatcttggccttctagcctggccaggtcccattgcctgtgggacacagtctgggtctttcagcttggacagggaagagggggatgtagtaccactgtcaaaactcggaagactgatgtcttagttcattttctgttgcctataacagaatacctgttcctgggtaatttataaggaaaagaaatttatttcttacagttatggaggctgagaagtccaaggttgaggggccatatctgaagagggcctgcttgctagtagggctctctgcagagtcctgaggaggtagagggcatcacatggtgagggagctgagtgtgctggctcaggtctcccttcctcttctcagaaagccaccagtcccgttcccacgataacccgttaatccattaacctgttactttgttaacccatgaatggattaatccactcataaagccctcatgacccaatctccttaaaggtcccatctttcaatatgtcatgttggagataaagcttcaacatgagttttggaggggacacatattcaaaccatagcaactggcatggagagggcagacccagggccgggggaggcaaaaggaggagaaagggatttctgacaacttgagctgtagaataatcagcattaggatgtcagtgagttccccttacaggtggcgttggaatggtctaagggtctgtaaggaggttggactggccgcctatagagtccaggtttctaagatgtatttgtctctctgggctatagctgttgtcattagagaagatagtgaagctgctttgcttgagggccttcctatgatactctatggacaatccaagttctatgtaatatatattttatacctttgaatcaactgagtaaaaggatactataaaaatacctattagggaaacctcttagaaaacctgttagacagcatctgctaaagctgaatatacgcctacccagcaatctcatttctaagtaaaggcacaacaggaatttttgcatgtgtttactaaagatgtacaggagaacattcattgcagtactatgctgaatagccccacagtggaagtggcccagtgcccattaatagtagacagaaaaaatgcattgtggtgcatttgtacaacaggatactacacacaaatgaaaatgaaccagcctcagtgatccacaatgaaatgggtgaatctcaccaaatgtaacactgagcaaaagaggccaaacatggacatacatatggcaggggtctctgtacatcaaattcaaaagcagatggcactacaggccaggcacagtggctcacacctgtaatctccacattttgggaggccgaggcaggtggattgcttgagtccaggagttcgagaccagactgggcaacatggtgtgttgcgggaagtcagggaccccaaacggagggactggctgaagccatggcagaagaatgtggattgtgaagatttcatggacatttattagttccccaaattaatacttttataatttcttacacctgtctttactgcaatctctaaacataaattgtaaagatttcatggacacttatcacttccccaatcaatacccttgtgatttcctatgcctgtctttactttaatctcttgatcctgtcagctgaggaggatatatcgcctcaggaccctgtaataattgcattaactgcacaaattgtacagcatgtgtgtttgagcaatgtgaagtgtgggcaccttgaaaaaagaacaggataacagcaattgttcagggaataagagagataaccttaaactctgactgctggtgagctgggcagaacagaaccatgtttctcttccttcaaaagcaaatgggaaaaatatcgctgaattctttttctcagcatggaacatccctgaaaaagagaatgtgcgcctgcgggtaggtctctgaactggcccccctgggcgtagcctgtctcttatggttgaggctgcagagatgaaataaactccagtctcccatagtgctcccaggcttattaggaagaggaaattcccacctaataaattttggtcagactggttgatcccaaaaccctgtctcctgataagatgttaccaatgacaatggtgcccgaaacttcattagcaattttaatttcacctcggtcctgtggtcctgtgatctcaccctgcctccacttgccttgtgatattctattatcctgttaagtacttgatgtctgtcacccacacctattcgcacactccctccccttttgaaaatccctaataaaaacttgctggtttttgtggcttgtggggcatcacggatcctaccaacgtgggatgtctcccccagacacccagctttaaaatttctctcttttgtactctgtccctttgtttctcaagccagccgatgcttaggaaaaatggaaaagaacctacgtgattatcggggcaggttccccgataatggtgaaaccccttctctacaaaaaatacgaaaattagccaggcgtggtggcacatgcctgtagtcccagctactcaggagactgaggtgggaggatcgcttaagcctaggaggttgaggctgcagtgagccatgagaccctgtctcaaaaaaaataaaaaaagcagatgaaactatttactattgttggaagtcgggataattagtagttacctttcagaaggggcctgtggggtgctgtcaatgttctgtttcatgttccatgggtgtgtttagtttttaaaaatttatgaacattataggcttatgatgtgtgcatttttcaggatgtgtgttctaggtcaatacaagattttaacatgtgtaaaatgaccaccatgagcattctgattgccctcatcccaccaccctaagtgtaaaaagacgtttcctaaaggtctgcaaagacttccaagttccctgaaaatgagactgggtgagcagggcagggttggtgctggagttggtggagtgcctggcaggggtcctccggctgtcagaagagaaccccagggaacggaacagcccagcatacagggagaagcagttagggcaaaaggcccccatgggctcaggaggagctgatgggattgtggcattattcccagcctctaaggcatttcttgtgcaaaacagcatagagttacttatcctcttagcaagcttaaatgcagaatcagacctgtcttgccgctctgctgagtgatcacttaaatagacatacttggaaccaacagaggttgcacgcacgtgaggactcattctccaggctgctgtgtggactggccagctctttcgttcttgcccagacatcatctcatttggctttaatagtgtctaagggcaataaagaggcactttgaataaaaatgattattgtgatactaacagctgccagcatttgttgggcactgagtgtgtgcccggcccagttccttagcaattaatctttattaacaacagtaccgctgaagtaggtactgatatgattcccacttcacaaccgaggaaaccaaatcttgcagtggttaaataacttggtcagggctggcagagctgggatctgaaccaagccagtctggctccagatgctggattctcaaccactggctgaacctgctttttttaaggaacaatcgccctcttgatgtttatagacaccatcagacatgatagaaaccagctgggcagggctaataagccatagttttcagtttatatttcagtgtgtttcatgttgtttaggttgattgtaaaaacagtcaaatcttgtaataacaagtttgaaaaataaagaaaatgggcctggtgctcacacctgtaatcccagcactttgggaggtggaggcgggaggatcacttgagcccaggagtttgagactggcaacagagagaccatatcttcacaaataataataattataaatatcccagtatagtggcatgtgcttgtggtcccagctactgggggtggggtggcaggggtggcaggaggccggggggatcgctggagcctgggaggtcaaggctgcaatgagctgtgattgcaccacttcactctagcctgggcgacagagcgagaccatgtctcaaaaaaataaaggaaaatgactcataatcccatcccctctctccaaccactggtatcatttagggacattttctcccagtctcctttatgagcttatttccatacagccatagttttgttcctttgtaccttatatgcaaagggtgtatacaagaaccaaagtttgtcagaagtcatctttgtggtgctgcgtatgatggccaggttacttttcctgcatttgggcactgagggtgttcttgttttttttgtttgtttgttttctttgttttgttttgttttgtttttctggagacagggtttcactcctgttgcccagactggagtgcagtggtgtgatcttggctcactacaacctccgcctcccgggttcaagtgatcctcctgcctcagtctcctaagtaactgggactacaggtgcacaccaccacgcccagctagttttgtatttttagtagagacggggtttcaccgtgttggccaagctggtctcgaacttctgacctcaaatgatccacctgcctcggcctcccaaagtgctgggattgcaagtgtgagccaccgtgcctggccattgttcttggttttccaacgtggaatcacactagagcatcttccatagcttgaattatttccccaggaggatggcagtccttctctcttcccagacactgtcttcacggccagcgatgaagatgggagaagctgagaggtgggggctgaatgtcttcttctggacagagccaaggggctggatggaaagcagcaggtcttaaaaacaactatttgttttaaaatacataacgaatggatgtctttttatcacaaaagattcatgcaaaacagaaatatggaataagaagcaaatgcccccttcatttgcctcccagactcctttccttctttccagactgtgacttccttcctgtgagtttctgtgttagattgaatcatacggaattgccaatattgaagaagttttgatttacaaaaatggcaatttcatatggttcgacctgacacgtgtgtgtgtgtatatatttaacagaaatgctattacattctatgtgttattctgagacttgctttccataacagtatgtacaggtctacctttttgttttctaatgactggcatgaggtctgataaattattttatagccctagttgaaggacattaagattatttcttgttttgttttgtttttgtttttgttcttgttttgagacagagtctcactctgtcacccaggctggagtgcagtggtacaatctcagctcactgcaaccttcgcctcccgggttcaagcgattcttgcacctcagccacctgagtagctgggattacaggtgcgcgccataccacctggctaatttttgtatttttgtagagacggggtttcgccatgttgcctaggctggtctcaaactcttgacctcacgtgatccactcatcttggcctccaaagtgctgggattgtaacctccactttcaccatctcattctatgccctatacccttgtccctagttcattcttgtttgtgtattttttttcccttgagcatgttagctaaaggttggtatattttattaagcaatgttaatattttgttttgtgctcccttttattaatttctaattttatctttttaaatgctttccttctactttatgaattttttctttttctgtatttttaagttgaaattttagctcatttattcctatcctgtattaacttctaatttatgcatttcagaatgctacatgttaactttatttacataacatatctttcatttctaaaaagatagtaattttcatctttttctgcatcagtgagtggtccttcaaactggcccctcgtccttttgacatatcttccatcattccttgagcatttccatagcttctagtataaaaaaagtttcaggctcatcttgttttttccttggatcagccttgtaatcttccatttatccaaggggccctgacttctctgagtgggagagatgtttggatgctctctctggatgctcattgctactgggatgatgctgttcccagcccctttcagtgggctgagctgggaatatgtaaggatatataacaacccctttcagtgggctgagctgggaaatattaggatatatatatacatatccaaatatatatatgtctgtatcaatacacacgttacctttctatttgtctgtctgtctacttctccatgtgttgaaaaacatgagttcaaccctatacactctacttccagtccaacaccatggggttcattctggctttcttccttcccatatttgtatcttatcctaacagtgacaaagttgattcttctgacccctccagattgctgcctccttgacatgcaagccccattttggcttctctgcttacccttacctgtgttgtctctgtgtcgtctctccagcagcctcttgaatctgccccactctggttatgtacttacatgtggcccttgagccacttctgtttgcctatttaatggctttttagagaaggaagaagaaaaaagaaaggtaggaaggtagacaggcaataaatatttttaaagggaagggtccatttacatttaatgtaattattgaaatgattggatttaattgaatctatccatttattttttatttttttaatccatccatttacaaaatggattacatatcaatttttctttttcttttcttttgttctatatgttcttttttctttcttattcttttcctgtcttatttttggattaactgagcaatgtctagtattccattttatctcctctgttggctttttaaggtatacactttttaattgatttttaaattgaaatccttaatttgaaaagtctggtttgcactaatattatacacttgaattttttacgaacatgcttgcactacaagaatgactaaaggatgtcttccgggctaaagggaaaatcataccagatggaaagtcagagcttcaggaaggaatgtagaacatctataaaaagtggattctcttaagttttactttgtctgaaaatgtatttattttacttcatattaaaataatgttttctgctgtggaattctaggttggcactttttactttcagcactctgaaaatgtcatttcattgttttcttgacttctaatgtttcagataagaaattaactgtcattcttaatgttattctcctgaatgtaatggggttttcttctctggctgatttaagatttttctattaatctttgattttcagcagtttgattatgatatacctaagtaagggttttttaattattattttgtatgtatcccctttgtgattcactgagcttcttggatctgtgggttaatgtcttccatcaattttggaaaattcttagccattatttcttcaaatatttatttttccctattccctctttcctttcctctggacttcagttacacatctgctgttgtcccataggactttgattttctattcttttttttttttctctctctccctgcttcagttggacaagttcattttttgttttgttttgttatgttttgtttttttgagacagagtcttgctctgttgcccaggctggagtgcagtggcatgatctcggctcactccaacctccacctgctgggctcaagcgcttctcctgcctcagcctcctgagttgctgggactacaggcaagcgccaccacatctggctaattttttgtatttttagtagagatggggtttcaccatgttaggcaggctggtcttgaactcctgacctcaggtgatccgcctgcctcagcctcccaaagtgctgggattacaggcatgagtcactgtgcccggacttcagatggacaatttctatcacacctctttttattcatgtttctgctgtagacagtctgctattaagtccatctaacaaattcattttggatattatattttttctatttctagaatttccatttcattctcttatactttcttatgtctctgctgaaatttttcatattttaaccattttgtccatctcttcctctgactttatatcatctttataattattataaagctcctatctgctaattcatctcagagtctgcttttatttactattttactgccatttcctgcttcttaaaatgctatttaattttgtttgaatgctgtacgttgtgtttaaaagtacggtgttgactaaagtggctaatttttaaaccttttacttttgagataattgtagattcacatgcagttgttaaataaatagctaatgtttacctgcagaaaaggcttgcccttctatcaggaagtgcgggtgaggtggtggtttttttttgttttttttttttttttttttttacttttatcatttaatttttatttttaaaaatgtatatagtaaaaaagctgggttgcggagatgtcggtcagtggattaaaaattttggttagggtacaggaacatattcaagagatttattgtacaacatggtgatgatagtttataacagtgtattgtattcgtcaaaattgccaagagattttaggtgttctcaccacaaaagataagtatgtgaagtaatgcataagttaattagctcaatttagtcattccacaatatatacatatttcaaaacatgttgtataggataaatatgtgcaatttttattgtcaatttaaataagtaacaaaataagtaaaaaaaagtctagaagcctatataacagcatactaacagtgtaactctggtgtaactagggttggtttttactttcttcattttgtcttttctaattttttgtatagtaacttttatcactgggcttaacaggaatctaaaaaatgtatttttagcaattgttatgttatatccacaacatgatctatatattttgtcagggaggtttattttttgactcagaactagtttgttcttgaaatatgtactttattcttttaattagggcttaaaatgttaaaatatttctaaagaggactattttgggactctacagtgtacctctttaatgagaacacccacagtttaggcctattaaggcatacttcctttattttactaaagaattaaaataataaagatttgataattttctttcttttttttttttattgatcattcttgggtgtttctcgcagagggggatttggcagggtcataggacaatagtggagggaaggtcagcagataaacaagtgaacaaaggtctctggttttcctaggcagaggaccctgcggccttccgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcatagatcaacaggatcccaaggcagaagaatttttcttagtacagaacaaaatgaaaagtctcccatgtctacttctttctacacagacacagcaaccatccgatttctcaatcttttccccacctttcccccttttctattccacaaaaccgccatcgtcatcatggcccgttctcaatgagctgttgggtacacctcccagatggggtggtggccgggcagaggggctcctcacttcccagaaggggcggccgggcagaggcaccccccacctccctcccagacggggcggctggccgggcgggggctgaccccccacctccctcccggacggggcggctggccgggtttttttttgtttaatcaggggttggatcagtactagttagttttagttcaccagtagttgcagtgtcttgggatcaggatcagcaggatcaggcccctccctccatcaagtctttgggacctaaccactgagattacagagctctttctctgttttccagctcttcccccacttccacatcactgcttccatagtagttcactggagacatttggtgggtagggaggactagctctatattggagactcttccagatttcagtcctccataccagcccaaatgtagttgtttttcttttctagcaaattttatctgcctgtagagtcttacttcttcatgtctcccatgctgcaggtatgaatcagcacttaagggctcatctcattctggaatttattttatttagacttcttgaatttacaattttttgatagcttcaagcaaaaatatgatgctctggttgttgttgtttattccattctgtcattgttacagcacaaatgtgttctttcttgaccatcatcatcttagctggaagtggaactatatgtcttttattagattaaggtttattattattttactatttatttttatttatttattctaaaatggagtttcacttgctctgtggcccaggctggagtgcaatggtgcattctcggctcactgcaacctctgcctcctgggtttaagcaattctcctacctcagcctcctgagtagctgggattacaggtgcccaccaccacacctggctaagttttgtatttttagtagagacggggtttcaccatattggccaggctggtctcgaactcctgacctcaggtggtcttcctgcctcggcctcccaaactgttgggattacaggtatgagccactgtgcccagcctattatatttttttggagacaaagtctggctttgtcaggcaggaatacacccaggctggagtacagtggtgtgatcacggctcattgcagccttgaattcctgggctcaagcaatcctcccacttcaacctcccgagtagctgggaccacaggcatgcatcaccgtttccagctaatttttgtattttttgtagggacagaatctttgttgtccaggttggtctcaaattcctgagctcaagcaatcctcctcctgccttggcctactgaagtgctaggattagtaggcataagccactatgctcagtcagtttattgtgaaaaatatcatgtatacagtagagtatatgtatcttacagcaagttataaaacatattaatcaaacatctgatgatcagcactcgggttaagaaatagaacatcagccaggcacagtcacttacacctgtaatcccagcactttgggaggccgatacaggcggatcgcttgaggtcaggagttcaagaccagcttggccaacatggtgaaaccccgtctctactgaaaacacaaaattagccaggcatggtggcggacgcttatagcctactcaggaggctgaggcgggagaatcacttgaacccaggaggcggaggttgcagtgagccaagatcaccccattgcactccagcctgggagacagagcgagacttcatctcaaaaacaacaacaacaacaacaacaaaaaaaaagaagaaatagaacactagaaccttggagtcttgctgtgctcctcttccactgtatcctcatcttcccctcatccctgcagagatcatttctatccagatttttgtattataatttccctggaattctttatggttttgccagctgtgtatgcattcctttaaatacattgtggctttttgccctttctgaacttcatgatacatggaattatactacatgcggtgtgatttgctgctttagatcaacgtcatgtttatgaattcatccatgttaatgtgcatagatagctattagctgttaattttcattgtactgtgatattccatcacatgattatacaaccatttatccatttgctatgacctgactgtgtctccccaaattcacatgttaaaaacttaatccccaatgtgacagtgttgggagatgggcctgatggaaggtgtttaggtcatgagggctcttgtgtattaatgccactataaaagtgctttcaggagtgagttcaccattttctgcttttcagccatgtgaggacatagcattctggggattctgctaaacattctacaatatacgggacgatccctcacaaaaagaattatccaacccaaaataagcagggttttattctggttggaagaggaatcaagcttttttctgtgatgagtagagctactttccatgtttgtctccatgcctgctgtgggagctcagtgtcatttcaagttcctcttcactcagtccccccatgcaccctccccagctagtagcccactttcactaatgagcacttctttactttagcttggggacaaacactgctgctgcttctgctgctgagtgtaagggagtggagggaagggtcttgagacccctgctgtcatgaagtcagttgtgtactctcagcagcagtttatgagggttcttattttcccatatccccaccaacacttaacagcaacaacctttaaatctgttgccagtctgatgggtgcaaactggtatctcagtgttagtttaatttgtgttttcttaattaacgatgattttgttttgttttgttttgagatggagtttcgctctttttgcccaggctggagtgcaatggcgcgatctcggctcactgcaacctccacctcccggttcaagtgattctcctgcctcagcctcctgaataactgggattacaggcgcacaccaccatgcccagctaattttgtatttttagtagagatgggatttcaccatgttggccaggctgatctcaaactcctgacctcaggtgatacacccgtctcggtctcccaaagtgctgggattacaggcgtgagccaccgtgcctggccaattaataatgattttgaacagctctttgtaactctggtttctttctctgaattggctatgtacattctttcccatttttctatttgatttcctatctttctcttattgatttgtaggattttattgtatactttgaatattaggtttttgacagttttttgtgttgcagatatctctcatttatctgttgcttatttatagtgtcagcaatttaacagaattttgatgaaattcatcaatttttcatcttccattttatgcttttgagatattgtttaagagatttccccccactccagtatcacagaagtactgttttatgtttctcctgttgatgttacaattttaccttccacatttaggactttgatccatctgaagtctttgcgaatgatgtaacttgggatccaatttgattttttccacatgttgatccagttttccaaacactatttactaagtggtctgttttaccccattacttgtagtgccccctttatcatttatccagtccctatatatacatgggtctttctctgtactccctttcattttttttttcctttttttggagacagggtctcactttgccgcacaggctggagtgcagcggcgcgatctcagctcactgcaacctccacctcctgggttcctcccacctcagcatcccgagtagctaggactacagacaacgtgctaccatgcctggctaatttttaaatagtttttatagaaacagggtcttgccatttttcccaggctggtctcaaagtcctgggctcaagcaatctacctgccttggcctcccaaagtgctgggattacaggcatgaaccatggcacctgacctgcactcctgtttctacttcatgggtttattggtcttgttcttggggcagaaaaactgttgtattattgtggctttgtagtatgtcagtattagttggctagggctgccataagaatgtgccacagaatgggtggcttaagcaacagaaatttattttctcacagttctggaggctaaaagtctgcgatcaaggtgtcggcagggttaatttcttcttaggcctctttccttagcttgtagatggtcaccttcttcctgtgtctccacatggtctcctcctgtgtgtccctgtgtcttcattttctcttctcataaggacatcagtcatactggattagggcccacccctaatgactttatttttaacttaattacctctttaaagaggtaatatctgtctttatcttcaaatacactcacattctgagaaactggggtttaggacttccacatataaatttagggtagacacacttcagcccataataatgttttaatatgtagtatagcaattatcccctccttgcttttctttttaaaatattgtctgagctgtttataggtcttcatttttccacaaatattttataagaaattggtctagttccttaaaagagtccagctggaatttttatttaggttgaataggatgtatacattaattggaaaagattgacatatttataatgttaattcatattcattcaagaccatggaatatcttttaatttatttagatattcttttttgtactttaacaacaatttcaactttttcttaatagagacttttgaattctttgttaaggtattcccttacatgtaagtctaccttacatttctggttgctgttgtgaaagttaatttatatattttctattgtatttgatagttgattattattagaaatgccattgattattataagttgattttgtatctggcaaacttattaaactcttgttagttttattagtttgtttattctttattttttccaaatagatggactattgtctgcaaatgacagttttcttttcctttatttcaatacttatatattttagttgtttttgttatcttatggcattgactggtagatctaatactgtgttaaacagtggactggatactgtgaatctttgttttgtttgtagttgtattagttatctattgccatgtaacaaattatctcaaaatttagcagcttaaaacagtaataaatgtttattctcttatacagtttctttgggtcaagaatttggtttcagcatggttgggtgattctgattgaggatatctcctgaggttgcagtcacaatgtcatctggggctgcagtcatctgaaggcttgactgacgctggaggatctgcctccaggctggctcactcatgtggctgttggcaagaggcctcagtctcctgccatgtagacctctccctagggctgcttgagtgtcttcaggatgtggcacttagctttccccaaagtgagtgatccaagagagcatgatctgtgtcagagcgagatggaagcctcaatgtcttttatcatctagtcttggacttcatacttcatcatttacacaaggttctattgggtatacaagtcggccctattgaatgtgaggggggactacttgaaggtgtgaatatcaggagggagggattatgtggaggccattttggaatctggctgacacaccagtctgaaagaaagtgcttctaaatctctgttaagaatgacatttgttataagttgtggatatatgacttttatcatttaaggaagttcccttctcctgttttgttgagatatttaaaacaaaaaaagtattaaagacagttaaggtgggtggggcagcaaccttacaagcaaatgaatgtgacaggcctgcacacacagagccagctttggatctctcccgtagtcctgtgtgataagtgggaggcattggcccatcatgagccctctgtagctgaagaactctgcaaaaacagccctttctgccttgggagaactggcatagctattttacttttttcttttcccttgcagtgtccaagacaaagattttggccacaggaggagcatctcacaatagagaaatcttacaggtaagcgttagtagtgggccttacaccatggcctctcccatatctgttatgtctaagagccagagactggataggaaggacagcctccattcccactcctgcaggaatggggagctcttagctcacactccaggaagcagctctgttgccttacagctcacactgtgagtgggatctgtctcacatgcaggtgaattctatggctgtgtacaatccactctctgataccagcactgtcctctggagtcacatggaaagtgcctgttcttccacatggcaaaccttctcacatctagtgccagtgttcttgtcttcctcaaggcctctgccttccaatgtaaccatcgctgattctccaaccagtcctcttataacacagttgccagactgttactgtccttctggtccttcattatgccagaaacatatgaccaaaagtagaatcaacctgcagatgtctgacactcagactgtcacctgtggggctgtcagagcctgttatggagacattgtgcatttttgggtgtagcctggggctgccttaactgttagagtaactgtattagctgtttgcttgtgactacctatcttaggtaagatttttctagaaacagagcctgaaatgggaattcttctataagcagtttgttgagagagtactcccaggaagaaggaagtgagggactcagggcagtgcagaggaagaaggataagtgaggatatggtcttgtctggagtctacttcagctccatcctggtggggaggtggggctctggaacatgaattataccacagagctgattttaccttgggacaagggggccaacaggccaccctggggaggttaaatctcctgtgagcggtggcctatgctcagccaaggtcagctttcttgaggaggtagtgctgcaagccattagtagccagtactcacagcagctggggcaggatgcacaatggtccagtgagggggatctgggtcggcatcagtggcatctactacaatatctctggtcaactaagacctcccccaagttctttccatgtgaactcctcttagtacaggtcctccatttgaaatgtatgcaatttatttgtgaacctaaatgggaaacttcaccattatgcccatgaaacatgctcttgttagcttgggtttgtttgggcttgttaatgttagtctaatacccagctgtctccagccctaggtcagtgccatttgctaaacatacttcctaaatcttctgccttgtctttggtgaaatggctaaaaagtacagggacagcctggggagctgtggctctccactacggacttcccccagctcatcctgactctattatcaccagggtagcatgaccaagcatactcctcttaaggcagtcgaggtggaatggaaggggtcagaagacatatgagggagagagcctggaaagtgcatcccacaatgtctgtgttccctctgaggaatggctcaccacagtagaacctctgtgtccttttcaggtgcttgcagatgtgtttgatgccccggtgtatgttatagacactgccaactcggcctgtgtgggttctgcataccgagcttttcatggtaggttgatggagggagacagctatctctggaagtggccaggacatggggtgggctgaggagggtggaaaggggagagtgaggtgtacccagtctttggggacattggagtcttggggacttcagcttcatttttctagctcccagcaggtgagaaccaacccatactctctgttcctttattctttgcttaaagtggagaaaaagaggctgggtcctaactgaatgaggtctggtcagagttaaggtcagcacagggacatgggaaaagaacacagggcatggttgagagcacgtgggcatgagtctggacagctagagggcaggagaggtggacaaagtccagagccgtcttttcagcaagaacagaagttgaaacaaaggggaaggcttcaggcccaagcagtccaggaccctggacagcaccatggagccctgttgccctgttggaggcctcgctaaaactctgggtattaagggaagctccccgatctaggcgagttctggcaggagcagcacctacctgcaagggcagtccttcaagttggatcaatttgctctgtctcctgcttgctcagggagctcctgtagcagcccaggtggttctattcttttcatattcttaacatttaacatacctatttcagcttatatttttcttttcttttttttttttttgagacggagtcttgctctgtcaccaggttggagtgcagtggtgcaatcttggttcaatgcaagctctgcctcccgggttcacaccattctcctgcctcagcctcccgagtaggtgggactacaggtgcctgccaccatgcccagctaattttttgtatttttagtagaggaggggtttcactgtgttagccaggatggtctcgatctcctgactttgtgatctgcccaccttggcctcccaaagtactgggattacaggcgtgagccaccgcacccggcctaagcttatgtttttctatcaacgttgagaattaatcaggcaacatatccttctctcaataattaaccttggccgggtgtggtggctcatgcctgtaattccagcattttgggaggccgaggcgggtggatcacaaggtcaggagttcgagaccagcctggacaatatggtgaaaccccatctctactaaaaatacaaaaattagctgggcatagtggcacacacctgtagtcccagctactcgggaggctgaggcaggagaatcgcttgaacccgggaggcagaggttgcagtgagccgagattgcgccattgcactccagcctgggtgacaaagtgagattccatctcaaaaaacaaaaaaaaataattaacctcttactcatttattctctccccaccccatctacctcaccctgcctcatgccatatcctatatcaagatcacttgggaatttatttccagattcttatattaagtacatttaatattatattggcttttattcacacttacctatgagtctgcctgcctgcctgcctgcctgcctgcctgcctgccttccttccttccttcctctgtttgttactttgtcttttttttttttttaacttcctgacatttcggttgggtgcagtagctcacgcctgtaatcccagcactttgggaggccaaggtaggcggattatgaggtcaggagatcgagatcatcctggcctagagggtgaaaccccgtctctactaaaatacaaaaaaaaaaagaaaatagctgggcatggtggcgcacgcctgtagtcccagctactcgggaggctgaggcaggggaatagcttgaacttgggaggcggaggttgcagtgagctgttgcagtgagccgagatcgcaccactgcactccagcctggcaacagagcaagactccatctcaaaacaaaaaacaaaaaaaaacaaacttcttcttctttctcctttatttctatgctgaggttttgttttgttttgtttaagacaaggtctctgttgtccagcctggagtgcagtggcgtagtcatggctcactgcagcctcgacctcctagactcaggtgatcttcccacccccacctcagcctcccggatagctgggactacaggcacacaccaccacacctggctaatttttgtagatatagggtttcgccatgttgcccaggctgaactcgaactcctgggctcaagtgatcccacccacttcaccctcccaaagtactaggattacaggcatgaatcctagtgctaggattaccgcacccaggctgtatggtagttttgttggaatatacaacctaaataaatattttaagagagaattcaataggtgatggttttgaggcctgacatgtccaacaaggcctttgtttcatcctcccaaatactggctgggtaaaagactctatgttcaaaatacttttcctgagaactgtgaagatactcttccataatcttctggccttcagggttgctgatgagaagtatggggtctgcttcataattcttttgtggaagtgggaaaggagtttccctttagggacttcactgccatcctgcactgtgttttgttttattctttttccctttctgtgcttgccaaagggtacctgggccactgccctgctctgccctccaaaaccaaagcccgagccaaatcttagctcaccagtccctacccagagggatactaaccacttcatttggagatatcttctccccatctgggtctggggatgactgtcttgtgtagccagtctgcgagtatgagtggagatggaaccagagtcttttgattagtttctctgctgtccaccccaccaccattccagtccctcatccattctgctctgagctgggattttctagcatttggttaggaaaactggtcctcacatcttcagagggcccttcttcactcctggtggtggtggtgtttgtatatctgacgctactacctaccttccctagaaattgctcattgtttcttgcccaccaatggcaaccttccccctgctactcatttgcttggtgagtaattattgagtgccccctgtatgccagatggtgtgctaggcaccatggttatagtggtgacccggagagacacagtatctggcctcgtggactttacagctcagcaaaagagggatcttaaaccaataatcactgaaatatatgggcacaagttgggaaaagtgctctgaggaaaagcagatggtgctgagcgctaaggagggcctcctgagcaagtgatggtcttaggtgcatcttagctgaggagaagggaacaggcatgtgaagagtggaaagaacattccatacagtgaaaaggctctgaggcagaatgagtggagagaagaccaggctgtccagaatgtggtgaacgaggggagagaggaggggcaggcagacccttccccatcatatgtcgaggttacccgacctattccatgaaaggcacaaccacaaagagaaagacaagctgggtcctgctggagacaagcctgcacttgccatttttttgttttgttttgtaattttattgaggtacaatctatatgacataaaaatcatccattttaagtgtccaattcattgatttttcataaatgtactgaattgtgcaaccatcactataatccagttttagaacagtttgccaccccagtgagatccttcgtggtgtttttggttaacgtcttcacttgcaacatgcactaatgtgaagtgacctttcccttctaggtcttgcaggtggaacagatgtgcccttttcagaggttgtgaagttagctccaaatcccagactagctgctaccccaagcccgggagcttctcaggtgagagaccatcggaatttgtttgtagcatttgcattatgaaagcccgctagggttttttcccccaccaaaaggtcacctacattgaacgtgatgtgctcaactaaaggagaaattctgctttattgaaattatcaagaaaatggagctaaagggccatgttgtcagctgcaagtcacagatactgctgattttacagccagggtcagatggattgctgggcatatttgtattgcttcttatgcctcacggtgggcccttccatgtcactgggctataaaagctactgaaaggatccatcactgaaattcaagacatgctgggtttctagcactgaaatctcaagtctagacccaagatagctgtgcagtcacccaggccaggaaatccctgtgaaggcagacctcacttgttgcaggttgggtccctcagaaagcagagtctgagatgtcaactaagatatatgaggtttatgggagtcgggggagttgctcttggaatccacaactgcagaaaggaaagggagtagacaggattggacagagggagaaggtgagcagcaatgcaatttctggagcctaagctattcctacagaaagctccgaagctgagatgacctttagagttttacccagttggtctaaggggctgggcctttataccccatgtcaatcagtcatcacatgtgggccaccccaggatggggtgaggcagctctttatagctaaagcagtctccaaagtgggctgtcagctgagggctctctgccaacagcactcccatcagttgggagaataagttcttcattcccgaggtgaatctggatggcacaccatagcatccgccacaccactgcacctatttacagaagggtctggcagcccagcagcaggggtgggtgcatcttgtaaggaactgtgaagggtctgagatttacctgacttgcaagctaacaagtgagcctgccaccattttgtagcggcaggcagaagacacgggactcctggatcagagacaaagggctttattatgatgaaccatgatgaactcatggttcatcaggaagcatgagcttcatgcttgcctcattttcccttggcccccaaattccacagggtgatgcaaagtgggcccaggtggatactggcacataatagtctgtgatacaactaaatgatcccgagcatagaaaactcccaaccttgtaaagaaactgcgagcaaacctgtctaaactttgccaccaaaggagacattatcctttttattcttgtcagcaaacagataaacattctctccagtgtctctgccctggagagagacactatctttatgtctctatactttacaaacatccttgaaaagatggtctgaaacgaaagctgtcataagacatgtagaaacactatggagaattgtctcccagcatatcttggaagcaagagctcatgctgtctagagcagacaaaccacacacataggtgtgcccaagcatctgtaatttttctgtttgtgagaggctatttttctctcatgttcgagaggccactcgatacactggaaagattcaatgtcgagataaaggacatttaagttctgattcttattctgcttctccttcaccatgagaccttaagcagcactccttgtctccagacctctgtttgtttatctgtgaagtgggcacaccatctgtcctgcctccctttaacttgctaattgtgaggcttaaaaagaatccttgaccaaaatggctttataatctaataggaaatctgggggtagaattggttcagtggttcaacatgagaactctggtcatcttccctgcaattccttaggtcagcagtggacaatgggaacataatgtgagccacatatgtcatttaaaatattcggttgcctcattttttaaagtaaaagtaaaaataaaaataaatgattaaaattaattttaatacattttatttaatccactatatctgaaatattgtcatgtcaacgtgataaatttgaagttactaatgtggggccggatgcagtggctcacacctgtaatcccagcactttgggaagccaaggtgggcagattgcttgagcccaggagttcgagaccagcctgggcagcatggcaaaaaccgtgtctctacaaaaaattaaaaaattagctgggtgggtatgtgcctgtaatcccagctactcgggaggctgaggtgggaggattacttgagcccagaaggtggaggttgcagtaagccaagatcacaccactgcactccagcctgggcgacagagaccctgtctcaaaaaaaaaaaaaaaaagttactaatatgatattttacatttccttttttgcatgaagcttttgaaatttggtgtgcatttaacacttatagttctgggcatgcttcaagtatgcaaaggtatacatggcttgcagctactgtattggatagtgcagctctggatgtgctccacatggtgacaggacagctatagctgccccaaacatcatgtcttcacagctgtattcgaaggcagggatcagaaggtgacattgggcagagagtctctcctcacacacctcttgctcatcagggagaaaaatactggcctatccctcccctatcccacacacgcccaacaggctaccacttggtcatatggtcaattctggttgtaggaaagtctagggtagggtctggctctttcattctatctagaaggaggccagcaaggaggaagataactggggaaagttttagggcagcacagcagcgtctgcctcatctagagtacggagtggccaatcctctgagctgtatgtgcctcatcactctccctggcctgcccatggccgaaatcactgacaactcatggaaccctttaccattggatccaaatgtaacctcaaaagcccacccaacagcaggttgcaagcagtgacagtctatatgattgtcagcgtatgtgacttatatgcagactgaatttgtggactagagttaaacttcttgagagcagggccacatccttcattctctctgtggcacctacagcactgcttgtgctcaaggggaaactcaaagcagtaagaatgttttctcccttagctcagctgaacgttgcagtttctccatgaggagaaatcaaagccccttagctttgttctctgactccttaatgtccaatacaggctaggacaaccttaggcccctcgcctgtgggcctctttataaagggtcacctgttatcttttgctttattttactcatggggtctattcccaagtacttcacaaacacataattcacagggtagaaccagaacatcagctgtgtcaccctcatttggaagagcaaaggaatttatctccctaagcccttctaggcagcacagacttatcgtggactcagaagccagcaggctccttctctctggctctgacaccctgtgtaactgtccctgagccttctcagacagagctgctccagctgcaccaagagtaggccccagttgcataatcagttgttaaaatacttggcttccagctgggcgtggtgactcactcctgtaatcccagcactttcggaggccgaggcggatggatcacatgaggtcaggagttagagaccagcctggccaacatggtgaaaccccatctctactaaaaaagaaaaaaacacaaaaattagctgggtgtggtggtgcacacctgtagtcccagctacttgagaggttcaggcacgagaatcacttgaaaccaggaggtggaagcttcagttaatcaagattgcaccactgcacctccagcctgggtaacagagtgagaccctgtctcaaaaaataaaaaaacaaaacttaactttggagcaaattaaaccaaattaagaaggaatggggttggcatgagctcctacttgtgtttacttgcgagtcgcaggaaaatccgggtccttggtcttgttgtttgtctgtaagacagcgtgtgcttgcctgaagtgcatctgcatttctcaggtaagatggacagccacagggaaaactgcttagggggataaaagaagagtaagaatgtggggttgtgtttctttttggtcttttttctctgttgggctttttgtttatttattttggcttataatgcagcacattgtatatataattttgtagcttctttaaaatttctacattacaaaataaatatttcattcttaaaaatgtatgtgcataccatttttaatgactgtataatattctatctgggtagaccaggcacggtggctcatacctataatcccagcactttgggaggctgaggcgggaggatcacttgaggccaggagctggagaccagcctgggcaaacatgagacctcatctctttaaaaaaaaaaaaaaaaaaaaaaagctggcagccaagatggccaaataggaacagctcgggtctacagctcccagcatgagcaacgcagaagacgggtgatttctgcattttccatctgaggtactgggttcatctcactagggagtgccagacagtgggcacaggacagtgggtgcagtgcaccgtgcgcaagccgaagcagggcgaggcattgcctcactcgagaagtgcaaggggtcagggagttccctttcctagtcaaagaaaggggtgacagatggcacctggaaaatcgggtcactctcaccctaatactgcgcttttccgacaggcttaaaaaacggcgcaccaggagattatatcccgcacctggctcagagggtcctacgcccacggagtcttgctgattgctagcacagcagtctgagatcaaactgcaaggcggcagccaggctgggggaggggcgcctgccattgcccaggcttgcttaggtaaacaaagcagccaggaggctcgaactgggtggagcccaccacagctcaaggaggcctgcctgcctctgtaggctccacctctgggggcagggcacagacaaacaaaaagacagcagtaacctctgcagtgttaaatatccctgtctgacagctttgaagagagcagtggttctcccagcacacctctggagatctgagaatgggcagactgcctcctcaagtgggtccctgacccctgacccccgagcagcctacctgggaggcaccccccagtaggggcagattgacagcccacacggccgggtactcctctgagacaaaacttccagagaaatgatcagacagcagcattcgtggttcacgaaaatctgctgttctgcagccaccactgctgatacccaggcaaacagggtctggagtggaccgctagcaaactccaacagacctgcagctgagggtcctgtctgttagaaggaaaactaacaaacagaaagacatccgcaccaaaaacccatctgtacatcaccatcatcagagaccaaaagtagataaaaccacaaagatggggaaaaaacagagcagaaaaactggaaactctaaaaagcagagcgcctctcctcctccaaaggaacgcagttcctcaccagcaacggaacaaagctggatggagaatgactttgacgagttgagagaaggcttcagatgatcaaactactctgagctacaggaggaaattcaaaccaaaggcaaagaagttaaaaactttgaaaaaaatttagatgaatgtataactagaataaccaatacagagaagtgcttaaaggagctgatggagctgaaagccaaggctcgagaactatgtgaagaatgcagaagcctcaggagccgatgcgatcagctggaagaaagggtatcagtgatggaagatgaaatgaatgaaatgaagtgagaagggaagtttagagaaaaaagaataaaaagaaacaagcaaagcctccaggaaatatgggactatgtgaaaagaccaaatctacgtctgattggtgtacctgaaagtgacggggagaatggaaccaagttggaaaacactctgcaggatattatccaggagaacttccccaatctagcaaggcaggccaacattcagattcaggaaatacagagaacgccacaaagatactcctcgagaagagcaactccaagacacataattgtcagattcaccaaagttgaaatgaaggaaaaaatgttaagggcagccagagagaaaggtcgggttacccacaaagggaagcccatcagactaacagcggatctctcggcagaaactctacaagccagaagagagtgggggccaatattcaacattcttaaagaaaagaattttcaacccagaatttcatatccagccaaactaagcttcataagtgaagaagaaataaaatactttacagacaagcaaatgctgagagattttgtcaccaccaggcctgccctaaaagagctcctgaaggaagcactaaacatggaaaggaacaacctgtaccagccactgcaaaatcatgccaaattgtaaagaccatcgaggctaggaagaaactgcatcaactaacaagcaaaataaccagctaacatcataatgacaggatcaaattcacacataacaatattaactttaaatgtaaatggactaaatgctccaattaaaagacacagactggcaaattggataaagagtcaagactcatcagtgtgctgtattcaggaaacccatctcatgtgcagagacacacataggctcaaaataaaaggatggaggaagatctaccaaacaaatggaaaacaaaaaaaggcaggggttgcaatcctagtctctgataaaacagactttaaaccaacaaagatcaaaagagacaaagaaggccattacataatggtaaagggatcagttcaacaagaagagctaactgtcctaaatatatatgcacccaatacaggagcacccagattcataaagcaagtcctgagtgacctacaaagagacttagactcccacacaataataatgggagactttaacaccccactgtcaacattagacagaacaacgagacagaaagttaacaaggatacccagaaattgaactcagctctgcaccaagcggacctaatagacatctacagaactctccaccccaaatcaacagaatatacatttttttcagcaccacaccacacctattccaaaattgaccacatacttggaagtaaagctctcctcagcaaacgtaaaagaacagaaattataacaaactgtctctcagaccacagtgcaatcaaactagaactcaggattaagaaactcactcaaaaccactcagctgcatggaaactgaacaacctgctcctgaatgactactgggtacataacgaaatgaaggcagaaataaagatgttctttgaaaccaacaagaacaaagacacaacataccagaatctctgggacacattcaaagcagtgtgtagagggaaatttatagcactaaatgcccacaagagaaagcaggaaagatccaaaattgacaccctaacatcacaattaaaagaactagaaaagcaagagcaaacacattcaaaagctagcagaaggcaagaaataactaaaatcagagaagaactgaaggaaatacagacacaaaaaaacccttcaaaaaattaatgaattcaggagctggttttttgaaaggatcaacaaaattgatagaccactagcaagactaataaagaagaaaagagagaagaatcaaatagacgcaataaaaaatgataaaggggatatcaccaccgagcccacagaaatacaaactaccatcagagaatactgcaaacacctctacgcaaataaactagaaaatctagaagaaatggataaattcctcgacacatacaccctcccaagactaaaccaggaagaagttgaatctctgaatagaccaataacaggctctgaaattgtggcaataaccaatagcttaccaaccaaaaagagtccaggaccagatggattcacagccgaattctaccagaggtacaaggaggaactggtaccattccttctgaaactattccaatcaatagaaaaagagggaatcctccctaactcattttataaggccagcagcatcctgataccaaagccgggcagagacagaaacaaaaaagagaattttagaccaatatccttgatgagcattgatgcaaaaaccctcaataaaatactggcaaaccaaatccagcagcacatccaaaagcttatccaccatgatcaagtgggcctcatccctgagatgcaaggctggttcaatatatgcaaatcaataaatgtaatccaacatataaacagaaccaaagacaaaaaccacatgattatctcaatagatgcagaaaaggcctttgacaaaattcaacaatgcttcatgctaaaaactctcaataaattaggtattgatgggacatatctcaaaataataagagctatctatgacaaacccacagccaatatcatactgaatgggcaaaaactagaagcattccccttgaaaactggcacaagacagggatgccctctctcaccactcctattcaacgtagtgttggaagttctggccagggcaattaggcaggagaaggaaataaagggtactcagttaggaaaagaggaagtcaaattgtccctgtttgcagatgacatgattgtatatctagaaaaccccattttctcagcacaaaatctcctaaagctgataagcaacttcagcaaagtctcaggatacaaaatcaatgtacaaaaatcacaagcattcttatacaccaagaagagacagagagccaaatcatgagtgaactcccattcacaattgcttcaaagagaataaaatacttaggaatccaacttacaagggacatgaaggacctcttcaaggagaactacaaaccactgctcaatgaaataaaagaggttacaaacaaatggaagaacattccatgctcatggataggaggaatcaatatcacgaaaatggccatactgcccaaggtaatttatagattcaatgccatccccatcaagctaccaatgactttcttcacagaattggaaaatactactttaaagttcatatggaaccaaaaaagagcccgcatcgccaagtcaatcctaagccaaaagaacaaagctggaggcatcatgctacctgacttcaaactatactacaaggctacagtaatcaaaacagcatggtactggtaccaaaacagagatatagatcaatggaacagaacagagccctcagaaataatgctgcatatctacaactatctgatctttgacaaacctgagaaaaacaagaaatggggaaaggattccctatttaataaatggtgctgggaaaactggctagccatgtgtagaaagctgaaactggatcccttccttacaccttatacaaaaatcaattcaagatggattaaagacttaaatgttagacctaaaaccataaaaaccctagaggaaaacctaggcattaccattcaggacagaggcatgggcaaggacttcatgtctaaaacaccaaaagcaatggcaacagaagccaaaattgacaaatgggatctaattaaactaaagagcttctgcacagcaaacgaaactaccatcagagcgaacaggtaacctacaaaatgggagaaaatttttgcaatctactcatctgacaaagggctaatatccagaatctacaatgaactcaaacaaatttacaagaaaaaaacaaccccatcaaaaagtgggtgaaggacatgaacagacacttctcaaaagaagacatttatgcagccaaaagacacatgaaaaaatgctcaccatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggtgattcctcaaggatctagaactagaaataccatttgacccagccatcccattactaggtatatacccaaaggactataaatcatgctgctataaagacacatgcagacatatgtttattgcggcactattcacaatagcaaagacttggaaccaacccaaatgtctacaatgatagactagattaagaaaatgtggcacatatacaccatggaatactatgcagccataaaaaaggatgatttcatgtcctttgtagggacatggatgaaattggaaatcatcattctctgtaaactatcgcaaggacaaaaaaccaaacaccacatgttctcactcataggtgggaattgaacaatgagaacacatggacacaggaaggggaacatcacactctggggactgttgtggggtggggggagaggggagggatagcattaggagatatacctgatgctaaatgacgagttaatgagtgcagcacaccagcatggcacatgtatacatatgtaactaacctgcacattgtgcacatgtaccctaaaacttaaagtataaaaaaaaaaatctggcaaattttttgccagaactgcaatttactcgaacattttccttgccttagtacagttgcttttagtttttcaattataattaagtcttcttagataaaggatttaaaaaaaaaaaaaaccctttcctattctacatgagaatttgacctttggttaactttctagctctgttttccttgagatctcataaaagtggactatcaacggttttactaggcaacattgcttatgtaaaaatggcctttgcttgggaaactgcatctgaactgagaaaaccataactacctggtgagaagtcttcctcagggcctccttgagtgcagtgactcctcctggtcctgcctcctacctactaagttgttacaggagatacttttgtagggcatatgaggttttgaagccagggtcattcttttgtctgtatgatgtggatctcaactctttttttttttttttcttttttttgagacagagtcttgctctgtcacccaggctggagtgcagtggtgcaatcttggctcactgcaacccccggctcccaggttcaagtgattctcctacctcagcctctcgagtagttgggattacaggcacctgccaccacacccagctaatttttgtatttttagtagagacggggtttcaccaggttggtcaggctggtctcaaactcctggcctcaggtgatccacccgccttggcctcccaaagtgctgggattgcaggcatgagctaccatgcccggccagatctcaactgtttgtgcctgggctgtaacctggttgggaggcaaagagaccctctcctggacagctgtgtgaactgctgtatggactgctacatggtcttccattgagaggagcacctcctgccactgtgtttctccaggctgtcttcccttggctcatggtggtcttataagtctgaatgtttagtggtatcaaagaagacccttggtggacttggcatcctacatttaggattatttccttaggagagcttcaccaaagtagaataactgggtcccatactatgggctccttaatacagatataaagtcaagtctatttcccaaagagttgtatcaccagctttcaccagctgtgcaatgaggcagccatttctaggtactctcaccagaatttttttgaaattttgtagatttgatcataaaaattggtttcttgtcataatttacagttttaaaaaatcttaaactgtaggtttgagaactgctagcatttcctcttttgtgaattgatgctttctttcgcccagaaaaaaagttaaattgcaagtaaacgggatttaaaaattttaaattgcaaagtgcaaccagatgtaagaggcattttccccctctgttctaaactgctttttctgcccttctaggtctacgaggcccttctcccccagtatgccaaactcgagcagagaatcttgtctcagacccgggggcctccggagtgaacaggcatccctgttgcccctgcctgcccagatttactgaccccatttgtcgacatggccccagacaggagggatccacttctctgttctgaacagctcttcctgcccctactgactccttggagtgtccaggaccatcttaaagccgccctcagcacatctgcatgaagatagataggcactcctgtccctgtgcccgtgtgccccagggcaggaaagcatctctcttttcctgtcttttatcccaggaggcaggacaacactgagactgggatatgtccaataaaaactatgacttttccccttgcagaggcagaattaaagctaatctagggactcaaatcagcagaatgggggagacaaagcccggtctcaccccctaacctcatcctatctctttctccaaccctgactgcccactcctccacaaaccgtgacccatagccgcccccaccccataccttgatctaccatccatcctcttccccaatccaaaccccacagtctcttctctcccacaccctgccctccttgtttcagctgtctgaggtgcctcgcagggcctctcttacttgccccatgctcaccctttccatgctgtccccattctctcctttcaccatctctcctctccccctccttcatctctcctccctccccaaactcacttggcataattcacaacctcccacccaaacaatgggcctggtggacgtgcttcctgtgccctccctttagctatgcccacagatcactgagagggaccatctcccaagtggtgcagtttagaacttctctccctttttctccctcattccctctctcttcttgcagtccacttgctgaagaagttgtgtcatttctctggaagaatttccaaaattctggatttcttttttattttggagtatttcatcagctgaaaagtgattctcactttgagttttcttcctatatttgtatagtgagttcctttttccttcctctttatccctcctgttttactttatacctctctattccttgctcaaattattgcaaaagcctctatagaaagtcctctgtgatctgactcctgcagactcttccagatttttctgcccaaggcctttactgagctcaggactccagctaaatcaaaatacgcatgttctcacccagagtgacaaaatcctgcagataggtttaagacctagtggctcagagcagtagctactgggaagttaaaaggaaggggcttagaaaatgaatgggaccaaaggcatcacttctgatggagatgaagccatcttgaaagtgagtggtgtcctttggaggcatggtggatgaaaggcgcaaaggaagcaagaggttaaagataatggcccattagatacaacagcaagcccaagattccgaagaagacagacaactccccctagtaccacctagacattactttttaaagacattttacattattgtccagcagaaaaaggctgtcttggaccatgaaacagtaaactgtaactaaacacttcaacatgaatttgaaaataaataattgtggatataaaagaacaccagagatcagaaattcaaaaactcagaataaaaatgaaaaagctacaagcatatatgagaagagaactgactgaacttgggaaataatttgaacaaaaagataaatcttcacagatatgaatactaaattatatcttaatgaaaatagatatggtcacaagtacattaaggcacgtagaaggtaggagtaagaaaagctaagagaagcaaaacaaacaaagcaatattaaaggaagagccaaaaagacccagaaataaaatgacagataaagaagattgtcaaagaaaagatgatacaggtaagattggaactcatgaagacaaaagataagacagtggcatagagttaatatttaaaattcaaatattaaaactcaaataaaccccaaagaacttttggaaaacaaaagaaaaccttaaactttatcttgaaagggtctatcttgttacttagaatattgaaccagaatgattagctctgagacatagcctaccaactatactttgaagccaaagaaaaagaactatgtaagcctctaggccaaaagacctagtctcttacaaaggaaagacctggttggcctcaaacttctcaacaaagcaagatagcaatggggcaaccttttcaagaaactcaaagtatgaactgaggatttcatatttcaccaagctgtcctttaagtatcaaggatataggaagaagttttaattacacaagagcccagggactattatactcacaacttcttccttagaattctactaaaagacaagcttcatccaactagatgattggggaaacttgagcaaaaggactggacatgaccattgaatatctttgtagatctgaggccaaatggaagtggggataagggtggaagaaccgtattagtcccttctcacactggtataaagatagtacccagctgggaatggtggctcatgtctgtaatcccagcactttgggaggctgaggcaggaagatcacctgaggtcaggagctcgagaccagactggccaacatggtgaaaccccgtctttactaaaaatacaaaaattagctgggtatggtggtgcacgcctgtaatcccagctacttgggaggctgaggcacgagaattgcttgaacccgggggcagagattgcagtgagccgagattgtgccacttcactccagcctgggcaacagtgagactctgtctcaaaaaaataataaagatagtacccaagactgggtaatttataaagaaaagaggtttaattgactcacagttccacatggctggggaggcctcaggaaacctacaatcgtggcaggaggtgaaggggaagaaaggaccttcttcacatggtggcaagaaagagagagcatggacgcacaagagagcaagcagggaaaactgtcttataaaaccatcagatctcgtgagaactctctatcatgagaacagcttgggggaaaccacccccatgatccagtcacctctcaccaggtctcgccctcaacacctggggattacaattcaagatgagatttgggtggggacagaaagcctaatcacatgaaatagtatcaaactatatatgctttgacaagacagaagtaacaaaacaaaaaagaagggagagaggaagaggaaaatacaaagaactccttgttgcttaggcaatatgtagaagtcaaatagtattatttaaagttgacaaaccaagtatatgaagtgtaagtaaggaaaaagggagatttagagcattaaaggtgtactatactattaatagtatagaatacatagtataattactagaataaaaatgtaaatcatcaatgctcaaagaagcaataataaagattacagtgaaaaacatgcagtaaatgtaccatcatacagtaaatatattaagtccaagcatataagttaaatcagtacatgtgaaaggacttacctattaaaaggaatatcagattggcttacaaaccaatgtcttattgtctgttatttataagagacacatctaaagtaagtgattcaggagaggctaaaaaaaaagagatgggcaaaaatagaccagacaagtaggaccacaaaaggcaaagattacagtatccatatctgaaaaggtagaattcaggaaaaaatagacaagacaatgaaggatacattaaaatgctaaaagccacaattcacaaggaggatatactatttatgagtgttagagcttcagttatctggtttgtcaactttaagtgatattctttggctcctgcctatcccctgtacaacaaagagctctttctactttcctctttctctctccctcctttttcattgtttccgttgtgttacttctgccttgtcaaagcacataacatttgcataacaaattatgcaaggaaaaatgaatagaaacctagaaataacagagaaatttaaaacacctctctctcatccaagactgaagttaaggagacaaaaaatacatataacgatataagtgatctgagtaacagtatctataaagtagatctaatgaatatatgttgaactttctaccttgataatagagaatattactctagggcaagcgtgatggcccacacctgtaatcccagcactttgggaggctgaggcaggtggatcgcttgagctcagaagttcgagaccagcttgggcaacatggtgaaaccccatctctacaaaaattagccaggcatggtggcaggagcctgtagtccctagaaatttatgactcttctaggaatcaagattgttgtcccacagcagcctcacacacctggcatagcagtgattaaactcattgggagctatctcaaaaataattgtgagtgaggcttttggtacatagagtagactccaatcagacacataaaacccacagtacattttaggaagctatactaatggcattaacctggattaaaagggactaaatgttaaaagaccctggacccccaactttctatgggcaacaagcaggcatagttgctcaaaagacagtttctagcccaggcatagtagctcatgcctgtaatcgcagcactttgagaggccaaggcgggcggatcatgaagtcaggagttcaagaccagcctggtcaaaatggtgaaaccccatctctactaaaaatacaaaaattagctgggcatggtggtgcatgcctgtagtcccagctacttgggaggctgaggcaggagaatcgcttgaacccgggaggttgaggttgcagcgagctgagatctcgccactgcactccagcttgggtaacagagtgagacttcatctcaaaaaaaaaaaaaaaaaagtatatatatcaggccgggcgtggtgtctcatgtctgtaatcctagaactttaggaaaccgaggtgggtggatcacctgaggtcaggagttcaagatcagcctggccaacatggtgaaaccccgtctctactaataatacaaaaaaaattaggcaggcgtggtagcagacgcctgtaatcccagctactcaggaggctgagacaggagaatcacttgaacctgggaagtggaagttgcagtaagctgagatggcagcactgtactccagcctgggtgacagagcaagactctgtctcaaaaaaaaaaaaaaaaaaagatatatatatatgtatgtatgtatctatgtatcagaaaaaaacgcaagtacactttaagcatattttaaaatgcttactgacaaaaatcaaagagtttgataaaattctgtgttaccatggctgtggagaaataggcattcgtatacatttctggtaggagtgcaattttgtgaaactcctaaagggggaaattgggcaacatcaacaaaactaaatatgagtatgacttaaccattccaataggaatctgcacaaagacacaattccaacatacaagacaacatatgtataaggttattgtgaaattattgataacagcgaagtacttgggaaaaggcacatatacattaatatacgacagattgaatagattataatgcatccacacaataaaaaagaatgaggaagatctctatgtaccaatgatgggtaaattccataaacaaaggacagttctctacttagttctttttattccacttaacaaagttttatagtttttagtgtatgtcttacacatattttgttaaattatttgatatttcaaaaatgttttgtgataaaatgtgtgacatttatcactttaaccatgttttgtaataaaatgtatgacatttatcattttaaccatggaaaagtgttcattttttcaattgtttttgctagcatttaggaatattccatggtatgttgaattattcattgtgaacatattaagatcaaattcagtagcattaggtatattaccaatattatgctaccatcaccaccacacatttccaaaacctttttatcattctagactgaaactctactcactaaacaataactcctatttttctctccccagcccttgataaccgctatcctttctgtctctatggatttgcctattctaggtttttcatataagtggtatcatacatgtttcctcttgtttctggcttattccacttcgtgtgatattttattaaattttgcatgtgtaaaatagttaatattttaatgttttaaatttaaaggttcattcacattgtagcaaggctgaataatattccgctgtgtttatataccacatcctgtttatccattcatccatcagtggacatttaagttgttttcaccttttggtgattgtaaataatgctgctatgaacattgatgtacaaatatctgagtccgtgctttcaattttttgggtatatacctagaagtggaattgctgaatcatatagtaattctgtttaactttttgaggacccaccacagttttccacagtagctgcaccattttacattccccagcagtaatgcacagggatctagtttctctacatccttgtcaacacttgttatttttctttatatatatatatatatatatatataatagccatcgttatggatgtgaagtgaaatttcattgtggtttttatttgtgttttcctaatgactagtgatgttaagcacttttcatgttcttatttgccgtttgtacacatttaattgttttgatgctgttggaaaagtgtttcattttttcaattgtttttgctagcatgtagagatagtttatggtatatggaattatttgttgctaacatataaaaatcattttttttttagatggagtcttgctctgtcgccaggctggaatgcagtggcaccatctcggctcactgcaatctctgcctcctgggttcaagcaattctcctgccttagcctcccgagtaactgggattacaggcacccccaaccatgcccagctaatttttgtatttttagtagagacgggatttcaccatgttggccaggatggtctcaatcccccaaccttgtgatccacccgcctcagcctcccaaagtgctggaattaacaggcgtgagccaccacgcccagccataagaatcaatttttgtttgattttgtgtcttgcaactttattaaattcacttactagttatggtagtattttgtattagtaggatatgtagggtttctatccatcatgtcatgtcatctataaaaacaaagacagttttcttctcttcaatctgtaagcattttatttcattttcttgcctttctgcaatggctagaatgtctagtatagtgttgaatagaagcagggagagcaataatccttgccttgttcctgatcttagcggacagcattttatcactaagagtgtgtgtgtgaatacgccctccatcgggctaagaaatttccctttcatttcttgctggaggtggggaggaatatttaaaaagaatgtgtaggtttgtcttgaattttgttaaatgttttgcatgtatgtgttatggttttggtattatgtgttccttaaatatttgattgaattcaccagtgaaaccatcttagttagatgttttctttgtggaacttttaagtgaaaactcaatttacataaaaatatatggcccttcagattttgtacttctttttgtgtcagtgttaataatacgtatctttcaaagaatatccccctttttttttggtagagatagggttttgccatgttgttggtagcaagccctaaccctgtcataaacaggccttaaataaactggccataaacaggatttctgcagcaatgggacatgctcatgatggctgtcatgcacactgctaaaagttgttggtttactagagcagggcaaggaacacctggccccgcccggagcaaaaaactgctcaaaccacaaacgatagcaggaaaggcctgtgccttggcagcatgtttttgctgcagataatcagccagagcctgtttctctgctcctcgctgagattgctttgtttcccataaagattgcttttagctaatctacaatctatagaagcaatgcttatcactggctttctgtcaataaatgtgtgggtcaagctctgtttgtggctctcagctctgaacgctgtcacccctgatccccactttatactgtattcctgtgtctgtcttaattactgtagcgccgctgggttggagtctccacgaccgagctggtctcggcaagtggtgcccaacacgggggctcgaacctgggtcgaatagtcgccagagcgatggttagaaaatgtggaactacactggaggacacccgagtactgttaaagcaatcctcatggtgagtaagaaggggagctcagaagcatcagggtaacaatgggacaagggtcgagcaggcatgaggcttatttgagtctgcttcgccatctcagaaaaggaggagtgaacgttagcactagctgacttacgcagctttttagtgcagtagagaaatattgccgctggtttccggaccgaggaactgtgaatgtagaggtctgggaaaaggtaggcagcacactgaaaaaggcatataaggatggtgttggggatattcctataactggtcagtgtgggctctggttcattccaccttggagcctttccacacagatgacgaggaggaggaatcagaggaagaaggagagtctaacgaagtaacagaagaggtgacagagcaagtttgcttgccagctaaagcagcagagtagggagaggtttgtccctacccctctacaccccctcattattttgaagaaaaggagtggcctgaccctccgaatctttcttttccagaggacactgggcgaaaagtagttgccccagtgactgagcagtgcctcgagcaaccgctgtcagttctattcaggcaggaatccagcaagctagacaagagggtgatatggatgcttggcagtttcctgttagaatacacccacctgatcaacagggaaatattatggctacatttgagtcttttccttttaaaatacttaaagaatttaaacaatttattaatcaacatggaccaggttttccttttgtaatgggactgttaaagaatgttgctgtctccagtcagatgatgccagcggtatggcaggatcacttctaggtaggtctaatttacatttaaaaggagtacaagtacaaacaggagtcattgattcagattacagtggggaaattcaaattgttatatctacttctgttccctggaaagcagagccaggagagtgtatagcacaactcctgattgtgccatatgtggaaatggggagaagtgaaactaaacagacaggaggatctggaagtacaaataagcaagggagagcagcttactgggtaaatcaaattactgataaacatcctacctgtgaaataactattcagggaaagaaattcaaagggttgggagatacaggagcggacgtttcaatcatttctctacagcactggccgtctgtgtggccaattcaatccgctcaatttaacatagttggagttggtaaagcccctgaagtatatcaaagtatttatattttgcattgtgaaggaccccatgaacaatctgggactattcagccaattgtaacttctgtacctataaatttatgggggagagatttattacagcaatggggagcacaagttccccattacatagaacaattatatagccctcaaagtcagcatgtgatacaagagatggggtatgtgcctggcatgggattagaaaaaaatttacaagggttaaaaaaaccagttcaagcggaaggaaaaaattcttgtcagggtttagggtatcatttttgatggcggccattgttaagcctccggaacctatacctttaaaatggttaacaagtaagccaatttggatagaacaatggttgctgagtaaagaagaactggaggctttagaggtcttagttactgaacaattagaaaaaggacatatagctctaacgtttcccccctggaattctccactctttgttattattattattatttttcttaagatggagtctcgctctgctgcccaggctggagtgcagtggtgcgatcttggctcactgcaagctccgcctcctgggttcatgccattctcctgcctcagcctcccgagtagctgggactataggcgcccaccaccacgcccggctaattttttgtatttttagtggagacggggtttcactgcattagccaggatggtctcgatctcctgaccttgtgatccacccaccttggcctcccaaagtgctgggattacaggtgtgagccaccatgcccagccctccagtctttgttaagaaaaaatgtgataaatggagaatgttgacagatcttagagccattaattcggttagacaacctatgggagcattgcagcctggactgccttctgctgctatgattccaaaaaattggcctttaatagtcatagatttaaaagactgtttctttattatccccttagctgagcaagactgtgaatggtttgcatttacaattcctgtggtaaacaacctgcagcctgcttagcgttttcattggaaagtgttgccacaaggcatgttaaacagtccaatgatttgtcagacttatgtaggacaagcaattgaacctactcgtaaaaaattttcacagtgttacattattcattatatggatgatatactttgtgctgcccccactcaggaaatattactccaatgttataatcacttgcaaaactcgatttctcatgctgatttaattatagctcctgacaaaattcagactactactccttactcctacttggggaccttagtaaatgacactaccattgtgccacagaaagtaaccatacatagggatcaattgaaaacattgaatgactttcaaaaattactggaaaacattaattggatatgacctgctctaggcattcctacctctgccatgagtaatctcttttctatccttagaggagatcccagtctcacaaacccttggcaattaacaaaggaggctgaggcagagttacagctgattgaaaagcaagtgcataaagctcaaataaatagaatagatccagaaaagatccagaaaagattgatttttccaactcagcattcacctactggtgttgttgttcaagagcaagatcttgtagaatggctttttcttccacatactaatccatggactctaactccttatttggatcaaattgctactctgataggaaatgggagaactcaaattgttaaattacaaggatatgatcctggaaaaatttttgttccccttacaaaggcacaaatacaaaaagcctttataaatagtcttaattgcaaacccatttagctgatttcataggtgttcttgataatcactttccaaagacaaaattatttcaatttttgaaattaactaattggattctccctagaataactaaatttaaacgaattgaaggtgcggaaaatgtttttacagatgggtctagtaatggtgaagcttctaactctggatcaaaaagtaaagttttccagacgccctatacttcagctcaaaaagcagagcttgtagttgtaattgaggtgctgacggttttgagatgcctgtcaatgtaatttctgattcttcatacgtggttcattccacacaattaattgaaaatgttcagttacaatttcatgcagataaacaactgatgactttatttacccaattgcaaacagcagttaagagtagaatgcaccctttttacataactcgtattagaggtcatacacctcttccaggacctttgactgcaggaaatcaaattgctgattgcctagttgctatggcattatctaatgctagacactttgataatttaacccatgttaatgcctctggtctcaaa

SEQ ID NO: 567 - DNA, 66859 bp, Homo sapiens
tcctaactctgtcaactttttgggaaacactaaatgttttattaacattctgaatatttgaaacccttctgttgtgacttgtagaggctgaaattttcttctttttaatggtatcccaaagactcctctgcaaaaataaggaaaatataccaattaagtttgtagctattgaatattaaataagcaatattacttcaagcctgttatcaaaataagttttatttattattaaacaatttcttagagtaaatcacagaatggttaaaacattacctttttctttttctgctcttctgcatttcctagtaatatagcttggtgtttcagaacatcatttacaagaaatgtcataatctctcttactcggccttctttgagtggtgtccagttaacagaaataacaattttctctttaggctataatcaaaacaatacattatataattacaatagtaattacataataaccaaaacaccttatatacaacttacaatatagtagggcttaataattgttaaccaacactctatatactaaacatttaataaatcaaatatatttctcctaccctatctgcttaattataagaaaaaaagtcactaaaaataacagggttcacaacaaaataaataataaaatcttaactgtattaaagcaatagaacagatagtctctaaatcattttgtttgagtggtttcaaaagatttaattgtacatttctaatttttagatgtgtagagtacttctacttcaaacacaaggaccctgcattatgaagactttatttaaaaagaaatgtaaagatgatcagctaaattccttcttccttacaaattcctctaaggtccacatcatcatactgagatttcttaaacaggtattattgttccaggcataagtgcaggtatcctgtaaaactcatttaatgctaacatccctaggaagcaggtattatgattatgcacattttacagatgaagtaactaacatccagaaaagtctgccaaagtcacgcaggtacctattagaacccaggcagtctaatgccagagtttggactttaacatctacaccccacaccctggcaggtagacagaatctgccaaatttaaacgctgacatgacaaaacaaattttgtttttcaggagaaacagacaagtttctgttttaaaggagaaataatataacatcataaacaactaattttaaaaaataagaatggtgcatttttactctataaaatagtttattctaaaaataccacaaaatttagttccacattataacaaaaaagagtaagttgaagtattatgtggatagaaaagaaatctgtctttccaaagaaaggaaagcaggcagtgattcatgaaacagaggggcggggtgggtaggttctgaagtgtagatagatgaaccattggtgacacacaagttaagggacctcagattagaatctcttttttctgcctaatgaagtggttattagcctactagttcagacctcctcggctaacggttttcatacttttggtgattctactcaatggaaaggtcacagcagtcaaaataaaaacataaattctccagtctttggtgaaggggattggagcattactcttgcaaatgcaatgcagtaaaagaaagctacaggagttcttgaaacaacatttataaaattaaatttgatgcagcattaaaattacacttaacagcaaagaaaaaaaggactaaaatactaaagtgtgcatacatactacacgtatatattgaaaacaactctgaataggtttttttggtttttattgtaggcatttagccagaacaaagctcactatttcaccggaaaaaaaaaccagttacctcgactctaagggtacatatggaaactaaaatgcatattaagatggctgatagaaattttaaaaaaagctgctttaaccaaccaaggtactcctgtcaatcttaaaaaagtgttaaaaaagtgcattgtctattaatttagaacggcaaggctatttcacaacgccttaagtctagtaaaagtgcttgtcaatttaacagagaagtctatataacttgctcctaaagatgctaagtgcgcgcgcgtttatgtgttgtccccgcccaagttagcgtctatcctagccttcaattagagaatatatatatatatatatatataatattgacacatatatatatactcacacacatgtgtatgcgtcaagggcccacccacagttattgaaaaggaactgacttcactctctaagggtcttttctgatttcttttccaagagccacccacagttattgagtgaaagggaactgactttattctctaagggtcttttctgatttcttctccaatcgtcaaccttcctgaggagggtggcaggaaagatagcggagaagcagaacaccggcctggagcacgctcctcctgagacctacctgcaacacgaaacagcgctgcgacacactgaagcccaggtccgcggccgggaagtgggagatcttcacttctgccacctcctcgttagggttgtctagggccagagacagcgtccgtgaggctcccaggagaacgtccccgaagcaaaggaaaggagacctgcagaagtggctgagagacaggaccggcggggaagacgcctcctcctcggccgcggggccccgcagccccgcgggcggcctccgctcggtcgggctcacttcccagcagcctcgccccactcgccggttcgccatggcagattcgagacccctcctggatctccttgccccgctcccacgaggcggctccggagcggggatccgggacttacgctgaccgcttcccctcaggggcggctgtagaggtcgtgggagtgaattcggccctttttcttttccactaacctactccctagaaaacagaaaacaagcccaataaactcgcaaattaaaaagaggagccaaacaagtatggcgttttgactctgtttaaacttgccgcctccaccaatgaggacctccgggcaccgccctcctcgtcacgggaccaatcggtgagcagcatcccctggccaatgagacggcggcgcttcatttgaatgattgcatccggccgccaatcgctatctgcggaggaggtgagaacggtagcggaatcctggccaccgtctaaaacccggggcttagaattgaaattcgtctttatatttttggttgtgctgaagggaagggagtcacagcatttccacaatacatgtagtaatcattgcggtttccaggaacaatcatagataaaactgttacgtaggcaaaaattggtttatgccactcctctcatatgcataccccgcccagaattatattaactttactgtcgcggtttccagggctgaatggtagagatgtaaagataattagtttgtatgaacatgcttattttagtgacaacatagcagggactcagtacatttacatgctgttaattacctcgggacgctgggagcaaaaccaggtaaacaaatgaaacctgagattaccagtaattcataaatgattgttttgactggcaatgcccttcacaaatatcttattagtttttatttcaattgtagggatctaataataattatagcttacatattagggattttttaaattatttatttattttgagatggagtctcgctctgtctcccaggctggagtgcagtgacgtgatcttggttcactgcaacctccgcctcccgggttcaagcgattctcctgcctcagcctcccaagtagctggaattagaggcgcgcctcaccacgactggctaatttttgtatttttggtagagaggggagttcgccatgttggccaggctggtctggaactcctggcctcaagtgatccgcctgcctccgcctcggcctcccaaagtgctgggattacaggcctgagcggcgcccgaccctaggctagggattttttaaaaatcctttacctatttatctcaacctttgccttaaacctacgaggtatctcttagggcgtaggtaccattatttgtatcttacagatgaggaatacaggtcatacagctaagtaggaagtggcataacccagataggtacacatgcctgtaatcccagcagtttggccctagtcttgctcttacccactacactatattgcctctaaaggcagtagaaaacttaaaaaataaaaataatgtctggatgtatgtatggttacacaaaacatgtaaaaagagaagtcaatgggaaatcaaaataaggaagatgagacatgaaattatattcaatggtgtccaatttcacctgaagttggaccttaacaatatttaaacgaaatttttccactgggcacggtggctcaagcctgtaacccagcactttgggaggctgaggcaggcggattcttgaggtcaggggtttgagaccagcctggccaacatggcgaaatgccgtctccactaaaaataaaaaaattagccaggcgtggtggagcatgcctgtaatcccacctaccccggaggctgagacagaagaatcgcttgaacctggggtggggggtgggggcaaggttgcagtgagccgagatcatggcactgaactccagcttgggcaagagagcaagacgctgtcaaaaaaaaaaaaaaaaaaaaaaaaaattctttcatagaggcttaaaaaaaaaaacaacaaaacaaaaccctggagcagagcctcacaagtcatttccagttctcctcagcatctaccccccacgacctctccattagcttagttaggctccaaaaaataaaacttggacggaggagagtgcaagatatgctgtgggagggaggaaacagcctatacagcaaagagttaaaagattttgacagtctaaggtggaatgtaatggtgttagaccaagaggacaaatcataaggaacaataaggccaaatttattgtcatgggtgcactttacccatttaattaatacaatgtccgaagtacctgggaatggctttaatagtttaataggttcactaattgaaaactgaactcagtagtggtttacagtcaggtaggtcaaggccaggcacggtagctcatgcctgtaattccagcactttgggaggctgagacaggaagatcgcttgagcccaggagttaaaaaccagcaacaaagtgagacatggtctttataaaaacaaaaacaaaacaggcagttaggtcaaaatgctcaaactacctggcattctgtacacgaaggagtccaaaagctcaggaagataggaatgttggagaaaatctacatgtgcaacctgcttggccaagtcacatctaaacatgcacaccctccacccattctccttttaccaaggtgttgataaatgcattaactaataaaaaggactccagcatccatgaaaagacctgggtgactattttttataggccagaaatgatgatagaggatcaataatgaaaataggttctctgatctccatgtgaattatatgatccacaagtggtcaaagtcgattggcacttaatagacaaggtggtatagttcttaccacaatatgctaatggcagaattgtaattagaggcagggatctgtggcaatggccagtttctcaagggccctataaataagatgagctatatactatggtgctgcctaacatatataggcagagaaataccacatatgcaaagcaaaaaacctaactgaagccaatgttgtggcagttatgccttttacccactttccaaacttaagacagttcatacacccaaagctccttgactagaaagaaccctgcaacacgaataccataaatcttctctcaacaattccccagagggaactgcagtcatttacccacatgaatatggattgggggcaggaacttgacttcctaagggttattagataatgagataatagctctgcctttctgctatactccagaatcctaaaatgtcactgtggaccaccagacatagtgagagcttctcaagaaccggtgacagatggcatctaagtcagaatctgtcttaccaagtgtcctttggatccacccatttccagaatataaaataggaacacttactgaccacattctcacactggttcctagatccaaggaacaagggcaattattggagaaagggccaagtggaagcccctgaaaatcaccattttcccaccacggcaattcagagattattctgaatacctgagagatgttgggatagtgattttgtccatatacccactttctccacttatttggccagtgcaaaagccagatagattctggaaaatgatagtagattatagcaattaggtgatgatgccaattattacactacagtttcagatgtgttatttttatacacaaatcaacatacctttgtcagctggtttgcagctatgaatcaagcaaaatgcatttttcttgtttttccccattcatccagtattgaaaaaccgaagcactttgtacttaagtagtggtacaatgctgtagcattactgtcctgcctcagggctcgtcaaatttcctacctatactgtaatattgttcagagagacctggatcttagtatcacactggtccattatattgatgacatttgctaattaaacctggtgagcaagaagtacttgtcaagaattgtgtgagtctgagattttatccctcttgcaagctaaagagttagcgtgccagtttcataaaggccagcagaaaatatgacagttttgggttagagacaagactttattattcacagaaaaaacagtagctagagtgtcagcatgttcattcacattgattcctcctgcttcctaagtctcatgggaccatacaaagggcccttgatggatgcctgcacacacagtgggttgtattacaggaaaggaagagcgaattggagatttgactgtttttatagtactatgcctgggcagggagacatcctatcgtccctcaagatttctgcaaacacaatcctgagaaatggcctatgtagaaattaataagggcttcacattcttagcatagccagcaagaatgtgtaggcctgctcagagcccatggtaagttgcatctctcaacaggagcaagcactgtggatgccaataataaaacaaatgtaaaccagatgggacaaagttcagggtcctatcacatctgtaaagtttttagggatccaatggtctgagacatgtcaggctatctcttctaaaataagaggcaacttgtactttgtatcatttgtaaagcctctttagattttggaggcaatgcatgcattattaagacacatctcaccaaaccatttacctagtaaactctaagactgacatttttgagttaggcctggaacaagtaagatctctgcagtaggtctgggctgcaatggcccaaaacactcattccatgacaatccaagatgtggaatagaagctctggcaagtttccagagaagtatcacagtacaaaattccaggtttggagaataagactatgccttcctctgcagaaaatcatctatcatttgaaaaacagatcctaattatgctattaggtatggtagagactgaatgcctcatcaaaggactataagtgactgtgatacaaactgtttattatcaactattacctaatccagggatcagcaaactatggcctaagggctgaatctgacccattggcttttttttttttttttttttttggcaaataaagttttactggagcaaggccataagcatttatttacatattgtctatgccttcacactgcaatggcagaatagctgtgatagaaaacatatagcttgtatagcctaaaatatttagtgtctggccctttacgaaatatttgctgacctgggatctaatctcaaggaccataaaatttgatgtgaagagcaacattgcactatcaaacaaaagcagaatctacaagaccagggctaagcaggccccaaatacacaagtaagtgatacaaacaggtgattcagattttagtaagtatcttttactacttctactactttgccacttccctctctctcaaactacacaggaaaaactgggtatctcttaatgataatttcacaagaaaaaaggcctgatttatgaatgaagctgtatagtaggtcagacataaacagacttacattacagcttctccttaggggtggatgggaatactctcagtgagaattctggatggtatgtttggtagtccacttcataaggaagagaacatggcctaaggtaaagctctgtgctgattcatggataatggctgacaggttggccagctggtcaaacctttggagaaaacaaaatggaaaattggtgacagcttggtctggggaggagcggtatataaaagggcttctcaaaataggtataggaagttaaatttgtgttccatgtaaatgcccatcagagaatatccatggctgagaaggagctcaaaaatcaggtaaaaaggacaatctatcctgtggaggtcagcttcttcccccagagatccatttgcttgcgcgttgaacccatttagaaagtggctatggcagcagtggtggaggataagaatgggctcaaggtggtttcccttgccaaagctgatgtgataagcccctgtggagtgcttaacctactgaaagaggctgatgctgaacatccagtctaattccattctccagtgggaccagctaactacctgtggcatgtggttacattgaacgctttctattatggaagatgcaatattcttcctctctgggataaatatatttttctgagtatagattactgtacctgcccccattatatatatatttacagaaagctttatctataaaccaatgaatatgtaatggttttcacatatgtccaaaaatttgttgctatcctctcttcaagagagggagtttaatttgtgtcccttgcatgtggactagaattagtgacaatagaatacagaagtgatactatatcacttccaagattaggttataaaaagacaacaactgaaatcctgggtacgctctcttttttggattgctttcaggaaagtggtgtgtgtgtggaggggtggggggaaggcggggcaggcagttgccatatcactaggcagccctgtggagaggccatgtgatgaactaaggccaaagaccacgagtgagcttggaagtaaagccatccccagtgaagcctctagagatggcaactgacttaacagcttgatttcaatctcatgaaagaccctgagctaaaaccacccagctaaatccggcctagattccttacccacagaaacttggaggtaataaaagtttgttgttttaagccactaagttcggtataatgtattagacagcaatagtaaactaagtatcacacacgacattggctataatcagaaaactcattttgcagaaatgtgctcatgcctatagaatttactggtcttctaacactcagaagcagctgctgagataaaatagagaaagtctattggaggctcacttatggtgccagatagggataacaacttgcaagtttgggggtaccatcctatagcctacagtttatgctttcaaccaacaaccatttctcccatagccagaatgtatgtttctgggagtgagggggattagaggtaagagtggcccctctcaatattatacagaataactcatttcactaatgaattttactacacttcagacttctctctaaaaaacagcataatatgactacttcaagcataaaagtcatcactaatatttgaatttatattacacttaaaattagtttaatggtttatacatttaatatataaaatatttcaaaacatatagcttatgagaaaatgttttaaaatgtgctgcaagttacttggtttcagagtactgcattcccatcctgtgaaaatgtggttcaataaaacctagatatgctgtattaggaccaaagaactttatatttattttaaatatcaaagtaacacaaagaactagttcaatatacagtacacttcctactcttcacagagaactgaaattttctataaagacatttatacttaggaaacatcagacaaccaaagtatgtataaaactcacaagatattttacacacagttcacaataattaattctgatattttagatttttctgtcattgcttttaaagtatccttaattaaaaacaaaaattattatttgagactgaaaacaagtgcaaaagcatttctactttaatatacactgtaaatccccataatcaaaacatttactacacaatgtggaacagctaaatgcccagttttgtattattttctggcagccacactcatcaattgtaatacagttttatcaatagggataagaagagttcaatcgttagaaggaataaaaattttgtaattacatcacagtacattgtccagctttaatgcaagcaggaataccaagcaaaaaaatacgcagtaacaatgagatgtgtacatcctcttcattcaatacatcttttagaatctccaacagcaatgcaagcattgattacttttctttacctaagaatttgaccaaacaaggttatattctttgtataacctctgtgctctaaatataatccttaatttctcctctgaatataatccttaatttctctttatgtaattggctgcataggctaaatttaaattgttttaggatttttctcaagatcatagatttatgatcatacacagcaagttgaaacatgagtaaacaaaacataagcactctctctacaaaaaccttctttttctcatcttccacacatcttaatcctattacatctatcttattaatgctacttccaaagagaaagagcagaaagcatgctaagattatagggaaaaggtatcttaagtaaaaacaattttagaggaaataaggaggggattccctctaccctcaaaacaaacaaacaaacaaaaaaccccacattagagaaatgtggaaaagggtaggatataaggaagaactgtctagtttctagaagtcgtttagaaaattattctcacattatccattattcactctaacagcaagtagcatttactataacactacttaaagttttagaaatgctacttgtagaatacatttctaggcattttaaatttggcactgaatcttagaatatccaaatacaaccttctttaaagtcctaatttttcctgagttgatcaactcattatatattggttgggatgttgctgctcctaatgagaaactcatctcaaaccatcacctcttgttcagttttaggcaaactgaaataaggtcattcagtgcagggctgtgtagttatggttactggttatttaaaagacagagaaacagagacacagatgcagacacactactcattttattttacttgtcagattcctctaataagcatatagagacaggcccaagagtggcttcacagtaactataaaggccacaacagagatttttaaaatgatatataaatcataaaaacaaatattcacactaacacttagtgccaatttgcctatataaacataaagcaacctaaaaaaaaaaagttgcccaaccagcaggcaacacaatcataacacccataaccaaaaaaaaataaaaataaaaatctattaatcagtacaatctagccagcagaatcaactctaagcaactacaacacatcgaaaaggcacaaagcattcaatgcagaaaagactgggtataaaaggacactgtcaaagagctactgctcaaaatctgacatttcatcactgatatatgagagtgatatggtaggaagaaaactcaagcttataaacatattagtttaactgtgtttttaatttgtttgcaattatattgaaaagcaaccaatgataattacttattaacccttaattagcagtttagagtcaccctacaaagatgctttgacactttttaaggttgatagaaaattattagtgtacctatttcatgacctgccatcgcctaaaaggaagtcacctaataaagcaccaatttaaaaccatatttttgctactcctattctcccagcaataaatgccttaattacttaaatgtatgcaaagactactatctttacagttggttaaatcttgctggcataaggaccaacccctaaccttaaatgggattttaggctgcaaaaaaaataggttgggtttcttacaaaaataacctcaacttgacttaaaaaaattcgaaggcaaaaattattttgatagtgtagtgtaaaaaataggcttatttagcatttagtagtgttctctaaaaaacataacattgtattaattaaactaaggaaaacagtattctcacttataattggtttgtcagtatgactattcccagagtattttcttttgctcctatttttatacatataaacacaataatcaatctcagtattcaaactaacaactttttttttttaaaaaaatccattattctaggacttcaactgtgcttctttggacaaatagttattcaagcaagaaagaatttaaagtcttttaaactatttaatacctactaaaaatctttggtgcatttaagtcaaaacccattagattaacacattcctgcacttgataaattattcaatttacagattaagtgctaactgctatctgctaaaaaattaatttaaaacaataaattatgctcacaaaataaaaaaattctgaatgaggctaaacttagttgcaagattcaaaattttaagtacagttacaaaataaatggattagagttatagagcatttgtccaaaatactctaaatcaaatattacaaaaggtcaactgaaaagaataggcctccttttatactttttgtgccaacttttgtcaaaagcctatatacattcagtttgcccaaatccatgaggttttcacaattgtaaaatttcttacatttttggaaattagaggcagcagattagtttcattttgtttttgttgttgttgttttcaatcatccactgaaactattacttcaccagaattatattacgcatctcccagactaggttaagattaaatgacaggatgtagtacctggcacatagtaagcattcattaatgctagctttcttctttccctactagtagctctgccacctactgaccatgtgagcttaaatgagtccttttatcttaacctcaaattctttataaagtgggaatatagcttgtttttactatttcagggctggttatgaggttcaaatgagataacatatatgaaagcattttataaaacagtaaatcactactcaagtttaagttatctacaatagtaactaaatacaattatattattatatttcactttactaagagatgtattccaaaaaagttctgtgtaaaccaattcctacaattaaatcatatatttaaagcattaggacggacattattattaaaagaaccctaaagtaaataccttcaaaaatcaaagtattcttttcaatgtgaaaatgcagtatcttctttttctgccaccaaatgtataatataccatatacatacatgtatataaatatatatatactatctgcctttttataagtctaaacttttctacattagcttatatgtaaggcaggctacatttttatgtatgatttctttcattatagtaagatttttagttataatattgccagtctttatgatgaaaatcataaagatatgtatttttaaaagtcaatttgaaagactaacagactaacagtacctcatatagtcaacctcaatcatgtaagtaccccagatataacatttccacacaaagaaataagaatactttaaaaaggagaacatagtaagtatgtccactagtcttaagacaattacaaccaaaccttgacaaatgaggctaaactcagattggttttattatttatatgagctactttggttaactgcctcagttttcaatatttcttttgttttacctccgctagtatggcgaatgttgctgtaaagtacctttatttcttaagtgcttcagcgacagtttccgccattactaattgattaaactttattcattaaaacttcactgttttatttgtgattttttttttcacaagggctgggctagactttacagtttacacacacaaaaaaagtgcttaaagcaattaggagtgtaaacaaaactgaaatagaaaacttttaaaactgctattttctactagtttatgtacaaatgacatgctaataataaatcaaccctgtctagtctaatcttcaagcaactctactaggaaacattatcttagtttttagttaaaattgacttgaaaatatggaaagtgcatgtctttaaaggtattttataattttgactttttcctcaattgtaatcactgaggttttgctgtaactgctatttcctttcaccaagtcctcaacttttgtctcatacagaaataaaaattaaaggttaattacagacattaggcttttgtgaaggcaaaattaaagatctggattgcatgtaaatctgtatataagtagtggttccatttaattaaacaatgttaagttaaattaggcacaaatttcataatctgtttggcaccttttctaacaattgaacacaaaatatctaggttctgtttcccagagtttctatcagccaagtaaatgaaatcaaaagtagcatgtttaattaaatttcattgagttacaactgctcttttcttagtgagatgaagacatatgctatgttgtattgtcaacatttctgaaataaatagtaaagtacaaaaggtgaacttaccttgaaaaacatctagttaaaactctcatatttttcttgtaacacattttcagtttgtataatttaatgcccagacctatgtttgcctttcttattcataacaattgaagtataggcaaaaaccaattatctggattattatttcagtcctacaaataatagctaatcttacattagttaagctttctggctttgagtatatcaaaagtccaaaggataatgataacctaaaattatgtatgaatggaaagacaacacagaaatatccaaggcattcttgtaaattcaaattcctaatttcaattttaaaaatttgtataacgtaatattgaatcttaggataagaaacagttgcaattatcagtgtactcttaattccttcttaaaggctacatggtcctcaaacttgtttgtaagaagggctaggaagaagaaggagaggaatgagactaaagaagaataaaaatttccactgatgattaaaaaaaatacttccataatatcagcagctaataattgcaaaaaatttaagaaaccattaaaagttagcactaaataatctttaaaaatcacaaaaatgtgcacttcaaatattatgccagaaattttgtccaaatattcatgttcagtaaacagagacacatagttttcttgatttgaaactgttctgaggacttgagaaactagagaaaacaagaaaatagcagccccacaaatttaaaagctatcatctctaccattagcatataaccatccaaaaatctgtggaatgtttagatttactcatgaatgatgctcattcgtagaaatattttgaacaccagtagtgctatcaaggcccagtaatgttccaagataagattgttctctaggatctagcatttgttcaggtcgaactgggtgaactatatttgcaggttgaggagtaagagtatatttttccagaaaagctaaatccgctgctcgtggataatcagttgactgtggctgtggtgacagaatctcatgagaagatggtgggagtgtggtagtatgacgcactaggtcactcggagtgtcaggcatctgaactggaaccagagttactggaacacatacttcagcagatacattctgtaacatcgtcttggcttccgactgataaactttgggctggtccatatattgttttgtttctgtttgaaagattttgtcatcagatgagtactcaactggcaaggatacaagtttttcctcagaagtactgagaggatcatcaggagattttatttcatgaacatggtcaatgtggtatttcagcttgtctttccgcttaaatgttgcattacagtgctgacagttgaaaggtcgggcatcagaatgaataaccaggtgttttgttaatgttttcttaattctaaaagactgattgcaaatttgacacttgtatggtttttcacctatatgaatgaacaagaatataattagatgtaaaatgtactcaacttgataagacaatgacttcaagtagcaaacttccaatgtgaatacttgccagaacttgataatagcaataatactgtatactatcacaaaatgcagacagtacaataaactggtaaaaataagaagcttaaacattaaaaagatctgggtttgaattctgactataacacttactagccaaacattgagcaagctacccaacttctatgcctaattttctcatctgtaatatggaataataaccaacctcacagagttggtaaatggaccaaaagagaaagtagagtaatagggcttagcactgcacctagtacataataagtgcttgtaaactattgttattgcttacttttattcccatagccctcaaaaaggttaaaccaaaacatctgattttctcccccacgcaaggaggataaaaactaaaacagcaattctaattaacatggttccttggattagataacaagtagttatctctagcctgaggtcaaaataagaagagttgttcagcggaaagaacaaagaagctggacctgtttttagatccccctgagtcaggttctcacactgtagttttgttttgttttgttttatataaaacattataaattcctaggttagccaatgtggtaggcagaatgatggcctatcaaagatgtacacactctagtcccaggaagctgtagatacttatgtggtaaaagagactttgcagatcagattaaggtaagaccttgaaataggcagaccaacaggcgtacacaggtgagtcaaatctaatcataggcgtcgtagaagatggccaataactgaggaagaatgggtcagacagatgcaacatgagaactcaatcacaaattgttagctttgaaaatggaaggaggaagctagaacataaggaatgctgcggccactataagatgtgaaaggctctcagtttacaataggcaagaaaacgggaatctcagtcctggtcctacaactccaataattgattcctgtcagtaacctgaatgagcaggaaactcattattccctatagcccctggaaagaaatacagctctaccaaacacttagatttcagcttggtgtcagacttctgacctaaagaactatacggtaataaatttgtattgtttaaaccaccaaatttgtggtggtttgttaacagcagcaatagaaaactcatatatccagaaacactaatactgcagtagacacaaaggcattattttaaagccaaattagaaaattacatattaattgtcacatgagtttgttgatattttcctctcatctctccatttgaagcatcatccattctcctagtaaattaaaagataattacatcttcaagttgaatcactaatatcaaactattatttgttaaatattattgttaaatattttgtagcccattggaaccttcaaatcccactaccagaaaatttagacagattgggaggctgattacctagtactactgaatttctacttgtttctggactaacattattactgatgtcattagagaggcagtgagacatgaatacattatatagataattaacttttcagaaaaagtatttttaactgtgtatagaacacacagcatctaacatttgattttacaagtgaatgcctataatcagagataataaggaaaagctcagaggagagtgctttgaaaacaaaatgtacacttccaaaatgcaagaactcttaagtgcgttctataaatccctggcatcaatacttgtcatgcaatgagcattctataatttttttaaaaaaaataagaacacgaccacagcaatactaacaccaccaagaagcacagagtctacttttatagacaaaagtttaagttttgagtgttctctggcacaggaccagcatgatggtccttaagcattttcattaaaaaagttttataagtgcaacgatgtttttaaacttagaataatcttcaatcagttctggtgtgtaacaaatacttttagaaaactgtaatccagatgggcatattcctttgagtagtttccattatcattttaaacaactttcattttcaatagaaaaatcaatttaggtttctaaaaagatgaaaattcataaagaaaatgttaacattattaaatgtaaaaagcaaacttatagtgcttaaagatagatagcagaaaaggtgaaaactatcaacttgaaaaaatatagattaaagaaataaaccttctacagtgagagtttctatggtaaaattatgtatttaacaataatgcaagtagagtgcatctcaagatcataaatcagagacataaggcaaccaaaaggtccctttaatgacagaaaggagcattaagagcagaaggaaataaacaatactcaaagagatgtaaactaatagttaaaatcgtagaatctatgagcctttagaatttaaaaatgtcatccacagaatcatctttctttagatattaaaaattggtatgtgaaaaatgtgcattgggagacttatttcagacttatttcagacttacatcatatcatggctcttactgatgagaagggaaagataaaagatttttaaaaaataacccccacacccaaattactctttgcaggcatcaaagcacagccaagtcagccagaacctaaggggcaaggtctggtgacataggaagtatagaggtgctttcttttctcctcagtgcactttcagagtcagtctatgaggaaatagacgccaagctgcaacccagcacttgaggaaatctcattggaatgggaagataaaagttggagtttgggactaccaaagaattgaagggtcaggagcctgaaaaagaaggaacaacagagaaatgaacaaaaatatctgtatttgccaactattaaaagaaacatttgctgggtgagacagctggaaaccaagagtcagaaggctacagggttgaccaatatttcagcaatcccaagaatactgggagacagagattagagttcaggactcaccaaagtgagaaactctggtaaaaacaccatgcagtcagtagagaccccaatgcaatgatgaactaggagaaaggcagatcagaagtagccagaaacaaaacaaagtcctctcatattctatttgcttgtgagaaaaaatttaaatctaactggaagaaacacatcttcaagggcttctgtaatttttaactcacaaaatctaaagttcaatacaaagtgacccaaatgatcaaatgccaagaggggaaaaaatacaatacacacactcaaagcaaatattatatatataagactgggacatcaaaatcaatatgattaatatgtacaggacaatacaggaaaagtaaattttaccagagattggaatctatgggaaaaaaaggaaactctaaaaaagataagtgaagatgcctaatgtacatgtaatcaaagtctcaggaggaggagagagaataggcaatagcaatatttaaaaagaaaatggccaagaatcttcctaaataaaagaaagacatcaagtcacagattcaataaacactataaacctcacaaaatacaaaacacacacacacacacacacacagaaacactcaaatcaaggcacactatagtaaaacttctgaaaaccaaaaacagaaaaatctaaaaaagtagccaattaaaaagagacatttccttcaaatgagcaacaataagactgatagtatattttttcaacaaaagcaaaacaagctccaaaaccaaaaataacctatctaaagtgccaaatgaaaaaagctgctaacgtaaattctacagtcagaaaaaaaattacctatgaggtaaaataaaaacattttcagacaaataatatggtgccagcagactgcatgaaagagaacttttcatgtataaggaaaatgactccaggtggaagaacagtaaacagtaaagaataaatacatggttaaatagcaataatattaaatatttaaaacaaaaaagcgatgtctttgggttttaagagacatgaagaatttaaatacatacaatatataacagataagaaagataagggtgttataaggtatttgcagtttctggaaagtgacgaataatttcaattattttatttatcttttctagaaggtaaggtagactgtaacaatttcagaatgcacattgttatcctgggtaaccactaaaaacataatgaaagaacacataattaagaagctaactgagggaaaaatgacaacaacaatccttaatgattataaacaaagtgaagacaagagaaaaaagcatcaaggaatcaattgtgtgaacagcatgatgatacattcaagcccaaataagtgagaaatcacataatttaaatgaactaaacatacaaattaaaggacaaagatgatcaaaatagataattaaacaataccaaaagatgcatatcataaatataagtccaaagaaggcttggaagtaaaaaaagaaaaaatatttaatataaaagtatccaaaagagtgctggtaatctttatcccataataaagagcaacattttataatgatataaaagaccattcaacagaaagatatgactaatatatatctaatacatatattatattagatatataatacgtatctaatatattatatatattatatataatacgtatctaatatattatatatattatatataatacatatctaatatattatatataatacatatataatatattatatatattatatataatacatatctaatatattatatatattatatataatacatatctaatatattatatatattatatataatacatatctaatatattatatataatacatatctaatatattatatatattatatataatacatatctaatatattatatatattatatataataatataacctcaaaataaagcaaaaaatgaaaaaatcaaaagaaataaacaatttacaatcatggttacagtagagattttcacataaatatctcagtaacttacaaaataagtggtaaaaaatgaagaatgtagaatatttgaatggaatatcttctctgacaagagtagaattacactaggtatcagtaacataaacttgcttagaaaatccccacatatttaggaattgggtaatacaatttgaagtaaaccattaacgagagaacaatttagaacagacattagaaaatatttttaactgaattataatggaaatatgaaattaaaaatgaggtacggagccaggcatggtggctcatgcctgtaatgccagcactttgggaggccgaggcgggcggatcacgaggtcaggagatcgagaccatcctggctaacacggtgaaaccccgtctctactaaaaatgcaaaaaaattagccgggcatggtggcaggcgcctgtagtcccagctactcaggaggctgaggcgggagaatggcgtcaacccgggaggcggagcttgcagtgagccgagattgcaccacggcactccagcctgggtgacagagcgagactctatctcaaaaaaaaaacaaaaaaaacaacaaaaaaaagtgaggtatggaaggtaactaaagcagtatttagaggataacatggctttaaaatacatacaataaacaataagaaatactacaatttaacaacttaggcatccccataaaaaaggcagggaaaggcaaattaaaaaaaatatatatataagccagtggctgacaagatggccaaacaggaacagctccagtctgcagctcccagcaagatcaacgcagaaggcaggtgatttctgcatttccaactgaggtacccagctcatctcactgggactggctagacagtgggtgcagcccatggggggcgagcagaaccagggtggggcgttgcctcactgaggctgaacaaagagaacacatggacacagggaggggaacagcacacactaaggcctgttgggggatgggggggcctggggagggatagcataagtacaaatacctgatgtaggtgacgggttgatgggtgcaggaaaccaccatagcacgtgtatacctatgtaacaaacctgcacattctgcacatgtatcccagaacttaaagtataataataaaaaaaaagaagaaatacaagcaaaatgggagaaatacaaaagagaaagcagatatgaaaaataaaataaatcaacaaagagaaaaatcagcaaaacctagtggttctttcaaaagcttaatgaaatcaataaatccttagcaagaaaaggcatattactagtaacaggaatgacaaaaaggttatcactaaagacactatcatcactaaaaagatcaataacaaaataccccaaattctgccaatagatttcacattttagattaacagaatacctttaaagtgaataaataaattgaaaatatgacagctctttaacggtcatactaaaacacaaattaaaaaacacacttaaaaaatctttaattaggcccagcatggtggctcacacctgtaatcccagcactttgggaggccgaggtgggtagatcacaaggtcaggagttagagatcagcctggccaagatggtgaaacctcatctctacttaaaaaaaaaaaaaaattagccgggtgtggaggctggtgcctgtaatcccagctactcaggaggctgaagcaggagaatcgcttgaacccaggaggtggaggttgcggtgagccaagatcgtgctattgcactccagtgtgggcgacagagtgagactcggtctcaaaaacaacaacaacaacaaaaaaatttaattaaaacctttccctacagaaaacaaactcaggaatttattctgtcaattcttgcaaacactaatgaggaaatgatgccaattttacacaaactcctccagataactgaaaaagataaattatttcccaaatcatcttttgagaccagcatagttatgataacacagcctgtcagggacattacaagggaaaagatataggcaatatgtctcgtgaaccaaaaaaatgtacaaaatataagcaaattgaattcaattatacaggataatatatcatgaacaggatatatgtatgtgtatgtctgtatatttatgtgtttgaatgtttgtttatttttgagacaagttctcactccatcacccaggctggagtgcagtggtgccatcccagctcactgcagcctcaatttccccggctaggtgatcctcccgcctctgcctttagagtagctcagactacaggcatgcgccaccacgcttggctaatttttggaatttttgtagagaaggggttttgccatgtttcccaggctggtcttgaactcctgggctcaagcaaatcatccacctcgacttcccaaagcgctgggattacaggggtttgtgagccatcgcaccaagcatgaacaggatatattatatcttcaatacaccatgaacaggataaacaagataatatatcattagcaagatactatatcaaaccagtctgggtttattccagaaatgaggtttaatattcaaaaatcaatcagtacaatttaccacataaataaaaaaatatgatcacctcaatcaatatagaaaaaacataaaattcaacaactattcatgacaaaaactctaaataaactagggatagtaatttccttatctgactatctacaaaaaacctataaaaaatatcatacttaattgtgaattattgaaagcttttcccttgaagatgagaataagaaaataatgtctactctcaatgtttctactggagatgtgaccaaagcaataatgtgaccgaagcaacaaggtttacttcccaaccctgaaagacagagagagagagagtgtgtgttataaagactaaaaaggggaaaatgaacctgtcattattcacagataacttgtttgcatgctttgaaagttcaaaaaaagctaggggtaaactataaaatttaatagaaatttagcaaggtcactggataaaaagtcaataaacaaactcaattctattcctgtataccagaaacaaataaaaaataaaattaaaaaaaggtcaaaatttgatacaaaaatatcaaatacctaggcataaatctaatgcaaaatgtgtaagatagctacactaaaaactacaaatcatctttgaaaaaaatctaaacaaattaatggaggtgttcacagactggataatacgatgttataaaaaaaatcagttaaggaaacgttgaccacaggttcaatgaaattccaataattcctagccagtatttttgtgtgtggaaattaacagactatttctaaatttatataaaaatacaaagggacaaaaataataaacacatttgaaactaaaaagttgacaaacaaagcacacatatatgatcacttaatttacaacaatatgccaatgaaatgtagtgagaaaggatcatctttccaaaaaatagcgctaaagcaattggataaccatatgttaaaaaaagaactttcacctttacctaataacaaacaaaaacaaattatagaaagttcatggatctagataagaaagttaaaataaatcttctagaaggtaaccgcaaaaaatattaatgaccttgggttgagcaaaagtttcttaaagaggacacaaaagaactataaagaaaaaaatggtacatgacgtctttaaacttcaaaacctttgttcatcaaaagacatcattaagagtgaaaaggtaagtcatagaggagaaggtatctgtaatatatatatccggaatgtagaaagaatacctacaaatccattagaaaaagacagacactccaatttttaaaaatgagtacaagaattaatctagtattacacaaaagtagatatccaaatggccagtgagcacaagaacaggtattcaacatcaatactcatcacagaggtgcaaatcgaagccattctcagatagtgctacgtatctatcaaatggatttaaaaaaaaagtatcaaatgttggtgaaaatgtgaagcaattgagattctcatatgtggctgctggtggtgtaaactgacacaattactttgaaaaaactacttagtagtatctcctaaagtagaacatatgcatatcctatgagccaggaatcctagggccatgaatatatataagagaaaagaatgcatatgtgtatgaaaagacatggacaaggatgttcacagcagctttattcctaagagaaccaagcaaatataaaccaagtatccataaaagtagaatgaataaattgtaacagtcatatgaagatgaaaatgaaaagaaacaaattactgtcataagggaatccacacttaatatttattaggtaaaagaatccagaaaaaaaagattacatactacatgatttcacttatatgaagttcaaatagacaaaattaatttttggtgctattaatataagtcaaaatagtcatcatctttgcaaggaggttactgactgggaggagccatagagaatccttctgaaatcttggtagtgttttaatatcttgatctgagtcatgactacattgatggattcattcataaaaattaattgaactgtttgagatttgtgcactttgtgtgctatacttcaataaaaaaaagcttacaaagaaaattcaccttgaataaaaaaatcagtcaacattaaaatcaagtcctaaatttgtggtcatctttatgccaatttaatgaatatgtttcaacaagacaactgttaaagaatagatgtaatcactacattctgaggattgaacaaacaaaactcatgattagaaaaagccatctgtacaagaaaatcttatatacattttccaactaatttatctaactgtgtggtttaaaaaaaataaaatagagaagagtcataggagaacataataaatttatttactcagcaaatatttattgagtgccaaactcttcaaaagccctacgatatgcattgattgtacatacttatttgaagcaattaggtgtactgaactggccaaaactgaaacaaacacattttattgtttctccagatgaggatatggagaaaagacatactaacagaagaaaaaaggttatagaggaaatctagttaaggaaattctaaaaaacaaaaatttagcaatatatatataatgaactaagggtatcccaacaaggaaaaaaaaaatctgaagaacaaaatttttctggtcacctgctatgagggtaaggatggttcaaaatccttcaccatttcctggataaactatcccataaaattactatctaattttactctatctctacatttggcaattttccttctgattaataaactcagcaattctgcttccttgataaagataccctagctagtaaacattaatatctcattttctagaatgtaaattaatgacattctggctaatctattcccagtgtttactgtgaagaattactcacaatacttataactctcaatgcacagataaaattgagtctctgaacctataaatctcaaaaatggacttgggaacatggtgaccatttcttgcaaaagccactctgtgaagtcctgtctgggtagactgttggtcactttagattgagagttggtaaatagagttttattggaatacaggcatgcttcatctgtttacacattgtctatggctgctttcacatcacaacagcagagctgaatgattgtgacagactcttagttgcaaagcctaaaacatttactatctagccctcaacaagtatttgctgacttttgccttctattatttttccctctcatttcataatagccatagtctttgtcttattccatcatagagctaatgtcctcaattttcaaagggcagagagacttgtcttctaattccaattaactgtgaaatatccagatattgatgttccacattgtcactggccaccagccaatcactataaatcagtgtttttaaaaattttgatgcaatgtagtcagcactaaatttctactcaagttgtacagttcttaaatcatcaatggtttgaaattaactttctgtaagttcaccatctctttcaagtcatgagttctattaggttaattatttacaaaagatatggaagataccatcaagttcgtttcctcattttacacttttatttatgctctcccaaattatgcctttttttatttggagagggctgtaactttgcttttaacagcagcactgtatcagtagtaaatcctttactgcaactatttgctaataatattgcccaaattcagttatttcccattctaatatttatgaaatcacttatttttctcttccagaatagcagcttgacaaaatccgaattgaatataaaacaaagcagccataaatacataaatgggcttgtttcttaaggaaaacaaggttttaaaaatgttaatttatatgtaaaggcaaacaaggattcagacaatatataagaaagaatctaacatattctgtatttcaaaatgtagtaacattcccaacggagaaaaaagaaagattttgcaaatgacaacttctggaaagcagctgaggcaaagccttttactataactacctataaatcatgactggctatgtaaaaaggaaaatgaaacgatggtaacttggcaaacaagacaatgaggtcatatttgcattactcttttaaaagagaagaaaataaaagataaaaaggaatttaatctgaaggcttaagaaaagccttcagaaagcaaaataaagaagaatcataaaacaatcagaaaagggaaaattacaactaaaagttgagtaaatatcttatggaaaaagttttctcaagttttgtaaaatatttaaaagtattgaagcttacataatagagaatagaagatgagaatattgttcagtcatggcatgaacttcaatataataagtaaaaatcttaatggggaaaaccaaagaaatttaaccaagaacaacaaagtttaaatgcctatattttacttctgattacactatatatatctctctctatatatatatatctatgaaccactcattaaattttacctgaatgcgttcgaaaatgcatttccagacttgatttgcctttaaaaattttcttacaaacatcacattgatgaaatgttgctttatatctaagaaaataaaaagatttgagtttttcaatataattttaataactataataaatatgacaatattaataattatattaataactaacataatgaaaataagttgcaacttcatttacaactgtgtatataattctcacattaacaaagtatagaactccaaagaaacatggaaatacttttaatatgttgagcttgcctctggtttttcctcttccagttacatccaacaaacgaatctataaaaagaggtctgtagattttcaactgctttaagtcactgaacttttattattactagctatccaaatatacaaaaagaaaaattataaggtagaaacagatcaagagtggcctaaaggggaaatgaagagttgtctagaaagggacatggcagaaattttgtggtgatgaaactattccatatcttaattgtggtgatgattacatgacttgcagaattatacactaaaaagaatgaatttcactttctgtaaattacaccttaactaaatttaaaaaatagatgctcaggctgattaaaaagaatctgcggcaattttaaaacccgcatttatcaaaaaggtgaaattgctctcatcagttcatgtcctaacaaaaaaattataaatttgaactaataaataaaattttatacctaaatttaaaaatgaaatattagtcctttatttttactacaaaataatagacagaaataaagcaataagttaccgaaaagttaacttagtaagcaccacagcatagtgcctaagaagtgtctttgagttaaacagttctcaactgaaaattttattgtgagaattgagatatttacaaaataattatcatttaagtggcagttattgagaaagccataccatctcacctcagaagcaattcatatggaatgaatacatggcaaaataattaaatcaaacctgggctacttaatcttctgtaaaacagtttgctcttaacatatccattgagttttactggaaatgtttagaacattgttaccaatacgaaataccaacatactatgcctaggattttaaatgtccctcatttttcaattcatccaacccaacatttataagacaacataaaaagcactgtcctagatgaacttaattctacttgatgaaacagatggttgttttaatttttgttagagacagggtcttgttctgtcacccagactaggttgcagcagcatcataatagctcactgcagccttgaactcctgggctcaagctatccttctgcctcagcctcctgagtagctgagactacaggtacatgccaccacacccagataatttattttcttttattgttttgtagagacagggtctcactttgttgcccaggctggtgtcaaactcctgaaacaaacatttacacagataatttggattttgtgaattgaggttgtgaataataaccctggcaaaagactcctaaccagtatgcttggtttaccttattccattcatatccatggtaaatataaacagagatacaaacagggtcaccatgggcacatagagaaagaggaagtagtactcgactgggggcaattttgccccccataaaacatgtggcaatgcctgaaaacgtttttgtttttcacatctggggatacgataataagtgctactggcatataatgggtagaagccatgaatattgagaaacgtcctacaatacacaagaaaagaattacttggtccaaaatgtcaacagtgtttgggctgagaaaccttgctctatactatgaacaaagtgatattttcaacataaatatgtacaaaacactttaacttcctcacagtggacttaagataaattctgtagggccttgcatggctaagaccctatgaaaatataccttgcaattaccacatggatgctaagccatacagattttcaaggaaggagaggataaacaatttgaactgaagcagagatgtcagtaaaaaaagaacttaaaaatgcctattgatttggcaacaaggaagtcatactgataactgagcagaataagatcagaggtcagattgcaacagtggctggaatgtgaagtggttactgaggtagtcaccataaaaaagtttagaagcaaagattagaaaaataattggtggttggaggcgtgttaatcctatgtacattttgctaattatgctcaggactattaagtgaagtctcttggcactttagaacatgtctgttgtttatcatttgcccaaatgcctaaccccaaaacatgaattacttgaatgttttacacttagcaactaacctcagttaaacttggatatctaaattatactaaaaagctgatgttcaagatagcacacagcgccttcaaataaaataatattttaaatgcttagtatgattagaaacaagtttaaattctgactgcaaacatttcctaacaactgctgtcttattaagtataatatataggcagtatatttagctctcaaagagcctcagcaaccaaatgccaagattttttattaattattgttaacttgcatgtcacctccctggcctttgaattaactgaaaacaaggaggaaaatatatgcttgctgaattcttttaggtctatagagatgctacagaatgtagagaaagagaactggttaacctaacttcaattaaacaaagtaaacaaaaaaagttacaactttcctcagagacttagccaatgtaaactatgagacattttgctttttcacttacttttgccacactttctctccaaggtgtacgcttttgtaatgaacagtgagatgatccctacgaccaaaacattttccacattcttcacactgatgagctttttcaccttaaaataaagacccaaatattttcattataatatacatctcaggtttttatccccagaaacaaactatcaaacagtaagatcacatgatgtcaaatataacaggaaagtaaagccacattttattctgcactatttgctttatattccttactcaaataactttcttcaaaaaatgtatgcttaatttcatggatgtgaatcttttccccgcttggaaaaggaatcaatagccttttgttgaacacttcaaatcatacatttcaatgtaacagagcaagataaacgaaactacttcaaaacttaggaattttaaatatatatatatatatatgtctgtatatcaaacacctcaaattgatatacattaaattaagatgagggtgtcttactgtttataaaaaggacccaaacattttcagatctttgtactttacttttagaagatttttcatctgtgaggatttcttacgtttgcaatgagccaaaatacaaatataatgaaaaattctacgtaagtccaatttctcatctctattcttacatttacttacaaaggcttggttttaaaaaacaattactgtctcaataccagtgtgcaattaaagcatgtggcctctagacttagaaattaagaattctcctcataaaaataaaaaggcataattccaatggaaaaagtcatcagatttttagtatctgttagaagtggtgaaaacaactgcaacctatctcattgagatcatctcagaaaattactatctgttgcatactttatattcaaaaattatgtttaaaataataataataatcacctgttctaccgtgctcatagagatggctctttcccattattgtgctcacagagttggctctcttagcacttcctgaacatcaatctgagaggaaaatatgaaagaaatccccagaatataaaaattatacagtataaagatctgaaattggtcaggattattaaggtactcttctccaaagacagggtttcaaaattcactataatatacacttttagcacctaattttaatcatttcccttttaatatgtaagtttcaccaacttcttctcaaatccaatcaaaatgagaaaaattatcatggcttctccctttaaggaactgtcaatagcaattattagatatatccatgtaatatgcaaaatgcaaattttgagaatttatttaaaattaaactttacactttatagtcacaaagggttaccaaataattaaaattacagtgaatatgtcataaacttatgtcccttttggatgctttttaaaaaatgttttcagaaccagaattacaaagaagtgatgagcataaaccaaattattaaacttatagccaacataaacataacatcatattatgttcctttcaggtatttaaaaaggattttcgaactagcattacaaaatatggtatacctgaatgtatttttttgtgctttgtaaggtgatcatgacggataaatgtttttccacattcatcgcactcatatcttttatcatcatgatgtactcgtaagtgaagtctataaagaaaaaagaattgaacaccattaaaactggtgacatagaaggaaaaagctcaataatgaataaatgatgaataaacaatgaaaactgggctgtctactcaaccactcatacattattggctttatttctatgactttcagagtccttttcagtcttttaccacctgaccccaggtccctactcatctctttcaagaaagcatttcaacatttgtatatgctcaaaccacttctcaacattattccttcccatcatattagatcctaaatctagttcactgaatctatcaaatgtctaaggttattatctagctgactggccaagactcaaaaatataaaaagtaggagtaatcagaaaggaattagaatcagacaaatgaagtaagtgtacaagtgactaggcatatcatgatgatagcaaatgatacagtaaatggtatggtttggctctgtgttcccacccaaatctcatctcaaattgtaatccccacatattgaaggagggacctggtggcaggtaactggatcatgggggcagtttccccatgctgttcttgtaacagtcagtgagttctcacaagatctgatgctttaaaagtgttccagcagttgcccctactctctctttctcctgcttcgcctaggtaagacgtgccttgcttgcaccttcacataccgccatgattctaagtttcctgaggccttcccagccatgcggaactgtgagtcaattaaatcctttttctttgtaagttacccagtctcaagtatgtctttatagcagtgtgaaaacagactaatagagcaaataatggagaatctgtcctattctggataattgttatcaactacaaactgatatttaagaattttcttttctaagaactcaactttatgaaaattacatcttactgcttttcttcacaccaatagaacaaaatggggctcattttatagtcacccaaagacagtataaaaggctcagattattaagattaatttaacttgaattacttttatctccagagcctctctctctatatatattctaatgaaaggaatagctttcccttgcaaattgccaaaataagtgttgattttaccaagaccaactgactagactacctctaaaggggaagtattcaatttaaacttaaagcaagataaataataaatgaaagtgtatatattaaagccttgtaacattttaataaaaattaaaattgtacacacatttcagaagtagttacatattatttatttagaaaaaaacttttcataaactgcaaatatggtcaaggattcaaccacagaaataactaaataagttataatcactattaatgcacagaagacttttgaaaattgagaatggggagttttttactttgtcttactttcatattaaaatgttctttgatagtaaagagtggagaaatacactaagtttaactgacttttcattcagagaaaagtaatgaaataaatatttaaataatgccttagtaaagccttctgcaaacttggtgtgagaaaatatttaataatattttataccacagaataaagataataaaatgtttagtaaaaaaaaaatctatgcagtaaagtttttgcacaactttgcatatcataaggactaagaaatgtttcaattcaacaaagtaataagaaaatagaactaaaatagagatataattctatcttacttaataaagggaaaaaatggttttacttacctatacgaacttccatgacgaaaactttgcccacaaatactacaaaggtgaggcttttctccactgtggattctcaaatgttctttcaaagtagttctgcattaaaatatatagattcgagattttttaaatgcctatatatagtaaatagatttctggaaaacttactagaaaggtattcaagctaactgatattatggcaattctctcctctttcttacaataattttgttcttttctattctcactagtatacaaacatgcttgttatagctctctctccttaaaaacaaaaaatacttcggcctcatttgccattggtttgctcagagatttaattacacaacttaagcagactttcaagaagtataattttaaaatgctcattatgacactgaattaagttgatgtgaattttgatagagagggtttaataatatttaagtaatccagtttatcagtactatttcttccaaatatgtgcttagtatttattgaaaaaatgttttaaagcaaagaaaatgttgtagtatttctaacttccaggtgctgatgtgaaaaaggaacctatatacagaatgtaattattgctattcctaagtcttccagccccactggccctggatgggctactatgaaaccattactcctcaaagtacatcactagcaattcctacagttctaaccttcagagcttccccacatatctaaagtgctgagtaataatgaacaaagttattttaaggggaaataaagtgaaagggaaatatgactgacctctgcaggcttttagctatcactactacagtcatgtactgcataatgacatttcaatcaatgacagaccacataaacaatgctgtcccataagattacaacggagctacacaattcctataacctagtggcatcatagcacaatacattactcacatgtttgtggtgatgctgttgtagacaaacatactacattgccaactgtatataggcatagcacatacaattgtgtccagtacataattattgataatgataagcgactatgttactggtatgtatttactatactttttatcatgatttagagtgtacttcttctacttattaaaaaaaaaagaaaactaactgtaaaacagcctcagccaagtccttctagaggtattctctaagaaggcatggttaccataggacatgacagctctatgcatgtactgtccctgaagaccttccagtgggacaagatgtgcaggtggaagacagtgatattgatgatcctgaccctgtgtaggcctaggctaatgtttgtgtttgtgtcttttgtttttaaccaaaaaaaagtttaaaaagtaaaacataaaaaatttaaaaatataaaaaagcttatagaaaataaaatatctttatgcagctgtacaatgtgtgttttaagctaagtgttactttaaatgagtaagaaggttgaaaaaatcaaaagtttataaaataaaaatgttacagtaagctgctgttcatttgagggaaaaaattttaatacatttagtgaaacctaaatgtacagtgtttataaagtctacattagtgtacactaatgtccgcggccttcacattcactcaccactcactcactgactcccctagagaaacttctagtcctgcaagctctactcatgatcggtaacctacacaaacacatatattcttttttatattttataccatttttacagttctttttccatgcttaagtatgtttaaatatatcaacacttaccactgtgttacaattatctacagtattcactacagtaacatgctatacaggtttgtagcctgggagcaatgggctggctaaaccacatagcctacatgtgtagtaggctataccatctaggtttgcataagtacactctatatttgtgtgatgacaaaactgcttaacaatgcatttctccgaacatagcactatcattaagcggcgcatgactgtacttggtttgtatttcaatcccatacctagtaagtttaaaggatgaatctgaaataaaagtagagttttgccagtagatggtgctcttctacaaggcccaccaatatgacagtctgtagataacacccagctttgtggaaaatatctctaaagatattcccagatccctacctgttaaatagttatagtaaaagatggaaaggttatctttgggattcttgttttgccttgatccatctgttttatagcttccaaacctgtgtcattcatgttacatttctgttctccctatctttgtagcttattctttttaaaaaacaaacaaaaacccttaatctagttttagtggggtttcagaaagacataaaatatgtacattaaatcatccatctaaaacctgcaaatcttgaatccatgtcatcttccataacatttgtgtaattccttttttccttatatttcaaactaaagcacaattcatgcattttgtgtcttatgttaccctaattcctataaatcatattgattgattatttctacataatagtactaggatttttgtgggtgtgcagataattcttcacctttctcgtactgattttccacagataaagcaagtccattttctctttccaccatgagtacattctatatgacgtttcaaatttccagtgtcgttaaactggcgaccacatatatcacatggaaaaggacctaaaaaggaaaaaaaaaaagtgtgcatttaaagtttaaagaggagatactaagttaaatttaataggtatgctgtaagttcatgcctatcctattggtgcatatgtcataatacactgcaatttctcttctaggttatttattcctagaataacatttccatatccctataaccaagtatagggctcagcatctaacaaacagaatgaatgctgaacaaactaatgagttaacaaattgaaatggccaattcctggtttgaaatcagactggaacaaagtagaaatggctgcatactaaagtttttgggaaagcgggtaataaaaaactttggaagaatgaatggaggacttaagagagtttatagtttggaaatatttctatttggtgatacaaaattaagcccaggcctctcatagtaacactgacattagttggatactgaatttcactatgattttaccaaataaaaaactggagacaagacagtgttctactgactgacaaaatataagaaagacaaagaatgcgtaaaaaagaagtttagtaaatacagctcaaagaagctatatattagcaagaagatgtctcagtatatggaaggacaaactgaagaaagaattctaatgaattaatcataatagcacaatggaaagaaaatagaattaagatgctgaaattcagaaacgtaactataagcaaaattgcttggtagccacagtagctctgggtaaatttcaatgtgttttacacattagaaatgagagatgacctcaaaatgtacattgtattaagtatctttaatggattctcatttaaaacctctaatatttcatttttcatgggatctaaatattttactcatttattaactcattcaacaagtatttatttattcttaattcacatcaagcactgtgttaagtattatgaaaaatctctccacctcctctgaaccaaaaaaaggctctaagaaattgagaaaacgaaagtcagtacttacatagctgaaaaaaaaaggtgaagtaaatacacgtgccaaaataaggttattatgcaaaatgtgtggttagtcaaagaatgaaatatctactagtaaaactttttataaaatatgactatctgtatagctggcggcttcagctgggcaaaggaagaaatgaagcattctctttaatgttcagttacttatcaggattcttcaaagaaaataacaactgcatttttttcctatactggatatccagttttgcatgcagctaaacctattttaaacaacctcctgggctcaagcaatccttccacttcagcctcccctcttttatttatttattttttctatatagacagtatctcactaggttgcccaggctggtctcaaactcctgggctcaagtgatcctcccacctgtctcccaaagtgctgagattacagacgtgagtcaccatgcctggccaagttctgacttttaaaagccaaactacaacttttgcacatatatattcatatatattaaaaattcttctcctttaactgttcagattgcattaaatacatatctttccctctgatttaacagaatatatattcctaatgtagacagtatgagtattgctttgaataatctaaagcagtcattatcaaaatgtgatatctagaccatttgcaccagcactacctgggaacttgtgcaaattgcaaactgtacaagttccaaatgcaaatacaaatttggggccatacgccagacctatctgagtcagacactctgggaaatccgttttaataaggtctccaggtgcttgtgatatataccaaactgcatgaagcacttatctgaagtgtacagtgattcaagggaacagaaacatagagacggaatgcaaaagaagctctctctatatatatataatattgctttgagtattttatatatgcatgtatacatatatgtatacatatgtacacacacacaaatacagaaaatacttataacaatactctatttggtttattaataatagtggcccaaaatgcaaagctactatgtcacaaaccatatttctcaaaggtcttggaaagactgaaaactataatactagaaatgacaatacattcagagaaagagaatgaaaactatgcctggctctacatttggcacttatacagtacctcatataatcctcacaacagtatctaagaagtacgtattaacttcattttaacaaatgaggaaactggaagtctgagaggctgttccagatcacctagtaagtggctaagtcagactcagaaaacaaggctggctagaaagtcttctacttccacttctacatcatgccacacctattaaactttttcttctagtaaatgtcaacctaacccagtaaatgtcaactcttattaaaaatcatacaaattacctaatcagttgtaaaatatttgtgggtgtacagtagtaaaatgtaatgatttatttactagttagattacctattgcgccgtaatttaatttggcagaaatagtatccccagatcctaacacagagctgatcatacatttagcagttgctccataaatatttactattttgaatgtcgaatgtactttccttgtatattttccgccatgaacattagatagcaggggagctaagccttactgcctaacatttctggaacacctctcattattggtatgctgcagcatgatagaagaatctcttaacaagtcataaaaatcttccagttcaaccacttctgaagaatgccctcttcaccagctctaacagttagtaaggtaagttcagcatatgcttgtatacttgtataatttcactgatgggaaagtaactattgtgtaagacaagttactttagtttgtaagttccaacacttaaaaagttattatagttccctctgatgtttctacaaggtagaaccaaaaagattacctaaaattttcaaatcaaaaagaaggaagtgcaccaattctccaataaaaactactttttctggaactaaactctaaagaaatttctcccatgaaacagaatcatgaacatgtcaactacagtttggtaactataaaaactgtttctacatgatggcttcttagaagtgctgaaactgaatactatgaaagaacaacttagtaaaggcaatttggagagattaagcttcaggtaaataatcttccaacatatactagtcttatatactagactcacaaagattaagaatcccttgttgcgcaatagtgccttgaaagtatttgaagacagctgctctatcttcctttcccagacaaaaaatttcaaggaccatgtttttcacatgataagatttcaagactctacatcaccaaaattacccatctctaaaatatatatttgtcaatatccatcttaaatgtggtatacagaaatgaatgcaattttccagatcaattcaaaatcagactattatttccctaattctgaaaaatacacttttattaatatagtttaaaactacatttgttttgtaaatcatatcacattattggttcacactgtgtccaaaaagcctctgcctttaagatcatctgtaaagtgagtagtttggatgataaactattttatagttcttaaagacttaatgactaaaagtcagatcacttccttaagtttacaactatttatttatttatttatttatttatttatatttttgagacagaatttcgctcttgttgcccaggctggtgtgcaatagcgcgatcttgactcaccacaacctccgcctcttgggttcaagctattctcctgcctcagcctcctgagtagctgggattacaggcgtccgccaccacgcccagctaattttgtatttttagtagagtcaaggtttctccatgttggtcaggctagtctcgaactcctgacctcaggtgatctgccagctttggcctcccaaagtgctggcattacaggcgtgagtcaccgcacacagcctaactttgtatttattcttaattaattttaacttaatttgttttgacctattgtacagcatacagattttttaaatatgtttattttctggtatactaaatacccttgatagctttatgacatctataaatttcataagcaatgaagtgtatatttttatctaagttgttaacaaaagtaatgaactgaacatggagaggacctctacctggaatgacaaaattcattagtgggattaacaatcagaaatttaccaaagtataccaccatctagaccacaactctccaccttggccataagcattagggaggtaattcattaaatactatagcgcattccaaatatactaagtttattctactccttgaaaaattatctttttccaaaacaagaatgtctcattctaagcactcacaaacctatgcaacatcaactatgaataaatgcacagtttatgcccactggcacatttgtcaccaaaaaaaaaaacaaaccaaaaaaaccccccaacacacacaaaaaaacacatttacacatctccaagaactgtgacatatacagtactcctttcaatttatatgactttctttgcctaagccaatactcaaggttcaccaagagtagttcaacaatcccccaaaatgaaatatttaggtataaatctaacaacataggtacaagatctatatgagaaaactacaaaactcggatgaaagaaatcaaagaaaaacgaaataaatgaagagatatcccatgttcatggaaagaaagactcaacttcacaacatgatctatacattcaatgcaatcccaatcaaaatcccagaaagtcattttgtggatatcaacaaactgattctaaagttaatatggaaaggcaaaagatccagaagagccaacacaacactgaaggagaaaaataaggttggagggctgacattacttggctttaaatcttactataaagttacagtaatcaagacagtgtagtattggcaaaaataaaaaataaaaaaaaaagatcaacagaacagaatacagagcccagaaacagacctacataaatatggtcaactaatctttcacaaagaagcagagccaatacaatatagtaaagatagtctttttaagaaatggtcctagtacaaatggatatccacagacaaaaaaaaaaaaaatacatctagacacagaccttacatcctttgcaaaagtgaactcaaaatgaatcacaaaaatgtagatgaccttaggtttggcaatgacttcgcacaatccatgaaagaaacaatggataaattggacttaattaaaattttcctctgtcacagaaactgtcaagatgatgaaaagtcacagatgaaaggaaatacttgaaaagaaatatctgataagtgttatccaaaatatacaaagaactctcaaaactcaacaataagtaagcaacttgattaaaaaatgggccagccaggcgtggtggctcacgcctgtaatcccagcactttgggaggccgaggtgggtgggtcacctgaggtcaggagttcaagaccagcctgagtaacctggtgaaaccccatctctattaaaaatacaaaaaacttagctggacatggtggcaggcgcctgtaatcccagctactctggaggctgaggcaggagaatcacttgaacctgggaggtggaggttgcagtaagccaagattgcgccattacactccagcctgggcaacagagcaagactctgtcacaaaaaaacaaacaaaaaaacaaaaaaaccaaaaaaaattgggccaaagactgaacagacaccacaccaaagatatacagatggtaaataaacatgaaaagatgctccacattatatgcatcaggaaaatgcaaatcaatgcaatgagataccactacaaacctattacaatggccaaaatttggaacacagaaaacaccaaatgctggcaagaacatgaagtgacagacattctcatgggaatgtaaaatgatacaactactttggaagacaatttgacagtttcttacaaactaattatactcttaccatctgatccagcccctgttttccaaggtatttaaccaaaggaattgaaaatctaagtctacataaaagcctacacaaagatgtttatagcaattttatttataattgccaaaacttggaagcaaccaagatatccttcagtgagcgaatggataaactgtggtatatccagacaatggaataaagtcctccctaggtatccatgagggactggttccaggatggcccaggataccaaaatccatggatgctccagtccgttatctaaagtggtgtagtatttacatggaaactatgcacatcatcccatatactttaaatcatctcttgattacttaatactaatacaatggaaatgtgatgtaaatcactgttatactatattttaaaatgtgtattattttttattgttgtattgttatgttttgttatttttttttaatatctccaatccacagttggctgaatccacagacatggcacttatagatatggagggccaattgtatcatttagcactatactaagtggaagaaggcaacctgaaaaggcaacacagtgtatgattccaaccatatgacattctggaaaaggtaaaactatggagacagtaaaaagatcatcaaatagtagatgaggtatctaaaaaaaatgaaccaacaaacaaaatacaaaggtcagtggttgccaggggttggtgtgggagacagatggagaagcacagggaaatttcggggcagtgaaactattctgtatgatactataatgatacccgtcattacaggtttgtctaaaacaacacaaaatacaatactaagagtgaaccctagtctaaactagagtctttgggcgattatgatgtaccaacgtaggttcttcgattgtaacaaacgtaccactctggtgaagaactgctgataatgggggaggctgtgcatatgtggaggcatagggcatatgggaaatatctattccttcctctcaattttgctgtgaacctaaaaccactcttaaaaagtcttttagaagaaaaagagtaattcagctatagaaggctcctccagcatgatgtgataattaaaattgtcatgactgccttaagaaaaagtaacttgcttacccagatggaacttttcttgatgctttaaccgagcaaaccgtgatttaaaatgttcttcacaataggtacacttaaaaggtttatcttgagaatgtagaatcatatgttcctccaagtgtggtcttcgagtaaaagatttcttacaaatctaaattaaaatgcaaacaaaatgttaagagaacctgaattaaaaattgtaatattaagcttgtaatgagaagaaaaccatataaattcaataaagagacttttctcccaacagaaaacttacaaaaagtaaaattcaattctaattgtgcagaaaaaaatgctctagaggaagtaaggaatgattttaaattagtactaaaggtagctgaatttcaactctttacatttctagtagggatacagaataatcatactatcttaattctagtcagaatttctaaatccatgaaatatattgttttttagtcacttatgtcaggaataaaaggttttttcagtgttgccatatatttgaataagaatctgaataagaagtcacagaaaaattattttaaagtgtatctcttgaagtggtcagtctaaaaatttgacattcatcaggtttttaaaaagaggtaggctgctatagtaacagcaccaacaataatgacatagcacatattatatataccaggcacaacgctaagtaattcatggattatttttcttgattctcacaataattctgtgagatagatgcaactggcattattaacattttatagccaaggatgatgaaacttggtaaggggaagacactatcttatgcagactaaaatactgtaataaataattaacttcaatttctagaagctgaaatcagagaaattgtgagaaatttgctgtatatataaattgaatcttggattaaagaaggcaaaaataacagctagggatgccttaaaaaagattaacctaggctgggcacagcagctcacccctgtaatcccgggaagcactttgggaggccgagacgggtagatcacctggggtcagaacttcaagatcggcctggccaacatagtgaaaccccatcactactaaaaatacaaaaattagttgggcgtggtagtgtgcacctgtagtcccagctactcgggaggctgaggcacaagaatcacttgaacccaggaggaggaggttgcagcgagccaagatcacaccactgcactccagcctgggtgacaaagcgagactccgtctcaaaaaaaaaaaaaaattaatgtaaatactgaaaaaataattagaggtactgtagaataaagatgtccataaatacgatggtactcctcctgttaaaaaatggaatctaattcccttctctttaaatctacccaggttggagtgatttgtttggccaacaaaatgtagtagaagtgattttcagagacttctgagactatgccataaagtctaatagtttttatctaggtttcttggaacacatactcactcttggaacttagttgctatgctagaaagaagctcaagaagcctcaaaaaaagaccgaagtagagaagaactaaggttcctggtaaacagtccttgctgagattctcgccaagaacaaacaccaagtgacctgtcacgtgggtgggccactttgttttttttgagatggagtctggctctgtcgcccaggctggagtgcagtggtgtcatcttggctcactgcaacctctgcctcccgagttcaagtgattctcttgcctcagtctccagagcaactgggattacaggcatgtgccaccatgcccagctaatttttttttatttttagtagagatggggttttgccatgttggccagattggtctcgaactcctgacctcaggtgatccactcgcctaggcctcccaaagtgctaagattacaggcatgaaccaccatactcggccttgagtgagccactctggaagtgttcccagaccagaccagaccatgcactagttgaaaacagctgagtgacttcagctgacaacaagcagaacagaagaattaacctagcaaatccctgccccaaatttggattcctaacacacaaaagggtgagacatatcaaaatagttatttaaggccactaagttttgatatagtttattatgttaacaccacatacccagaaatgggggagaaagtctaacattttatactctgtgcaacagtaatgtcacagtttatatacataaccataaatacatggtatggtgattacaatgaaaataaaaactaggatttccactgtttaggtccatcatctaaaaactaacctataccaggcttaatttacaaaatatattagaataattttatataaaaggaaaattctaaaagtgagataagctaagtcacattactttaaaacctaattactttacttccccaaaagacgttgcatttactttggttttctaatttgttttaattaaaaactcttacatcacatttccaactttcactcttagtcttcttaatggaaataaattcttgtgcattttcaggatgaaatctatcagaggaaaagaaaaagattattaggaaaaggttatattagttaaatcaatattccatgtgaatatgttgacagtaattaccaggatcaagtactgattcctttcataatgagacaagtaggcatagatgagctctttaagaaggtatcattatcattttaaacacattcaggaacctagctctttatagataaactgaaaggtaatatacctgattttttttagtccagatttcagtaaatttaatttttagagttaaatatataatactctattaaatattatttatctcacaaactgttacacattaaagacaatgttgagtataagaataaatttcttgaccgggcgtggtggctcacacctgtaatcccagcactttgggaggtcaaggcgggcagatcacttgagcctaggagtttgagaccagcctgggcaatatagtgaaacccagtctctacaaaaaatacaaaaattagctgggcatggtgcacgcctgtagttccagctactcaggaggctgaaatgggaggattgattgaacccaggagttagaggttgcagtgagctgagattgtaccactgccctccagcctgggcgacacagtgaagccctacttcaaaaaaaaaaaaaaaaaaaaaagagaaagaaacttatcagagtataaaaaccacatatttctgaagacagacttgccaaaacccaagaaagaaaacaggataatcaaaatactgtatctcaatgaatctccaatgaaagaattggagataagcactttatagatgtttttagctttccacatatttaaattaaaaggcacaataaagtatattatggaagcaagataatacttgcctcttaacatgcttggctaaagtcttcttgcttgcatgaagtttattacaataagggcacttgtgctccttcttatgaaattctgtttcattactgtgcttctttctgtgaacagttaggttagactttgttgaatagcgctggtgacaaatatcacactcaaagggcttctcacctgtgtgaacacgggtgtggctctcatattttcctataaaaaaagaaaaattaaaattaaatttagtacatttgctatactgtgattggaatttgagagtggaataaaacctcatgatttagcaaacttatatacacatccaaatccacacacaaaactagaaaaaagtttacgtaaatttctacctctgataaacctaatgacttactattttgtgcttcctgttcaaagtgtacttttcctcaaaaacttgagtcattaaaaaaaaatattcatgatcacacattttaaaaattaagaggtttgatacattttctgaaaactgttggaaaattctctgaaacttaaatttttaaatgtatttttaaacttaaaattaacttttagcaaaagatcaattcatcatttaagatttattatgttcatatttttggtatctctgtgggtccatacacctggatatggatactggctctctaaatagagggttacgtgaccttggacaagtaacctctatatgcctcaaatcttcctcatctgaaaaactgcggtaataacagaatttacctaatagaactgttgtaataataaacaaattcatacacataatgcacttacaacagtgtcgaacacataagttatcaattactgttgtctattattattactgggtaatctgtgtactgtgaatatgcacatctagtaatttgaattagaaattttgaaatatatttccaagcaaaaggcaataaaaataggaaaataaatcaacatgaaaggtaactcttaattaaaaacttagctttgctctctcctgaaaaataaatgtataaataaatttttcttcaggtgaaaactaatgtgaaagtatagcatttcagtcatatactttaaaaaggatacatcctatgtataacatgaaaattatgaaaaatccaaaatattccaaggccactgaggaaagatataatcataattatgtgtctacccaataaaataaaataaattcaataatttagtaaatatatatacaactgattttattaagcaagtaatatcatattttctaaaaataataaaaaaactgaggaaaggaaaccaatgtatttccttaaggtaagggaagaatgttaatcacaagcaaagaaaacagaagtacaatgaaaaattaggtatttaggtgtagaacatagtaatggtatatgcatatctgatatgcatatagtcagaaaactcagtcaatatttaggcatctcctaaattagttgcgcgattttaatcaagctaataatttaacctctctttacttgcgttagtaacacttcatggggttgtgacaagtaaatacgttaacaaatacacacaacaacacttaaaacatcctggcacagccaggcacggtggctcatgcctgtaatctcagcactttgggaggccaaggtgggtgaacacttgaggtcatgagtttgagaccagcctggccagcatggcaaaaccccaactctacaaaaaaacaaacaaaaaaaaaaccaaaaaaacaaaaaaacccagcacatagtaagcactaataaatattaactgtcatcattattatcatacgggttactagtcataatatggacatgtaggtatacctcaaatataaacatggatacatctgatttatgaatatctgttataacaaatcaaactagggtttcagctctctgataacattggatacacttggctctttccccttgccactgctaaaattgcttagtatctcagttccctctctgctactgctagagtatactcaaccatttacacatacatgtacacatcctaccaccaccacctcccccgctgtgttcaaggaatcagaccaaatactgggaaaagacagaggtcactatatgggtttttaagtattcccttattgtgaaagttttcacatttcatttttaactcaccttttaaattatgtaaataatcatactgatatttaaaaaactgtaaaatcaaaagtatacagtctgattttttaataactaaacttgtgatttttggaacaggtccatttttaactggggattgactgtgcatgtttagcacagattctcaagattgagagacaacttatcaacctcctaatgcttaaatcttctcatctttctttcttttttttttgagacggagttttgctcttgtccaggctggagtgcactggcgcgatctcggctcactgcaacctctgcctcccgggttcaagcgattctcctgactcagcctcctgagtagcagggattgcaggcacatgctatacgcccagctaattttttgtatttttagtagacacgggtttcatcatattggtcaggctggtctcgaactcctgacctcaggtgatccgtccacctcggcctcccaaagtgctgggattacaggcaggagccactgcgcctggacctcatttttatttctaacaaaagtagcagcataataaaaatcttaaagtatgaaaaatttttcaacaaatcatttacttgctatgaaaatgtctttgctgaaaagatgttaaattaataattagcagcattctccctctatttaaaattgagaatttcttctatgcatgcaaataaaaattaagttacttatagctaaatactgaagtcattgaaatggcagttatattaaaaattaaaatcactttgactagtaagcttccatttccctacagaccaggagagataaagatttaagcaagaaaaaaaaaaaaaaagaagaagaagaaggaagtttgggaatttaaactgaaatagccaaatttagaaaaatctcatgatttttttaaaaaccattttaaataaattcagccaaatcaagcagaccaatgataatacagaaatttgagtaagtaaaataattttttagttattaattcaaattttatgcacttaggctttgcatggcctgttatcaccatggatttgaatttctgaacaagaacaggagagacaacttttgacggaatgctggacccagaagagctaggtagatctctacagactagtgggaaaatatatgttaatcttcgattttcatgtttaaatcatttggtagggttttttctttgtttttgttttgtttcgttttgttttttgccagggggagggcactcctcagcacaaacagtaaacatctacaactgtttctctactttcatggagtggggcattcaataataatgtataaatcaaaatgttcacttaaaacttatcaaagtttcaatttcaaaaacagtattccttcacagaatattaaactacacccaagcattcctgatcctgaacagaaaatacataacattttataacataagaaattttatccacagcatttttctgaactgaatcccaatatgaatcatgtctcaaatcagaagtcataaattaaagatattttcacatgaacaaatttgaccttatacagagtttactcccacatgggtcatataaaattaccaatgttagattttgtatgcagtttttacaaagagaaatatcaccagatgagttcattatatatctgatattgctacatcttaaaatgtaccttgaaatattcatatgagttagtctaaagaatatgtaattaaaatacttagccttagagagttgtgccattgttataacccttttctattaagaactaagtggaatatctgcacgatggactagtcacatttttttttaaaggtataaaacatgttctacctctagaagagattgtgaatttaatctaatgaaagattttagttctctgtggaaacaataaaaaagatgaattatccaaattttctctctcaccccatctgtcatctccctatttttgcctgtttatccactaggtttttggtataaggggaaaggtcaaaggactcttatttgcatgataatttgctgagaggaagacagccggtagcctaaggaaaaatataactggaagaaaggataaaagatgcaaagtaatggaatcaaattagtagattacttattgtggaactaatggttccagcagaaggtctcaaagcttatgcatctctcataaacccaccccaaagaagccaagttagaagcttaaagaaggctaattggcttcttacaagcccaaagtcaagccagataccaacttttcaacttagctcaaataaacaagtgcttactaaaaatttatttgaaatgacctgagatgttacaaagaatactagccaagagtaagatacgtaacctccaggctcacaatctaagacagataaataccccaaaatctgggtggcattttaaaattctacgaaaggaatgtggatgatatgagaataatgggaaggtggcgctcgaactcctgtgttgttatttttttaaataaactgtacttctaataataaagatggtaagagaggacacttaagacacatggatcttctgctacatattcttttcattctactcatcaccagtctacttagtctacattcaatgtatcataactctctgctttactctcattctacatcccactcccaacgccactcatcttccaagtctaagctacattatcattctggtcctttgttatatgctccttcttgtctccctggctcttttttcatccctttttccaatttccttctccacactgaagccaccatgatctttctaaaattcttacaggccatggtttcctttgtaaaattcttttcaacagtccctatcacctactgaataaagtctagtctagttaaattagattgtccaaagtatacacctctgtagaacatacaagacatacaaaatctgaccaccactttcttgcccaccttcatctcctgttattttcactatgcctccctgaccaccttgaaaccactcacacttgagcaatttccagaatacaacatacctcaatgcctttgcacatgctggtccttctgtcttgtaaactgttccctattctttgagtctcagctcaaatactatctgctctgagacacttctcctgatttccttagtcttctatacttatcctgataaaattatctttattgtaacatgattgtgttttttcatgtacccattaaactctaaggttcttgatgacagagaatatatcatttcatatttgtttaataatgtttggcagcttagagacaataaatatgctagaacacctacattttgtgcaatattttaagtgattccctagaattaccccatttaatcctcataataacctttccctaccccatgagaaggtactattagcatcacattagcatcatctcactttacttatgaggaaacaaaaacacagacaggttaagtaactcacccaagaacaggattccaaaaaaaccaagcagtcttatattactataactcaggctttttaactagcgatatatgaataagatatagatagatatagatatagatacactaaggtaatagagatgagaaactactggtgaaaagcaagcagcagggctaaacaaaaaagaggaatgggtagaagagtgacataatgtaaaatacattcagaaaggtcagtcagaaataaacctacaatgtgacctactgattcccacaattatctgggctgaacttggaaaaaaaggaaggggaaggggacaggagggagagagggagggaaggagggagggagggagggagcgagggagggaggaaggaaggaaggaaggagcaaaatgtcctcctcttagtaaatcagcacctcaatcttgagcagtattttcccaaattgtgcagaaaactctagtttcctaggatgctcaaagaagtacctccaaagtatcttgcggtaaaatgatttaaggaaatactgggttaagcaaaatcaacaggtttctttactaaagaattgggcagttaaaaccgattgtgaattacgtagttcccaatcttacttgaacacagaagccttctcttacatagcatgtcacgggactaatgttcagtgggacagtttgagatatttgtgttgcacctacaataccatttgtgaactcatccctattcactcatctccaagtcaaattaagacaattaaggcagaatacaggaagcatgcactaagagtacaaagtctaagaagtctattggaaagatgcaatgttctcaggtacttcaacccaaaagctgttctcacctctatacatatcttcacagtatttgtttacagttctacaacagcattttatccagtctaactttaacaacttacttgtatacatatgctcttggaattgttactgaagaagttattttattcatgtttacacacagcctcagttaaaatattaataattattaaattagattgtccaaagtattctgattcagagagaaaattattccaaaaaacattataaaaagcaaaaagcagataccactgttatgtcagcgtataatgcaacatctttttacagcaaatgatcaccaattccttaaaaaaccaatttccgcctatatcaataacataagtaagttaacactgtaagacatatggggatatattaaactgggtaagtaatttctaccaggtcagattgcagtaatttttttttatcattatatgtggtagaatatatttcacaatttcataacttcaatttacctggaagcttaattgttgcaactgaaaagtttacattagaacagttcatctcagacacttccaagaattatcttacctagcaaatattagacaacttgaaattaaacatgtactgacataaaacttaaagtgatagactacatttcctcaaattcttttctaaaagaaaaaaagttgatgtattcattattataacaaccaaagcttcttggccttttggctaaagtcacatgtataatataaccagagtgctactaactaggatactacctaaagtctctatctacagtattaaattacattcatttcaattttatccttcaccatagtttaatataaaacatcccctttctattaaatagtgctagatactggaaaagtgacaacatttataactcatatattaccatgcacggggaaaacagtatacacattattaaatctaatataatccacttttttaatgagttaaaaatagtatttatcactggaattaaaccggcatataaatcaaagctctacatgataattattgacactctggagtctttcatagcaaatacatgatctaatgatgtgtcactgggagatgaagaaaagtaaaggctaatataaatacttaaattaattcctgaatcacaacaactttaaagtaacaggataaacactattgaaaaccaaggtattctccctacttaaacagtctttttagaagttactttccaagtttagtttttatttatcacctttaaaatatccaagaaaagtaagtgattagagatagaaaaccagttttcttttcttacctattcggtcaaatgttttatcacatttaggacactgcaatatttttttgttgctgttctgaatgaccactggagttaacccctcatgaacatttcctacagaatcaccagcctcaggttcttcttctgcatcattatgatccttttcactttgttcttcaatgtcagagtactcatctgacatctcctcctctagctcatcttcttcagcattatattcacttccagggtcctcagaatcatttctatctgacttttccttatcaaaattttcttgattcaaattgtctgacccatcaccactttcctgttcatcatcgctggtgtcatcaaacttaacagggcacttccgattcctttttgatcttcttgcggagaaacttctctccagcatttttaacccatgttttttccctaataaaagggacctatgggttttagccaaatgattctctaaagactttttataacaaaaatgtctactacagaatttgcactgatgattatttgatagtcttccagttaattcatttagtgtttcttctggtgatgacttttcagttagctctgaatgaaaaggggcaacattttcgttatttaacaacttcactgcatctataatgtccaaaaattttgcagcctctaaaacaagaggtatttcatatttgtacacaaaaaattctgatgtgtaaagaaattcaagcaaatgctgaaaaactgaatgtgttacgtgatccagggtgacaacatcagtgcttggatttttgctcaaacacgcatgaaaataactactgccgacagcaacgactactttatgtgcactaaattcttttccttccactatgataagtaaatcacaaaaagatggttgcttctgcctatcatcatttaaatattttagcaaattcttattatactgcaaagaacttaaaagctttctctgatctggagagggaggaagttcctggtaacagtgaagagcttcaggagttggtcttcctgcagaatgagtataggtcacttggtcacactccactgcaacatttccttctgaagaatctttatgatagcctagatggatcttctcaagatttgaagtaacctttctcctcttcttcattgcagtacagcaatttcagaacaagaaacttcataagtgtcttaagtgatttataaaggaaaactagattgtcttggataacagcttctgaaggggcgtgcccaagggtttcatggtctgcaaaagagtgagaaccacgtaaaataactccatggcaaagcaatgctaaatcagccaacggcaatcatcaacgaattctttctaattataactgaatgatgataaaatcacagcttacactcattcgtggcaaagattttggggcggagaacaaggagggccgggtttagaaaaggcagccaacaaaagaataattttaaaggaacccaggcacaccttccaggcctgattcacgaacagggtgaaaatacccgggcagaaaggggagagatcttccaagatcgttgacggtgcgggttgaggaggctgaagtcgtggtttaggggtgctgggatggtgacaataaggccgtggcggccgcgagatccgagtctctccattaacatgctttcctcgggcgggcaaggcacagctcttcaggaatagagagcgtccctcagccaaagccacccggtgagagacggccccaggaggggcgcagagcagaagtggggtcaaccagagggacgactaaaggaagcagaagagctttcccaggcccgggcaaggcggagaatgcgcttgtagtcggcgatcccgctacccttcccacccagtttccctgggaaaacgccccacagatccattaccgggaacccaaggctcccccgctggctcccagcagctgagctccactctgggcgcgctcgctcctgcgcctacccacttccgggttcagccccccacctcaccaccccctcccctccctccgctccttcccctcccagagctccgccgcctccgcagccaacgaacacgtcaaccgctcgcgcagcctccaagccctcctgagagagaccggcgcgcgaccctgcgcgaacgagtgcgcatgtgcgcgcacgccgctttacgcatgctccttaagttccccgtactccctcggagaccctagctacacgccgaatccgttactccgggttttcgcagtggctcggtggcctaccccgatcgaaaccgtgaggcttttgctgagggagggcaatgggagaggggaggatggacgcagagtttagaagtagtttgccgaggtgcagtcgcacgaatggatttcatcctcactggtgtatttaatagtttgtaatctaccaaacagcaactgccagaagccagtcccagctaacctactggcgtgcacgaaagaacccagcgatgctgatctcgtttcgttatttttctgacttaaacggttaaatctaaacgcgattactaagaaaaaaaattttatacctatcattgtacacagaaaaaaaatagaaaaatgtttatataagcgtaaagctggtaggacaggaaaggaagccgaaacaaaaagtaaagaaaaatccacaaggacaacttttggagctagtgcctgagattttggatttctgagtcccaggaggtgctgatatcatttatctgcggactcgtattatgaagcgcaaggtcctagagcgtgtgattttacaggcataaggaatataagatgaaggctgagacaaaataggatgggtggcctaattttcttcccccaccctctcgtccctcccatacacatacaacctgacaactaaaagggccgcactccatggaagaactcctgcagagttggactccccaccggcaaacaggaggaggctatgaagaaacttgcctgtctccgattttcttgggaattgaaaaaataaaatttttaagcctttcatgaaaattcctagcaaaaactcacattcacatggatttgcacaaagattcatatcacctgtgagactcatcccacaaaaactagccacactgaaaagagagaaaaatgtaaaaccaagatagaaaaaggatggtagtctgcagatattgcaattatcagaaacaagtatatttaaagaaatgaagggaaatgaaaaaattatcaaaaataactaagcagattaaaagaataatttagaagtgaaagctatcattatcttagtacttagaacgttgatggaaatgtgtttttattaaaacagaagggctgatccaagatagaaaaatataaatccaaagaaatagaaaaaattctgataagagcaaataatgaaatagtgaaatatacaataaagagaaccaatagaccaaaaatttgggtgttgggatatgtaaaaggtttagaaacttttggaaagatttgatattgccagttttacccaactcttcaaaaaatttaaaatgggtggcaggggcaggtcacatctcatgagacaagcataatgattatacccaaacttgaaaatacgttgcaggaaatgaacattataggtcaaactcataaaattaggtgcaaaaatcgtagacctacaagtgatgtctttgtggtgtgtgtgtgtgtgtgtgtctgtgtgtgtgtgtgtgacggagagagagagagatacaactgaattggatttaataaaggaatgaaagatttagttagcatttaaaaataaacgtgtaattcttcgtattaacagaatgaaagatgaaaaccattgatcatctcaatagatgcagaaaaatatttgataaatttaacacatgattttttaaaaatctcaagcaaggattagaaaatggcttaatataaatagaagctactgaaaaatttttaaatggagcaaatatcacacttaatgaaagattgaaaacttccacggaatttgagaataaaccaagtatgctttctatcattacttgactttttttttctttttttgagacagtctcgctctgtcacccaggctggagtgcagtggtgctatcttggctcactgcaacctccgcttcccgggtttaagcaattctcctgcctcagcctcagcctcccgagtagtgtgactacaggcgcatgctaccacaccgggctaatttttgtatttttagtagagaggggctttcattatgttggccaggctggtcttgaactcctgacctcaggtgatccacccgccttggcctcccaaagagctgggattataggtgtgagccatggcgactggcctacttgacattttaatagaggccttacctaggagaaataagcataagtaagaaatagaatgtataagttttggaaaggaagactaaaattaatcattatatgttttaagtatgttggtgccatatttagatatttagaaaaaatggttttaaatcctatggattaattacttttgactttttaatttcaatatgtttaggggaacaggtggtatttggttacgtgaataagttctttagtggtgatttctgagattttggtgcacccatcatccaagtagtacacactatacctaatgtgtagccttttatccctcacccccctcccaccctttccctgaatccccagagtccattgtattattcttatgcctttgcatcctcatagtttagctcccacttatgagtgagaacatatgatatttggttttccattcctgagttacttcacttagaataatagtctccaatccatgttgctgtgaatgccattattttgttcctttttatagctgagtagtaatccataatatatatgtatactacaatttctttatctgctcattgattgatgggcacttgggctggttccatatttttgcaattgcaaattgtgctgctacaagcctgcgtgtgcaaatatatttttcgtataatgacttcttttcctctgggtagatccccaggagtgggattgctggattaactggtagttctttaaggaatctcctccgcttttccatagcggttgtactagttcacattcccaccagtagtgtaaaagtgttcccttttcaccatgtcccagccaacatctattattttttgatttttttattatggccattcttgcaggattaaggtggtatcacattgtgcttttgatttttatttccctgatcattagtgatgttgagcattttttcatatgtttgttggccatttgtatatcttcttttgaggattatctattcatgtctgtagcccactttttgatggaattttttttcttaccaatttgtttgagttccttgtagattctggatattagtccttcatcagatgtagagatttcgaagattttctcccactctgcgggttgtctgtatactctgctgattgtttcttttgctgtgcagaaaattgtagtttaattaaaccccatctatttatctttgtttttgttgcatttgcttttgggttcttggtcatgaagtctttgcctaagccaatgtctataagagtttttccaatgttatcttctagaatttttatggtttcacgtcttagatttaagtctttgatccatcttgagttaatttttttataaggtgagagatgaggatcacctccttggttaggtgtattcctaagaattttattttatttttttgcagctattgtaaaagggtttgagttactgatttgattctcagcttggacgctgttggtgtatagcaaagctactgatttgtgtacattaattttatatcctaaaactttgcttaattcatttatcaattctaggagctttttggagtaatgtgtagggttttctaggtatcatatcatcagcaagcagcaacagtttgacttcttcactgatttggatgtcctttatttctcgtctgattgttctggctcagacttccagtactgtgttgaatagaagtggtgagagtgggcatcgttattttgttccagttctcagggggaatgctttcaacttttccccattcaatataatgttggctgtgaatttgtcatagacagcttttattatgttaaggtatgtcccttctatgccgattttgctgaaggtttcaatcataaagggatgctggattttgtaaaatgcattttctgtgtctattaagatgatcatgtgacttttgttttgaattctgtttatgtggtgtatcacatttattgacttgcgtatgttaaaccatccctgcatctctggtatgaaacccattggatcatggtggattatcttttccatatgctgttggatttggttaactagtattttgttgaggatttttgcatctgttttcatcagggatattgatctgtagtgttctttttctgttatatcctttcctggttttggtattagggtgatactggcttcatagaattatttagggaggattccctctttctctgtcttgtggaataatgtcaataggattggtaccaatttctcattcaatgtctgatagaattcagctgcgaatccatctggtcctggactttttttttttttttgtaggcagtttttaaattaccgtttcaatttcactacttgttattggtcccttcagagtttctaattcttcctggttttaactgggagggttgtacatttccaggtatttatccatctcctctaggttttctagtttatgcacataaagatgtacacagtagccttcaatgatcttttgtatttctgtggtatcagctgtaatatctcccatttcatttctaattgtgcttaatttgatcttctcctttttcttgtttaacctcctcactagtggtctatcaattttattcatcttttcaaagaaccagctttttgttttatttatcttttgtatttttttgtttcaatatcatttagttctgctctgatctttgttacttcttttcttctgctgggtttaggtttggtttgttcttgtttctttagttccttgagatgtgaccatagattgtctatttgtgctctttcagactttttgatgtaggcatttaaggctatgaactttccttttagcactgcttttgctgtatcccagaggttttgataggttgtgtcactgttattgttcagttcagagaatttttaaatttctatcttgatttcattgttgacccaatgatcattcaggagcaagttatttaatttccatggttttgagggtttcttttggagttgatttctaattttatttcactgtgatctgaaagagtacttttataatttcagttttcttaaatttattgagactcattttgtggcctatcatatggtctgtcttggagaatgtaccatgtgctgatgatatattctgtagttgttgggtagaatgttctgtaaatatcttttaagtccatttgttctaaagtatagtttaaatccattttttctttgtttaatttctgtcttgataacctgtctagtgctgtcagtggagtattgaagtcccccaatattactgtgttgccatctatctcatttcttaggtctagtagtaattgttttgtaaatgtagaagctccagtattaggtgtatgtatatttaggactgtgatattttcctgttggacaaggccttttatcattatataatttccctctttgtcttttttaactgctgttgctttaaagtttgttttgtctgatatatgaatagctattcctccttgcttttggtgtccatttgcatggaatatctttttccagcccttccttatatgttgagtctcttgaagacagcaaacacttggttggtgaattcttatccattctgccattctgtatcttttaagtggagcattttggccgtttacattcaacattactattgagatgtgaggtactattctattcattgtgctatttgttgcctgaataccttgccttttttttttcattgggtttttattttataggtactgtgagatttatgttttaaggaggttttattttggtgtattttgaggatttgttccaagatttagagctctttttagcagttcttgtagtgcttggtagtggtgaattctctcagcatttgttagcctgaaaaaagactgtatctttccttcagttatgaaccttagttttgctggatacaaaattcttggctgataattattttgtttaaggagggcaaagatagggccccaatctcctctagcttatagggtttctgctgagaaatctgctgttattctgataggttttccttcatgggttacctgatacttttgcctcatggctcttaagattctttccttcatctagactttagataactttatgactatgtgcctaggtgattatctttttgcaataaatttcccaggtgttctttgagcttcttgtatttggatgtttatgtccctagcaaaactggggaaattttttttcgattagtcccttaaatgtgttttccaaacttttagatttctcttcttccttaggaacaccagttattcctaggtttggtcatttaacataatcccaaacttcttggaggctatgctctttttttaaattattttttctttgttttggttggattgagttaattcaaaagccttgtctttgagctctgaatttctttcttctacctgttcaattctattgctgagattttccagtgtattttgcatttctctaagtatgtccttcatttccagaagttgtgatttttttttaatttatactatctatttcactgaagattgttcccttcatatcttgtatctgtttttataattcactaagttggacttcacctttctctggtacctccttgattacttaataatcaactttctgaattctttttctggcaattcagagttttcttcttggtttggatccattgatgttgagctagtgtgatctttttgtgttgttaaagaaccttgttttgccatattaccagaattgtttttctggttacttctcttttgggtagactatgttagagagaagatctggggctcaagggctgctattcagattcctccatcccatggagtgctcccttattgtggtgctctcccccttcccctaggtatgtggtttcctcagagccaaactgcaatgatttttatttttcttctggatgtagccacccagtggagctaccaggctccagaagtgtctgcgcagagtcctgtgatgtgaactgtcttcaggtttctcagttgtggataccagctcctgctctggtgtaggtagcaggggagtgaagtggactctgtgagggtacttggttgtatttttattaaatgttctggttttctgttggttggcctctagccaggaggtgatgctttcaagaccacatcacctccggttgtgtgggaaggatacaaacttgccctaggctcaggcattagatgagccatagagctcccaaagaactatgtgcattgtctttggctaccagggcaggtagagaaagaccatcaggtgggggtagggttaggtgcgtctgagctcagactctccttggtcagtgtttgctgtggctgctgtagggatgggggtgtggttctcaggccaatggagttacgttcccaggggaattatggctgcctctgctgcatgtaggtcaccaagaaagtgagagaaagctggcacttacagacctcaccccgctcccacacagcccaaaaggccagtctcacttccatcatgccctgccaacagcatcaagtttatttccagatggcatgtgagcagggctgagaacttaccctaggctactagcctcccaactgagaaagcaagcacagctttcaggtttcatgcctccccacatgcctcagcttctgtgctgtgtctgcactcccgatttgctccctctcccaggttctgtccagaaactttgcattcaatcaaaattgttcagctggaagtttccttctcttgccatttttgttttgtttttgtttttgttttgttttgttttgttttgtttttttgagatggagtctcgctctgttgcccaggctggagttcagtggtggcgatcttggctcactgcaacctccacctcccaggctcaagcagttctcctgccttagcctcctgagtagctgggactacaggcgagtgccaccatgcctggctaatttttttgtatttttagtaaggacagggtttccccatgttggccaggctagtcttgaacttcttacctcaggttgtatgcctgcctcagcctcccaaagtgctgggattacaggtgtgagccacaacacctggcctctcctgcggtcttttcccagttcccctggcagccctttccaaaaacccgtgtgagacaaagtcagaaatggcttccctggggaccaagaatgcgcatagggctcttcttgctgcgtcttctactcctgtatttcgctcagctctctaaatttgtctcagctccaggtaagtccaaatccttcccctgtgatctggaccttcaggttccccagtgggggtatgtatttggaggcagatgatcccccttttacacattcacactttgggcattcacagtttttccactgtatcccagggcagctatctgcttctttcaaagggtctgtgaattatctcagctttcctggtatgttcctatggtagttcttggagtaaaagttcacaatgtgagcctccacacactgctctgtccatccaagtgggagctgcaagttagtcctgccccctattcaccattttttccctatggagaaattattagttaatgaagttgcaggatgtaacattgaagtacaaaataaaatagtatttaccagtaacaactgtgatggttcattttatttgtcaacttggctaggctgtggtgcccaattatgtggtcaaacaccctgaggatgttgctgtggaggggtgttttatatgtgattaacaggcaaataagtagactttgagtaaagaaaattaccctccataatgtggtaggcctcattcaatcagttgaaggccttaagagcaaggacagttttcatgaagaaaaagaaattatctccaggaattcaaggtagaaaccctaactgagttttcagcttgctgtcctgcggaattcagtctcaagactgaaacatcatctcttaccaggatttcccatctgtggacctgtcccacagatttcag

SEQ ID NO: 568 - DNA, 36615 bp, Homo sapiens
cagtcaagattatcttctataccaaggattggcaaattgtagcactggctaaaactagtctgcagctggtttttattttaaaaatattattcaaatacagctatgtccatccatttatatatggactgtggctgcttttgtgctattttggcagagtcaagttttgagtcagataccagatggctcacaaagtggaaaatatttactatcttggcctgtacagataaagtttgcccacccttgttttatatcatagtgggggctatttcccttaaaaaatactactccccttcttcagttccttcagtgatgctccattgctcagggtcaagttcaattgctattgggttgcacaccacttagtgaataacttacatgttcccacctacttgaaatgctgcattttcttttcttttttttcttttttttttcttttgagatgtagtctcgctcactgtgtcacccaggctggagtgcaatggcacaatctcggcttactgcaacctccgcctcctgggttcaagcaattctcctgccttagcctcctgagtggctggaattacaggcatgtgccaccaggcccggctaatttttgtatttttagtagagatggggtttcaccatgttggtcaggctggtctcgaactcatgacctcaggtgatcctcccgccttggcttcccaaagtgctgggattacaagcatgagccaccatgcctggccaaaatgctgcattttcatataaagttctatgctttggtctatttccagacccttttggtttctgaatggccagaaggcttggtagtaaatactttgcagcttgggtatgagttcaaggttttttgtttgttcgtttgtttgtttgtttgttttttgagacggagtctcgctctgtcacccaggctggagtacaatggcgtgatttcagctcactgcaacctctgcctcccaggttcaagagattctcccacctcagcctctcaagtagctgggattacagacacctgccatcatgcccagctaattttttttgtgtttttgtagagatggggtttcaccatgttggccaggctggtctcaaactcctgatctcaggtgatcctcccgcctcggcctcccaaagtgctgggattacaggcatgagccaccgccccctccaagttcaaggttttaagacactaagtggtctcgaacccttagagaccttgctttcctcgtgtcttgaccatagcacgtggccagctcacactttatcttgagtaagtctaaaagctcttctttggtttcccaggtgtatgaagcttatggtcaaacagaatgcacaggtggctgtacatttacattacctggggactggacatcaggtaagtcctccatctgctgggcaggaggtgccatggttgggagaaaggttctaactgaactaggactttggagtttagataacttcagttctctggactaatgtggcaaatgcaaaattcaagttttgggtccaggcctgcctatcttggctagtctgcattggtgccaggtgatttttcagtcttcctcttctagagtcaattcataaatatcttagaaatgtgcctggaattatcaccatgcaagagtttctcagctaattcagcacggtatgttctaggtcacgttggggtgcccctggcttgcaattacgtgaagctggaagatgtggctgacatgaactactttacagtgaataatgaaggagaggtgggtaggtcatgccctgtggtcagacagtcatggtggggaggtttatatcagaaagagcaaataattgtaagcaaacttggatttggcccctttgagattgttagcaaagaattaagcattctgaacttcactttcctatcccctatagtggagacttagatctggtgctcttcacagtgtagtggaagccatcaaatgatttaaggggagcaggtgtttcataaactgcccacgctgggaggagcagcctttgctattgtcaccgccttgtatgtctgctgtgcaggtctgcatcaagggtacaaacgtgttcaaaggatacctgaaggaccctgagaagacacaggaagccctggacagtgatggctggcttcacacaggagacattggtcgctggctcccggtaggtatatcatcagaactcctggaagtctatgctaatggactgagaagaacaatctgcttatagcaagaggtgcagaaatgcaagtaggttaatcagctgaggcagctggaggggattaggtttgtaccctacctggcttatgacttcctcatactatccagagaagaacatacagactgaggtggtggatcacctgaggtcaggagttcaagaccagcctggccaacatggtgaaactccgtctctactaaaaatacaaaaattagctgggcatggtaacgggcacctgtaatcccacctacttgggaggctgaggcaggagaatcgcttgaacccaggagatagaggttgcagtgagccaagattgtgccactgcactccagcctgggtgacagagactctgtctcaaaaaaaaaaaaaaaagaacatacaattgaaagaatctaggttaagttaaaaaaaggctgggcatggtggctcacacctgtaatcccagcactttgggaggccgaggcgggcggatcacaaggtcaggagatcgagaccatcctggctaacacggtgaaaccccgtctctactaaaaatacaaaaaattagctgggcgtggtggtgggcgcctgtagttccagctactcgggaggctgaggcaggagaatggcttgaacccaggaggcggagcttgcagtgagccaagatcacaccactgcactccagcctgggggacagagcgagtctctgtctcaaaaaaaaaaaaaaaaaaaaaaaaaaaaaaaaaaatatatatatatatatatatataggctggaagtcatgagatttgtgttctggttgcagctcttccatggatcaacaatataaaattctgagaaagtaatttaacgtgtgaataggagctgccaaagctagaaagtctttcttaaaaaaaaatttttatagagatggggtctcgctgagttgaccaggatagactcaaactcctggcctcaagcaatcctcttgccttgacctcccaaagttctgggattgctggtataagctaccacaccagaagtactgccagagtacttttggtattttgatcacactgttacagaagacaccaagatgtagaccagttgaagtgttttcttcttgccttattccttatcgaatatacaaccagcaagcagtaagtcagtgatcctagcactgtttttagacccaaactgaaggtgggattctttaacaggtcaggtagacctgcacatcagagttggcatgggtcccctgcaatggaataaatttgctaccagccagggaaaaattaggtgacttctctaggaaaggggaagggagatgtactactctgtcctttttttttcccccttaacttttcttgaggcagaagttgtggtttgaagccaagtgtggcagctcacgcctataatcctaacactttaggagactgaggagggagaattgtttgaggccaggagtttgagaccagcctgagcaacatagcaagactctgtgtctaccaaaacaaaacaaaacaaaaacccaaaaaactttggtttgataatgccgttggtccacagcttttgcctcttatgagtttcttgggataaatatcctccctattaattcacaggcatatcaaaacaaggaagaaggatttctaaatcaagtgtttgcagaggctagtgtttgtctctcattgaccttcacagcccctttctgtggaagatacagagacatatttttagcatagcttgataattagcagtagttgctattagttttcctaagaagaaaggaaattattgcaagggcagtgatgggatttcccaaaagatcttccctctcaaaagttttgtcttaactatgtgctggggaagtgggaatgtcactagaacttaaaactcctttcttgctcaatcaatatttaagatttaagtgagatttaaggaatgcttgacaatgtaacttttaagaacactggtcctaacgatgcattttattgatttgggtttggtagtatcttgctaatatatttgtttctgtctagtaacagaattaaataacactctaataagcctaggatgtaagcaacagatatgtccccacaccagggttatagaaggctgcaccttattaatcactttcagataatgaacgttaggctgaattgatggctaatttatcaagtcggccttgtgatagttccagtgttggtttagttagtcgccctacttagggtgttagcatgtggattttatttgccatttgtcccaattctacaattcaaatccctaaagacctaagctcctcagaccaattagttcagagaaatgaagctgcaaatgacctttggtggctggtcagagtcctctcagccctgttgctgtcctaacaagcccagtaattgagttgcttgattagcacagtggagctgtttgagcctgctcccggatctaacaaggaggaaaacataacagggagtcaagtggtgggagaactattcaaatcaaatcaaaagtctaaacaaaagacaacacctctatttctgagagttctgaaaatgaactaattggaaattagtgattggaaattgagagctgtgcaatttcttccttggatgaggcatcaatttgcataactccagtagatccaggagactttctctaaggctgcgcattgactctccacatagatatacagtaaagacaggttcttgctgcacgatgcttccctcccctttcaccaaagccaagaaagagaaatgaaagacagctcaaaagtctctggagaaatcagctttagagaagaaagatgactgtgacttcaccactctccccactgatatcatctctgtggctcaaaaatactgatacttttatctgtctcatgtagaatggaactctgaagatcatcgaccgtaaaaagaacattttcaagctggcccaaggagaatacattgcaccagagaagatagaaaatatctacaacaggagtcaaccagtgttacaaatttttgtacacggggagagcttacgggtaatatatcattttaacaatagcccatttcagtcacaaaccatgctggttcttgtagctacaggaaatttgtatagttgggttcagaatgagaagatccaagcttataaaactaaaaaaaaaaaaaaaaatgaagttacattccaaacctcaaataaggcaatttcaatttaaaaaatttcaaaactatgatggacgttgtacacaagtcagtagaattgtttagaatggctatactaaaaggtaatgattcagtaaaaaatgagctccacattgcacttagttcccattccttaaggagttccttaaagctatgtttaagagcagtatgtataaaacaacaaactgttgcaatatatataaagcaacaaacaaaagtttgatcaacaaactgttgttttatacatactatgcttaaacgtagctttaaggaactccttatcccaaaacaacgaactgttttatacacactgtgcttaaatgtagcttttaggggacaaggggagagttgacatggacaagccagaggcgctttaagcttaatgttgaaggatcagatttgaatggaacatctttgtaatgagatattgagtgggaaaatgggattacagttccatggtgttgaaaatatatggtgagaaaagaacactagtactggatttaaggttttggggaaataactattacaatgacataattctgctttatttaactactgggggacatccctacataacttctctcatgcccttgcaccttttatttcctttccatagtcatccttagtaggagtggtggttcctgacacagatgtacttccctcatttgcagccaagcttggggtgaagggctcctttgaggaactgtgccaaaaccaagtaagtcttgcctaggaaagctttatgcacacccatgggcccatcgtggaggagaggatgcctcaccagttcctgcatctgtcacaagtggctgcagcccaaacagactgaatagttttatgggactcggggataggatggagagtttaaaaaataaaactctcttttctatttaaaataatatgttcattgtgggaaaagattgggaaagaagagtaaaaatgctattcagagaaaactgttaacacttagatgtgccttttcttctcagtttttctttcaatattgggcatataatgtgcttgtgcatagttttatattcctgctttcatactgcatggctttgacaggcactttgagttggttcatgcttagcccttcaggctttttgaaacagccatgctttaagtgatgttttgtattcttaggttgtaagggaagccattttagaagacttgcagaaaattgggaaagaaagtggccttaaaacttttgaacaggtgtgtgctaccactgatgttatactggcctcttgtcagaaagttttgtttaaagtttccatctaatgaggtttaaatgtataatttctaaggaattgattttagattttgtgccattaactacaaaatgaccttttgtagttacttgtacagcgccctttttttgctgtttattgtccattctcccttctccctactcattactttcttaaattatgtttgtgggaatgggcatgtgttactgttacctttaccctttcactgcatcaacctcactttcttcacagagcactcagggggctctgcagagaagtccaaatcactaatgagcatggatgtgtgtgtgttcatcttccaggtcaaagccatttttcttcatccagagccattttccattgaaaatgggctcttgacaccaacattgaaagcaaagcgaggagagctttccaaatactttcggacccaaattgacagcctgtatgagcacatccaggattaggataaggtacttaagtacctgccggcccactgtgcactgcttgtgagaaaatggattaaaaactattcttacatttgttttgcctttcctcctatttttttttaacctgttaaactctaaagccatagcttttgttttatattgagacatataatgtgtaaacttagttcccaaataaatcaatcctgtctttcccatcttcgatgttgctaatattaaggcttcagggctacttttatcaacatgcctgtcttcaagatcccagtttatgttctgtgtccttcctcatgatttccaaccttaatactattagtaaccacaagttcaagggtcaaagggaccctctgtgccttcttctttgttttgtgataaacataacttgccaacagtctctatgcttatttacatcttctactgttcaaactaagagatttttaaattctgaaaaactgcttacaattcatgttttctagccactccacaaaccactaaaattttagttttagcctatcactcatgtcaatcatatctatgagacaaatgtctccgatgctcttctgcgtaaattaaattgtgtactgaagggaaaagtttgatcataccaaacatttcctaaactctctagttagatatctgacttgggagtattaaaaattgggtctatgacatattgtccaaaaggaatgctgttcttaaagcattatttacagtaggaactggggagtaaatctgttccctacagtttgctgctgagctggaagctgtgggggaaggagttgacaggtgggcccagtgaacttttccagtaaatgaagcaagcactgaataaaaacctcctgaactgggaacaaagatctacaggcaagcaagatgcccacacaacaggcttattttctgtgaaggaaccaactgatctcccccacccttggattagagttcctgctctaccttacccacagataacacatgttgtttctacttgtaaatgtaaagtctttaaaataaactattacagatacttacgttgtggtgtttctttcctcatggaccatgatgaaaatcagtcttaaacaaggaccccttaaaaatcaagtacagtatctgttcttaaacttgggtacacaatagaattatctaggaagtttaaaaagacactaatgcccagcactttgggaggccgaggcggacggatcatgaggtcaggagaccgagaacatcctggctactatggtgaaaccccatctctactaaaaatacaaaaaactagctgggcgtggtggcgggcacctgtagtcccagctactcagaagattgaggcaggagaatggcatgaacccgagaggcggagcttgcagcgagccgagatcgcaccactgcattccagcctgggtgaaagtgtgagactctgtctcaaaaaaaaaaaacaaaaacaaaacaaaaaaaccactaatgcctggttgccactccagggattctggcttaaatggccggatacagcctgggcactgagattgttaagaagacccacagatgattctagtctgcgaacaggttagtgaagaaaagtaagttctgaagaccaaaccttcttatcccatagctgtaaagaataaaacaaataccagctgagccaaaactccaactgagcacaagtcatatccattcttttaccatctttgttgtactctaattataatcttgaatattaatagtattcttttctggcctccaactggagttaaagagaatgttcttggatggtctttctagattttgagcccagaaaagccaaagaaatatctattcttaaggatctgaaacaaaagggtaggcaggaattaacttttaaagtctagctcccattatcactttaactttctcgccttcacttcctttcctattctcccctcacgcattacagctgaacctcactagttaccttcctgtttctcaaacgtgtcagacacaggtccagcctgtttttgttcttgctgctgtctctaaaatgcaaatatcccaaagcacatgacttgtcccctcatctgcttcaaatgccaactcaagactgtcctaccttcttgcttcacaataacatgactccatcttacatatattttacctgtctgttcactgctgaattcccaagtgctcttcccttatcctcaactattacaggcctggcccccaaagcttcacattccctgccttggaaaggtttctgaagtccagagaaataggctttctctttccttctgtgattccactgttatgtttagacaagcccaatttaagcatccaagcccaccagcttggatcctaccactcacacaagcttcagctttttactcaagggtacatgagtagtttgatatcactatgtttaaagtctagaacactactgccacgggatccttggggtgttgcttccccagctggaatcctctgtggctggcagcccaaagtccagagggggcctaggcggcagggcgctggtgtcagcaccactcagagctcacgtacacctggccaggtcctcacagcacccgggcttggcctcacctttgctccagagcgagtgccaggagcaggaagaggccaagcagttgttggggggggggtgtggggggggtatttcccctcggccccctagagcacaaggatgcccgggtccgcagccacggctggacagctgtagctacgcttggctcctgcctatcacggctccccctcaacacccctcaggccaccactgccatccgctgccatcactatgaccgcaatatcccattaatagggttaatatcttgaagcaagtgtgtcatgtcttaagccacgttttaagatgccagttgtccacagggcagcagagcagtttttccataaggaactaagatgaacctttttagtcagcaaaaagaaaaatgctttaagtaaaaactgattatacccaacatccattgatctttatttgatttgacaaaatctgcatttttaaaagacaggtaacaaaatctgaggttatactgaatctgacaaattgagttctatagtatctagaatatcatataagaaatatcaactgagggaaaagagaagtaccacatgcagatgctcctggcaaggggggaactgtatctgcaggtgaggtccagagtgtgcagtgcataagaaaatcctacagaaaatgccgttaacttacttggatgaaatgtttttcctttgagggggaggaagaggtggtaaagaggggcaggaattcaaaggcatatgcagaatggcttctccatttcaaaatggtaataaaaatatttaaatcatggcactagggcacctttgaggaaaagaacatcttaaccagagtaggctcattgcataattctttagtaatatgtacaattttcaagtaattaagcagacttaaaggataattttgttttaacagcagctatctatttttcttctccccctctggggcttgatctgtttcagcatcacagggacacttttccacacattttctagggaaccaaccccttattcttgaaacacctgagggagaaaatgaaattgaggtgaaatagtctgatggatgacagtgacattactgaaagcagtaagtcctattacttcaaattaataagcttgtagttagacttttattccccactttgctatctattataagcacagtttgaaggggaaaaaaataagatttttaaatgttcataacaagctaggaacaggtatttcccaaatttgatgatcccgaatagggactaatgtggttaaagacagctcctaactagagtcagggggaactcggtatgggtgtttacttatatgtgtatgatcaggaaaggtgtttttggcacaccatcacactgtcttttccagggaactatcttcttgtagtctttgtaaatttcctttttagactttttctaacatatatatttctttcttttttttttttgagatggagtcttgctctgtcacctaggctgtagtgcagtggcacgatctcagattactgcaacctctgcctcccgggttcaagcaattctcctgcctcagcctctggagcagctgggattacaggcacacaccaccatgcccggctaatttttgtatttttagtagagatagggtttcaccatgttggccaggctgatcttgaactcctgacctcaggtgatccatctgccttggtctcccaaagtcctgggattacaggcatgagtcaccacacctggcctaacatatacatttctatatcacggccgtcataagaggttaatttatgattaaccccaactattttttaaagaacatcccgagctaatctttactttaaaaagaaacaattataaaacttaagaaaaaaaaaaacacaaagtttcaatctactggtttttataacaacttaagagaaatgctcaaagtgggggcagcaaatagtacaggggtttggtgcatagaatctggagtcagactgcttggggttaagccctagctccatctgttttcagtgcatagctatgggcaagttgcctctctgtgcttcagttccctcaatcaaatataaataatagtgcctacctccgaagtattttggggacttctacaccttaagggtagcacttatacaagtacttttcgcatagttatgagctcaaatgttagctatcattaaaaagacctgaaaaatacaagagctatagagaaatatataaggaagttccttttgttgcttagtgatatacccttctatgcagttcccctaatgcattaggcatgattggtttataaaagttattcttgtaaaatttggaattattgctaatagtcttgtcctttaaacatgcccttccatttccataccttctataaaggaatcatcaagaattttgtctccatataaccagtatctgaaatatttaaaagatgaaaattaattttttaggctagatattaattttgtccttgaagaagaaatgcagtacttcctattacttaccgtaaacctcttgtggctaaaatgaattcccctttttgcagctgtattcgaggctcttcggtgcagggacttgtgaagaaggttttgattcctttattcagagggcagcaggcaccactataatcttctattactttatagcgaacctgtcgtcagtgatcagaagaaacctttaaatattcacccatgatatctgagttttaagtctgaatttcaaattttaaagcaagatccaaaatatccagtgacaagccttctagttccccttctaggggaacctcccagttccccatccacctagttccctgggaggcaactaatgtttctagttctcaaggcttttcttactcctcttttcaagcccatagctaagaattagagttagagcagggctaagaacattctgccatgatggaaatgttctgtatgtgtagtatccaatgcagcagcacttgacacatgtagctactgagtgagcacttacaatgtagtgaatgcaaacaagaaactgaatttttaaattgatttaattttaacaaatttaaataaaacagccacatgtggctggtggccatcatatccaacaacatagttgtaaggataggtttcacattaaggagctgtattgaggataattattttcctatgttggcaatataaatggactaaattcctcccaacctctagtcccaattatttaaataaaaacaaaagttaactgcatcaaatttcaacaaatgtattaaggaatactatttaataaaggccaacaattggtttctagtcagtcaattaaaaaaactgtatggaagtacagagcctaacaaaagaaaaaaaaattaccactgcaaaagaagtacttacacttctgactctcttatctgctttttgtttcaactgttctatctgtttggaagaaataaaaagaaaaaaatgaagtctcttgtctcaatgttgaaaaatcgcctttcctcatcaactgtcagagtgatatggcaaaaccccaattttccagcatttcaagttgctgataatttaaaggccacaggttgttttagcatggaaaaaaaggccctatgctaagaaccagaggctgagagtgaggttttcttctcgctattcactctctaatgtcctcatctgtgtatattcctagagtgcttactgtggcccagggatcagggagtatattctccgccctcatgaagcttctcaggtgaaaacactgagattcactgattctgtagagacatggcagacaaactacaaatgaataatgaagaacatttaataatgaagttgaatgaataaaagtcatcataacttaatttgacatagctactattaaatagcactatattagatataataggagaaataaagataactcatgatctctgtcctagaatcttatgaagttacagatataagatagcagaattaaataaaaatatgagacttcatgagctaccatagagtagtatgtgattaaatgtcacattcagatgagtctatgggggtaggttagactttatggaagaggtaagactggaacgagtcttaataattttagatagagtggaggtcatataagatggaaaaaattgtgggcaaagttgggtgacaggaatgtataaggaattcatatgctactgtaagttggaaggtaatttttggccagatttcataaaactatgttaagggatcaggactttatctcacaggtatagagaattaaggagatattgaaataaagggagatacatgatacaaggagtgctttagaattattagattcattttgacatagtgaaaacattcatattacttattttactacaaaatgtcacttgagttgagggggagttaagggaaagaaggcgaggcaaaaaggaagggctatttgaacaaaaatactcactgttaagctgtattggtgacagccttctcttactggccactcaagtccatctccttcagggacccctgaccacgtaaatacctgtttaaagttcctccatctacttcccatatcatatggaaaaacaaagacttcatctagttgataatactgaattcgatctttagcctgtgggtaacaaagatataagatggcaggtgcctctgtctaagtggcctgcagtaatatgttattgagaacacttatttctcaagtttctaacattcataaaaatacttcctccttgctgtaatattagtgtacatggaagcaatagacaacttcatcacaatataggaagaacttgatatagaacaccagccttgtatgtgattacctaggaaatatctgacagggtttctttaggaataagcactcataaaggcttattaaaagttagctaactttatctcatacataaaaagtcctcaatgctcctagttgttcagcaatacaaaacaattcaggtatatagaagggatgcagataaacagattcaggagaaaggtaaaggtttattcaggatggaaccgttttattcaagatagaactgttttgtggggtgcaccagaatgtaacagttgtatcagagggtaacagttatatcctgggtggcagtgatgcccatgggaatgaccaggaaaggtgtaacaggagagctgttttatgaaaaacattttttaaagctagcagatatatacaggagatcttctttctttttttatactatcacacatgtacacataactcatttatatatgcatttatatgtacatgttatgcatgtacataactattcagcttgcatatattccaggcatttaaactgttagctttaacttgaggaaataaattggctttggatttcttaagttccactgacacctagtggtacaaagatacattatttattttaacaataagtatacaaatcccttcaaatttgttgtatatagtgtctggtaatttctatacatttcctataaatttaatatggtcatttgtttgaattttttactcagcaataaagtgcccgttctgaaataatttctagtctatggccataccattcagcatactcaatctcatctgaggtaatttctaaatgtagcatggcggtttataagcagccttggtcatccacaaaaacaaacaaaaaaatgttaatctaatgtcaatatatttattatgcttattagaaatgatactttgaaatatttgattatcaggggacaatgttttatggaaaatgttgcaattatttgttgagtgatattaaagttaactatttactaaaataattattaagctataatgcatatgaatctattaagttatataaatccatcctccccagaaagtaaagaataatttcattttcttttttataaacacagcttcagagtcttcaaaatggactgaatttcaaagaaaagagttctaggctatttacaaagaaaaactggtaaatataagagaatttataaaatgactaagacatgtctttgcctaacagaaacactcaatgaagttaggattctatcaatattgtgtgttaaaaggtgatgaaggggtgtggtagatgctatgggaaaagggaacaaaggaaacaaaaagtacttagccaagtctagggagtatccaggaagggtccttgggagaaacaataccttaactaagtcttgagaagcaagaaatcaggcaaaaagagagggaagagcattctaggcagagggaacaacatgtgcaaggatacagaagcataagatgtacaaactatgagtaatttagtatcaagtgtgagacagggtagagaagggtaggaaattaggctggagaagtagataaaaagaagtccgccaggtgcagtggctcacgcctgtaatcccagcactttgggaggccaaggcgggtggattacttgaggtgaggagtttgagaccagcctggccaacatggtgaaagcctgtctctactaaaaatacaaaacttagctgggcatggtggcatacaccttgtaatcccagctacttgggaggctaaggcaggagaatcacttgaacccaggaagtggaggttgcagcgagccaagattgtgccactgcactccagcctgggcaacagagcgagactccgtcgccagaaaacaaaaaaagaagtcataaaaggtcttacttatgtagaagctaagaagctcagacttcaacctgtacatcagtggttctcaaagcatgctttatagatcactttgagtattcaggactttttcttgctggtcagcaaggccaagctattttcataataatactgaaatgttatttgtctttttgttgcattgacatttgcaatggtgaataaaactgttggcatcttagcaaaaaccaaggcagtggcaccaaactgtgttggtagtcattatgagcaattccatgtaagaatgtccttgatgaagcagtaaaaattgtttttaaatattaaatctcaactctcaaggagatgtcctttatttttaacagtctgtgtgacaaaatgagaagtatacataaagcgtgcccaagtagaatgatcatctcaaggaaaatagttgttaagctgtaagctaacaaaagctgtagagccagcttttttaatgtaacactattcttatttgaaagaatgagtaatatagcaaactaaggttattcagacttcaggacttggtgaacattttctcaaaaacgaacagtcaggcagtcacttcaagggaaatgactgacagtatgggttaatagtaaaaaattaaggctttcaaatgtatactagaattacaaaaaaaaaaaccttgtatctaccactgtgagcctgacagctttccaatacttaaggattttttctcataaaaatgatatattgatatacgtgaatgcaattttgggatattgtataatgaaaggtgtttaacgtttgcaaaatctacataacacagtaaactagtatttgccaaatgaccgatgcctgatgttacataaaaccacatactggtaaaagattaattcaaagagcaagatagactgatgagttttaaaataaaaaggtataaaaatcttattgataagaaatatcacttgtcaagttttcaatgtaatacggaagaacatccactattatcatgtaaaaggcctattaaaatattctatccttttctacctacttatctgtgtgaggctagatcttcacatacttcaatcgaagcaacatatctcaacagactgaatgcagaagtgagaatccaaccatcttctcttaagtcaaagatactaaagagatttgtaaagatataaaacgatgctattcttctccctattttgtaatttggaaattgtgaatattcccctgtggcaacaatcagcttggtctgccaggcaattctttggtatacaggcttgctccccttcatggacgttatctgcccagaccctgcaggtatttgggtttcaacccctgccacaggaatggtgaggctctgagaagttttaaacacagagcagggtagtcagatttgtgtttcatgctagaatcacaatggacagtatgaagtattggacattgtgaggtctgtgacaagcaaaatgttaggagcttcattgaatgtctaaaacactgagaaaaacctgatggcagtttggtagggtggaagctcctttccaaatgggctgctttctcctctagtctaagagacaacaaacagatggtttgacgtgtggcttaggcctctgcgaccactcagggtgtatgagaagcacctttctgtgggagttacagaatgaacaaaaatgtttcctatattcaccttttatgtggcatgcaaatgacttacggtagccatttggcagccatgttttcacttttaggcacttttcgttaatccggtctaataacagactttattaatattcaggactttaccagtcctttattaatatacttttttaatattgaagaaacaattattaaaatttaccttctcttcaatccatgactcaatagaagttttgtttctgagaattattttcatctggaaattaaatgatagtaaaatttaataatgcgaccttggttcctttaagattatcatattcataattctctgagatagcttttattactccattccatagacaaagataccaaggataacagaggttaagtaccacaattaccatgtcatccgtctgactccaaagtccttgttcttaactactgcaccacggtacctctccgtaacaatgattacacccatccataatcaaatctgaatctagtatgttaatcaaactttatgtcataagtactattttcagagcaaggtttaataaaacattgatataatccatttaatcagtgcttacttataatttgctattaaaatcttttatcactatttttaactaactttaaatttacgattaatctatttatgagaagtaacagtgactcatttcagtcaacctcaatatttcacttgccttaaaaataatgaatgtattcagtctttattctattatttgattttcctagatatgactgattccacatatataggcttttatattataggatcttagtttatttctaatatgattctaaattagaggcattggggaaaatttttcaaagaatttggtcccaggctagtagacgataataaagtataaacaaaaccagattattttaaaaccaagagttcccttaaagtctggctgtgccttcagagagacagtgtagtatgttagaaacagccttggtggaggctgcaataagccgagatcgtgccattgcactccagcctgggccaacagagccaggctctgtcacaaacaaacaaacaaacaaacaacaataaaaaaataaacagccttggcccaggagtcctcatcatattccaagggcctagcataatacctggcccacagtaggccttcaatgaatgaatgaatgaattacgtgaatgcaataagtcataagaatggtttttgggccgggcacagtggctcacacctgtaatcccagcactttgggaggctgaggtgggtggatcacaaggtcaggagttcaagaccagcctggccaagatggtgaaaccccgtctccactaaaaacacaaaaattaaccgggtgtggtggcaggtacctgtaatcccagctacttggcaggctgaggcagagaactgcttaaacccggaaggcggaggttgcagtgagctgagttcacgccattgttctctagcctgggtgacagagtgagactccgtctaaaaaaaaaaaaaaaaaaaaaaaaaaaaaaaaaaaaaaaaagaatgaaaaagaatggtttttggtcccttcagagccaggtcctcctcctctgtgttctcatagcactgtgcacataaatctatgatgtacatatggccctgtattagttaactgtttaatattaactgtcagttcctaagggcagctacctcttcattatcatttatgcagccttagaaattagcaaagtgattcatcagagtaggctttaaatagcatctttatcatagggctgttatggagattaaatgagctaatacatgtaaagtgcctaaaacagtgccttacacataataagtgctcaataaatgttagctatattatgattactattattaaatatatactattataaaataacattagtgtttaccaagtacatgaatgggtgacattgggtaagtcacttaacctttttgagaatcaatgaattaatcatctgtcgggaagggaaaatgtttaccaagtacatgaatgggtgacattgggtaagtcacttaacctttttgagaatcaatgaattaatcacgtgttgggaagggaaaacagtaagactcctctattggggtggatgtgaagagcaagagagactgtacaggtgagaagagctctctcaattctgaagtgctccagaacttacctaacttgaagttagcattttaaaaactaaatcaatacctagaaattctggcaaaattaaatcaaaattatctgacgaatacaaaggagattagttacctaaatgaaataagcaaaaataatttccatttcatactggacacttaaatacaggctttgtctctttcttgtgcaatcagtcccaacaacttgacacttttgacttgaggtaattgagatgcttacctggataaaaaacaacatcccaacagctatggttgttcctaaagctaatcccaaggcaaacaaggtggtagcaaatgcagctaatccaaatggaacaattggaagaggatctctccgggctgcactcatgtcgatcttcactgtgttccacccaaaggagagctatcgcagcaacaatagcacacgcacaaaatgtttggttatggtaactggtcagactctactgtgacacgtaaaacaacttgatcaaagagataacaacgtggccctgtggccaacgcaaacacagctatttttattttattttatttatttattatttatttatttgagacggagtctcactctgtcgcccaggctggagtgcagtggcacgatctcgactcactgcaacctccacctcccaggttcaagcaattctcctgcctcagcctcccgagtagctgggactacaggcatgtgccatcacacccggcttattttttatatttttagtagagacaggtgtcaccagattggccaggctggtcttgaactcctgaccttgtgacccacaccgcctcagcctcccaaagtgctaggattacaggcgtgagccactgagctgggccagctatttttaattaatatagtaatgagctcggaccgatgtgcaggatatcattcttagttttctcaaatgttactttttgttgttgttgtttcctcagaaagtgtcaaggagaccttaccaacattaacatacataaacaacactagacactaatctaaaccagaactatgtcttttctcttctcttgctattctacatcgcagtattcttccacagtgacaagtgctgcctaggattcagttgtttcttccctcatgttttacaaatggtgatgaagaactgataaaatgcaggccaaatatggccacagatgtgtgctgcctggcctgcataatgtttcaacattcagaattaggtgccaacatttaaaaatcaagagatttcacataaaaatccagattttcagatttttctgggctagaatttccaaacaccacaagctagcagatcaaatatgggctgtcccctccccaaaggacagactctccagtttggcagtcccatcaggtgtgtctctcgtttactttcaaggcctgtttagggaggtttgtgtcccttgaactttatctcatgactacttgcccataaatcaacttgatctcttgctggtttaatctgtttatattttatggtatgcatctgctccatgagccaccttccagggcactagaatcagaaatgaacaaagaactacaacttgccacatgaatgggatgaaagtaggaagcactagtgttgtctttttttcttctattctttccataactattaagtttgaagtctaacaaattacatatacagtactaaaatatttatcaccttcaactacagcatgtaagttttcagaacaaatactctttcctcatcttaaaatttaagttttaatgctttctaaaaaggaacccatataccagtaaaacaaagttctatttccccaactaaatcacagaaagcatatttccaaaaggaacctcttaaatgttgataactaccatttaatcttgcatggatgattttataacaaaacattttcattttcacttacccgatgataaagctgtgtgtacatagtcatcacaaaaatgaaagcagcatggatacaacccagtggtgctaaaaggagaaacagtgtgaacgaagcatgattttggtaaccacaacagttgttgatccaaggacagtgatggtccatcttcatcacacatctaacaagaaaaatttacataaaacatgaggcagaaaatcctgtctactttaaataactttggtcttcaaaagatcaagcaaataggaatccagcatgtccatgagctacgagagaattatacttcatggaacagaaagaaaaatctttatgagcttttaaacaattaagtgactccttttaaattctaaacagcacaggaaagggcaggctttctaacagcttctgaggaaaagatgtcagctacaagtatttgtttaaagaagtcaggagacccactgaaagagggtctctttataatgctcattataaagaaatgagcatggttcctggttttcttctagtttgtaagtgcagtgacccaagtgacctacaatagagactcaacaaatcccttatagacctccagtggggttaatgggctcaaatagacacatgtaacttccttcctgttctcatagtatcctttagttaatggatctctgagctaagcaagctaactccagaatataagatatggtataataaacaaagtcttgccgtgtactgttgatagaagacaatgttttggcctgaaacaaaactttatttgctttcaacggttctctaaatttcttactaatcagtgattatagctgttcattaaaaaaggtcacaggttatttcatatttttaatagtcagttttcttctaagtttttgatattaaaacatttgtgataataggcacctggattattagatgtgtataaagtgtaaatgtttgtcaataagtaatgggaaaagcagatctcccttataatttagactcagaacaattctaaagttagtccagatggcagctgactaacacaattaatcttgatatatggaaacaaacttaaggtttatacctttttcccttgttcttgtaggacaagaggcaaagtaaatctgtatttttctggaaaatcttttcacttgtaacaaggaagaattaaatctatttattatctagataatttaagtataaaatggcgattatggacacaagtattctgacaatattgtttataatatggtaaccttgcagtgaatagaagtagcactaatgtagtataagcaacaatgaaaacatcagtaattagttgatcagtcctcgctgaacagcaagaaagacaggtacctgttacactttctgcagtgatgtgaacgtggtgccttgtatgcttggcagactttacaatactggagatacatggtatcctgagaaatttccttggcagcaaaacagaaacaaaaatgcatcatcggatacttgaatataagtatgattcctacggtatgattttcttttatgggcgataggggaaggagagaatcttaacttgcatttccagtcctcttatttgagctaaaatatttttaaataagttttctggtaagagcagcatcactttcccaattacccagaagtccttttaaatttttcttccttgtgctccacctaaattcagtgtcactagttggttctacttaccccaaatcttagtggattcaggagttcagaaaaaggtagctgacaacttagcaggtattttagagtgaggagttaatcgtgagttgatagtcctactgaaatctgctccctccttgacattacccgtcaccacccctttcttgggccattttaatcacttcctaactagtttcctttactgtagtttttcttcagcacaaaccgtgtattgtcaaaataatattcctataatacacctctgactgtgtcagactctgcctgaaaacccctacaactttctatggtctacaatttctcatgtatttaagactgtcacaatctgcctttgtttcagctgtctctgccctacatgatcttttccccagtcacacagggctgtctactgtttctgaatacgtggtcccaccattctttcaacctgaaatgccctcttccccatctcctttggaaattcccactcctccctcaggtccccaactaacaatgctcaattcttctaactttaacagcacccatcacgttctactttatagtttagtgatttgcacaagtgcgtttgtttcttgcttaggttataagctctttcagagttcaaattacatcttaccctcctctgtacgcattttgaatagtacatagcacatgatatacaccagtgcttcccgaactttaatatacctaagcatcacctgggcactttattaaaataaagattctgcttcagtatgtctgaagtggagcccaagattctgcctttctgacaagccatcaggtgtggtcccttagcaggaaacatggacattcataagcataaatttcccagtagtttttaagctataaatggatttggactatacttcccaatgttatattttcagtgcaatgattttaaaactttatgatttaaaccagcagtttctaaagcgtttttctcagttctaagggatgttaatgtattacatgaaaaaaggtactacagccaaacctcactgtgtatgacatgtgatgtttcctaaacttttgaccatgaacctatcccacctccaccccacctccatcttttttttaatgcagagcaaatattcaataaaattgctttggaaaatgctattttggatcaatgtgttcaaacagatatgaaataaagtctccgagcctaaatgatcagtgattagagtaatatacttagtctctgtgaggacaaacagtaggctgtgtttggtattattggttagtagataaggcaaaaaccaaatatacgattatcattaaagttcattgtcttacagaatctttcttaccggtttccaccccagagggacaaagcccggaccgacaaacatggcattgaagtaattataaagaatcatgacagtccaatttatcaacatgatgaaattcacacttcctccagttgtatgtaagggccaataccacaacacagagtcaatcatggccatggtagaacatattgctataacaccaagggctatgatgggaccccagtgacacagtctctttaattcttgtagattttcaaacttgataaccgaacagaatgtacccattttggcaaggaagaatgccttcctactttaaaagaattatagatttcctttttctgtgcgcacatttccatgtgccacaagtccatgtgtgttctttaattgtcatgccttcaagctgtgaactgttaacgcagattacaccattttcactgtcaggcacccaaagctctttatcttaactaggagaatccagtgtcttggtctgaaacccaacctaaagaaaacaaaatgggaaagttcagttaaaacaaaacaaaacaaaacctttattgcataccatacttgttaactacaataaacacctacacaacagcatctcacaagtgcactacactttgggatgcatatcttgtcaaatgtcaaaaagaactacttttgacttatccaaaatatggtacaagtttgaatggcatgcaaactggatacacgattccaaaatagttttttttattccttctccgcttgtcaggggactgtcaccatccaacgcttagtgaatagtttgagaagacaaagaattttaggaccttagagttgatctaattcagtttccttcttcatagaacagaaattgtcttagagaggctgagtgattagaccaaggtcacaagtaacaggtgaaccagaatagaaggcaagtcaacgacctccctttatgaaattctaagctgcctcttatgaagtcttgaattaagccaagtatgagtcagacatggtctatgccatttgcctgcagtctcctccaccccgccacccaaacatcaagagaacagtcaatttggcccaaaagtaaaggagcgacagtgaaagcaaagagagcatgcaaggaaaggaagggaggagatagagcgagagtgtgtgtggtgtgtgtgaaattatgaccagaagagtatatgagaagaacctgaattagaagattcgagggaagaaagaagaggaagtgcctccaggagcgagggaaatggaaggcagggcggcgagctccggagagatttgtggaagggcatctctgcctggactggatctgaagatctggaagaggatctgagctacatggataatacagactaccacgcagcagacgctgttgacttgtgcctcagtttcccgcccgagtcatggagcagagggcttagaaataaatcctcacccaaggaagaaatatcctggtaagccaggttggtctcaacattcaggagagcctgctcccactctggtgggacaaagaccaccaaaatcgtgcttatattccctgccttgactcccacctcagtgtggtccctggtgtctgctcctcagccatcgcatatccggggcggcctgggctcacccggaacagattttttcctccttggatgactccgtcatggacacctcagcccaggacaagcagagagcaaaccctggcagcgagaggctggagtgcgggacctgctacaagccgagcacctctcggccagcgccctcgccaggactctcccgctcaggccccctgcgcagtctctgttactgtcacttccggaggttcgccgcctcaaacctccctccggaagcaagctgctgtgccttgtagcgtgtggatccggagccgattcccagaacacgaaggggggaaaaaacgcttctaatgatccctcagaacttgcatattttcatacgcttttctggggggaggcactaattggggcgcttttcctttgcgaacttacttatcttaaagtcggagcggaaaataaagcacgcacgcaacccaatttccggagaaccgagattgcgacgaacaaccaggaagcggctgggttgagagctgtccccggttctccgttctgctctcgggggcaccttccggggttcctaagccgcggggcccctcgctgcccctcgaggccctttccctgacctaggctttggcctgggctactcgttccggagccgccatgtcgtccgacttcgaaggttacgagcaggacttcgcggtgctcactgcagagatcaccagcaagattgcgagggtcccacgactcccgcctggtgagagccttgcccggctggacgagggtgctggggagagctgggagggtgcgggcggtggaacgccgcccgagtaagtgtgtctatgaggcgcgaggctggagtgggtggtgccggctgttcccaggagggatacggcttggcttggttgagggtaaggagtcaagttcgggtgtggggtgccgtgaaaagagccttcggaatctgagccatctgagttcgaatcccggctctaccttcttgtaacttgcataacctggaaacgtttcttaacgtcttaagagtcttaatgttttcatttgtaaattatagacatgtgagtattcaaagaaaatgaatgaaagtatgtagcctatggatctacaatctacagcggcgttgttgtgttagtaataatattgttataattatatgcggcaaaatagaggtaagaatcagggtgcctagattcaaatcctacctctgtcacttagaagttgtgcctcttaacccgggaggcggaggttgcagtgagccaagatctcgccattgcactccagcctaggcaacaagagtgaaactccgtctcaaataaataaataaaataaaagttgtgcctcttaaacagacttcttagtctctttcaactttccttcttagtaaatgggggaaaattgtacttctctcatggggttgttaggtagattaaatttatataacatatttaaagtcacttttggtgttgttagttgctgtattagcattagtatttttcataccccccacccccatttcttgtttctcatccttcttggggatttattgtataacccagtttcatgtaaaacttggtacaagataatttttcacacttaaaaatttcacatctcccatctggaaatgtttttgtttttgtgtttccttttgtgttttagcacatcttattttctatgctagactgtcaactatgtgaaggtgggagctgtgtctgatttccttggcgtttacttattaggggctcaggaaaataagtgaatgagcaggtgaatataaatatgatcttttgtaactatggtttgtacaatgttgattcggggactatctttctctacagattagagtagttagttacagaaaagggttttacatttttgtttagttttgttagggaaattgaaccatcatctggctgctagacttgtccctaccctagctccaggatataaagtgtagaaaggtggatgtgctcattaatctgcggattggtgggcacttcacttgcccacttgtcctggtactagcaataatttctcccggacctaagttgtcattcctctttccctttccctacttcccccaaaacttatgtgtttataagtaattttcttcccttatttctttgtttttcttcccctcacctattttctgttaatagggatatttgcttgaagccaggatctctgaacttataccccactcatctcctgaagtccccagttagttctggaggagatggatgatgtcttaaagaggtttatgagtccaagtaagggaacaagaggagagaaccaaggtagtatataccaccaagctctgctgcctcagagatttttgtgtcgaaagtggctgatggcctcatctcttcatgatacatcacctcgcctcttctcttcagttctgcttttctccactgccggagatcgtcttgatttttgttattgttggagactacttcctttgaattgagtcccagagcctcagagtatcaggacttgtggttccagttagagttttactcatttttaattgtaattgttttagcagtagaaacatttctttgggttattagtttttgtattgggaagctgttttacaaggtaacaaaatcatccttggatgcaaagttgtaaatttccaagaaaacagatcgtgttacaatttttttcttgcctttatattttaatgtgacaattcttaacacatagaaggaaactttttgaattcagtaccttaaaaataaaactgggcagagcccggtggctcatgcctataatcccaaaactttgggaggccgaggcagacggatcacctgaggtcgggagtttgagaccagcctggccaacatggagaaaccctgtctctactaaaaatacaaaactagctgggcgtggtggcacatgcctgtaactccagctgctcaggaggctgaggcaggagaatcgcttgaacctgggaggtggaggttgcgatgagctgagattgcgccattgcactccagcctgggcgacaagagcgaaactgtctcaataaataaataaattaaaaaaaaactatgtctttccttagctgtagtattatataaggcccaaacacaggagcttcattacaattgaaaggagactgcattgctggctctggaagaatgcttactgacttgtattattgaataatcataattcttttttctttatgagatggggtcttgctgtatcgcccacgttggagtgtaatggcgcaatctcagctcattgcaacctctccctcacggctcaagtctactcccacctcagcctcccgagtagctgggactactcaagccactgtgcccggctgattttttttttttgtagagatggggttttgccatgttgcccaggcttgtctcaaactcctgggctcacgcaatccacccacttgggcctcccaaagtgctgggattacaggcgtgagccaccgcacctggcctgatcataattcttaaaaacgcagtagttgccctcttaataatgacttgtgcttgcccctttttaaatctatttccaattgatgtatagaaaaagatgaaaaatatatccatgtagttatgaatttcagatgtatgtctgtagatgaacagacattaatatatataaccatggcaaaaatagtttgatgacaagtaattataatctctctctctggccatcattggcgagtgcagtgttgagctaaaagtgacccagaggaggtgaactataatttacttgagttaagaaggataaaaattggagcaaactttccagccaaagcagttaattcccccaacatagtaacttacttaaattcaagtagagtgggtagatctattgaaatgaactttactctgctgtgcatgttacaatgtattaaagtattgcttccaaagagaacagaagagtgaacatttaaaaattttattttaagaaagaaatctgattactctgtgatattttttaaacaataaagagattttgctcttaaagtgtttgaatcttaactaattttagtaattgaactgagatgggtgagttctttcttaataccctatggcactatatttgaacattgtttttttaattattatggttctgtgggaaagtaaggaaaagggatgagcagaaactatacagttagtactttattgtgaagttccttttcctctagtgatgggagtgaattcttaagtggggaatgttttcctctggtgcaaagattctgttacacgaaataggcttcctgaagaattttaaagtagtctttttgcaattagttgcttactttaccattcacagagagggaatgatctgttgtgaatcctgtcactttatggctgtcctcagaattgtaccaagaaagtattacagcaaaatgattcagattcagacatgacatcagatctgtttagaaccctagttctgctacttactagatgtgcagtcatggacaattgcttggcctttctaggcctgtctcctccatcggtagaatgggggtgagagagtaataatttcaaccttataatgtaaaaatcagtgaaataaaacatgtaacacactagcacccttcttacacagagaaaacacgtgatatactagccattaatgatattactgctgctgctgaagacaacagttggtaagattagctaggaccccgctcttcagactttgtcatgttaattgaactcttaaatcttacacttcaattcttgcttcctttctgttcctagactagaattaggtaaatttctcttgatgaacacatttgaaaggaggtaagtgattagggccttttggatatgaatttggaactgggctttgaactcaggatcccaaggggggcagtcggaggagagaagtgaaagtggtgtcggacaaggcaggtgtcctttctggaaggaaatgcctgagtctagtggattggttatgccaagccctggaggattgtctagaccatctagacttagccacgtgtagatgaaggcataaacatacttctgtgattctctcttgcctttgcaaggtggttgcagtgagataattcagaaaagttggcttttgttcatgaatattgtggtttgcttaaaatatatttggctttagagctgtaatatctacgtgtagctattgagcacctgaaatgtggctgttgctacattgtgaaatgataatattttagatatatgcaattacgtattattgaaattaaaaacattattaaaactaatttcacttgtttctcttaaaagttttttatttttgaaaactttaaaaaatactgctacaagaaaatttaaaattgcatgtgtgacttgcattatatttctgttgctctagagggttacagttgaagggatggttccagtcctgattcaggaactcactgctacaatagtttgttccttgttaggattcaggctacctcaaaatctgcttcatgagctgctgggcaaggtcccagctttttcaattgagcatacagggaagatagtctttagcagttactgatggcccagttatgtctcataaaaaatttaagcatttagggccgggcgcggtggctcacactgtaatctcagcactttgggaggccaaggcgggcagatcacgagctcaggaaatcgagaccatcctggccaacatggagaaaccccgtctctactagaaatacaaaaattagctgggtgtagtggcacgtgcctctaatcctagctactcaggaggctgaggcaggagaattacttgaaccagggagtcagaggttgcagtgagccaagattgcgccactgcactccagcctagtgacacagtgagactctgtctcaaaaaaaaaaaaaaaaattaagcttttatggggttgtattcatctttgaataatatacattcatataaacaattgtgtgtgtgtatgcatctatagatctatatatctgtatgttgtctatatattggtcaatttagtcaacctaagtaatggcttcagtcttttgtttttgttttttttttttaaataaactttttattttagaacagtctgaaatttacagaaaaatcacaaagatagtacggagaatcccatataccccatgcccagttttctctgtgattaacatcatgttaatatggtacatttgttacagctagtgagcccatattgatacattattattaactaaaggtcatactttattcagatttcgttttgttctgtttgttctttttacctaatgtcctttaactattccaggatccaatctgggacactgtaaaacatttagtactcatggatttttaggcccctcatggctatgacagtttctcaaactgtccttgtttctgatgactttacagtttagaagagtactggtcagatattttctagaaggttccctcaactgggatttgctcaatgtttttctcatgattagattggagttctgggttttggggaggaggaccacagaagtaaagcatcattttcaccacataccaagaatacatactgtcaacatgacttatcactactgatgttaacctttatcacgtggctgaggtagtgtttgccaggtttctccactgtaaagttactgtttccctcccttttccatactatttggaagaaaatcatatatgcatagcctatacttaaggagtggagagttacactctacctccttgaagccaagtaattacgtgaattatttgtaattcttttatgtaagagagatttatctattcatttatttacttattcagtcatttacatcagtatggactcatagatacctattttatcctttgtgttatattccaatactactttattttcatgttgctcaaattgttttagcgttgaccattgggagccttttttttaatttggcttctgtgtccttttggtatacccccatcattttggcttttttcttttcttttttttaaggactatattgctttctgatagtataagatactccaggatcatcttctctatttcctgtttcagtgctagaatcagccctttctctgaggaatcctgtttcctttaattaaagaagggtattagaaaccaagatctggacagtaggtgtgcacattactcccggggtgttgttgcctctggaacctctcagctgacaaagcaaggaaattcacatgtatatactaagccatgtatatgaacatatctacaagcatttgcatatgtaatcatttgtatatatagtatgttaaacacaagttcatactagtatctccagctctaatccattatcagatggatcattctgtaattgctttatttcaacactgaccattctataccatgttacacagggtagcatcagtaatatacccatttaaaaattatctgttcctctcttagtggtttgaccctacatttctaagtacatacataatttctgctgctagttttattttaacatatctacattgcacaaagacaggtacaagtaactgaattcaagtgagccttgacactttaatgagggtgttctgtgctgattaagcacttctgtaaatatcaagaattatactatgcaaagacttgtttgtacgtcagcactaagaacttctattgagtaggaaatgagaggccaagatgggaggatcacttgagcccaggagctcaagatcagcctgggcaacatagtgaagccccatctctacaaaataaaattgaatttaaaactagctgggcatagtggcacgcacctgtcatcccagctactcaggaggctgagatgggaggacaccttgaacccaggagtttgaggttacagtgagctatgatcatgccactgcactctagcctgggtgacagagcgagatcttgtctctaaatgaaaaagaaaactaattaaaaatgtattgagtaggaaagaaaagatcatacatactatgctaagacttatgtgtatgtacatcagcacttatcaagcttatagaccaaaaaaaaaaaaaaaagtgggagactgtttatatattaaatagtatattttatataatacatatagcagttacgagctcagttcaggacaacagacccaccccattagagttccaactctgctatttattagttgttgaactttcaggaaataatttagtatctctgatcttatttaatggcttgagaaagggatagtaataatacctcaaaaaggttgttttaaggattgactataacaatgttaaacacagagcaccatgtacattaatgatagcccttagttacaaaggtctgaatcctaggtacatgttgtttgaaaggggatgtcatttggggtgggcagaatgaatctcttttgggaattacatgtaaatgttgccaggttaccaaaacttcgtgttggtaggtatttccaaggtcatctagttcagttccctccccttccctcctcccctcctcccctcccctcctcccctcacctcccccctcccctcccctcccccctcccctcacctcccctcccctcctcccctcccctcccctcccctcccctcccctcctcccctcccctccccctcccctcccctcctccactcccctccgctcctccttccctccttccccccttcccccttcccccttcccccttcccttcttcccttcttccctccttccctccttcccccctttcccccttccccccttcccccttcccttcttccctccttccctccttccctccttccctccttccctccttccttcctccctccctccctccttctctccttcctttgttcctttccttcctttgttccttcccttcacttccctttccttccttccttccttctctgctccctcccttcctcccgccctccttctcaccttgctttgttctttccctccttcctttgttccttccctccttctcccctccctcccttcctcccttccttccttccttccttccttcctcatactttacccctaaatcatcacttttgagatttgccttcttaaaaacatgaggaacactataaggaccaatcaaagaatgtctcagttccatcattatttctgacagcaccatcacaaaatgaattttatgaaaagaaaatgatctaattgtgttaactccacctctattccaatttaattatttttttcgtgaagggaaatttgtcatttcaaatgggaagatttgccccagtcctcactaaaatgagctgtttttccccctcagtttctctgtgagtaataagtatgttgctgcgtgctaagactgactcatttattctgtaagcacttagtggcccctaccatgtacagctctctatgctaaatacagagtttggacacgatttgtcaagagtagtctctgccttcaaggagccggcaatgagcctgaagaggaaactgcaggccaggtgcagtggctcacacctgtaatcccagcactttgggaggccgaggcaggtggatcacttgaggtcaggagtttgagatgaccctgaccaacatggtgaaacctcattctactaatataatacaaaaattagctgtgtgtggtggcgcatgcctgtagtcctagctactcgggaggctgcagcaggagaaccacttgaacctgggaggtggaggttgccgtgagccaagattgcaccactgcactccaggctgggtgacaaagtgagagtccatctcaaaaaaaaaaaaaaaaaaaagaggaaactgtagaacctaatttttaatgaccgttgtaccccctagagccgagcatagaactctaggaattcaaaggaaatgaggtatgtctcaggacctcgcctagaaggataggtggggtttggacagacagaaacaagcaaagactatattataagaggttgcaataaatggatgcagtgggcatctgttgcacccagcagctttcattctatctactcaatttcctattgaggaactacttaaacccccttattccagtcttgatagaactgacaggctgccctgccctctgtaggtcaagaggtgaacatattacctaagcaaggacatttatagaatttttgccaggaatttgatcagaatgaaccaaggaaagagaatagttagagccgctcaagactttgctttagcagagactgtaagttcctatttccttggtatcctgagctactcctcatacttgtcttt

SEQ ID NO: 569 - DNA, 120951 bp, Homo sapiens
atataactaccattaaatgaatagatcataaaattaaatttttatttgtatgaatctacagtctacaaatcaaggccaaattgaatatgagattctagtattttttttaactttctgaaccacacaatcagctctctgaaaatcatataaaagaaccacaatatatcagtgctttaaagtaattctttcaggaagcaataatgacattttaatgctttcagaggaaatacatctgaatgaattatgctagttaattatttcctaggttctttaccttcctcctcacataatttacaagcaactcagaatctatttcttttgttaaatgaccattaacatgagtgcttagtggattagcatttctgttcatacaccatactgatctgaacgtatgttctaatggtgctggtgaaaattgtgatgctgaaatatacggcataaaaacacattttaagattttaaaatattactcttttcttaaatctggcactgttaaacaaagggacagatttgagccactttagatcaaaaggaaagtacagtctctcttcttccccacaaaattgaaatgaggcaaataaagcagcctgttaccattttcaagtctggtttaagacaagacaggtttgttatgtggatatatttcataatgctaagatttggacttctaatgatcccattgcacaagtagtaagcacacaactcaataggtagtttttcagcacttggacccttcctctctccccacttagaatatccaatgtttattgttcccatctttgtgtctatgtgtacccaatgtttagctcccttttataagtgagaacatttggtatttggtttctgtttctgcattaattctcttaggataatggcctccagctgcatccatgttgctgcaaagaacatgatttcatcatgttttacagctatgtaggattccatgatatacatgtaccacatttttaatgttaattttatttttaaatttattcttggagcctataaattggtaaattacaatagtaatagcacaaatagtagcaatacagagtattcagcaatattgtaatatttctttttactcaacagtccacctttgtgtttcactttccataaacaaatacactggattaaagcaataatacttctctcggaattctggaactgggactgaaacctagaaatgattattactctgccatgtctgaactgtatctaacatgaacatataaatgcagaagtggttggcaggcatgccccacaatgtaaactgaagagttgaggaaaccagcatgtattgagagagtaatatgtagttgcttgaagagaaacagtaatgagaaacaaagtgaaggaacttccttatttcactacagcaaatccaagccccaggaatattctttcagccctagaattccataagataactaaataccttttctaaaattctccttttgcttaagctaattcaaattgagtttctactacttgcaaccaagggagctgtaagctcatttatattgactctcagtaacacaggagtatttagtgttgaatatgaagagtctgcttttggtttcatgaaaaggattgctttctaatagtcagagctcactgtagcagacatgaacggggttctgcccagaccacctccaagagaaccttctgcaaaatagagctgactgacagaccacttgttattcctctggacctaccgggctgcttcccaactaatgactgagcacagtgagggtacttatgccaggcccttcctgcttgatgcaggacccttctgatgggcaacttttttcaagaactcctcatcaacatagctgaaaccttcttagaactgcactcagatctgagacttcctatcatcctacttccttctctccttcacaggtgtccaatttacatggctacatgaagattcttcctacccattcctgtaccctcctttttccttcacagatgtttctccctgttttatttgtttgctagggctgccataatgaaatattacagagtagggggcaattggattttttgcagttctcgagcctgaaaatctaagaccaaggcatgagcaggtttggtttctcttgatgtctctctccttctttacaaatggtcatgttcttactgtgtcctcacatggcctttcctctgtgtctgagcatgcctggtgtctctctctctttataaaatgacaccagtcatattgaattctggcccaacccatatgacctcatttaaccttacttacttccttaaaggccctatctccaaatgtagtcactttggagtttaggacttcaatatttcaacatatgaattctggggagacacaattcagtccttaacacctgtctaatctctgttggaatctgctttttgaaagtcccaaactgatgccgtgaacaaagggaaaatgagctgactttggttaatagtgagctctgcatcagtgaagatggtcacacagagcctgagagatgactgtccagtgacagtgactggtccacttgattagatttctatctaaattccacactcacagagttatttattttttatggaacattaacaattaaaagtaacctggaatctgtcagtttgatactaagataaaagactaaattagcatctttgaaaacatgatatgagaagaatcatagaagacacatttgctttctaggttagtcatctttatgaccgtatttgtacaaaggcacatagatatttgtgtcttgttcattcatctatatctatcccaaatgcccagaaagcatagtgtttggcacattttgtgtgttccacaaatagttgttggattaatggattggtcattgccttcccaacacccccacagttaccataccaataggttctcaggttctatgtgttagaaataactggaggactgtgatgattatgatgcaaatgagagatttaagatgaatgattttactgatttttctttctttgttgggtattttggaaagttccacatgggaggtagaagatacaagtcttcatgtttagttttatggcccccgaaggcatccaggtatttcttctctgggttgaacaatctgactcccaagaagtctacattattataccagaatctttctagtaattaggttcattaaggcttagtttttcttcctagaaataaaggctgacaggaaggagggaagacttaggattggatgccatgcttcatggcatccatgaagctgaaatgagctgatgagagaaaaaatagtgagtgcttaaaagctgcagatacttaggtttctaagacattcctggagaatatctatttgaaacatcagaggggagagtatagataccaggaataggagagtttcactcaaattggcttggcacagataaaaatttctttgaaagctactctttttagttgggtatacatttgtcaaaggttttcaagagcaccaagttctgacctctaagcagattctttaaaaatcagcaaactaacacaggaacagaaaaccaagcaccgcatattctcactcataagtgggagttgaacaatgagaacacatggacacagggaggggaacatcacatatcagggcctgtcgggtggtgggaggcaaggagagggatagcattaggacaaatacctaatgcatgcagggcttaaaacctagatgatgggttgatgggtgcagcaaaccatcatggcacatgcatacctatgtaacaaaccagcacattctgcacatgtatcccaaatcttaaataaaaaaaaaaaaatggtacttgcagagaaaaagaaaaaaatatttaaacttttagaataattattctacatatttcttgagttatatcaaagtcagaagaatgtttgaaattgataaaaaaaaaaaaaaaaaactcctccaaggaggtattgaacatgtatcaagggtagctacagcattatctcaatgattgattctaccaccgagtgcagtccaagcaagcttcttccttcacgtaataggatgaatataccactccctttaactcagtagtcttcataagctagtaaattgacatcctactggatttttctctcatgacatcccaggtgttgcccattgtatttctagctcaccattagtgtgccagttacagctgatgatgcttgggcttattgtatagcagtaagtttaaacgttttcgtagttccattttcagcatgaaattcatcacatgttcagaagagtcctttttactctgcacttccccaaatgcaataactgacagctccatttgttgtaaattgactgaaccccaaagaggtcaggaataaggcagagagagattagtggttgcaagctccccacaatccccactcctggcagaatgtcacaaggtcatcattcctgtaccatcctacagaggatttcttgatgaccaagaaggtcagagatgatttgggggtgtatgctgtctagcagctacttggccaacagctccccctccagggcactggaacatcatttccacagcaagtcaaggttgcatcctcaccttggataaactagctgaggaccctcttcctcctgcctcactttccatttccttgtctcttcctttgtgatttatcctctgtctctttctctttgctcatcatctctttctttctctggcttttttcattttctaaaatcattttctacttgttcctatttcctctttccagacacattcttctctctctcataatctctgaattatattttttataatctctgcctctttcttgtctttagtctggaaatctttccctctttctttccatttatatttgttctttatgtctgtctcccttttttatgtttggggtttttattgtttgtttttgagatagggtctcactctgttgtccaagctggagtgcagtggtgtgaccatagctcaatgcatgcttgtactcttgggctcaaatcatcctctctcctcagcctcccaagtaactgggactacaggcacacatgccactatgcctggctaacatttttttattttttatttttatatttgtagatatggggacttcctttgttacgcaggttggtcttgaactcctggcctcaagcaatcctcccaccttggccccccaagatttggggattacagatgtgagccactgcacctatcccctttaatatgtttggttaaacctcctctcccctaccaattttctctcctctctcttttctttttttccttccttcctccctccctccctccctcccttccttccttccttccttccttccttcctttctttcgttttttttgagacagggtctcactctgtcacccaggctggaatgcagtgatacaatcatggttcaccacatcctcaacctcacctggctcaagtgatcctcccacctcagcctcctgagtagctgggactacaggcatgggcgaccaggtatggatagctttttgggttgtttttttttattattatttttttgtagagacagggttttgccatgttgtctaggctgatctctgactcctgggctcaagccatctgctggcctcagcctcccacagtgggattacaggcgggagccactgcacctggtccctctcctctttcttatatgcttatctggtgtggcatcaatttgtcgctatctactgctatttgtttacaaaaaaagtagatatttatttttctattatttctccatctcctcttcaccctcctcatcaagtatctttctatattctttacttttctttccctcattttcaatttttatcttaccaaatctttcactgaatttgtttcctacctttcttgttttatgtcttctctttgttgtctttttctctcctcctggttttgtacacacacacacctgttcttcctccctacctccctatccttctttttcctgtctcgctttttgttttttttgtttgtttgtttgtttgtttttctttttgagacagagtctcactctgtcgcccaggctggagtgcagtggtgcgatctcggctcactgcaagctccccctcccgggttcacgccattctcctgcctcagcctcccgagtaactgggactacagacgcccaccaccacgcctggctaattttttggtatttttagtagagacggggtttcaccgtgttagccaggatggtctcaatctcctgacctcgtgatccgcccacctcggcctcccaaagtgctgggattacaggcgtgagccacctcgcccagcctcatgtcctgttttttaactcatcctttggctttatgtctgttcttatctgtgtatgtgtgtgtgtgcatcgtgtatgcacacccctcacatgtgcacagaagacaggagaggcaaggggaggagtgcatgaggttagagagctacccacagagactgaatctgtggtttgtaaccctggtttcccatgagaatcttctgatttagttgtttgcaaaggggtcaatgaatctaataagcctgggtttagatctactggtttaatgatgaaaccccttgaaagccaagattaattattttcacctcatgcaataaccaataggaaaagaaaggagagttttgaggacttcagtgaaataagatatctgtgtgagagagagaatctaaaagcattgtgggggatggtcacaaagacagtacttggatgcagggaaatgaacagaaattcatatctatctgtctttttgggcctcattaaatagcacctcattgagctttcatttagaatccatttctccttcccagaaccccctgcaaatgtttatttctgcatttcagtttttaccaaactcaggctcactttttaattacttgtccatgtgtctgctctcccctggactgagtacatcaatggcagtaccaagatatttgctccattgttttcttgggattctttctagcccacgcttttaattatctaagtgttcagagtcagtgtcagcatttgcttaattcagttaagtaatatcatacttaatcttcaaaatgttaaagtgattaatattaacaactgagatttaatatcacaaccagttatatgtagaactggagacagaattagttctatccaaccaattgttagatttgttggaattgttcattccaaccatgtaccattgactaagtgctgagataactagttagaatatggatacagtgtagtttcaaatttgggtgtgcactcttgacccagacatcctggctttttgcaacttgccttgcaatctcagctttgcaacttggctagctacatgtacgaggcagactaagactgtgcctatttttcagaacagccagttgttagtcccctgtggccatctgtacatgctgagttggctcaggaagatgctcatcttcagaagatccagtgtcagcccgagtgttcaatttggctttatttaaattaatttttttctatttattgtttgggacctccagaaaataatgccagattcttcctatgtcagttaaatattggcctgttctcccttctcttcaaatcaacttgaggaaggatttgatgtatcaagtggggacaccccaattacagaatgagattccagatttctcagtttgaaatgttagcaggaaagagaatcaatcaccagcaaattgcaggtattactttacaatttctttcccatgaaaataggattctctttgaggagggcttgttatggcaagtagattagcagaaatgagtctgtaaattcaccaaatgctattcttatccacaggtaagacaactgctacaccatggcacgtccaaagcactacagagtaatggactgcagatcaggaaataccctccaacctcgctggttttcaacttgttccaaacctccccatactcagttcccctctatttctgacactcttagcttcacaacttgaagctaagatctttttccattgtcagtttgacctcgtaatctggccttgcactgtttatattattaataatatgtacccaaaacccatgtatgctgacccaggtaactgcccccaccttcgcattctgcaaacacaaatacaagatagccagaggttatcttggacagcactagatgaacccctaagcaatgtctctgccatagaagatccagttttcaaatataagttctctgaaagctcaaagcttgctatagcgagaaactcgtgtgcaagaccaccatcaaaacaatcttcttcataaggagcaaactactgaccaaaagttttttttgttgtttgtttgtttttttgagacagtctcaccctgttgcccaggctggagtgcaatggcataattttggctcactgcaacctccacctcccgggttcaagcgattctcctgcctcagcctcccgactagctggaattacaggcacccgccaccacacccagctaatttttgtatttttagtaaagacggggtttcaccatgctggccatggtctcgaactcctgatctcagatgatctgcctgcctgggcctcccaaagtgctgggattataggcgtaagccaccacacccggccgaccaaaagttttatcacttcaatttcttaggatgaccagaaaagagctgcttcgtagctccaaggaacaggaacctgaggactaccaagggccaacttgagtattgtgacttcctattccattgggtttagcccgcagacatactacttttgactccacatgcacagagtagagtaggtgcttgataaatatttgttgctgaatgaatgaattagaaattgatcatacttgccctttgagtctctagtgaccgtgtcatctcccaaatcaatattaataccaacatgatgaaatctaaaaattatttcagatattcatcttctttattatttcagttcccaccgatgatagcaactaaaggtccagggaaatgcaaaaataaataggcaattattttgtgaaaaattttcacatgaaaaagtcctctttccagtaatcccaccagttccttaattctagaatgaaaagaaaattggaaatactttattgtattggcatatagggactgagactagaattatactttcagacaggagaaattaggtgaatagtcctgttcttacagattaaccattgctttcactgatccatcactgaccgctgcaaatggttaagttctattaccatctcacataacatgttcaaaaagtaaaaagaaaaaagaaagctttttcaaaaggtgaattctaagggactctgtaatggccctgttatttggagttttttttacttatatacaaagctgaaatggcaccaaatatccactttgccttgttctctaccaactctttaaaagtaggaatctatatttcttggcaaagttcaaaactaaacatcaatcaaagattcttagccataggtctagaccctctctctaggcatgtatgagcacatctcaaaggtagatgaaatttataaatgcgtctctggagcctctacgagcatcattgcatgtgggaaggtttctgctcctgatgtgaaaggtagaattgatccctatatctgacctgtatgtggcataatcaaatgaaaagcagggaactccgcccctttctttcacttttttttccctctctcatgtatgttttctctgtttttctttttccttgctcttttacatgaatgtaattatcaatagtcacttgctgatattcatcccccatagtacctggtggcaattgggaaacaaattatatttagcaagacaatttatggtttgtgtcaaaagatacatgttacttttgcttctcttcaccttctgagctccagtctaccacccaaccataaatattattcaaatattggagctttatctgtcttttaactgaagaactacttcgttgtatgaagagttaaatgtctattatgtaattttgttttattcaaacagttgatataataaagatattcacatgcattttaaaattatacaccgatttattataagtgatataaaatacagtgaaaagaatttattgttaaaaactgtcagtgaaacatctgatacacatctggctatgaatggtagattcaaacgtgataaaactgccacttgaaatgcatcacagtaccagcaggcacgtggcaatcttacctccttacttctttgattacaatgatacgatattcactatatccctctgtggttgtccttttgttaaaatttgttctggttttcatagttccttttgtacttcaacaatcacattttggcaacttactctggtaattaaaagttggattcaaggaaaactatgaactcccacatttgttcattctcctttccatccctgaattctgtcttttgtaatgtagaccttgtgtgacccacacagcaaaatttaaaaaatgtacccacttcagatttccccacctatccaacctaatctgatatctcatcctgacagactgcagctgccaagaagaagattcctgtgctgctctcaggaaaatatgtcccacttgttttctaattcaataaagatactggtttaaatgtgaagccacacaagagaaagatgaagccaaagctgttccccctgaggaattgttttgaaataaggcattaggaccctccattcaattcatatttaatagaccaccatctcttctgccttcatcaggaaaaaaacaaaaacataaacaaaatagtatctgcctatgattaatagtatttaattacacgcacttttgtttgagtttacttccttgctttctgaaaaaaacataggtatttagacactagttcatgatgataaaattaaaatttagttttacaaacaaaaattgaaactgtcatttgtaggaaaaaaattcaaatttaaaattgttatttttcactattcttagatagcaagagaagtaagaatttctttactgtgatttatatcacaacagaatttttttccttgacaaaggaccttttaaaaatcccaggaaaggaccacaaaataatcaaagactgcacattgtaaataaaacccttcagctgttattgaaacataagtataattacacacaaggaaaaggtattataagcagagaaaagatgccttaagaattctttgtctttttccaaactgatggacatgagtgagctctaatatcattatgtttagaaatggcttcatccagatccaactgtacaccattaatattcacttccatgcagccattataaaaggcattcactggtgtggcactgaatggaacatctgtaaaaggaaaatattagaatattagtccaagacttttagcatcttgtttgtttacagtgagagaagtcattcagacttcctgtttccaaccaaattctaatcctaaaggaaaagttaatagtgaaattctattccataaatacatgttaagtgacgccgatatacatgttactgtacttcattgaattcagcatgtcatgagttcctcagatttcataaacacaattagttccatttaaacttaaacacatttgagggagagtagaaacaagcatattcttgtgatattctatttttattatacaaataacatactattttctctttaaacttaagcaacagtttaagcattgttaaatcattttcttaactccaaattatagctacttgggaatctcttttaaatgtcatgatcaatatatctcttttattattgttggaataaaagcagatttctgtatttttccaaagaaacaatttttttgttgagcatacaataggtcatgatacaggattcactttcatgtactatttagagttcctaaaaataacaattttccttcctcttttttggcctctcctctccattaatcttaactcacaatggatattctttagcccttattcttcatcttcagtaccttatgccaaaaaaaaacctttaaattttcaacttctaacttgccaacacagtgaataaagttcctactttactatgactgtgagctcatagcatttgttaagaatccctttcaagttgggctaaacatcatagattatgccacttttccttttttgagaaaagaaattactcaaattcattcgattttgaggaaagaaattactcaaaatcattcatttctcttgggttttagtacttcacatggaattttacatgcctactttgcatgtaattaataatttacccatctcacagtttatactcttaatatctcaatatttagctcctctcaaatcttccccactctttctctcaagacattttgcctgaagttagtcctcagtgctgttgccaaaatcccgaaaccactgaaattttgataattctacttcttttaaactctttgttggtttgatttcctaaaattgcattcaactaacttgtggataaggtagtaggtagatttcaatatagaatttattcatttaaactataattttactccctaataattaggcatgctcactacttacctctatctatctatctatctatctatctatctatctatctatctatctatctatcatctatctatctgtctgtctttctatagcttttaaagcctatttacttctatttcccaaaaccccagatacaatttccatatatgggaaatcaagaccatgagcagtttaagcagtatattgaaggttatcagaggtccagacatcaaactcagaattctccccatgagaataaattgcaaatgtcatctgaaaatgcttctaaataactttctgcctctaattttccatttaaagtgaaatattggtgccaatttcatattttccaatattcagttaaagatgaatctgtttttcctccagttttccccatcttggtaaatggaatctccatccatgcaactgctcatgccagatacctaaaagtcatccttatacctgtctttcagttattaaatcctattaattttgtttctaacacatatctccgatctatttactgtccatcatcttcattgttatcaccctggtcctgcagcttcctcagtttcctcatctgtaaaatggggataataatagcacttacctcactggactattttgaaaattaaacaagtggatatatttgaagcacgttaaacagtgcccagactgtttgttttgcaatagttgatggtagttagatactacaactattgtcactgctcacgcctgtaatcccagcactttgggaggccgaggcgagcggatcgcaaggtcaggagatcaagaccatcctggttaacacggtgaaaccccctctctactaaaaatacaaaaagattagccgggtgtggtggcgggcacctgtagtcccagctactcgggaggttgaggcaggagaatggcgtgaacccaggaggcggagcttgcagtgagccgagatcgtgccactgcactccagcctgggcgacagagccagactccatctcaaaaaaaaaaaaaaaaaaaaaaaaagctggataaatgataagatgaactgaataatagatgaataaatattgggtaaattagaacaaatattgaacttataagactattgtgatgatgaaataaaataacatatcctttctggctgggatagccaaatgaagcaaaacttgatcagccttagttcaacatttttaaactaaacaaaacaaaacaaaaatatgccaataaaatgtcggtactagcccctagaaaaagaataatgaatactggattttatgttcccttctgatgcttttttactataattatatatttaaaatattatcggtttgattaaaatatactttttaaaactgaagaaaaagtaagcagatacctggaaggccacccaggtatgtggccacttttgctttcattgctttgtccaagacggcaagttgtctttgaaggtcttcatgggagatggtttctattttaagtggtgtcgacaactccagattgtttctgttgactctaaattccagatgagattgttgatcggaacatagacttagggcctgtatccgatatattacagtattttcaacagataacagaatatcctgaagagcagagcaaagattcaatataagcaaggagtaagagtaatgctgcttaagagtgacttttgagtttttgaaagtcaaaaactaaatttcaataaggaaagaaaatgtatgatagagcctctaaatttaagggaaaaatcactaattattataagactaatttataataattatgactaaaatttaaaatacacattagttttacaaactcaaagtttagctaaaatataaatgtatactggtttctgaaaattccgtaaaacaaccggaacctataggagtgtcttatatctttctgtttatgagccttcctaatttccaagtttacatatgaaaagggaaggagttgaatcactctttgttgagaaaagacttgggaaatttaaaatgctttagtaagcatatgccagcaggactaacaggtttctttgtgccacacaagcaatcctacagacttgggataaaataaatgaagaggccctgagaaagaaaaaccagggattgccaccagcacgttatagaacatttaccagaagattctacagaaagaaaatgtgttcattctgctgaacctttcaaactgccgttatgcctaaattactcaatgtgttgagtgtgatctcttcatatagcttatatggcatagaggaaagtgataaaaacataatcagaaatgtttatttaggaatccaagatacctattttaagtgaaaagactaactttgcaaatataggttacttgaggaaatctgttattgtgttgtacatgtccgtatccttaaactcattaaaagagattgtcaataaagaaaatgctccaaaatgatcaatgatatctggaataatgttatgaaatattgcatagaccttgagaaggaaatctgacatgcaaagaaagaaccacggaggcaaacactcaaaggataaattaaatatcaaagacatggcatgcgttaacctcctccactgcatgaatgtagtgtttaagataagaattccattttgtttaaaaagaaaaacaaactagcaaacaaaaaacccctgaaatccaaatgtagaaagctccttaaaggcaggagattaaaacaaaaacaaaaacaaaaaaaaactcatcaggatatttttaggttacttatggttaaccaccagaaacttcccatcctcctccctgaatcatactttaagttgcaaacagcataacttgttttactacaatagacattattcaaccacaggtctctttctaaaatctactgaaagcatccaagtcagccttggcataaacatcagcttcttgctgtaacttgttagaatgcactgtggatgacacatagacagaacgactatgctctaatagaagtctgaataatacagattttctgataaccctcatatttcctttcatctaaggctttttcgtgttcttcctcctaatttcaaataagagttgccagtaagaaaccaagtggaccagttttaactttctctcttttttcctaacttactcttgggagaaaagattaagagtgtaagaaagaacaaaacattataattaagcactgaatatctgacagtgcactgtaattagactcacttctatgttgacagtacagactaattcccacaacacataaagtattcttaataagggtggatctctatgtactcggatggctccaagcagcctgtgtgagagtctgcctaatcttaggtatagatgcagtaggtttttcattcctccctccccttacttcttcattcagaccttggaaacaagccagaaaaaaagtaacaataatagacattttttgagtccttaatgatgtgctggagattgtgccaaacactttacataagttactttatttaatcttcaaaatagtcctttgaggtaaatactgctatgtatacattttaaaaaatgaaaagaaaaacaaggcttatataggtttagagttaagttacctgtgatttttcagaggtggagtccaccaaggacacagcaaagggcactgtgttgttaccagaaaccaaggcaagcataacaccagtgcccgtggatggacgaatattcaaggtcacatttacatgccaaccctcagcactggatacattatctatttaaaataatgaaacagaagcatgatcaatgcactcctaaagtgcatcagaaggaattattattaacacagtccaggtaatattcaaaactatcttgtgtaatactatttccattccctttctcaatgatctatataacctaggcaaaacaaaacaaacttttttgtaatgcaggcaagaaacatgcaaatggagtaccatcttcccgttcttcctagaagagaattctggattgtggtgttaaggattatcatggattttcccagtttgctctttaacagtgcttccttctcccttgcacattcaccaatgctcaaatctcagagtggtcatatttccaagcacacgtttgaaaattcaacaaatttactgtaataatttagggaaaatctgggtacagttgccatcatcactccaaaggataaatatgatctatatacataggagagttggatagttcgatactagagaaatacactgacatcagcagttagttttgaaatcagaataggaacccttgttttgtgaatctcttgtcataatccttcacattctctttcttaattactaggttaattgtctatcccactaacatgcaagctctaggaggtatatatctctatcattgctttgttttccccagcactcactcaatagatatttgttgaattaatatgtttccagaatagttggattactaaaaatattagttcataatctgaatgaagtcttcctcatttaatatgatgtaacatacagcaaagcccaaataccacacggagcccttgaaagggtaaatgtgaataaggaaaatcattttcctttgacaagatgttcttccacttagccacatataatgtcactgtttttcattataatcctgtaactcccatccagaagaaaaaaaatatatagaccgggtacggtggcacatgcctgtaatcctagcactttggaattgcctgagctcaggagttcgagaccagcctgggcaacatggtgaaacatctctactgaaaaaaaaatacaaaaaattagccgagcatggtggtgtatacctgtagtcccagctacaactcgggaggcttgattcaggagaatcgcttgaactcaggaggcagaggttgcagtgagctgagatcacgccactgcactccagcctgggaaaaagagtgagactctgtctccaaaaaaaaaagaatgtttatatgtaatcattgtgaaataagtaatttttaattgatatatcataattgcacatattttggggtacatatgtcatttgataaatgcatacaatgtgtaatgctcaaatcagggtaattggaatttctatcacctaaacatttatcttgaaataagtaaatttaacacagaatattaaactcaaactaaaatgaacacacgaatgtatagaagttaaaatgtaacattaaatattaattacaaagtagatcacttacaaattatccatgaaatgattaattacttattaaagtaatttttttagatacaatataactcttattttcattaccttttcaggatttttttcctttggccaaatcaccatggatttagttttatcctaatttaatcctcaccccatttataactttaaaaaaatctttcataggcagaacagaactaggcattgtatcaatttgtgttagaaaaagggaaatcatttttgtaaaatttgtccttaaaaatacagtaaaaaaggctgggcacagtggctcatgcctgtaacaccagcactgggaggctgaggcaggagtatcacttgagttaaggaatttgaaaactgacctgggcaacacgggaagaccctgtctctgcaaaacataaaaattagcaaggcatggtggcatgtggctgtagtcctagctacttgggaggctgaggcaggaggattgcttgagcccagaaggtctaggttacagtgagccatgattgcaccactgcactccagcctggatgacagagagagaccctgtctcaaaaacaaacaaacaaatgtagtaaatatagactacgaaagatgggagggtgggaggagggtaggggttgaaaaattaccaattgggtatcatgttcactatttgggtgatgtgtacaccaaaagcccagatttcaccactacacaatatatcacaatatatgcatgtaagaaatctgcacttgtacctcctaattacataaaaatttaaaaatgtattttaatgtagtaagcactttttttttttttttttttgtgagacatgctcacactctgtcatccaggctggagtgcagtgataagatcctggctctctgctgtgtcaacatattgggctcaagccatcctcacacctcagcctcctgagtagctgggactacaggtgcatgccatcaggcttggctaatttttgtattttttgtgaagatagggtttcaccatgttgccaaggctggtcttgaactcttgggctctagctctttgggatctgcccgcctcagcctcctaaagtgctgggattataagtgtgagccaccttacctcgccctttttaggttacaaataaacacaattaaaatgtaatttttttcttaaagcagagatatcacattagtgttaacaatttataatgcaaagtgttagtagctcaaataatgaactactaaaaaagaaaaagacaaagaattcaataaaataattagaatttataaatagctaataaacatatgggaggatattcaagttcagtagaaattagagaaataatattaatattcaaacctacaaaatttaatttttgaactatcagattggaaaaaaactaaagcatacactttctcattctgttggtagaaatattaattgataaaagatttttggaaaagaatgtaattgaacctctaataattatatatttgcataacctttgatagagataacctaattctaaaattttcttccatagaattaatcacataaaggtagaaggatgtatgatttaggatgttcacagaagtattacttctaaggttaaaaacctagggtcagtatggcaagattccctgctccacttaggctgtagaaaagtggaaagggcaccactcccacccttacaacaacaaaagccaaattatctgcataatcatgacttttcttgaaactatcaaagagctgaggtcgcagagcaacaaactaaccagaaacctaaagaaagacaggtgtttccaaggaaagccagaatgagaacactttctaatccagggcagacaggaaatgccatgcaatttggtaaaaataatttaggtaaagatttaaacaaattgctgaactccatgtaggggctgacgtaagagtttagaagccctagaaattacagacacaaagacaattcatgctcattcacaggctcttctccacagaccttaccatgcactcaagagaaaacagagtgcagggaaggagatccgaaaaagcctctctcttaatatggtcctgaaagcagcaccagctacagggaagccacaaagccccatctagatccttctcggtctcctctacacaacacaagttttcaagccaggagaaaggcagcaaaccttgtcattaggacacatatgaagactcattgcaactacagattaggaagaacaaacaaaaaaagctatctatcatgcagaaggagcaagaaaacatattgagtcctgatcactagacatctcccctactgatgagagtcagggaagaggaacagtgaaaattccacactcctgagacccagggatacaacacctgcctaagactgaatttgtacgacaacaacatagaatgcttccccaacctccgcatcttctctgccatgttagcaaatgtcaggtaacaagagcactctgctaggggtgggcaagacacttgagagacacaagtgggagagacattttcttgaggcgtattatggagggaatacataaaactgagctgctatgatgaaaaactctctaggccaggcacggtggctcaagcctgtaatcccagcacttagagaggctaaggcaagcagatcacctgaagtcaggagtttgaaaccagcctggccaacatggcaaaacctcgtcaaaaatacaaaaattagcagggcatggtggcgcacccttgtaattccagctactcaggaggctgaggcatgagaatcacttgaacctgcaaggtggaggttgcggtgagccgagattgtggcactgagctccagcctgggtgacagagtgagactcagtctcaaaaaaaaagaaaaaaagaaagaaaagaaaaagaaaaactagctaccaaaccattcccttattctaagcagaaggtagtattttgaaaatctgaggctgggtgcggtggctcacacctgtaatcccagcactttgggaggccaagggggtggatcatgagatcagcagttcaaaaccagcctggccaaaaacacaaaaatacaaaaattagccgggcgtggtggcgggcgcctgtagttctagctactcaggaggctgaggcagaagaatcacttgaatccaggtggcagaggttgcagtgagccaagattgcatcactgcaccccagcctgggtgacaaagtgagactccatctcaaaaacaaaacaaaacaaaataaaagatctgaaacctgtggtgcattaagggtaatcctggcaccaacaaaacttaagaagctcaacttttcactagattgattcaatcccattactaagagcctagcaaaagaaatgtgctcatttccagacacaaatattctttatctcagtctctactgttatacgtaagatgcccaaatctaaaccaaaaattacatggtacacaaagatgcaagaaaaacaacacttggtcaagggacaaagcaaacaaaatgacgagactcagatatgacacagttggaactacgagacagggaatttaaaataattatgatgaatacattgaaaactcagtacataaactagacaagtgtgaacagatagggaatttcaacagggaggtagaaattttaagaaagcatcaaatagaaatgctagaaatgaagatgaatctttctgatgcattcattgatagactccatacaagtgagaaatcagtgaactttaaaataggtcaattgaatttacccataaggaatcaggctatgtactgataaacctgaaataacaacacaagcacattcaaatgcctttatatttttcccaatacactgaaaaatttttgtaaaaggtatataatagtatgaataagcataagactagagtgggcacacagtagatactcaataatgtttcacaaataaattattactgtttgttaatgaataaatttactcattaatgagaaaatagagataaatggaaaatcacttactataatctatgtgaaattgagcaattccagaaccaggatagtaggagcccttctccacagtaaccaggcaatgcttattttgtttttcttgaataatttcctttattccagaagctccttgcttcatcaaattccagcttcgtatacatccatctagacgagggttaatctaacaaattaaaatacaagtcaaggagtgcattttaaacttaaacagtggctcgattatgagtataggttttcattaagagaaaaaaaatcctttctttgataatagttgaaaatattttgaattttatttaagtttttcttttcaaagtattcttcagatggacagtctttttcagtacaagcaagctcatactatcacaagccctcagtgggatcttaatggtttttaacacttcaagccccacctgcctctcctacatcatccagtggtaacttttctgctttcaagttctatatttgcttctagctgtggccctgggctctaagttgtcttgtttatcttctttgtttgtttgattgagatggagtcttgctggagtgcagtggcaggatcttggctcactgcaacctctgcctccctggttcaagcgattctcctgcctcagcctcctgagtagctgggattacaggtgcccaccaccacgcctggctaatttttgtacttttagtagagatggggttttgctacattggccaggctggtcttgaactcctgacctcaggtgatccacccgcctcggcctcccaaattgctgggattacaggtgtgaaccaccacgcctggccttgtttttctttagtggcatttataatatgggtttgtcttgccaatcagactctaagtctcttcagacacaaaagtgtttgcattctttagcctccatcaagtatcctgccaggctcaagacatgtaataaccgtttcataaatgattgatactttttgaataatttattttacttttaaagtgtattaatttctcagtttcaaacaacaggtatactcatgtcaacatgggttaattaattcaagcttaatatcatataatggaaatcttttaaaagttaaagtaactacgaatttccagagaatgaaagacggatgtaagatagtaaatatttaacaataaatttcaccttatgtgctattctttagctcttgcatttaagtcctaaaaatagacttgagaaagtcctttgactggcttttacaaaatggtgtaattttggacttaaatatatgaatttatatgtttaacaactgagtatggattatcatgatgttaacactgaacattacattactaatgttaacattagtgttaacattctcaagtgttaacttgagaattttagaaatccacttcatgatttatgctggggatttaaatgggcacaaaaccactacgtcatttttttatttcattaatataatttcaagggttactaatgttatttttccatgatcatttcaagttgtcacacttagtatgcttaacaaaacaacttctattgattctcagaaacacacatattcaaatctattacagacaaaaggaactcatccatgatgaatgatacaagcttggatcattaccggtttaatgagttcactttccactttccgagggaatcctgcaaagtatactttggtttccagcaatccattttccggcttaaaaaggggtccaggtttatttatatccatcacagcttctttagctattttaatgctaatactatgttctaattcttccacagacacctacaattaaaaagaaaaattaccaaataaccaagtattactacatgtcatttgaaatactgggatctaaaacttatgttattattccaataaaatacttctgtaaagtaatcattttaatgtaattattaatttgttacaactcatttggaatgtcaaattatgataaatgtgataaaaaggcatttagggtggcagcacgatcaaaaattaaaagcataccatattttaaagttaaaaaaaatactattctgttaagcttaaacatccagttatatatctttcaattccaggctgctagaaaattaacaattaagtgagccattctatcttaggaaaaatttaagtggccttattttgcaattgtctgataatacgcacatggaatcaatagtgtaaataagttctttttttttttttttttttgagacggagtctcgctctgtcgcccaggccagactgcggactgcagtggcgcaatctcggctcactgcaagctccgcttcccgggttcacgccattctcctgcctcagcctcccgagtagctgggactacaggcgcccgccactgcgcccggctaattttttgtatttttagtagagacggggtttcaccttgttagccaggatggtctcgatctcctgacctcatgatccacccgccttggcctcccaaagtgctgggattacaggcgtgagccaccgcgcccggcccataagttcttaatataaagtaagaaaaatcaatatgttcactattctgttaattgcacacaaattattttttctttaaaattcaaaagtgattgaggcaataagaaaaaaatacataaaattaaattggagttttccaattttgagagttgtttgggtttttaaaaaaggtttcaagtaagggtaaacaacaataaaaattccttctacaaaggcaatttgaagaaccactgctgcaatcacttcaagtaaaactatagcactcaaagagcaaactcttcactcactaaccaataatataagccaaacaataagcatattaaaacaccatgataggaagggaaaaactatcctccaacataaaataaatttagttacacaaatttaaagttggtcaacactccttctttaatatagccaattagcagcatgtgaacaactattctctcctttacagactttcttaacttagcctacaacacttgaccctgattgcttctctttctacactctaaccactacttctcagtctcctttgctggatcctcccctccccacagctcaggccccagacctttttcctgtagccatgcaagtattttaagtgagacactatgactccactccagggcatttggaaaatttggaggtgaggaacacttttatttgtcacaatgagtaggggccatgctggcactgcaagatgatagacaatctgcattatgtacataggctagtcatgcagaattaataataataagtaatgcagaactaataataaaatatcaagtattcttaaaatcttttgaacatcactgctaggtattcatgtagggaatattcatgcttacaatcatctgagtttgtgcatacatagacacaaaatatttgctgcactattttagcattcattacatttttcaagaatgtaataatcttgacaactaaggatagattgatatttgttttgttcatatctttaccaggaacttcccaccactttggaaaattaatattaccaatggcaacaccatgtatgcccttaatggtacttgagttgctaatttaacaccccagcattagtcttcatttgtagcttttactttatgcatagaagcaagctttgacaagtgttatagttatagttgactacgtatatattgaaatacatattattttcttataaattactttccttttatttatccatattaatataataatgacagaattattttggttttgattgggtatatgtgaaggtagtttatattactgatacatttcattatagaatagtaaaggagcattatatattttcagacattggatgagatagtgtttggaaccactggtcaacacaaacagtttcatggccttaaaacccctctttatgctgagtattcaaaaattttaattgaaggcttaacttcaaaaatatatccagaatctgaccacttcttaccactcttaccatcagcacaccagtcaaactgtcatcttctctccgctgggttattccaacagtctcctaactccatatccccatatcctgttatacactcattctccacttctggtttccacaaagccattagcttctgattgggattatcttttaaaatgcaaactagatcatgtcccttctcaaaaccatccagggcctttcaatttagcataaaatccacatcctcatcatggcctccaaggccctagatgatcttattctagaccacgtttctaacctcattttctaactactctcccctgctgctacactactctgtgttattcctcaaataccaaacacatcctattccaagaaattctgtacttgctgtttacatggtacagaatctttttatattccctcatttatttctcatgacatgtgctctcaagtctcagctcagatctaatctcatcagagatgcctttcctgattctatatgcatactaaccaccattactctctatgtctttgtctggcttttctttttccttataacatgaataactatctggcatatttattttttcatgcatttgttgtttgcgtctcaccattagaacgcaagctccataagagcactgacttttttttatttgctgttgtatctttaccacctagaataaggattagcacatagaagtgccaataaatattttgctgaatgaattatgatacatttacaattaaaattcctattaatattagactcataatcaaagataagatgtaatcatttataaattcaccacgtttgcccaagtgtgctttgtttgtacctctaatgtaatgtatttcatgttacattatattatttcccaaagaagcatcagctacttatctgtgaggtactaagctctagagcaaggaaaatctcttgctattgttgcgggaagtcagggaccccgaatggagggactggatggagccacagcagaggaacataaattgtgaagatttcatggacatttattagttttcaaataatactcataatttcttacacctgtcttactttaatctcttaatcctgttatcttcataagctgaggatctacatcacctcaggatcacaactgtgttaactgtacaaattgattgtaaaacatgtgtgtttaacaatatgaaatcagtgcaccttgaaaaagaacagaataacagcgattttagggaacaagggaagacaaccataaggtctgactgcgtgcagggtcgggcaaaatagagccatatttttcttcttgcagagagcctacaaacggacctgcaagtagggaagatattgctaaattcttttcctagcaaagaatattaataattaataccctggggaaggaatgcattcctgggaggaggtctataaatggccgctctggcagtgtctgtcttatgcagttgggataaggactgaaatacgcccgggtctcctgcagtaccctcaggcttattagggtggggaaaaaaccccaccctggtaaatttgaggtcagaccagttctctgctctcaaaacctgttttctgttgtttaagatgtttatcaagacaatacgtgcaccgctgaacatagacccttatcaataattctgcttttgccctttggcttgtggtctttgttggactctttatcagtagtttctgattttgcccttgtcctgtttcctcagaagcatgtgatctttggtctcctttttgcactttgaagcatgtgatctttgtgacctactccctgttcttacaccctctccccttttgaaatccttaataaaaacttgctggttttgtggctcaggtgggcatcacagtcctatcgatatgtgatgtcacccctggaggcccagctgtaaaatttctctctttgtactctttctctttatttctcagccagccgacacttatggaaaatagaaagaccctacaatgaaatattgggggcaggtttccccgatatgctatagttctaatgccttgaactcaggaacttagcatcaaaagcactcactaaaagcttactgaataaatgagtgcatgtctgcataaatgaaggaccaaaataatttagtgatgacctcacatgacttctcaatacaaacttcttgtctgggtgcagtggctcacacctgtaatccctgcactttgggaggctgaggagaattgatcacctgaggtctgaagttcaggaccagcctggccaacatggtgaaacctgtctctactaaaaatacaaaaactacctgggcatggtgtcaggcactgatagtcccagctactcgagaggctgagacaagagaatcacctgaacccaggaggtagaagttgcagtgagcagagatcactgcactccagcctgggtgacagagcaagactccgtctcaaaataatagtaataatagtgatgataaataaataaataacataaataaataaattgagatcagcacaaacttcttgccagctcctctaggcataaaagatgtctcttttgtgcaccacattctaaggtgaagccaatcttctctcagctatcctctgctgatggcagcaatgactctatacttcagaaaagacttctccccactatcaactagcagtaatcccttcagaaaagtcccactttaatccagttgattaaagtgctattcttgatcattagattaaaggctatatgtaggattaaattaaaatgctaatttcttttctttctttctttctttttatttttgagacagtcttgctttgtcacccaggctggagtgcagtggcgtgatctcggctcactgcaacctccgcctcctgggtttaaatgattctcctgctgggattgcaggcgtgcgccaccaagcctgactaatttttgtatttttaatagagatggggtttcgccatgttggtcaggctgctctcgaactcctgatctcaggtgatccacctgccttggcctcctaaagagctgggattacaggcatgagccactgcgcccagcctaaaatgctgatttctaagcacactggtacctgctaatgtatatcatttgcacaaaaactgacaactaggtccggtacaatggctcatgcctgtaatcccagcactttgggaagccaaagtgggaggaggattccttgagttcaagaccagcctgggcaacatagcaagaccctgtgtctatttttttttaaggattacttatctatctgcttatatttgaatttgaattacctttttagacttgttactatgtttatttctccttactttaaaaaatattgttggcaattgaggagttttccttgatcagtgttgtctttgcataaattgttatgccagccgggtgtggttgctcactcttgtaatcccagcactttgggaggccgaagtgggtgaatagcttgagcccaggagtttgagaccagccttgccaacatggtgaaaacctgtctctactaaaattacaaaaattagccaggtatgctgttgcacacctgtaatcccagctactcaggagggtgaggcacaagaatctcttgaacctagtaggtggaggttgcagtgaggcaagaccatgccacggcactccagcctgggcagacagagtgagactgtctcaaaaaaaaaaaatatgctagccgcggtggctcacatctgtaatcccaggactttgggaggccaaggcaagtggatcacctgaggtctggagttcgagaccagctggaccaacacggagaaaccccgtctctactaaaaacacaaaattagccgggcatggtggcgcatgcctgtaatcccagctactcgagaggccaaaacaggagaatcacttgaacctgggaggtggaggttgcagtgagctgagatcacgccactgcactccagcctgggcaacaagagcaaaactctgtctcaaaaaaaaaaaaaaatgttaggcctcctaatagtccctaacaccactgttcaccaaacagcaactaaaaaaggtaaaaagttaaagacagagtagttcaagcaaataactaaaaacaatgattctaatatattaagtgagaatattatttctcaggatgcttcagggatttacagtatgtagaatatacctcatatagcatcagataactccaaatccattttggtttggtatcactataaaaataaattatgattttatacagactgcatcaaagtgggaagatattgatgaaatctgcaaacgtaccatattccatagaccattattaataacatcacctccagttgtgattttggatgtatgttcattcttaagctgaacttcaatctttccaccacgaagtgcaatcaggagccacgctgagtgatcgatagattctgcgtacagtatcacgccttctgaatcatatgtccggaaatcaaattctgctgaaaatctaaacaatggacaaagagagatccttaagagtaagaaatacagaaagctcaatgcattattctttttttcttgtactgacaaacagtaacacagacaaagagtcaattatttatttctttttctggaattaataaaagagaagggcagaattagactgctcatgtattatctctggttccatgtacgtttaaaattaagttattatattttcttgcttattcttggaatcttttccccagggaacagatgctttggtaatttgtcatctttctttgacatatattttgatagcaccttccaaatgctgaaattaatacacaggtataagtatcaggcatactatatctctcctggagccttttatacactatataatctgacattaagaagtggtagttttttttgttgttgttcttttttgtttgtttttgtttttgctgtatccataagtgatcataaaatgtgttacaatttcatcgttggtttattcatcaaaaggcatattttccctataatttcacatgtcaggaatcactcgtggagatctacaagatggcacatggatgactgcagacatcattaagccttcatgtgtggtaagaaaggtaaaatttaaaaacttaaaatatatctattagctttcctaaaactccagttgcataagtcactgttgtagaatacacagaaggaaaacttaaaagacatagtctacccatgtgtttggggggtatctgagtgctggcaacatctgttgctattaagactctagacatatatgtagctattacaggggagaaaagtcttaggatgcaggacttaaaataacatgtgttgattcagtatccttaaaacacttcaatgagaatcagcattgaagtttccaagggactagcaaatccacatgattgacgaaagacaaacagggaaaaggaacaataggtgtataactattagtcacctaacttaaaataaaggcaatttaagttaaagagtctggacttcagataattgctatattaggcaggacagaatcccacactcttaccgcaatatagtaaaatagtaatagtaatagaggcaccatttgcaatggggcacgtatctccctcaaatggaacaaagaaaaggtgacaaaatgaatgttttcatctttagaattccaaagaaatatttaaaaagaggtaaaatgtggagtaaagtatgttggatggataacaatgtagtaggaatttactgaactcagattatgaaaaaaagaacaattttgcttggaataaggacttctatgctctttcataattatctgagcattttgctgatgtgaagcaatattatcttgccaaaatccaaatctgtgtatgctcaggatcttccagcagttgattctattatggagataatttccttttctttgtaaaatcaggctgaaatcatagtttcaaagggtcatgttctgcatattttgtttctggaatatatcagcagcatattgattcattacaatggggaacaattcattctttttcacaagcatggtaaacaggaaaatagaatgaatttgttgacatttacggagggaaagtatttgatcatgagcaacagacgtcaagaaatttgcaaaaataaataaaagcactagctattctttgtgttgatcacacaaggggcagtttataaaaattcatcaagctatacatttaatctaatgtgtacatatcggtacatactttatatttcaatgaaaagtttaaaataaataaataataaattctggaaaaaataatttgtccaattctgatcccatgttagagatcaaactactatgaatcgtcagtgagaaatgaacaaactcctggagattggctccaggacctctggatggtatcaatatccacagatgctcaagtcccttatatagaatggcatagtatttgcatataacctatgcacatcctctcacgtactttaagtcgtctctacattatgtataatactcaatacaatgcaaatgtatgtaaatagttgtcatactgtattgtgtctcatttgtattattttgtattgtattgtcattgtgtttttttctgaatattatctacccgaggttggttaaatccacagatgaggaactcaaggatttggaggatcaattgtattcctaaaagtgttatttactagaactaatatttttctctcattattattctcatagcagggaagagttttctccaatctctatcattagaagatattagttgctctgtgatgttaaaggaaaaaaccacatattggcagaaataaagtgtggaaggagcactgttacttaagtatttatgtaagttattgatcttagaataattttcaatgtttttaataacgtctatgaatttagttgaattatttaatgaataatcattcatgtatctaacatcaagttctaaacatacatgcttatttaattaaaatattttaaaatttgaactgtataatctgtctcaagtattttgccttctcattattccaaaaaaaatccaatttctttcttctacttccagcaatgtatgcttctgagaaaatctgataactgaagtacaattatggcagatcacctgaggtgatcacctgaggtcaggagtttgagacaaccctgggcaacgtggtaaaactctgtctctactaaaaatacaaaaattagctgggtgtggcagctcacacctgtagtcctagctactcagaaggctgaagcaggagaattgcttgacctgggaggcgaaggttgcagtgagccgagattgcgccactgcactccagcctggggaacaaagcaagactctgtctcaaaaataaataaatataataaaataaaaattggatcataaacattgctataaaaataagtggaatcatgactaaaaaacataagcatttacttcatttctgaactcaatctaagtacgataataatggataaagtatttagacagccaactaaaattatgtaatatatgtctttaaaatgccacttaagcaagtttaaattttttccttaataattttgaatataatgatattctaaaagcaatactgagtattttttattacctggttttcataacatgtgtaaagaataatggaaatttcacaagtacattaaatctactttcccagcttcttagtaaatatgcattttctacaaaaggaataatatggaataatgtaaaatgttcattggggaaagtcagcctagaatgactcaaaaaggttttaggatgaaaattacatgtgtgaaggagtaaattaactttaggtttccccaagtcatctgattggtaatatgactacattatctgataggtaatacaatttcacacacttcaaaccttttcggccacttttcttctgcccttatctgcttaacctctagaaattatcattggtattggttcctcacctgctgatttctggcaaacgaaattttaaatataaaacaacccctgcaaactgctccgccaagtaaagtaattcatactttgtgtcaaggttcaagggaaggcacactgaaacaacctggaataaaagaaaccaaataaacaacaagaaaatcaaaatgcacaggttattgcttaatgtttgtgtgaggtcatgcatttttgtttggttactaatgtatcatctgtaatacactaaaataattaagaatatttttggtaataataaatacatatcttccatttccttgtatagtctatctatcagtataacctccaagaatacatgtgttttaaagcctcgttcaatgtgcatggctttcgatctttgtctttaatacttcctttgcaaattttcgtcctaaacacaaactctttcttcaagaaccaatatatatttctttaattaacagtcaggtatattatctcccatgaattatgtctgaaaattatttttatttgaagtcagaaataggtgtaagaattaatgtaccaataaacagcacctcattcattcactcattcatttattaagcaaaagttttctgagcaagaatgtgctatctagatagtaaagggaatactggaaaacatgaaggaaataaatataaattcagatctcatagtctccaaggaatttacaagaacattatttaaagtcatcacatatggtatcaagtattttttttctacgagtgaaaacaaacattaaaatgaaaagcttttaacatacaaattattgaacacatatgaggatattttgaggagaattacgtacatagcactatattaaatataggcccagaaataacattttatttccccttaaaactttaataaatctatttcaaggcagacggtgatatgtaactacaccaaatacagaaataataaaggactaaattacaaaatagatgttcacacagcatggcatttcaattaagtagtaacgtaccaaaattacaacaaatgccaactagcttattaccaagtaggttgcatattattgaatgtgacatttttctggacatatacagctttgttttggcaacagctatagaggtatgtatgtatacttagttaaatcattatttaggcattttttatggtctgcctcataataatatataattttaccttcacttgtcaaaaaaagatgcaggaaaaaaagagctcagatggtgacatttatttcaatgaagtaaaaatgagcacctacccccaatattcaattcctgggtcaattatgcattaaatctaagtaattaaaagcaagtttgagagacacagattaagaaatcaacctctctgaattatgatatacttaaaccccactaaatcctagaaatggttaaaagggtacattaaaactgcacttgtaccctctgaaattttatgagcactttataaaccctataacgcctaaggcatgatcaaactagtcagagtggaatccagaaaagtagacactggaaaatgttttcactgaagtttctatgagagattttttttcacaatgagggctattaaactcagcttttcttgatttcttaagtaaacatacaagttgtattttataaatgtacagactacagataagtactctctaaactgtgactctaccctcttttttttaaacccagccactaattatccccaatgtttatgacttacatgaccataattagtaaataatcatgactcataacctgcttaaagctacagcaattattgcagaacgtctgtattttcctgacttagctatgtgaaaataagtatctaggatctctcattttagaaaacaggtgagaagttaagcattgtaaaatgtttacctcacaactcttctgatcttgggcaagtttgaatcctttcttcccatcacaatagcaagtgtaacctccagggtaattgacacaaagctgagcacacatgttctcagagcattcatctatatctgaggtaaaaaaaacacacgcacacaaactttaatatcccctaaatgttcaatcttataggcagaggaatattatgattgtagtatgatataatcaatgataatcgaaccttagggaaagaaatactatgacatcaaactacatttaaacataatactgaacatggaaatttaaacgagttacaagtatagtttttatttacatatttgaaacaaaaattaatttataactttcagtgattaagtaaagtataacaattctaccaaatttctcattttgaatttgaagaaaaaaaagattgagaatctcaacttaactgtcatttctgatcatttgaatttcattgagattacctcacaattcattgctttgaaaaaaagaaaaaagaaatgagaagggaaagaggaagggagagcatgatggggaagtaaaggaaaggaaagttagggaagggaagggaagaaaagacccctttaactgaaggttgatacaatcaggaattaaatgacaatatcaagaacattggaacactcataatgcgataattaatgttggcagtgaatttagggaaatatctgtttttttttttttaaaaaacctcactgtgatgtaatctcccatattatgaaatcttctatatggtccctgtccctactccatattttgagaaaatcattcttggaaatttataatattatgttgaagcaaacatctatctcagagttatataagatcattgacattttcattggatatgccctatgacctttaaaactccacaagctcataaatgctattattgaatatgttctcataaaataatttaaaatagattcccaaaattaataatccttagtattaaaattgcatattattaaagttatagataagagtcatatataaatctttttaaaaaatatgtcattcattaaataaaactacaatacaagtgatgaagttggctaatgataattccgcagacatctagagttttccacggtaatttctatctgcaatggtgagaaaggagaaatgtgttgcgggggctggcaggggaatatttttggtgattgcaaaaggagatgataggacatcaaaatctcaaaagcagcatacgtagttaaaaaatatattgtaaaattattattgatttaggcaacttcatagagacagaaaacaagattagaggttaccgccatcaaggtaactaataaaagaaaactcactgcttaatggttactgcttaagagtttctgttggggctgatgaaaaagttttggaaatagcagtgatggctgcataatggcatgaatgtaattaatgccactgaactgtacatttaaaaatggttaaaagagtacattaaaactgtacttgtagcccctaaatctattttttaaaaggtacattatacatgtgtgtgaatatacatacatacatatatatatacagatacaatagaaaaattagtgttgattagttccagccatggcagtaaatctgttttaaaattttaaaaaatcgaaaggaaggtatgagataatctgtatatcataataaacaaacctacaaacaaacaactataatatgttgaagcttcctgatgcacacagggcagcgccactgcagtcacatgaagtaacagcacctttaaggggttgccccaaacccacaggctctgacattaccgatcagtatttcttaaatttctagagtattgttatcatttctttatcatgagataatagaactgtgtcattttttattttagaataaatgatttatttatatatgcacagaaaaatcactgaaaagcttggaataaaaactaaagttttaaccatgctcattgtctcaataagatgatttttaagcttgtgtctttcttttctatctactgtttttccttccaaagtgaaattctctttatctttgaatatgatataaatgatgtgaaaatatgtttatcttgtttttaccacacatggaggtctccaattcataggtagctcaaagggccaactggcgtgcctaacaccaaacttaaagaccatatgccttacatactcttgctctggaaggaaggaagccaatgattacccaattgaacaagctatattagggataagaaaatatgactgttgatgtcaaacaaagccaatgcttttaaatatcagttcagggttcacacccaccctctccaccatcagtaatgataccaccatcatcctaccttcacaagactttgatttgagattatatctgtagccttcggggcattcacattcaaaatctcctgggatgttcttgcacacagctgtgccacaaatgcttggcttcaaagagcattcatccacatctataaataaaatcactatattaaaaaacatttttcccataccagcagacactaccaaagaacccttgatttgtgtttcctggatcttgtttaatatatgtaatgagataacagattggcctttggaccaaaaaacattaaatctatcatcatatgttagctcactaaatatgatttctttctacaaatgcagagggaaatttgattgatgtttgccatgttcctttctagttatgttaagaaggagaaagctttagaaattttcttatctgccaggttgtggtgcgaaaataaatggaggtcttgaaaacagattcactccatattatcacaagtattttttgtacatgggaaggctcatctcttctatcttgtttctttggaaatgaacaaacatctaattagtacactactattgttgtctaaagtagacaatagtgattcaaatttaaaataagattaaggtctctaagtacttataaatctgcagttaatccaatatgaatttagtgctaaatgaatattccagaaatttcagatgcatatattatattgccaaatgaagaaggagataacatattgttagcaattagttactagatgagcacctgtgaagaaaacaaaacatgtgacagaaatagttcaatggagacggaattattagtgaactattctgtgtactctctggagaaagacaaattcagaacagaaaatatgttttctattctaaaagttgacagctttttttccagattaatagtcaaaatttaggatattatttaaaataacttgcacaaaaataataaaaccagttcccttgtaggaatttttctatattttgactgtatcattgtcaatgtcttgagtgtgaaattgtactatcattttgtaaactcttaccactaagggaaaatggggtaaagggtatatagcatctctctgtattacttcttacaacttcatgtgaatctttaattaattcaaagtaaaatatccgatttttaaaaagagctaaaaactctatgtttttgaaataaagtaagcctgagcaacagtgggacactgtctctacaaagttttttttcttaatttagccaggagtggccgggcacagcagcagtgctgtaatcctagcactttgggggtcaaagtgttcgagaccagcctgagcaacatggtggaaccccacttctacatattaaaaacaaaaaaggaaaagagaaaaaaattagccaggagtggtggcatgtgttcttgttactaaggaggataaggcaagaggatcacttgaacccagaagctggggtgccttgaactatgattgcaccactccactccatcctgggcaacagagggagaccctgtcactaaataaataaataataaaataaaataaaatcagtaaaaatatgtcaataagtgtatttggtttgaggcatattgcagggaattatttagatcatacaagtttaagttacagtacattggttttatgactccaaactgacatctaatgtctgactgaaaggttgtattctttcagctgggcacagtggcccatgtctgtaatcccagcactttggaaggccaaggtgggcagatcacttgagctcaggcgttcaagaccagcctggtcaacatggcaaaaccccgtctttaccaaaaaatacaaaattggacaggcgtggtggcatgcgtctgtagtcccagctactcgggaggctgaggcaggagaatcacttgaacccgggaaacagaggttgcagtgagccgagctcacactacattccagcctgggcatcatagcgagactctgtctcaaaaaaaaaaaagaagaagaagaagaaaagaaaagttaagctttattctttcatctttagacagttactggcaactggatcccaaccatttctacatcttggcaaaggtctcattgtaatagtgttttttgtggttttggtttgtttgtttgtttgtttgttttgagacagatctgttgtgatctcagctcactgcaagctctgcctcccgggttcacgctattctcctgcctcagcctccggagtagctgggactacaggcacccgccaccaccctggttaattttctgtatttttagtagagacggggtttcagcgtgttagccaggatgatctcgatctcctgacctgttgttgatccacccacctcggcctcccaaagtgctgggattacaagcatgagccacagtgcctggctgtaacagttttttatatattcttctatctgttttatacgttattacttacatatcatgactaaacaataatgcaaatgaatataagaacagatgtggtcatcaggaacattcctattaataagagcacttttgtaatcatttacacatatatatgtgtattaactgagtggataagaattaaatactttttaatttttaaaaagtcacaaatttggccaggtgtggtggctcatgcctgtaatcccacgaccttgtgaggttgaagtggatggatcacttcaacccaagaatttgagaccagcctggacagtatgacaaaactccatctgtctctgtacaaaagctacaaacattagccaggcatggtggtgcacacctgtagtcccagctacttgggaggctgaggtgggaggatctcccaggaggttgaggctgtattgagttgagatcgttccactgcactccagcctaggtgacagagcaaaaccctatctatcttaaaaaaacaataaaaacacaaattctttagaaagagactattaaagtatttaagcgtagaagtaagaatgggtactatttgtttacaaaatgcatatggtatccagcattgtgatggtttttctatcactcatgtcctaatgacagtctttttttttttaattatactctaagttctagggtacatgtgcacattgtgcaggttagttacatatgtatacatgtgccatgctggcacgctgcacccactaactcgtcatctagcattaggtatatctcccaatgctatcccttccccctccccccaccctacaacagtccccagagtgtgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcttagtattccatggtgtatatgtgccacattttcttaatccagtctatcattgttggacatttgggttggttccaagtctctgctattgtgaataatgccgcaataaacatacgtgtgcatgtgtctttatagcagcatgatttatagtcctttgggtatatattctaagtagtctcaaaatccaaactcaaacagaccttcaaataggcagataagaaagatacatgatcacaaattggataactgtttagaagaatttgttgttaatgtagttcactttagagtcatttaactgcagtttaaataatattatagtacattttatcatactaaacactgctattcagtaagagatggatgatttgaacatgaatccaatttagggctttaccaaaatatatataaaataaagagtcgaacaagaaattcacattttaacttacttttttttttaacattttagcaaaacaagcaaacaaaaagtactggaggagagaacttggatattatattgtatccagtttctaaaggcaaattttaagtccaggtgggaaattttatttttagtcatccatacacctggtatgaatacttgaagatttagtcatagcattaacacagccaaactgaaagacagtatacaaagagaaaaaaagtcaaaatttagggataggaaaacaatgaaaaacaaaacaaatacactagtaaaatgacttgttagaaagctaaactaacagggaatatttaagtctgaagaagaaaaaggagttatgaccaatgatatgatcttaaaggtataaagagaaagaaaactagatcttttactttcccaaaaccacaacaggaaatgaggtgccagatgaagggctgatgttggaaatcagaaaagtatttctgaaaaggaaaaataaaatacaatggaagaggttattgcagtggatttctttctatggctatgtatcttactagaagagaataaaaaatataatgtctgaaaacaggataaacaatgattttgcaaagtttgtagcatgcaaagacttgcattgaaacatcactttataatgaaattccttattgaaacatacacacaagtgtgtacacgcacatacaataagaaaatttttaaaaattgtgttatcagtactgtaaactaaaatgcaggccaggcagagagctcccatctgtaaaccaaacactttgggaggctgagacaggaggctcacttgagttcaagatcagtttgggcaacatgattaaccccatctctacaaaaaatacaaaacaaaactagctgggcatggtggcatgcacttgtagtcccagctacttgggaggctgaagtcagaggatcaattaagctcgggaggtcaaggctacagtgagccatgatggagccactctactccagtctgggagacagagtgagaccctatctctcaaaaacaaacaaaagctaaaaagcagttccacagtatcacaaggcttcaatgtcgataaaaatgtgttagtataagcacttacatatcatttttccaaaaatttgctagtaaaatttctctaactgggattattctcacatagtaaatgtgttttaattctaccatcctgctcttacctttacaatctttcttatttgaaagcataacaaaaccatttttacaggaacagtggtaacttccaggtgtattatcacaaatttgactgcaacctccatttatatttgagggatctttgcattcatttatgtctaaaacaggaaaaaaataaattatttttaaagtaatataacctgcagagaacttttcaggagaccaatcctgatgagctggggggcgggggttattatacgtaccaaattcacacttttctccttgccaacctggtttacaagtgcaagtaaaagaagcttttccatctttgcagctcatatatccatcttcattgcatggcagaggactacactggtctggaatggctgaaggaaatagacatctatttattttttttatctcatgtcatggaaaaataaaattgtgtgtactataataaaaatcctgaagcctagaaccaatgaaaaaaaaacacacaactcctttctttaaataatacttttcctaaattaaaaagtgagcctattaggcaaatctttataattattttgtaaaaataaactacagatggcagcagtggcccatgtagagtggccgctgccaagacgccagctgcagtggggatgtgggccagggcctcccactccacagagcagataggagccccacactccccggatgctgctgcagctttcctgtcgtggctccggacccgggtgtctctgtgctcttgggggcctgctcccgctgccaggcttctccccgcagcaggcatccactctgatcttagaggcatggccagggctgcacgtgccatggagctggtaaaagccaaggacaagggggagctccactccttccaaactggtgggacaagagtcccctgagtgcagctgcagctgcccaagcctggctggaaacctgggcatctctgtactcttgagggcctggggaggcccattctgcccaccacaggctcagaagtgcctgctcttgcttcctgacctctcctctctcctggcacccactctggtcatggaacaaggttggagctgaagccagctgttgtcgcagcctagctgggtgggcataagctcagggcagcgctaacatgccagcaccctgtcccctccagtctttgggctccaacaagcatgggaagggagctgaggggcatgctgagggcagctcagtgctggcctgcaggcacccccttggcacaaacagcctgggtgccatgaacagtggcaggaggtagacagcttcctaggtggaaaagggtaggtcccctgtgaagtcccaccttcaggctggggaaggcctgaggcctgtgggctgggctaccagtcctgctgactgatgggggaacactgggtgctttttcctgggcccacccatggcagcccatggaccagtcagcatgcactttccctctctgaagaccataaaaaccccagactcagccagagcagaacagatatccagacaaccagctgcagaaaggagctaccatctccagggcctcccatgtactgggagctgcagacatcgaatgacctgtctgtagagaagaaccactgtctccaggccctcctctgctgagagctgctgatgggacaaccagctgcagacaggagccacccactctaggcctcctctctactgaaagctgcagagacaatgggatgacctggctacagagaggagccacctgcttcaagccctcctctctgctgagggctgaacacttgatgggacaacctgcctacagagatgagctacccactgagggtctcctctgagctgttctaatgctcagtaaagttcctgttcatcttgctcaccctccacttttctgcatacctcattcttcatggatgcaggacaagaactcaggcaaaggcaccaccagccacagaagtttccagccagaaaagcaacaccccaaagatcccataacactacttctggattgcaagtatatacagtatttcataactgtaatttagatatttttccaaatatattacctcatttgagccttagaacaattccatgaggtagacagaacaatactattctcaacattaagagaaaaagaggctaggtgtgatggctcacacctgtaatcccagcactttgggagaccaaggcaggcaggcagatcacttgaggcctaggcaacaaggtgaaaccctgtctttacgaaaaatacaaaacttagcggggcgtggtggcacatgcctgtagtcccagctactcaggagtctaaagtgcaagaattgcttgaacctgggaggcagaggctgcagtaagctgagatcatgccactgtgatagagccaggctctctctcaaaaaaaaagaaaaagaaattaaaattttcaatttggactaagatgatgtaacaaggaatagatttatcttcctgccttaaataagtagaacttcagtctaactatgtaaaataatggtttttcaaatattggagaacaggaaggagaacaccgtaattcctaaggaaaagaaaataaacaagctgagacctacaattggaccacattactgcctggagatagcttctatgcaacagtgcaagaaacacaaacagatcccagtggtctccctgggttgagaaaacaaatattggagtttggggagatcaaattagaattctgctggtcagagtactataaaggcagagagagggaaaaaatgtgtgtgtatggaaagagagagagaaagagagatagaggaaaagagaaagagtctccagagatctgcaaaaagatcccgtagggtctttggctgaatgatgatttgcacaggaaaatttccagagctcagagagggatagggatagtttgttttagactacccagacctaaaatatttcacagtacaaatggcatcaggtggaatcctcacaaggacttattattgaggctaaattagttttaagctaacggctactccagattgccttaacagagcttaaaatcaaacctcaaaagatttgtttttaatgtattccacataagttacctaaatgccacaacaaaatcaaacactgtttggaagaagcaaagaaaatccaggacccagcaacataagctgtaagcttattttcttttccttaggagtcacagtgttctgcttcctgttctccaatgttcaaaaccattattttgtatactgacccaaaagaaactcacttgaaatataaacacactggtatgttcaaagttaatggatggaaaagtaaaccataaaaacactaaacaaaagaaagccagagtgacaacattaatataagatagattttagaataaggaatattaccagagaaaaagagcaatattaagaagtacaaagtagggcctggaatggtgtttcatgcctgtaatcctagcactttgggaggcccaggtaggaggattgcttgaggccaggagtctgagaccagcctggagaacacacccaagaccccatctctataaaaaataaattagccaggagtgatgatatgtgcctatagttccagctactcaggcggctgaggcaggaggattgcttgaacctaggaggttgaggctgcagtgagccatgattgcaccattacactccagcctgggcaacaaagcaagagcttgtctaaaaaaaaaaaaaaaaaaaaaacgtacaagtaaagatcaattatagtgccttgtttattttcttcctaaaatatcgaagcactttatcaatatggcaaatgacatgccatttgttttttatttgtaatttctgtcccctctttagacactgcaatagtcccttgatttctgcacatatccacaccagcctctaaacttcccagtcaactgtacatgttcttcccatccttccaatacttccaatactcccaatactgcctatatttctatctctttgcatatgttagccaaagaaaatttttgttgttaaataaataaataaccaacctagctaacgcctaattaattccataattttttaaaaaagtcttcataggatcgttttttttgaaatgtggcaatacattaggtattagtttaaaatcatagaaaataatagaaaatttttatcaaaattattattattctgttctttcgtaaattttaagaaaagataaagcatgaattaaatcattaaatatacgtattcagacaaactgtactccctgtgtaattacaagcactttaaattagagaaaaacacagttaaaagaatatctagagaatttcaatcctggatgtaaaatattctctgaacaaacatcacaatttatatcctgtgattgcaccatttgcttttactaatttaccaatttaccaaaaaagagtcaaaaataatgtaccagaattatcattaggccccttgtgaacttcagagcaagaaagctaatttgattcacataacattttccatgtttatattatcagtgccaaaaagttagaagaataaacatggctctactttgagctattaatctactgtaacatttagtcacactacatgattatgcaacaacagccaaaataaagctgttgggaataaaaattctgaagctgataacctttaggaacagagaacactgttcagtttaaacattaggcaaaaaaattcattttgagtaatacaggagcatttacaactataaacaagtattagaaatgcagtttgaaaatacttccttgctgggcatacaacccatcaaaggatcatttctcaatttttaaacgttagtttatattaccatgggtgtactttacctacagagtttttgttttgttttttcaattgatggtagaagtgcttaccattgacacagcttcttaggtcaggataagcattagttgactgacgtgcagcagtgaataacccagtttgaaaagagcgaagacaaactgaaaataaaaacaaacataatcttcttagagtagacacacatacttgatctgaattcatggtaggaactgtcccaagaggtaggacatttatgctcctgtagattcacaagattcagtcttcaaaatgcaacactaaatgtttccatctacctttctgaaaaattaaaaatctacaagcaagatggcaacagatacagaaacataaaaaataagtctgtgacagcttcttctctctggagaagaaccttaaagtcagaagtgaaaaaaaccttgatttagcatagaaatttattgtcatataagtctatgtttttaattccacagcagaaacaagatgttgccctcaaatctactgaccagagtctgatttataaagtatatgtaattaagtcaatagaatcagttcgtgtttctacttgctataggctacttccaattcttctcatgttgccctgagattaatacagtaatatttgtataatgcttctatattacaaatcaggtttacttcattcccttcattcttcactacaaccctgtgaaatcagatatagcaacctggtagatattgctaggaaactaagaaataacagctggaattgtaaagatgaaatactttgtgactttaacgtaactaggagttacttagtgccaaaaatatatttcttaagaggcactaaagacaccatatgtattacttcattgttcagacagtcaccagcttactataaaaaagatggtgttttacttagcttttgccaaggaacaaaccacccccaaaattagtagcttaagtaatcattgtatttttctcatgatttgcgggtcaaatatttgcagagtttggttgggttgtttgtctctgctgccaatggagtcaaccaggatggctggggcaggggactgcttccaagatggagcatcttggaagttctttggcatctctctttccatatgatagatcatgcttcaaagttctccacgtgggtgtttctcttagcatgctggtcttaaagtggcacttctttcatgacagctagcttctaagacagagaaagcaaactgccatggcagttatgggacactgtataacttctatcatattctgttgatcaaaggggtcccagggtccacccagattcaaagggtagggtgtgggtgggggatttattctacctcttgatgaggacacagcaaaatgacactgtagaagggtatgtggaatggaagacatttttaaaccatctttggaaaaatacagtgtatcacagacagattaaaagattcatttgaagtcagtatgtgtttaagttacctatggctgctatgacaaattaccacaaatttagtagctttaaataataaaaatttattgttttacagtgccgagagtccaaaaccaaaagggctagcagggatccattccttctggagacttcaaggaagaatccctttccttgccttttccagcttctagaggtcatctgcattcctgggctcatggcctcatccttgtatgtctaccagttcttgctttatcattccatatctgactccatatctactactgactctaatctcctgccatcctgttataaggacccttatggttttatcgggtcctctcagatatcccaggataatgtctccatggaaagatctttcatcacatctgcaaagtctccatttgccatataaggtaacagtcacaagttctaaggattaggacatagatatgtctggggcggggaggggcaggcagggtggaggaaggaggtcattattcagcctaccatggtgagatagaatattttcccaaataagtcttaccttacacattgtgggggtgtttctggagcccctatctgagtccactttgtgttgctataacaaaataccacagacgggctaatttattaaagaaagaaatttacttctcccagttctggaggctgggaagtctgatatcaaggtgctttagtgtctcatgaaggccctcttgctacaccatcccacagcagatggcaaaagagggcgaaagagcaagacgctgaatttgcagcctcaagcccttttataattggtgttaggctattcatgatggtggagccttaatgacctaaacacctcccattaggccccacctcccaacactgttccattgggaattaagtttccagcacatactttttgagggtcacattcaaagcctagtatttgctccagcccccaaaattcatgtccttctcatgtgcaaaatacgttcattccatctcagtagtcctgatatggtttagctgtgtccccaccgaaaaatctcatcttgaattctaatcctccacaatccccatgtgtcaagggacagaccaggtggaggtaattgaatcaggggggcgattttccccatgctgttctcatgatagtgagtgagttctcatgagatctgattattactaagtgtttggtagttccttctgcattcgttctccttcctgctgccttgtgaagaagatgccttgcttcctgatatagtttggctgtgtcccaacccaaatctcattttgaattgtaataatccccatgtgtcaagggcagggccaggtggagataattgaatcatgggggcaatttccccgatactgtgctcatggtagtgagtaaatctcacaagatctgatggttttataaatgggaggtcccctgcacaagctctcttgcctgccaccaggtaagaagtaactttgctccccattcaccttctgccttgactatgaggcctttccagccatgtggaactgtgagtcaattaaacctcttttacattataaattacccagtctcaggtatgtctttattagcaacatgaaaatgaactaatacgctttccctttgccttccgccatgattctaagtttcccaaggcctcctcagccatgctgaactataagtcaattaaacctcttttctttataaattatccagtcttgggtatgtctttataatagagtgaaaacagactaatataagccccaatgtattaactcatactagcaccaactcaaaagtccaaagtccaaagtctcatctaaatcagatatgggtgagactcaaggcatgattcaccctaaggcaattcccaccagctatgagtttccaaaatgcaatgagataagcatgatagacgtttccattacaaaaaggaaaaacaggtaagaacagtaactggtcctaaggaagtccaaaacccattaagaaaaacaacataaaatgttaaagctctaatatagttttccttgactctatgtcctgacttctgagcacacaggggtaggggctgagccctcaaggtcttggccagcccatccctatggctttgctgggcgtaggccatgctgcggctctcacaggttggagtcttgtgccagcagctctcccagacagaagttgcatactggtagccctatagttctgggctctcggggcttcccaactcccatggctccactaggcattgccctggtgggggctcactatagtggctctgctgctgtaacaagtctttgcctggacacccccaggctgcccataataacctttgaaatctaggtggaggccaccttgaccccacagctcttgcattctgtgcacctgcaaaatttacaccacatgaatgccaccaaggcttatgaggtatgtacattccagagtggtgggttgagatgcacctaggcccacttgagccatggatgggatggccaagggacactgtgctgaaattcaagcagcagagtccctaggtcgtgcagagcagtggtggtcctgcaggtgcccctctggaaactgcatcaaggtcttgctctgggccagtgatgggagaggcagcttcaaaaatctctcaaatgtctttgaggtctttcgcccattgttttgaaaaacagcacctggctccttttatttatttatttattttaatttcaacaggttttggggggaataggtggtgtttggttacatgtataagtaagttctttaatagtgattcctgagattttggttcatccattacccaagcagtgtacactgtacccaatatgtagtcttttatctttcaccccacctccaccagttctccgaagtccccaaagtccattgtattattcttaaacctttgcatcctcatagtttagctcccacttatgactgtgaacatacaatgtttggttttccattcctgagttacttcactcagactaaagagcccctggctcctttctattcatggtagtctctttgggaaatggtaacttgggacacacccttggtttgctctcctaaagaccttttcactctttatatgaccaggctgcgaatttcccaaatatttttgccctgattcccttttaattgtaaatccaagctttaaatcatttctctttttctcatatattactgtatgcagttaaaagtagccacaaaggctgggcacggtagctcatacctgtaatcccagctctttgggaggctgaggcatgcagatcacttaaggtaaggagtttgaggctgcctggcaaacatggcaaaatgctgtctctactaaaaatacaaaaattatccaggtgtggtggcacacacctgtaatcctagctacttgggaggctgaggtacaagaactgcttgaacctgggaggcagaggctgcagtgagccaagatcacaccactgcactccagcctggatgacaaagcaagactctgtctctaaataaataaatagataaataaattaatgcagccacacagttccttcaatattttgcttagaaatctctgctatcctagtacttatctcttaaattcagccttccctacagccctcaggcatggagataattcagccaatttctttgctaccttgtaacaatgttggtctttactctagtttccagtgctttgtttctcatttccatctaggatctcatcagaatgggctttagcattcatatttctaccaacaatctaatcatgacacttaagtaatctctaagaagttacattcttttcctgcatgtcttctttttttttgacccctcaccagaatcatcctcaatgctccattcacagcaatctaggctcttcctagcctgctcctccagattcttccagcctttagccattacccagttccaaaactgcttccatattttcaggtatttgttatagcagcaacccaatgtctggcaccaatgtttcgtcttaggcctttttgtattgctataacagaataccacagactcagtaatttataaagaaaaaaattattttttacagttctggaggctgggaagtccaatattaaggtgctaatcatctggtaaaggccttattacagcatcatcccatgacagaaggtagtaaggcaaaagggtacaagagatagagaggggaagggagccaaactcagccccagtaaaacctaagtagttttaggtctcgagtagtcttatctttggttcatttgtccttcttcttgaatcatctactttcagacttcatttattcttgtgtgaagacttcattagaatcatcgtttttgagaaagcttcatttcgcatctctggcaaattttacagtgaatacagccaaaatttgaaagctctgaggctggagacccaagtgaaatgtttcatatgagtttagaaccccaggccagactacattagcttaaacacataaggcacattatatagaagcctacattaatattcatgataataatttcatggaaaagtgtgttcagaattacagtgtgaagagccatttgctttgctactccaaagcagtgtaatacagaaccctcatattcccacttctctttcttaccacacaacaggaatagtaaaaattgaggagggtaaacaggaaggtgaaagttggagggagattgtctctgcttctgtaaactgatgcggaagctcccacaagaaaagggattaaaaacagaaattaggaccacaggagagaaaggctaagaaacagaccctttcaagagaggttctggtggtcaaggcatgacctcttaggaaaagatcttgctacatgtacctttacttatatttttcactattagttttattaacaatcaaactggtttccttttgccgctttctataggcaccactatcctagctatcttgatttgtcaattctaaaaaatagttcaaacagccactgactcctagacaaaggttgtactggaattataatggatcaagagtcaggtaaattttttatttctctaagaaactactttatacccctctgtctttaagtcacagaagacgcatcacataaaaggctgaatgtttgcttgttttgactggaggagcacaaggctgagttattcataccccgcccctttgacagtatattatgatcgctggtgtttgaaaatcccattacttgctttcaaaaaatacatacatattcctttctgtctccatttcctccatttccactttcattcaccctttaggcagtcattctaatgggttatgtggtttttgtttttttgtttgtttgttttgttttgttttttgtttctttgtttttttctttgagacagagtctctgtcgcccaggctggagtgcagtggcacgatcttggctcaccgcaacctccacctcctgggttcaagtgattcttgtccctcagcctccccagtagctgtgagaggtgacagcgtgctggcagcccttgcagccctcgctgctctgggcaccttttctgcctgggctcccactttggcggcacttgaggagcccttcagcccaccactgcactgtgggagcccctttctgggctggccaagcccagagctggctccctcagcttgcagggaggtgtggagggaaaggcgcgagggggaacagctggagttcctggtgggcgtgggcttggcgggccggcactcggagcagccggccggccctgccagcaggggcaatgaggggcttagcacccgggccagcagctgtggagggtgtactaggtcccccagcagtgctggcccactggcgctgcgcttgatttctcgccaggccttagctgcctccctgcagggcagggttcgggacctgcagcccaccatgcctgagcctcccccgcctctgtgggctcctgtgccatgaagcctccttgatgagccccaccccctgctccagggcgcccagtcccattgaccacccaagggctgaggagtgcgggcacacggcttgggactggcaggcagctccacctgcagccccagtgcaggatccactgggttaagccagctgcgctcctgagtctggtggggccttggagaacctttatgtctagctcagggattgtaaacgcaccaatccgcactctgtatctagctcaaggtttgtaaacacaccaatcagcaccctgtgtctagctcagggtttgtgaatacaccaattgacactctgtatctagctaatctggtggggacgtggagaaactttgtgtctagctcagggattgtaaacgcaccaatcagcgccctgtcaaaacagaccactcgctctatcaatcagcaggatgtgggtggggccagataagagaataaaagcaggctgcccgagccagcagtggcaacccactgggtccccttccacactgtggaagctttgttctttcactctttgcaataaatcttgctgctgctcactctttgggtccacactgcctttatgagctgtaacactcaccacgaaggtccgaagcttcactcctgagccagcgagaccacaaacccagcagaaggaagaaactccgaacatcagaaggaacaaactcctgatacgccgcctttaagaactgtaacactcaccgcgagggtcggcggcttcattcttgaagtcagtgagaccaagaacccaccaattctggacacagctgggattacaggcctcgccaccactccttccttcctggctaatctttatatttttacaagagatggggtttcatcatgctggtcaggctggtctcgaactcctaacctcaagtgaatcatcctcctcagcctcccaaagtgttggaattacaggcatgagacatcatgcccagtggttatgtgtatttttaaaatttgtaagtgttcttgaaaatatatatttacaatttcatttccatgttttttttcacgtgtgtaaatggttttgtgttatatatcacatcctctaatttttttctcagaacttgatttttatgatcaatccatgctgctacatataattcattgctactaaccactaagtgttacaccacagtatgcaaccaccactttataattctctctacccatgataagacactcaaattacctccaactttctacctctacaagaaggcggaaagtacatcctcatgcatgtctccttagtacctgcataacaatttctttggaatagatacccagtggtggaattgtgtgatcattaaataggaatgtacttaatggctctcagaggtgcattctcaccagtggagtataaggatttctacatccttgctttctaatttttggcagactaataggtagtaaagtaatatctcattatttttctgatttctaaggagaggcagcatattttcatgtcattttccaaatctgaaagttttcttctttgaaaattttccctattttttttttttaccatttttctattgatccttatttgtttttcctgcggatttgaaaaaaaataaacatttataaatatcacctcttgatatttatatttttgatatttatttgacagagacagatctgtcatttgtctcttaatcttactattcatgtctctcttgtaagataaattcttaattttgttataatccaatttattatttcaccttacagcttgtgaatttaaaattttcccccatgtcatcagtcacaaagatattctcccatattgtttctttaatttcatggttttattttaacatttttgtctttattccatctagaattcacctttacacttggtggtaattagaaacccatgtttatttgtctgctaatagctggccattcttcgcaataccatctttaaataatccacagtgacttacagtatcatctttatcaaatattaggttgtcatagatatgagcctttctctgaactttctgttcagtttcatgttctgaaaataccatatagttttatttctatagctttatattattaatatttgataagatatttctctcttttgtattttagacatgtgtggacttttagttcctcagttaaattttaaaatgagtttactgagtttctcaaaaatatttttttaaacaagattgctctgaacatataaatttgaggatggccacacatagtacctcacacctataaccccagcactttgggaagccctggcaggaggactgcttgagcccaggagtttgagaccagtgtgggcaacatagtgagaccccatctctaaaaatataaaatataataaaataaaataaaatcaatttgaggagaactgatcactgtatagtatcactcaattcaagatcatgaaatatctttccatggttttaattcattttctaagtcttcaatttgagtattaacattttctccatagggtttttatgtgttcttaagatatttctagatatgttatgggatttgctgctattgtgaatgctatcatctttttaatttctactagactactgcttgcataaagaactactatggatttttataggagagtcatagaattatctaaataccttatgtgttcctatattttgtctatggattctatttttttccagtattatatctattaaaagtaatgacaggaatatactatagcttatgatctatacaatccctatttttcttttcttattgcattgaatgtaacctccagtacttttctttttgttctcaaccataaagaaactatacctaaattttattcattaggtataatgtttactgcagattttgttcactttctttttcttttctctctctttctctttccatctctccctccctccctcctttctcatgctaatttgctcaaaacaaccctatcttattcttgttctagctgacattaccttatgcattattaatcctgaactgaagtgtgaaaatttggaagattaattatatggttattctagatttaacctttatcaagctcagaaacttttcttatattcttagtttgacaaaaacttttatcataactaagtagtgatctctatcaactgctttttctgtatgaactgaggtaataatatacttttagtggtggggtcttactatgttatccaggctggtatcaaactcctggcctcaagtgatcctcgcacttcagcctcttgagtggctgggattacgggcataagccactgcacccagctgatttcctgatgttaactcacctttaaatttctggaataattctacttgatcatgatattatttttaacacacttaagatcggactgaatatcattttatttagaattaattcaaaatcaaaaggaatgctatttttcttttcttttattccctcacttaaattttaaaatgagtttactaaatgtctttatttgattttggagtcaagattacataagcctcttagaataagctcattttttaaggacaatatcttaataagggaaacattaacaatttcttaaaatttggaagagttcatttgtaaaaccatctggatctgggtttcgggagaaataggaagaagagggctttggctgcggttttaacttgtttaatactcgtttgtataactaagttctctattgcttcctgtgaaattacagatattttatgtttttctaggaacacatccattttatttaggtttccaagtgtatttaatatagctgtttgtaatattttatgataatatttttaatctgtgttgagtttagaatattttccctttctatcttgtactctatgtattggcatttcctctttctcttttttgtttttccttgattattcctgccagatgtcagtctcacttactaaccttttcaaagaatgagaatgtgcttttgttaatgctcacttttgtttttctattccacttatttctatctctgtttttgttattttaaaacttcttgttacttggggtttgctctattgtattttttgtgtttgttttctcaattggaaagttcatgtcattttttaaattatcaaatctgttttgtcactactgccttgtcagttagaacccaatcccccaccacacataccagcaggtcaggccagcttttcgcctacccaggcatttcttaaacttctttttgtcattttattttgttattattagtgcttggaatcttattgtttctttagagaagatttgaagggagggagtcagcattctgaggtaattcaccaacttatcttagaaactaaaaataatttcttttttttatttttcaggttttttccttattttattttttgccagctcacatcaaaaaatgatttctaatgtttatatttaggctcagagttcaccattcttcccaggaagtttctctctctttactagaaacactcactctattaggtgatactaggcctatggaaatggtagttatttattccacttcttacaaaagagaagaacacaatttaaaaactataatgaaacccagagtacttatttccaaatcgcatgttttcaagatagtacatggaatatgtaggccaattgaagtgctttatcagcccctgaaaacgaagtctaaatattgccccaaatatatgggttacaattttttaatttctttggtgaccttatctcactacagggaccttcctgtatgagctgttgtagttagtaaaactactgttagatttaccagagaaaggactgttttgttttgcttttcaaattagagccattggcctatagaatatacacatcaaataacaaaaaaagtgtaacttaggcaggacatttttaaaaattgtttttaacagtggaattcaccacacatgcctatatacaaataaagaccaaaatatgaaatttaaattaaaaaaaatcataataaaaagtatatttttgtttcacatgatgggttgattaaacaagaatacatctgaagaaattttgacacattaagttatttatgtacgttgacatatttggtgatttaaaagctctgaagttagaaaatatagttacagtgcacacttaaaactacagaagctggaaagctaaacaacttgtttaatctgaaacagttaaaaatttttaggtctgagcctggatcccacatcttgtgtttttgttttagtttgttttattttatactttggttttttttaccatgttgccaaatgagataggcaaagagaagagttgggcagggccagaaaagcggaagttaagagagatacaaggataaaattatgaaaaatattttatctaaggaacttccccagaacacataatgctgtattagcatggtatttatctttatccaaatgtactctgatcaaaggaatgtatcctctacagtattgtgcgtgcaaaaatgcagcctcattacatggccctaagaagcaagagttaacactgtttttttaatgtacacataatatttaacagccaaatattgtctatttttattataaaatatttacatttctatctaaaattaaaaagctgaaatagtcttgatatactatcttttctacactttaatagtacaaattcttgcatgtaactttacaaaagaaaacatctttttcatggatatatccatatcccactgcccttttaaaatacagcagctaaggctgggcagggtgggtcatgcctgtaatcctagcactttgggaggctgaggagagtggacacttgagcccaggagttcaagactaccctggccaacatggcgaaaccctgtctctactaaaaatacaaaaattagctgggtgtggtggcacatgcctgtaatcccagctactcgggaggctgaggcacttgagaatcacttgaaccagggagacagaagttgcagtgagctgagagcaggccacagcactccagcctgggtgacacagcaaggcgctgcctcacaaaaaaaaaaaaacagttaacccatgaaaacgcatatgctcatagactatgtctagcacctcaatataactgagcatcagcccaagagcttcatgagaaagacatgagaaagaaaaacactaaaatttaaaatgtcacatggtaattaaagaaccgttccaaatttctcaacatgtgttaaatataaagacagcaaaattgcatataaaatgaaacctcactcccaaggataatgaaattacattggatggaatagataggtggagagttagacaggaacatatctaagttcccttccatttctaagattatataattgagatgttttgaacttacctaagtattttggataaaaataatcctagaaagaagaaaaagaaaacatatcttagcaaacctaaatttcattatagagttaaaacttaattttataatgtgtttttatattaaagatgcaaataagttacatataaccatcattttcacattataatttttatatagtaaaatataccaagagaaaacaataaaattaagccagtaagatacttaggcttaaagaaatattgatcaattaatcatgtttcaaaagcttctaatctaaaaacaagctctatttaggatggtaaatataatcatacatgcccttttttgtacatcctttaatttttccataatgattagataaccatttgacacattttatgtcataatggtcacctacaccagattcaatgttgaatcacagtaacgtactctctttttttttttttttttgagacgaggtttctctgtgtcacccatgctagagtgcagtggtatgaccatgactcactgcagccttaccctcctgggctcaagtaatcctcccatctcagccccccaagtagctggaactacaggtacatgccaccatgcacagctggttttttgttgttaattatttttttgtagagatggggtctcactatgttgcctaggcctcaaactcctgggctcaagcgatcctcccaccttggcctcccaaagtgctggaattacaggtgtgagccaaggtgcccagctaacagtgacatactttgaagtgaattaaagtagacatttatcttatacatcttatgtacatgtagtaccttacctataaattggttgtgtaccaaaagtttgtctgtaaatcagtcaatttggagtaaagaatgtgctttcttaaaaagagaaaaatgttaaaaatttctgatagtaaggttctcaggctagtccacaaaagcattcttaagccataatatatctaatgtgtaccattaacagcacaagaatacctcatgagaaaccagaatttctacacaaagacatattcaatgttaccacttagtaagtacagaacataagctcatccagaactgagtcaaaggcctcattctttcctcctctcatataaacctacacaatagataatgggattcaaaggtgatattgcgaccgtcaaaggaatatattagagatgttgaggcataagtagtactgtggggactggaaatgtggactgtggtattagggatgtggacagggagtggttgggtagggtcgaaaatgatcacacctgtaatcatgagaattgtaacacagtaacaaatgtttggtgggggtggggcagagggatcactgtggtcacacgtgtaatcctagcactttgggagactaaggtgggcagattgctcgagcccagactgggcaacatggcaaaacgccctctcgacaaaaaataccaaaattagccaggtgtggggctgcacacctgtagtctcagcgacacaggaggctgagacgggaggattgcctgagcgggggggtcagggctgcagtgaaccatgatcatgccactgcactctagcctgggcaacagagcaagaccctgtctaaaaaaaaaaaaaaaaaaagtaactttttttttcatttctcccctttctgtcttgctctttctgtcatttttttctcttctgtcaatgagaccaatgctagaattagtggaagggaggaagcacatgaatgagttttccttcctcactatctttcctcctccacatcaaggtcttctccctcactgggcttttgctgcttagaggctaagctgatagaatgtatccattgtgttagaaatacacactcaatattaatgagtgatgtactaatatggtatcttgggcagacaggcatgccttacaatattccagaataacaaaacaaaaattagaatggatggggaaaaaaataggtaaaacaagaatggcagagtgttgattattattaaaggggtgggggagtttttataatgaaatgtattacactgatctctctactttgagatctatttaaaatctatttaaaatttcaatattagatgatacctacaattgtgacttaaaatctttcatgtaaagtaacagtgggccgggcgcagtggctcatgcctgtaatctcagcactttaggaggccaaggcaggtggattgcttaagcccaggagtttgagacttgcctggccaacatggcaaaaccccgtctctactaaaaatacaaaaattagccaggcatggtggcatacgcctctaatcccacctactcaggtggctgaggcatgagaatctcttgaacccgggaagtgggggctacagtgagcagagattgcaccactgcactctagcctgggcaacagaaagagactttgtttcaaaaaataaaaataaaaataaatgccaatggagaaatttaatgaagcattgtaataataatccaaactagcatgcatgcgtgcgcgcgcacacgcacacacacacacgttaatacttcagacatcctttcccctccctctaacactatcaaattctggttagaagaaaatatttgcaaaccatgaggtcaatactatttgctgataatgaagtgtaactgaactatagtttagtcagaacaagctgttattggtgatcatgtctgcctaaaaagcccattttcctttaaaggtacttcctctcccctccccctaacactatcaaattctggttagaagaaaatatttacaaaccatgaggtcaatactatttgctgataatgaggtgtaactgaactatagtttagtcagaacaagctgttattggtgatcatgtctgcctaacaagcccactttcctttgaaggtacttcctcctgaaatggaagtggttatgtgtggaaggtgatacacagaattattgactttaagatggaacagaaggaagtacaggctggaaatgttcagtctgtagttgtatgtctagatgtgtgaacttgatagtttccataaatgcttaccgtttccgggtcattttcaaagacctccctggcttcttctttattgcacagttcttcgatgcattctctttcaagattaccctgtttggtttcttcaagtaaagaatttgcacgacgcttcctaaccaggacttgtgaagcctgttgctttgacaaaactgaaggaaacaatcagtttatatgaattaatcatttttccatgtaaaatatattgttttattaaacaataagagttaaaatcattttctgcctatgaattgtatgacatttaaaatcagtatgatcgaactaagaaaaaaatgcagatacagaagcacgttggttaacaattcagagagcgggtttggtgtgcagctgcagcccttgtatgatggtctacacaaattattcaggtttatacttgaggttaaacacaccagataatattcaatacttcctttattatgactacatcagagaaaacatgctgaggccaggtgtggtggctcaccttcgtaatcccagcactttgggaggctgatgtgggaggtccacctgaacccaggtggttcaaacccagcctgggcaaaatagtgagaccccatttctacaaaaaacaaacatatatatatatatatatatatatgtgtgtatgtgtatatatatatatatgtgtgtgtgtgtgtatatatatatgtgtatatatatatgtatatatatatacttgtgtatatatatatgtgtgtatatatatgtgtgtgtgtgtatatatatatatatatatttttttttttttttttttttgagacggagtctcgctctgtcgcccaggctggagtgcagtggcatgatctcggctcactgcaacctctgcctgccagattcaagtgattctcctgcatcagcctcctgagtagctgggattactagaatgcgccaccacataaaaaatattaattgttcatggtggtatgcacttatagtccttgctacctgggaggctaaggcgggagtgccacttgagtgcaggaattcaaggttacagtgagctgtgatcataccacttcactccagccagtaagaccctcattctaaaaaaaaaaatctgaaaaaaaagaaaaaacatgatgaaatgcctatgtcaaaagccatagtcttagccaggcctggtggaacatgcctgtaatcccagctatttgggaaactgagacacgagaatcatttgaaccagggagccagaggttacagtgagctgagatcctgccactgcactccagcctgggcaatagagcaagactctgtctcaaaaaaaaaaaaaaaaaagccataccatctttaaagcaagagtaataaactttctcaattttaatgaaaaacctttgtgatctctgtggagattgttgttgaacagcaacaataaaaataacataacaaagttcaatatcaagcaacagactggaggaaaatacttacagcatatagaatagaaaaaattgcatccagataagccgaccaatacagaaatgcatgcacggttgtatataaaatcatttctaaaatataaacaaactataaagaaaacaatataaacaatcatataaaccatcactacagagaataaacgggaaataaacattataaagtgttcaaatcaaactattttaaaaattatatttttgcatattagactggcaaaactttaaaagaatgataatatcaattattggtgagagtaagggaaaacatgcattcttgtacactggtagtggagcataaactggcaggttttatttgaaggtattttggtaaaatttaaagcacatatactcgtcatctcaacaactctgattctaagtatgtcctacatatatgcccatgtgctggaaaaaatagaattgtttattgaaagactgtttgtgagatcaaaaaattaaaaatgacttaaatatctatcaagaggggcacaggatcaggcacggtggctcatgcctgtaatcccagcactttgggaggccaaggcaggaggatcacttgagccaaggagttcaagaccagcctggatgacaaagagagaccccacatctccaaaaaattttaacaattgtccaggtgtagtggtgcacacctgtagtcccagctagtcaggaggctgaggcaggaggatcacttgagcctgtggggggtcaaggctatagtcagctatgatcacaccactgcactccagtgtgggtgacagagcaagaccctgacttaaaaaaaaaagaggggaatggaaataaaagctataataaacccgtactgtggaataatatgcagttgctaaaaggaagatactcttgtactggagatctcaaagatacagtaagttaaaatgcaagttgtaaaatgccacactcatagcataattctctacaaatcagctaaagtagtatatatgtaaatatcatgtggaaaaatacacagaaaagagtttggaaagacaaactgctaatacaacaattatatttggagaaaagtatggagagtgtcgagttttggtttattattttagcatgttaatacagctttttaatgaaaaatgtaaaaaacataaataaaatctgcaagtaacttttttcctgatcttaaccacaaatggttctttcactaagaagataaacaagtaatataaatgtctgaatttctttcccttttcttgtctcttattacctggtaaacaataagcaataaatactcaaaagttgacaatagaagaaagaaaaaagcaaaaagatttatcaacagttactatatttatcagttaagtaactaaaaaaatctttcaagagtgaagtaatattactttatttctctgacttgccaaagcagaggtttaaatgtaatggataaataaataaattgtttgggttagatttgtaaccctatctcttgacatgtttatcatgctcattaaaatagagattaagtcaaggcagaacgtatataaaagatggtactctgtgatcatgctatctgccaagtgtgttattgacttatcaatgacagtcctgtcaacagtgaaagagcctgacgtgggcaattatctcatttattttaagtagttttacgcatgctagtttgtaataaatacagcaaaaaatttggactttttgaactttacagcaactatgtgattctttctggggaaaacaataacactttcattgaagggtgaatacactgattcaattttaaaaatcaaggttaaatgcacttaggaaataaagctccatatatattcacttcttggcattttttccttacacaatattaacttttggaattaggagtttgatagtgatttttaagaacatctctttccccgtatgggccccaactaaagggtacaaagcaggtgtaataacacatactgtattcatgcttgtgaaagcaaaggtctaaatcacccagaatagccaaggtttttgagttcttgggaatgtccacttaagtttataaaagtaaacataaccacctttattatttaagagatgatgaaactcaggtaaaaagcatgcaacatatttttccataattgtaaagtgaataaacaacaaaactacagctagatcataggcatcccaactctcagacctgcaatccattgtttattgtctgctgcttttcaaaaatcaggaagttttattgtctcaattgttgagaggaatattaaaaaaacaaaaactgttatgcttctgtcctacaggaaaattaagctaacaacaacaaaaaattttgtctaaatatatttgcactaaatttggatttcatctagttcagcccaacaatgctttacattggtatgatacataacaatgttcaaagcacgaattaattatttcatttgattttcacatgctgaaataaactatcagacagaattatcatccctattttcctattgaagaaattgaagctgagagaggtgacatgatttgctacgagttgtgctaatggaattcaaatatacccatccccttagcccagtgctcttttcttgagtgtattctgctactcaaatgtccatgatgtacctgatttaacttttttcatttacatatttttatttggaaatgtgtttatcaatacagtgaaactaaattatagagacactgatgtcattagtttagatataattactttataataaaagacatagtaattaacatatgatgtacgattttagaacttcagtggaatgggcagcttcatgttgatgccatttcaacagtgaattatttcagtctacctactttccaagaatgtcaccatctctaaataaaaaaataatgcttgtggtctagaattactttggtgcctccatattctgagagaagtactttatctccagctttcacactgactgcttgaatccctttcctttagggcccaatcggacagctactactgttgcttgcaatacttttcctgagacttttctggaagcataatgccttctttggttacggttttggctgcaccactttcagccaaagaacactcggtcaaagagcagaagaaactttctacgtgtttggtctcccatgactcccgctgccacagctcatactctgctcttgcacaactgccatgagctgactttaatttttgtaaaagaaattatgtggttgtgcagtggataaggtcactatcttaaataattagctgtcctttacaaaataaacccatccatctaagagaatggcttttgaagcagtctactgcttcttgccagaaagatacaggcatgacatcatgaacccaaattaaaactacaggactgttggatgagacaagcatggggtttgaagtgctttcagcaattggctcaaagttcttctgcccaaaaatattcaccctgctgacatgcagcaatatctaaaagttccattatttaccataataaccatgacatatgagcacataaatgctgttttacattatctcctttaatctgaatcataactgttctaagtagattaaaattttccgttttatatatgaataagctaaaatttaaagttgagttaattttagcaagttcccacagctgagaacacagacaaccagcatccaaaccctgtcctctttttgtattagcacactgtcccttactcatttgtttcacttctttatattaagaagtatctcaagaaagtccttgttaaaacccaactatgttgcttgaaaagtgttacattcagattcaaaattttaggttataatgtggagtttatgagtctttcaagataagaagtacaactgagtcaacttgatttttttaacttatctgagtcactccttcaaaataatgaccaaagcaggtggaacaattatgacaataataaaaccattgtgcaaacatgaactggaattctctttgaaattgtattcacagccttcatatgttctcttcatgtggggggtaagtctttgttttttgagtgtaaatttgattgacttacctccaaaaaataatttattgttattggtttcataagagcccctgtaatgacagtgatgctagcactccctctgctaatgccaccctctgttcaaggagggcaggaccaaaggtctgcaggttgtccaaaactgatcagtcaggttaaggatgaggtggcagatggaggagcatccaggttttaggatagcttatcctctgaagctcttccattttgctcccttgtttttttgcaaagatggttctcacattcttccctccaaaagctcatctctcttttagttctgctttccatctctcttttccctaggctcttcttatttggcatctcataaatgaaaaattgcccttgaaagaatgtttctgagaagagagtctttggctagcacttgggttggccaagtatttttatctttgtgtgggcttcagtgttggatgaggtgaaggaaaatggctttcactttacaaatatagagaaccaccagttgatactttgagacataactgtgcttcacaagtctcaattgatgaaacagtatattttgtttaaaccaagactgaggctgggtactgtggctcgcacatgtaatcccaacacattgggaggctgaggtgggaggatcccttaaacccaagagtttgaaaccagcctgggcatcatagggaaacaccatctctacaaaaaatttaaaaagtagctgggcatggtggcgcacacctggaatcccagctacttgagaggctgaggctgaaggatcgcttgagcccagaaggttgaggtacagggagccccgaatgtgtcactgcactccagcctgggtgaaagcacaagaccttgcctcaaaaaaaaagaaaaaaaaagcctgagaaaaaagaattgcatatattatttaaaaaattaattaataatgggctggcgtggtggcccacacctgtaatcccaacactctgggaggccgaggtgagctgatcacttgaagtcagcagttcgagactagcctggccaacatggtgaaatgcaatctctactaaaaatacaaaatttagccaggacagatcacgaggtcaggagtttgagatcagcctggccaatatggtgaaaccccgtctctactaaaaatacaaaaattagctgggcacggtggtgcgtgcttgtaaccccagctactcaggaggctgaggcagaagaatcacttgaacccaggaggcggagggtgcagtgagctgagatcgtgctgctgcactccagcctgggcgacagaaagagactctgtctcaaaaaaaaaaaaaaaaaaaaatttaaccaggagtggtggtgggcacctctaatcccagttactcaggaggctgaggcaggagaatcacttgaacccaggaggcggaggctggagtgagcagagattgcgccactgcactccagcctgggtgacagagcaagacgccatcacattaaaaaaaaaaaggctagttaataatggtaaaaaaataataataataatggtaaaaatggctgtatattcaaaaatgtatttaaaataattacattaactataaaatacttcagttatttttcataaagatttctaccacagaaaatttccaactggaggaaagaagcaattgaaaaaatgtgaaggttgccaggattaaggaaaactcaaagatgggtttttatgtagggattcaccaactattatccttgcttttctctagattttatattttgtatcacattgaggattatgctgctatgcaacgatttcttctcatattgtgttaagggttggaatgggttaaagaacattctgtaatgaactgtatctaggtctttttgaaggactgaacaaatactgactgatgagaaatactttactagagtcaaagatcattaagagataggtgtggataaagatttaaatccagggagagaaaaagaagaagtaatctgtgaatgaaatgttacacatataaaggcgagttctaaaacattaaggataggggagtgtaggctggcatttatttagaagtagaaaagccactggtggaattaaaaaaaaaatgtgaccattgaccctccattctggaacagatcattgaatgagtacaggagcaatgcctgaactgtttaacaacaacagaagtgaaacggacctctccttacaccaagatttaattataacttcaatttacagcccctttctaggaaaaaaaaaaaaagtcactctggcgttgtttccacagattaaaacctttgattaactagacagagaaagcagtacacgttagttattccctccaaacagcaaatatctttactcgaatgatagaatacacggctttattacccagaaaaaaagttacactggccatttcttttatttgaattgtttgttcttggtcagtgatcaatgaagatgcttcattgaagggattcaagagctcagatgttggcaaggataaagaaggaattttctacaactctattttttttctcctgactactagattgcaaactggttatgtttcctaatgctacaacaggaggtctttttcatgacatgcagcaagatagtcccacactcagctttcattgtcttttttatctcctacccactaggaccccaaaacatcatttgattttgacatcatgcaccaagaagttactgcacagaaaatgttttgtttttgttctatttgacttattttgttacaattacatcaatatattagttctgtggcctgggtctgtacttatgtttggaaaagcaacaggcaaagtgttcctggacacttaaaaaggcaacagtaaaataattctcctaattttgcaatatcgccctacttgcaatagcccctagatccctgaaataagcaagtctgaaactgtgcttagaggcttagaaggatttcagatatcaatggcattcctttgactcttaggatataatttattttttaaagtgcttatttgcaagtgagattacttggaatattggtatatcgtcaagtgagtctttctaattcaatggtttctaccagcatctcagaaccctctgtcaaataaccaaaaggctttaagacacagtctaaataacagtgaaataaaacaataactcattaaggaaaggagagaatatcattgggctaaggaatcaaggaaaaaaataaaaataaaacaagcagaaaggaaagaggcagttaacatagaaactcaagtccacattaaaaaaaaaaaaaaagtcagccacagacaaaatgaaaaaactactgttttttttttcatagtaagtaaaatgataaaataagcattttcattgtacttggcaaggtgttatggactgaatgtgtccccatctcccccccacaccccttccccgctccaaattcatatgttgaagccctaacacccagtgtggctatatttggagacaggtcctttaaggaagtaattaagactagatggggtcataatgtgaccccctaagattagtgaaccaaaaaatggcaataatagactctgatgactattaaagggggaagagagggaaaagagttgaaaaactaactgttgtttgctatgctcactatttgggtgacaggatcattttgccccaaatctgagcaccacgtaatatgcccatgtaacaaacctgcacatgtatcccctgaatctaaaatagaaagttgaaattatataaataaataaatataaaagcaataataataataaaggattagtgtccttataagaagggactcaggggagttctctatagctctgttgtgctttctctatcccctgtgcacacaccaaagaaaggccatctgagtagccagcgagaaggcagccatttggaagccaggaaaaaagcctgcaccagaaactgagttaactgaacttaatattggactttctagactccagaactgcaagaaaataaatttctatggtttaagccatgaactctgtgttgttttgttgtagcagcctgagcagactaatacacaaggcaagttagtcatggactatttctagctgctctgtaaaggcatacaaagtgatgcttatggttaatgatggcagagagtatttatggcttctccctctaggaccacataaaaatgatattaagataaatgtttaaaaattttaaggagtaagagaatttttaaaaacatgttttttgtttaaaaaatatacaaattgacagcatggtaggggtcattattaaataagtgatttcatcaaattctccaagctggaaagctgatgagaacctgttggtgaataaacaagggacaggaagagttgatccgtagcaggacgagccacagacaaaacctctcagacaccgagttgtagaaggaagggctttattcagctgggagcatcagcaagctactgccttaaaatccgagctccctgagtgtacagtttctgtcccttttaagggctcacaagactaaagatttcacatgaaagggtcgtgattgatttgagcaagcaggcagtacgtgacaggggctgcatgcaccagtggtcagattgaaacagaacagagcagggagtttcacagtgttcttttacacaatgccgggaatctatggataacattggtttctaagtcatgagttgatttttttttttttttttgagatggagtctcactctgtcgcccaggctggagtgcagtggcatgatctctgctcactgcaagctccgcctcctgggttcatgccattctcctgcctcagcctcccgagtagctgggactacaggtacccgccacctcacctggctaattttttgtatttttagtagagacagggtttcaccatgttcaccaggatggtcttgatctcctgacctcgtgatccgcccacctcagcctcccaaagtactgggattacaggcgtgagtcaccatgctcagcctgagttgatttttaaccactaggtttaggccaggcaggcccaggcccagttttgggcctggcgctgggctgcctgtctttggtttcacttccttgtttttttcttgaaacaggtacttagtataaaacaatataaaacaatatgagagggtctctctcttccctcagatccaatatacacactcagagttataatggaaataagaacacttttgcctaaagacgcctacaatgaaaggaagaacccttttgcctaaagaggcctcagaaagactttaacacagctttagcaggagggtgggagaaggcaactagaagcagagggattaatttgaaaatctcccaatgacacaccaatagtttccccatcccaatgtacatgaagtaattgtcaggcctctgagcccaagctaacccatcatatcccctgtgacctgcacatatagatccagatggcctgaagcaagtgaaggatcacaaaagaagtgaaaatggctggttcctgccttaactgatgacattaccttgtgaaattccttctcctggctcagcagctcccccattgagcaccttgtaacccccgcccctgccaccagagaacaacccctttgactgtaattttccactacctacccaaatcctataaaacggccccacccctatctccctttgctgactctctttttggactcagcccgctggcacccaggtgattaaaaagctttattgctcacacaaagcctgtttggtggtctcttcacacggacgcacatgacatttggtgccaaagacctgggacaggaggactccttccagagacttgtcccctgtcctcgtcctcactccgtgaggagatccacccacgacctcaggtcctcagaccaaccagcccaaggaacatctcaccaatttcaaatcggttaagcggtcttttcactctcttctccagcctctcttgctacccttcaatctccctctctcgctatccttcaatctccctgtccttccaattccagttttttttcctctctagtagagacaaaggagacacatttcatccgtggacccaaaactctggtgctggtcacggacttgggaagacagccttcccttggtgtttaatcactgtggggacgcctgcctgattattcacccacactccattgttgcctgatcaccatggggatgcctgccttcattcacccacattcacttggtggcatgtcaatggtgggaatgcctgctttggctgctcacccacactgcagcccagggctgctcaccaccccccttctccatgtctctaccctctcttttctctgggcttgcctccttcactatgggcaaccttccaccctctattcccccttcttctcccttagcttgtgttctcaaaaacttaaaatctcttcaactcacacctgatctaaaacctaaacaccttgttttcttctgcaatgccacttgaccccaatacaaactcgacaattgttccaaatagccagaaaatccactttcaatttctccatcctacatgatctagatagttcttgtcataaaatgagcaaatggtctgaggtgcctgacgtccaggcattcttttacacatcagtccctccctagtctctgttcctaatgcaactcatcccaaatcttccttctttccctctcgcccgtcccctcagtcccaaccccaagcgtcactgagtcttttcaatcttccttttctaccaaccaatctgatctctcccctcttccccagagtgctcctcctcagtttgctccccgccaggctgaatcaggctccaattcttcctcggcctccactccccgacactataatccttctatcacctcccttccttacacctgctctggcttacagtttcattctgagactagccctcccccacctgcccaacaatttcctcttaaagaggtggctggagctaaaggcatagtcaaggttaatgctccttttctttatctgacctctcccaaagcagttagtgtttaggctctttttcatcaaatgtaaaaatccagcccagtttatggcttgtttagcagcaaacttgagaccctttaccaccctagaccctaaaaggtcagaaagccgtcttattctcaataagcattttattacccaatccgctcccgacattagaaaaagctccaaaaattagattccggccctcaaaccccacaacaggacttaactaacttcaccttcaaggcatacaataatagagttagaggcggccaagtagcaacatatttctgagttgcaattccttgcctccactgtgagagaaaccccagccacatctccagcacacaagaacttcaaaacgcctaagccacagtggtcaggcattctttcaggacctcctcccccaggatcttgcttcaagtgccggaaatctggccactgggccaaggaatgcccgcagcccgggatacctcctaagccatgtcccatctgtgcagaaccccactggaaatcggacagtccaactcacccatcagtcactcccagagcccctggaactctggcccaaggctctcggattgacgccttcccagattttctcagcttagcggctgaagactgacactgcccgattgcctcggaagtctcctggaagcctcctggaccatcacatatgctttgggtaactcttacattgagaggtacatctgtcaccttcttaatcaatatggaggctacccactccacattaccttcttttcaagggcgtgtttcccttgcctccataactgttgtgggtactgacgtctgggcttctaaatctcttaaaactccccaactctgatgccaacttggacaatattcttttatgcactcctttttagttatccccaccttcccagctcccttattagactgacacatcttaagcaaattatctgcttccctgatgccacccttcttcccaacccaaagcctccttcacatcttcctctcatatccccctacttctactacctccctggcaactgatcacatgtccattactatcccattaaaccctaatcaccattaccttgctcaacaccagtatcctatcccacaacaggctttaaggggattaaagcctgttatcactcacctgctacagcatgggcttctaaaacttataaactctccttacaattcccccattttacctattcaaaaaccagacaagtcttacaggttagttcaagatctgcgccttatcaaccaaactgttttgcctatccaccctctggtgcccaacccgtacactcttttgccctcaataccttcctccacaactcactattccattcttgatcttaacgatggttttttcactattccactgcacccctcatcccagcctctctttgcctttaccctgacacccatcagtccctgcaaattacctgggctgtactgctgcaaggcttcagggacagccctcattacttcagccaagctctttctcatgatttactttctttccactcctccacttctcaccttattcaatatgttgatgacctactttgtagccctgcctttgaatcttctcaaaaagacaccctcctgctccttcaacatttattctccatgggatatcaagtatctccttccaaagctcaaatttcttctccatccattacctaacttggcatagttcttcatgaaaacccacgtgctctccctgctgatcatgaccaactgatctctcagaccccaaccccttctacaaaacaacagctcctttccttcctgggcatgattggatactttcacctttggatacctgcttttgccatcctaacaaaaccatcacataaactcacaaaaggaaatttagctgaccccatagatcctaaatcctttgcccactcctctttccgttccttgaagacagctttagagactgctcccacactagctctccctgactcatcccaacccttttcattacacacagccaaagtgcagggctgtgcagttggaattcttacacaaggaccaggaccacaccttgtagcctttttgtccaaacaacttgaccttactgttttaggctggccatcatgcctccgtgcggcagctgctactgccataacacttttagaggccctcaaaatcacaaactattctcaacacactctctacaattctcataacttccaaaatctattttcttcctcacacctggtgcgtatgctttctgctacccggctccttcagctatactcaccctttgttgagtctcccacaattactattgttcctggcctggacttcaatccagcctcccacattattctgaataccacacttgacccccatgactgtatctctctgatccacttgacattcattccatttccccatatttccttctttcctgttcctcaccctgatcacacttggtttatcgatggcagttccaccaggccaaatcaccactcaccagcaaaggcaggctatgctatagtatcttccacatctatcattgaggctaccgctctgcccccctccactccctctccgcaagccgaactcattgccttaactagagccctcactcttgcaaagggactacacatcagtatttatactgactctgaatattccgtccatatcctgcactaccatgctgttatatgggcagaaagaggttgcctcactatgcaaaggtcctccatcattaatgcctctttaatgaaaactcttctcaaggctgctttacttccaaaggaagctggagtcatatactgcaagggccatcaaaaggcatcagatcccatcgctcaggacagtgcttaggctgataaggtagctaaagaagcagctagtgttccaacttctgtccttcagtgccagtttttctctttctcactggtcactcccacctattcccccactgaaacgttcacctatcaatctcttcccacacaaggcaaatggttcttggaccaaggaaaatatctccttccagcctcacaggcccattctattctgtcgtcatttcaaaacctcttccatttaggttacaagccactagcccgcctcttagaacctctcatttgctttccatcatggaaatctatcctcaaggaaatcacttctcagtgttccatctgctcttctactactcctcagggattactcaggccccctcccttccctacacatcaggctcagggatttgcccctgcccaggactggcaaattgactttactcacatgccatgagtcaggaaactgaaatacctcttggtctgggtagacactttcactggatgggtaaaggcctttccctcagggtctgagaagtccactgcggtcatttcttcccttctgtcagacataattcttcagtttgggcttcccacctctatacagtccaataacggaccggcctttattagtcaaatcacccaagcagtttctcagtctcttggtattcagtagaaccttcataccccttaccaacctcaatctttaggaaagatagaacggactaatgatcttttaaaagcacacctcaccaagctcagcctccaacttaaaaaggaggactctgtcaaggatagagcccaaaaactcaccaaccaagcaagtaattacactgaaccccttggacactctctaattggatgtcctgggtcctcccaattcttagtcctttaatacctgttttcctctttctccttgtgtcttctgtctagtttctcaattcatacaaaactgtatccaggccatcaccaaccattctatacaaccaatgtcacttctaacaaccccacaatatcaccccttaccacaaaatcttccttcagctaaatctctcccactctaggctcccacattgcccctaatcccactcgaagctgccctgagaaacattgaccattatctctccataccacccccccaaaatttttgctgctctaacacttcaacattagtttatgttatttttcttattaatataagaagacaggaatgtcaggcctctgagcccaagctaagccatcatatcccctgtgacctgcacatatagaatcagatggcctgaagcaagtgaagaatcaccaaagaagtgaaaatggcctgttcctgccttaactgatgactttaccttgtgaaattacttcccctggctcagaagctcccccattgagcaccttgtgacccctgcccctgtccgccagagaacaacccttttgactgtaattttccactacctacccaaatcctataaaatggccccacacctatcttccttcactgactctctttttgaactcagcctgcctgcacctaggtgattaaaaagctttattgctcacacaaagcctgtttggtagtcacttcacacagatgagtgtgacagtaaaataatcagactgggcccaataaacattcattgcatatgtatacaagaaaataataaatgtacagagaactaactgataactctcccatttagaagaaagactaacacgaaaccagataaatacataaaacagcagaagaaaactacacctgccacctaaaactaacccagttttgctgtttatatatgaaaacacaacgaaaaaatcatcagaaatatggaagaaaacagctattagtaacatgaaaaagaccaagaaaactgacttgagaaaaatcaacaaaatatacattcttctcagcaccacatcaatgaccacatagttggaagaaaagcactcctcagcaaatctaaaagaacagaaattataacaaactgtctctcagaccacaatgcaatcaaactagaactcaggattaagaaactcactcaaaaccactcaactacatggaaactgaacaacctgctcctgaatgactactgggtacataacgaaatgaaggcagaaataaagatgttctttgaaaccaatgagaacaaagacacaacataccagaatctctgggacacatttaaagcagtatattggagggaaatttatagcactaaatgcccacaagagaaagcaggaaagatctaaaattgacaccctaacatcacaattaaaagaactagagaagcaagagcaaacacattcaaaagctagcagaaggcaagaaataactaagatcagagcagaactgaaggagatagagacacaaaaaacccttcaaaaaaatcaatgaatctaggagctggttttttgaaaaggtcaacaaaattgatagaataataaagaagattgcaagactaataaagaagaaaagagagaagaatcaaatagacgcaataaaaaatgataaaggggataacaccaccgatcccacagaaatacaaactaccatcagagaatactatgaacacctctatgcaaataaagtagaaaatctagaagaaatggataaattctgggacacatgcaccctcccaagaagaagttgaatctctgaatagaagaataacaagcttggaaattaagacaatagttaagagcctaccaataaaaaaaagtccaggaccagacggattcacagatgaattctaccagagatacaaacaggaactggtaccattccttctgaaactattccaatcaatagaaaaagagggaatcctccctaactcattttatgaggccagcatcatcctgataccaaagcctggcagagacacaacaacaaaaaaaagagaattgtagaccaatatccctgatgaacattgatgcagaaatcctcaataaaatactggcaaaccgaatccagcagcacatcaaaaagctatccaccatgatcaagtggggttcatccctggaatggaaggctggttcaacatatgtaaatcaataaatctaatccatcatatgaacagaactaaagacaaaaaccacatgattatctcaatagatgcagaaaaggccttcagcaaaattcaacagctcttcatgctaaaaactctcaataagctaggtattgatgggacgtatctcaaaataataagagctatttatgacaaacccacagccaatatcatactgaatgggcaaaaatggaagcactccctttgaaaactggcataaaacagggatgccctctctcaccactcctattcaaaatagtgttggaagttctggcctgggcaattgggcaggagaaggaaataaagggcattcaagtaggaaaagaggaagtcaaattgtccctgtgtgcagatgacatgactgtatatttagaaaactccctcgtctcagcccaaaatctccttaagctgataagcaacttcagcaaagtctcaggatacaaaatcaatatgcaaaaatcacaagcatttctatataccaataacagacagagagccaaatcatgagtgaaccgccattcacaattgcttcaaagagaataaaatacctaggaatccaacttacaagagatgtgaaggacctcttcaaggagaactacacaccactcctcaatgaaataaaagaggatacaaacaaatggaagaacattccatgctcatgggtaggaagaatcaatatcacgaaaatggccatactgcccaaggtaatttatggattcaatgccatccccatcaagctaccaatgactttcttcacagaatcagaagaaactattttgaagtttatatggaaccaaaaaagagcccgcattgccaagacaatcctaagacaaaagaacaaagctagaggcatcatgctacatgacttcaaactatattaaaaggctacagtaaccaaaacagcatggtactggtaccaaaacagagatatagaccaatggaacagaacagaaaccttagaaataataccacacatctacaaccacctgatctttgacaaacctgacaaaaacaagaaatggggaaaggattccctatttaaaaaatggtgctgggaaaactggctactcatatgtagaaagctgaaactggatcccttccttacaccttatacaaaatttaattcaagatggattaaagacttaaatgttagacctaaaaccataaaaaccctagaagaaaacctaaggaataccattcaggccacaggcatgggcaagaacttcatatctaaaacatcaaaagcagtggcaacaaaagccaaaattgacaaatgggatctaattaaactaaagagcttctgcacagaaaaaaaaaaaaaaaaaaaactatcatcagagtgaacaggcaacctacaggatgggagaaaatttttacaatctacccatctgacaaagggctaatatccagaatctacaaagaacttaagcaaatttacaagaaaaaatcaaacagctctatcaaaaagtgggcaaaggttacgaacagaaacttctcaaaagaagacatttatgcagccaacagacacatgacaaaatgctcatcatcactggccatcagcgaaatgcaaatcaaaaccacgatgagataccatctcacaccagttagaatggcaatcattacaaagtcaggaaacaacagtgctggagaggatgtggagaaataggaaggaacacttttactctgttggtgggactgtgaactagatcaaccattgtggaagacagtgtggcaatttctcaaggatctggaatcaacagatgctgagaataagcatcacattaactatacaactccattcagaataacaaaacagtttaagtctccctctctccctcttctgtttgcagaagctcagaaaccaggattctagcccttaaaataaaacctaaaaactgctccctaaagatagggataacatcatgagggaaggttccctctgtggatctgggatgacaaagagcaggacttccagtcactccaaatttcatctcacttaaagtttgggagaaagccgataaagcaactagaaagagttattttcttttttttttctgagacagtctcgctctgtcgctcaggctggagtgcagtggcgtgatctcggctcactgcaagctccaccgcccaggttcacaccattctcctgcctcagcctccagagtagctgggactacaggcgcctgccaccacacccggctaatttttttgtatttttagtagagatggggtttcaccgtgttagccaggattgtctcaatctcctgatctcgtgatctgcccgcctcggcctctcaaagttgctggaattacaggtgtgagccaccacacccagcctagaaagagttattttcaaagataaatactctccccccttaccttggcattgcccttgcacaattttcacataggcacctaaatagaagcctggttattgatacatgtgcccagttataggactgataacaattttctgaattaagagaaagtcctgttggggaaacagatgtaaacaaaagcaaaagaacccatgccaactacctagtttacccagcttacttaggactttcttcaaaacatataaactaacaatcaaagatcgccagatatttgcatacagttaatagcatggaagaaataaacaagaatgacccaaaagaaaatagaggtaattgaagacacagaagaaaacattttaaaatctgtagctaatatcctaaacaaatttgagaggctctgccatccataaaaaaaaaaagtaggctgcaatgaaaagaaaaaaattgagaactaaagtatgattgaaataagaagttataagtgcaatgtggtgctgagaagaatgtatattctgttgatttggggtggagagttctgtagatgtctattaggtctgcttggtgcagagctcagttcaattcctggatatccttgttaactttctgtctcgctgatctgtctaatgttgacaatggggtgttaaagtctcccattattattgtgtgggagtctaagtctcttttatgcagccaataaacatatgatgtaatttcactcaaaagcacaaactgttgttttttagaattttatgttgtttataaagactatttagaacaataaacaataatgtttagaaacagaatataaatgaaaataactttttaagtctaaagattatattttagttctctaattttccttttccatagcagcctatttttgttttatgcgtgccagatctgctcacatttattttatttagtatattagttacaatttttaaaagataccttccatgacttcaattacttctatttcctttgaggttatttgctctatacatttctcttattcatttcttccatgttcctgattttatgaaaatatctggtagcaagtatctggttgttagttacatttttcagatattaaaaatgtgccagagaaataaaaacattgcaagcatggcacagtaacagaataacagttcatggaacatgtgtttatcaggctccaggattctcatggaccaatgtctctaaattgctctggagaaacaggcactcactaagcaggagattcctagaatacatcgctgctgtccttaaagtctcagtaagggccaggaccaagaatcattctcatcaacatttaagctaagcagacaatattaggcagtgccacaccacaataggaaccttaatatattgaagccagacccgaaacctggacagttagctacataggttcacttctgtcatttttataaactcacaatcaatgtcacctacttttataaaattgagtatttcgtaccccacttaccacatttggcaggattttactatattgatacattattgggatgggagagacattcctttataccacactaaagacaaaattgaaaagaaaaatacaaaaacagatttggctcataaatagcaaaaatgtctgcatccaaaaacacaatctgtactagtaaaaatcaaggtgcaaagtaggaaaaaagatgccacttacatgaaagaaatttaatacttttaatatatacagaaaatatacaaatctataagaaaaaaagctctactaaaaaaataaactaacaacataattaggcatttcataaaagagggaaaaaaagactaataagggtattttaagaagttgaaagaaacgagaaaggagttccaagatggccaaataggaacagcttcagtctacagctcccagcatgagcaacacagaagatgggtgatttctgcatttccaactgaggtaccgggttcatgtcactgggacttgttggacagtgggtgcagcccacagagtgtgagccaaagcagggggggcattgcctcacccgggaagtgcaaggggtcggggaattccctttcctagccaggggaagccatgacagacagtacctggaaaatagggacactcacaccctaatactgcgcttttccaatggtcttatcaaatggcacaccaggagattatatcccgcccatggctcggagggtcccacgcccatagagctttgctcactgctagcacagcagtctgagatcaaattgcaagccagaagcaaggctggggggaagcgcgtctgccattgctgaggcttgagtaggtaaacaaagcagccaggaagctcgaactgggtggagcccatggcagatcaaggaggcctgcctgtctctgtagactccacctctaggggcagggcttagctgaacaaaaggcagcagaaacttctgcatacttaagcatccctgtctgacagctttcaagagagtagtggttctcccagcacggagtttgatatctgagaaccgacagactgcctcctcaagtgggtccctgacccccaagtagcttaactgggagacatctcccagtagtggccgactgacacctcatacagccaggtgtccctctgagacgaagcttccagaggaagggtgaggcagcgacatttgccgttctgcaatatttgctgttctgcagcctccactggtgatacccaggaaaatagggcctggagtggacatccatcaaagcccaacagacctgcagctgaggttcctgactgttagaaggaaaactaacaaacagaaaagacattcacaccaaaatcccttctgtacatcaccatcattaaagaccaaaggtagataaaaccacaaagatcgggagaaaccagagcagaaaacctgaaaattctaaaaatcagagctcctcttctcctccaaaggaatgcagcccctcactggcaacagaataaagctggatggacaatgactttgatgagttgagagaaggcttcagacgatcagtaacaacaaacttctccaagttaaaggaggatgtgcgaatccattgcaaagaagctaaaaaccttgaaaaaagattagatgaatggctaacaggaataaacagcatagagaagagcttaaatgacctaatggatcaaatgaatgaaatgaagtgagaagagaagtttagagaaaaaagagtaaaaataaatgaagaaagcctccaagaaatatgggactatgtgaaaaggccaaatctatgtctgattggtgtacctgaaagtgaaggggagaatgcaaccaagtgggaaaacattcttcaggatattatccaggagaaattccccaacctagcaaggcaggccaacattcaaattcaggaaatacagagaatgccagaaagacactcctcgagaagagcaactccaagaaacataactgtcagattcaccaaagttgaaatgaaggaaaaaatattaagggcagccagagagaaacgtgaggttacccacaaagggaatcccatcagactaatagcagatctctcggcagaaaatctacaagccagaagagagtaggggccaatattcaacattcttaaagaaaagaattttcaacccaaaattttatatccagccaaacgaagcttcataagtgaaggagaaataaaatcctttacaggcaagtaaatgctgagagattttgtcaccaccaatcctgccttacaagagctcctgagggaagcattacacatggaaaggaacaaccagtaccagccactgcaaaaacatgccaaatcgtaaacaccatcgatgctaggaagaaactgcatcagctaacgagcaaaataaacagttaacatcataatgaaacataacaatattaaccttaaatgcaaatgggctaaatgctccaattaaaagacatagactggcaaattggataaagagttaagacccatcagtgtgctgtattcaggagaccaatctcatgtgcacagacacacataggctcaaaataaagggatggaggaagagctaccaagcaaatgggaaacaaaaaaaagcaggggttgcaatcctagtctctgataaaacagacttttaaccaacaaagatcaaaagagacaaagaagtccattacataatggtaaagggatcaattcaacaagaagagctaacaaccctaaatatatatgcacccaatacaggagcacccagattcacaaagcaagtccttagagacctagaaagagacttagactcccacacaataataatgggagactttaacaccccactgtcaacattagatcaatgagacaaaaagttaacaaggatatccaggaattgaactcagctctgcaccaagaggacctaatagacatccacagaactctccaccccaaatcaacaggatatacattcttctcagcaccacatcacacttattccaaaattgaccacatagttggaagaaaagcactcctcagcaaatctaaaagaacagaaattataacaaactgtctctcagaccacagtgcaatcaaactagaactcaggattaagaaactcactcaaaaccactcaactacatggaaactgaacaacctgctcctgaatgactactgggtacataacaaaatgaaggcagaaataaagatgttctttgaaaccaatgagaacaaagacacaacgtaccagaatctctgggacacatttaaagcagtgtgtagagggaaatttatagaactaaaggctcacaaaagaaagcaggaaagatctaaaattgacaccctaacagcacaactaaaagaactagaaaagcaagagcaaacacattcaaaagctagcagaaggcaagaaataactaagatcagagcagaactgaaggagatagagacacaaaaaacccttcaaaaaatcagtgaatccaagagctggctttttgaaaagatcaacaaaattgttagaccactagtgagactaataaagaagaaaagagagaagaatcaaatagacacaataaaaaatgataaaggagatatcaccaccaatcccacagaagtactaactaccatcagagaaaactataaacacctcaatgcaaatcaaccagaaaatctagaagaaatggatacattgctagacacatacaccctcccaagactacatcaggaagaagttgaatcccttaatagatcaataacaggctctgaaattgaggcaataatgaatagcctaccaaccaaaaaaagaccagaaccagacggattcacagctgaattctaccagacataaaaagagttgttaccattccttctggaactattccaatcaatagaaaaagaggaaatcctccctaactcattttatgaggccagcatcatcctgataccaaagcctggcagagacacaacaacaaaaaaagagaattgtagaccaatatccctgatgaacattgatgcaaaaatcctcaataaaatactggcaaaccgaatccagcagcacatcaaaaagcttatccaccccgatcaagttggcttcatccctggaaagcaaggctggttcaacatacacaaatcaataaatgtaatccagcatataaacagaaccaaagacaaaaaccacgattatatcaatagatgcagaaaaggccttcagcaaaattcaacagctcttcatgctaaaaactctcaataaactaggtattgatgggatgtatctcaaaataataagagctatttatgacaaacccacagccagtatcatactgaatgggcaaaaatggaagcattccctttgaaaattggcacaagaccgggatgccctctctcaccacttgtattcaaaatagggttggaagttctggccagggcaatcaggcaggagaaagaaataaattgtattcaattaggaaaagaggaagtccaattgcccctgtttgcagatgacatgactgtatatttagaaaactccctcgtctcagcccaaaatctccttaagctgataagcaacttcagcaaagtctcaggatacaaaatcaatatgcaaaaatcacaagcatttctatataccaataacagacagagagccaaatcatgagtgaactcccattcacaattgcttcaaagagaataaaatacctgggaatccaacttacaagggatgtgaaggagctcttcaaggagaaatacaaacccctgctcaacgaaataaaagaggacacacaaaaaaatggaagaacattccatgctcatgggtaggaagaatcaatatcacgaaaatggccatactgcccaaggtaatttatggattcaatgccatccccatcaagctaccgatgactttcttcacagaactggaagaaactactttgaagtttatatggaaccaaaaaagagcccgcattgccaagacaatcctaagacaaaagaacaaagctggaggcatcttgctacctcacttcaaactatattaaaaggctacagtaaccaaaacagcatggtactggtaccaaaacagagatatagaccaatggaacagaacagaacccttagaaataataccacacatctacaaccacctgatctttgacaaacctgacaaaaacaagaaatggggaaaggattccctatttaataaatagtgccgggaaagctggctagccatatgtagaaagctgaaactggatcccttccttacaccttatacaaaaattaattcaaggtggattaaagacttaaatgttagacctaaaaccataaaaaccctagaagataacctaggcaatagcattcaggacataggcatggtcaaggacttcatgactaaagtaccaaaagcaatggcaacaaaagccaaaattgacaaatgggatctaattaaactaaagggcttctgcacagcaaaagaaactaccatcagagtgaacaggcaacctacaggatgggagaaaatttttacaatctacccatctgacaaagggctaatatccagaatctacaaagaacttcaacaaatttacaagaaaaaatcaaacaaccccatcaaaaagtgggcaaaggatatgaacagaaacttctcaaaagaagacatttatgcagccaacagacacatgaaaaatgctcatcatcactggccatcagagaaatgcaaatcaaaaccacaatgagataccatctctcaccagttagaatggcaaccattaaaaagtcaggaaacaacaggtgctggagaggatgtggagaaataggaacacttttacaccgttggtgggactgtaaactagttcaaccattgtggaagacagtgtggcaattcctcaaggatctagaactagaaataccaattgacccagccatccccttactgggtatatacccaaaggattataaatcatgctgctataaagacacatgcctacagatgtttattgcggcactattcacaatagcaaagacttggaaccaacacaaatgcccatcaatgatagactggattaagaaaatgtggcacatatacaccatggaatactatgcagtcataaaaaaggatgagttcatatcctttgcagggacatggatgaagctggaaaccatcattctcagcaaactattgcaaggacagaaaaccaaacactgcatgttctcactcataggtgggaattgaacaatgagaacagttggacacgggatggagaacataacacaggacggcctgtcatgggatggggggaggggggatggatagcattaggagatatgcctgatgtaaatgatgagttaatgggtgcagcacaccaacatggcacatgtatacatatgtaacaaacctgcacgttgtgtacatgtaccctagaacttaaagtataaaaaaaaaaaagaaaggcaaagaaaattctgcaggcaattgtcattaccattattttaatttggagtattgaacagttcagatggaggacgaaagataatcatctagtctgacaatcaaaatatatattttaagttggctatatctacagatattcaattttacactgatgaatatgcacaatgggcagaatttgcttaacagaactgaccatatattgaacacttggtttactatttgactctatcctgactatataacagaagatttaaaaagatcaattcccatggttttgctttaatgtaaatagactgaattataatcagaagaaagtttccatccatgatagtaaataaatggtctcagtgaaatgaagattcagaagcacttattttaataattttcataatgctattcaaaggtatctacaaatatacagcggtaggatagtagtatcttttattggtatctttcaattttgctaatttttatgggaaacttttggttatactctagaaagaataataatttaactcatctttggttctcaagaattttataaggtgcagcaattttactattaaattgtgtattttcaaagaaaaaaagaaataaacataaacatttatctcagcatgatggctcatgcctgtagtcccagctactcaagaggctgaggtaggaggattgcctaagcctgggaggctgaggctgcagtaagctgagatcatgccactgcattccagcctgggcaacagactgattctctctctgtctctctctctctctgtctctctctctctctctctctacacacacacacacacacacacacacacaaacacacacacacacacacacacacacgttatcagaattctttcaagcctcacaagatagtggatacacaagggtacattaacatttgtgactgaattttgtggtcttcttaccctcactttgtgatccagagattccagtatttgccaagttttttaaagcattttgggcaagtctcacatcaaactaatacatccactccatccactccctctacctcactaaaaaatctttactatgcttgcattaacaaagatttaaaatgaagttaatgtccaactttggcaaagatgagaggaacaagacaccctttaaatctaccttcaaaagcacgttcccaggaggaaatttaacaatatgtatcccaaaccttcaaaataggcacactatatagacattcagctaacaattctatttctagaaaattaacctgaggaaataaacatgaatatatatatatgaagaactatatatgaatatgttcattacaatataattgatataagcaaaacattggaaataatctaaaagtccgaaaatatagttttggttaaatatattataataagcacatataaaggaaaattatgtatctattttaaagggtgatatagactttaacttactgatacaaaaacaatcatcatagttttatgatatgaaacatcaagttacaaaaattatatagagcacaattccatgtattttcatttctaagaatatatatgtgtggacaaaagcttagaagaacatagagcaaaatgttacattggtctctggtcagtggtactacagatgcattttttattgcatatctgtattttcaaattagattgcattaaacatggctttcttgaatagttttaaaatattagagaatcactggcttacagctagcagtgtaagccagggaaagttatacaatgagacccaaaggtctaaattccaaggttaataatggattgtatgtttcaaaacaactaaaagaggacttcatatgttctcaacacaaagaaatgataaatatttgaagtgatggatatgctaatttgcacgatttgatcgtttcacaatgtataaaaatatcaaaacactacattgtaccctataaacatggttgtcctttagtattcttgggggattggctccaggaccccggcagatataaaaatccaaggatgctcaaatcacttattgtattaggccattctcacattgctacgaagaaatacctaagactgggcaatttattttaaaaagaggcttaattggctcacagttctgctggaggctgaggcgggtggatcacctggatcaggagttcgagaccagcctggccaacatggtgaaaccctgtctctaaaaaaatacagaacttagctgggcacagtggtgcatgcctgtagtcccagctactcaggaggctgaggcaggagaatcacttgaacccaggaagcggaggttgcagtgagccgagatcatgccactgcactccagcctgggcaacagagcaagaatccatctcaaaaaaataataataataaaataaaataaaataaaaatattgaattatcacccaacccccctaaattattatttttacttatatgtttttgtaagatatatgtaaaataaaacctaataaaacaggaatatttaggtaaaaagaatttgtgtcatctaacagaacaagggtcaagactttttttcatcgcaaaggttgttttcttttagattaatgcaatgttaatctcaatcaaagcttaataatgtaaagatagtttaggtcttgctaatgtcaaacatcatcctgccctttttgattcactgaataatgatatgaaacccaatcctacatttgataaaattccaacatctgtcaaaacctctgcattccttcattcttgtggatagtcactgttggttttgtagattagctttcactaacctcttcctcacttgcatcttatgagactcttttctttgtacttgatatggtttggctctgtgtccccatccaaatctcatctttaattgaactcccataattgccacatgttgtgggaggcaactggtgggagaaaattgaatcactggggtggtttcccccatactgttctcatggtggtgaataagtctcatgaagtctgatggttttatcaggggtttctgcttttgcgtcttcctcattctctctttgcctgctgccattcatataagatgggacttgctcttccttgccttccactgtgattgtgaggcttccccagccacatggaactgaaagtccagttatacctctttctttggtaaactgcccagactcgggtacgtctttatcagcagcatgaaaacagactaatggagtacgtaatcaatttagatgtgaaaattgacactttttgaaaacactagaggcagaggaattcagggttcagttgtttatatttaagcaacttttgtaatttaaagttgaaacttagaaatgccacttttactgggtgcagtggctcacatctgtaatctcagcactttgggaggctgaggtagaaggatccgttgagctcaggagttggagaccagcctaggcaacatggccaaaattagctgggcatggtagctcaagcctgtagtcacagctattcaggagctgaggcaggaggattgcttgagcccagaaggtcgaggctgcgatgagctgtgatcacaccactgcactccaacctgggggacagagcaagactctttctcaaaataacaacaaccaaaaaaaggaatttaaaaataataaaagaaagaaaaaagaaatgcccattcctaaaagtctttacccacctcacatctagtaatttctcactggagaccttctccacaagctgcattctcttgccatggtgctcagctttctttctcccttctctgacatttcctcttctcttgccctaattgccacctctggccattctgcaaaaatttgttcacttatctatcttctctatctcattaaaaactagattgtctcaaactttaaatgtggatagaaattacctgaaagtcttgtttaaatgcatattctggatgagtacatccagggtagggccagatatatttcatttttagttaagtccccaggtaaacctgatgctgatgttccacggaccatactggaatagcaaagttatagaccatgtttcagggacttcactttccaaaactcaagcttcttttcaaggtaatttctaatgtaacaacagttctcaccataggagtaatttcaatatcagctgttaccatattttttcgttctgctacattaatagccaactcagtgtaataatactaagtaactaccagctggtgtgttagcaggcatagtaaattatgccctccctctatcacaaagtttattcagataattaaaacaaccacacactttgtaatatatattaccaaaggttaaataggcaataagtatttatacttctcttagaggaaaatacattaatttcaaccttaagagaaaatgtttctaacagacatagtgccgaagaaatattccatgtgcttcattgagttttaactatttgaactataagcagaagtgcgtttgtcactttttttttttttttttggagatggagtctcgctctgtcgcccaggctggagtgcagtggcacgatcttagctcactgcaagctcagcctcctgggttcacgccattctcctgcctcagcctcctgagtagctgggactacaggtgcccaccaccatgcccagctaatttttttgtatttttagtagagatgagtttcactgtgttagctaggatggtctcaatctcctgaccctgagatccgcccgcctcggcctcccaaagtgctgggattacagccgtgagccaccgcgtctggctgcgtttgtcacttttaagctgaggcagttaaaaacaagtacaccacctccattgctcttttttttttttttttttttttttttttttgcaggaactttggatgctatgtgttccagatggtataactaaagatgaaagagatttatgcaaaccacactgaactttatatggttaagaaataatctcttattttgccaagccatcaagatttagaaatttgaaaatcaatttggagatttgaggattaatgtgttatcacttcatagaccatcttatcttaactaatataaaggtatgaaacatttaaactaatacctgtaacagaggttattcaataatgtgcttgtttctttgttaataataaaaatcagagggctctaataaaagtaaaaacacatagataaaatagagttgttcaggtttattccttgaataaaataaccaataaaacaaaagggcaaaagaaaaaaaaacaaaggcggttttttaaatattagagactagctattgagaaaaaaaaaacacttttctaaattatcctttaaatggaaaaattaagaccctgcaaagctttatgatagttcaattcatgattctaaaaaagggaaacaaaatcataaagtatgttaaaacttgaatagtctttggatagatcacctggcatgactgggaggatgacaaagaggaattgtctttcaaacagaaggaccagcatgtgaaaaggccataggggagaagggacagagaatggtccattttgagaggagaagcagggaaaggtcagttgtaggaagagataaggctggaatcccctagattttgagctttgcatgccaaattcagattgcagaaacagtgataggagacaaaaagcagcagctgatgcttttaaaattgattttatagaagcaaattgccatgttatggtgagggccacatggcgggaatggtgagaggtctcaggagctgagggcctcaatcctacacttgtgaggaactgaattctcccaacaatcaggaagcctggaagtggacttcaagcttcaaatgagatctcaaccatgaccaacccattgattttagccttgtgagattctgagcaacttaactggatttgtgcctggacttttgacctatgcaactgtgagataataaattgtgttttcctaagctgttaaatttttggtaatgtgttacaaagcaatagaaaatgaatacaaaaagagatagcataatttttaatcaggctgaatgtggtaatattgctgctttcattccatttgctagctagggctgccagcttccgttctaacagttggcttggttggctaatgccatcctagaccaatcttggcacacaccaaataacattgaaaagccagacattccttggcataatgtaacagaaagaattcaaaaagactaggagacagaaattctggcttgaattttttacgtcacccctacctattctctcctcctcaatcatccccactctcccccaatatagaagagaagactacattttcactgatcctgtgaaaaacgattattggagaaaccactggaatttttaataagcattttactggcagttctccctagatcaaacatgctggtgggagggacagcaatggaaatgagcccccagatttcaagtggaatgggaagaaacaggggtggctgagcttagttagcagctcttactcacctgaacaaaaactggggtgtgtgtagtgatcacattttggagaaaggattaacaagcagagatctcacgagattgagatgaatagacaacccaccgatttcttcactgtttcatgcacaaactccctatactagcaaatagaggctgtacttcaaccacaataaaaataaatcactgcctctccttaatcaccaattttgagttatctgactgatccagaacctcttgagtgaaggagaggagagaggcccttaaggaagtatccttctgttacagtttcatactataagcttttctcccagtttctccaaactaaagtatcttacctgaataactacactgaagagaaacatcccaaaaacctttagtgattattagatagtgggctttgaggaagcaaaatgtctaagacctaatgtatgctgattaaggtatgctggttggaattgaggcttatgcaagtcagctgataagcagaattctgtcctaaaaccatctaactataggcctaatcagactcaaacccaaagctttcattccttccctaggactgagagcagtggactctcagtggactcttcagcaagagtttggtcatgttggaacattcctgcagaagtgagagaagttgttatgtacctgagtgtccatcactaaggtagaagaataaattttggtagatgtcttatttttgaggcatattccattttaaggttttctactatgatctatttaccacaggagtcgaaaggctgccaaatatagatgggaaccatagtaagagaatgctctccagctagttcaaagttcaaatcaagtggtctgtcacttggcctagccaatgatccatcagatccaattgtgctcaaattttctgaagagcaaggtcctcttcagaagctgcagcaagttccagaagagaaatttcagtagagatctccacgatttgtgcaagtctcatttccttcagcaagcaattcgttttcttttgagaaactgctcttgggttttttgttgtttgtttgttttttgggacttaagtggagtctgaaaatctgactatctgacacctggtgaccatgagatgtaaacagctcatcataagcgggatgctgtcttttccattgagctatgtagttgtgatagcataaaccatgctcaactgttataaataagatgagcctaaaggcataacttagttgccaacacaggttggtcactctcttgacttcctcctcaccctcaaaccccctcattggtctcataagaagagatctatgaccaactaatctctggcttacagatgtgttaatctgtctgcatcactacaaaggaatacttgagggtggataatttataaagaaaaggagtttaataggatcaccattctgcaggctgtacaagaagcatggtgccagcatctactcctggtgagggcctcaggaagcttccaatcatggtagaaggcaaaaggggagcagtggatcacatggccagaatgggagcgcgagctagaaggagaggtcccagactttaaacaaccagatctcacgtgaacctctgtgaatctcatatgagaagtcactcatcacctaggggctggtgctaagttattcataagggacctacccccatgaccaaaacacctcccaccaggcaccacctcctacaatggaggtgccttccctcccctccccttccgttccctttccttttctttcttttctgttgcaggaagtcagggaccctgaatggagggaccggctggagccacagcagaggaacatgaattgtgaagatttcattttaatatggacatttatcagttcccaaattaatacttttataatttcttatgcttgtcttactttaatctcttaatcctgttatcttcctaagctgaggatgtacatcacctcagggccactatgataattgtgttaactgtacaaattgattgtaaaacgtgtgtttgaacaatatgaaatcagtgcaccttgaaaaagaacagaataacagtgattttagggaacaagggaagacaaccataaggtcttactccctgcggggttgggcaaaaacagccatatttttcttcttgcagagagcctataaatggatgagcaagtaggagaacattgctaaattcttttcctagcaaggaatattaatattaaggccctgtgaaaggaattcattcctggggggccgcttataaacggccactctgggaacgtctgtcctatgcggttgagataaggactgagatacaccctggtctcctgcagtaccctcaggcttactagggtggggaaaaaacctcaccctggtaaatttgaggtcagactggttctctgctctcgaaccctattttctgttgtttaagatgtttatcaagacaatatgtgcaccacggaacaaagacccttatcagtaattctgcttttgccctttgccttgtgatctttgttctcccttttgccctttgaagcatgtgatctttgtgacctgctccctgttcttacacccactccccttctgaaatccttaataaaaacctgctggttttgagggtcaggtgggcatcacagtcctacagatacgtggcgtcacccccggaggtgcagctgtaaaattcctctctttgtactctttctctttatttctcagccagccaacacttatggaaaatagaaagaacctatgttgaaatattgagggcaggttcggatttcctaggccaactaagaatccctaagcctagctgggaaggtgactacatccacctttaaacaaggggcttgcaacttagctcacacccgaccaatcagagagctcactaaaatgcgaattaggcaaaaacaggaggtaaagaaatagtcaatcaactattgcctgagagcacagcgggagggacaaggatcgggataaaaacccaggcattcgagccggcaatggcaaccccctttgggtcccctccctttgtatgggagctctgttttcactctatttcacaatattaaatcttgcaactgccctcttctggtctgtgtttgttacggctcaagctgagcttttgctcgccgtccacaactgctgtttgccgccgtcgcagacccgctgctgactcccatccctccggatccggaagggtgtccgctgtgctcctgatccagcgaggcgcccattgccgctcctgatctggctaaaggcttgccattgttcctgcatggctaagtgcccgggtttgtcctaatcgagctgaacactagtcactgggttctacggttctcttctgtgacccaaggcttctaatagagctataacactcactgcatggccgaagattacattccttggaatccatgaggccaagaaccccaggtcagagaacactaggcttgccaccaccttggaagctgcctgccaccatcttggaagcagctcaccaccatcttgggagctctgtgagcaaggaccccccggtaacaacctgatacttttcttttcttttctatttttattttttatagagtctcattctgtcaccaaggctggagtgcagtggcatgatctcgattcactgcagccttcacctcccaggtcccagcgattctcctgcctcagcctcctgagtagctggaattacaggtgggcaccaccacatctggctaatttttgtatgtttagtaaagacagggtttcatcatgttggccagactgatcccaaactcctgacctcaagtgatccacctgcctcggcctcccaaagtgctaaagacttgagattacaggcatgagccactgcgcctggccagaagtcacttttcaacatgagatatggaggggacaaaacatcctaaccatatcaacagacgcctctctgtggtataccaatatgagccagatgtatacctcctataaagctacagccaaaaactaacaaactaacctctctcaggggtggtcctgagaggcactggagaagcaaaaccctcactatgggcagacatataagtggcatttctcattgttcactttgcctacaatgagaaattgcctgagatggttgcaaatggtctttccagaggttcagtgacttgtaaagaggtagatcacaggcttagggacgaagttcaagcaagaattgtcccagagatgagaatgtttgtgttccaggtgaacattcacaagacagcaccacaccagagaagttattagtaataatgatggcagaatgacctacttaatgaccatcagttatgtttcctctcaagactatctagtgcaaggaccacaaactaaaaattctaagtgtccagtaggcagcataaacaaaggaagataatttggttaaagacaatgggagatgctcagcattgtagcaaactgcagcgggcacattctatctaaagaaggcagatcaccacacctgtaatcccagcactttgggaggccaaggcgggtggatcacaatgtcaggagttcaacaccagcctggccaacatggtggaaccccatctctactaaaaatacaaaaattagctgggcgtggtggcaacatgcctgtagtcccagccactcaggaggctgaggcagggcgacagagcaagactctgttccaaaaaaaaaaaaaaaaaagaagaaggcagctcacaatcagcttcagctgaatcttaccatgttgggatgtgcgccagtgttgtcagatgttccttcattgtttctcaagagaagccataaaaccaaatgttgacatgaaatgttccaatttttgaaacgtataagggccaaacacagaagtttataggccacatatggctttcgggttgcccccagtctaatgtttatccaatatttatttaaaaaggaagccacagtggcaaggatggaggctacacattggccacactggatctgccacatgaactttccttcactaaggcccacccagactctccttataaaagtaaaaacaccaaatttttctgcaggattgctattcctcgagctgctaaaagttgaacatatcacatagttcaatcagattatccggtagattgttgattaagaagggctcttccatcatggaggagcagcataggtagagacacttattgggatttaatttttctgtcagcacaactattggtagacttattcaatgctttatgctaagccacacaacactacctctaaggatttaacaccacaattaaaacaaatcagtggaaggattatagttttccttggccttagtgtatatcctaatatctggaaggagctaaccttatggaatgatgaactcaccaattatagagggctcactcactgtaagacacaacactatctttcaaaatatggttttaaaaaatatggtatgttctctgtaccagcaatcattaaaatatagtgctatctaggcatagtggctcacacctgtaatcccagcactttgggaagctgaggccagagaatcccttgagtccaggagtttaagatcagcctgggaaacatagcaagatctcatctctactaaaaatcaaaaagaacattagttggtgtaatggcatgcacctatagtcctagttacttgggaggctgaggtggaaggatcccttgaacctggcaggtcgaggctgcagtgagacatgattgtgctactgcactcctccagcccatgcaacagaatgaggccctgtctcaaaaaataaataaataaataaataaaagattgtaggctggtccaatagtagtgggttatcagaacttgttaatattagtatcattaagttgatacacaacctccaactggcaaatttgactggcttaaaataaaataaaatacagcactattttactaaagccaaaatacacagatccagaataaagggaaaaaggaaagaagtacttgtcatgatatgatgtttaatgactgctatggctgaccccaaaagatgctgaagttgtaattccctagtacctgtaaatatgaccttatttggaaatagggtctttgcagatgatcaaattaagatgaggtcattagggtaggccttaatccagtgagtctggtgtccttataaaaaggggaaatgtgggcacagagacagacatgtacagagggaaaacgatgtgaagacacaggaataatgccaccccaaagccaaggaacatctgaggttaccaggagctaggagaaagcatgaaacatattctcccctcacagccctcagaagaaaccaaccttcctgataccttgattttggacttctagacttcaaaattgtgagaccacaactttctgttgtttaaaccacctactttgtggtactttattatggcagtcctaggggactaatacagttacctaatctcaaattttttacattccgtcctcacaactgcattcggctcacctacaaatttggaaaccaagaatggtttccaaggaatgcattcactaggggatctaacatattttccactgaattataagctcagactgctgtgttgccatttgaagctctttacctgctgaaaaaaaataaagaaataaaaatcagaggattatgttagaaggaagacaataatccaggcaaaatagtgttgttgccacatactaatcagggttaggtgtgaagcccctccaggatgactactgtccacaggagaaataggaaaagaaacaatggatggaccacccacaggtagggacaataagggctcggattcttcctgaatatgctatggttcatcttattgagcaaacacaaacatgaggcacttgcatcctgagggcaagagagctatgaaatgggtagggaaagagtcataaataccagctcatgcttgtaaccaagggagagaaaggcaagccctaaaaccattacctgtattcccttgcctgttttttttgtttttgcttttgttttctttttttttttttttttttgcatataagatgtgttggtacactataatgtatcattttatccataaagcatagcacagaaatacaggaatcatggccatcacttgatgatacctaggaaatggaagcctcaagccttcctctctgaatgtggtgcctggaaccaattgaggagagggttctttctctgtgcagtagttatttgcattatatcagataaatattttcaaatggtgtgtatggaaagaagggcaagtgtatttgttagacagccaataattagaatatgtagacttttcttatttctgtgtccttcccagcatccattcttttgtgggaactgttcttccggcactctgtgcaattctagtgagctgtcgatcacaggactccagtgccaggctaagccaaaatgatcagggcctcctaggaatttgagctgttcacagagacacataggactggaagacagaattgagtcatctgattggcagctcctcaagtactgtcacatgagttcccactgtataggtcacctaaatgttcgcattccttctgtaggcctggcttctgtaggcctggctgttcagctagccattcagtagccttccaataaattatttaactgctccttccttccttcctctcttttttcttttccttttttctttcctttagttagcaatagttcattactgttgcttataggcaaagaatactgtattatcaggcataatattttgaaggtttaagtatgtatatagatcgctcaagctgcaaaaatataaacttgatgaacagaaaaggtctattgtttcttagcacagaattaatagtaagagaatgtggcatagggtttgatgttgtattactgtatattagaaattgtttctaactcttccagcacaaactccaactgtaacctaaccttgataaaatctctccatcagtgcaacattttggactttttagtaaagataatttaagaaaagataagccttcataactagtaaaaggaatagttagagaaagaaagaagagggtacaaaagaggaggaaaatatgagtcagtagtgtctagagtagcctgcactggcccagggtggcagtctagataaggccaaattagcacagccaaagggacatcctctttctcctatttcctcaccacatgccttaagtgggaaatgattaaaatatgtagacagtatctattttatttttattatttttggagacaggatctcgctctatcacccaggctggagtgcagtggcataatcatgctcactgcagcctcaacctcctgggctcaagtgatcttcccaccttagacccctgagtagctgggcctacaagtgtgtaccaacacatccggctaatttttttttttaatttcttttgtaaagacggggtcccactatgctgcccaggctggtcttgaactcctggcttcacgcgatccttcctcctcagcctcccaaagtgctgggattacaggcatgagcggctatgaccgggtgacagtatatatgttaaatatagagattctcatctctctctctcatacatatatgtatgtatatatatgtattctggaaaattagttaatatctctgaacaatttctttttttatttttaaaacaaataagttgaattagattatttctaataactctttctaaaataaagctatgatttgtaaatgtttttctttaaatcacaactataagccagccatggtggtgcatacctacagtcccagacactcagaaggctgatgggaggattccttgaggccaggagttcaaagctgtagtgccctataatagtgcctgtgaatagccactgcactccggtctgggcaagattttttttaatcacaaaaatatttttttaatcgtccttagctttctatggcctaaacaatgaattataggctggataaggtggctcactcctgtaatcccagcactttgggaggctgaggtgggcagatcactggaggtcaggagttcaagaccagcctggccaacatagtgaaaccctgtctctactaaaaatacaaaaattagccgggtatggtggtgcatgccagctggtgcaataccagctacttgggaggctgaggtggggggatcacttgaacccaggaggcagaggttgcagtgagctgggatcacgccactgcactcctgcactccagcctgggcaacagagcaagactccatctctaaataaataaataaataaataaataaataaataaataaataaataattctaaataaagaactacacaatgaattacaaataaaatatttacagctctaattatatctcagatttaaaatcatatggaggctgggcacagtggctcacacctgtaatcccagcactttgggcagccaaagtaggcaggccgcttgaaccctggagttcaagaccagcctaggcaatatggcaaaacaccaactctaccaaaaaaacaaaacaaaataaaaaccacacacacacacacacacacacacacacacacacacacacacataaattagctgggtgcggtgctagataggtgctgatctgggaggatcccatgagctcgggagggggaggttgccatgagctatgatcatgccactgcactccagccttagtgacagaactagaccgtctcaaaaaagtaaataaataaaaataaagtaaaatcaaatcatatggattaaaaacatcacatctatatccaaatttcctcataagtaaaccacagatgacttttaatccaattaagcaatcaaaaacttttaactgaaagcattatggggccaactattctttatgtgatatacttgaagaattaatttatctgctctatcagtgttatatataacaagtgtaattccccatatgtttatatataatacacatacacaaacccatataatttttacctctgcctagattcagtcaaaatgtaacaatctctacaaagagaaaaagcctagcaaatttctatgatgacaaggagttaagtgtggcaagctactttgcctttctcctctccaaaacactagctatgaagcaaatatttaattgtcctaatgaactatttaggtaataagcgcatgtagttacaaattggctgaatgataggggtttgaatgctgaagttttgcaattgtagctgtttaatgtaagatcaaaaaataatgttttagtcccaagttagatttttaaagtactgcattcatcctgatgactaactaatagaaactagtggaatgttagcaaattgatatataattttctagaaatttccatcttcaaaaagtttactttggagctctagactcctaaaagttatttgtaattcagagttctcactcctgttccaatccctgaaaataaaacatagaacaagaagtcatttttggccaggtgcggtggctcacgcctgtaatcccagcactttgggaggccaaggcggatggatcaccggaggtcaggagctcgagaccagcctggccaacatggtgaaaccccgtctctagtaaaaatacaaaaaaaaaaaaaaaatagccgggtgtcgaagcaggcacctgtaatcccagctgctcgggaggctgaggcatgagtatcacttgaagccggggggcggaggttgcattgagcggagatccagccactgcagtccagcctgggcagcagagcgagactcaccctcaaacaaacaaacaaaaaggcgtttttattcaataaacacacttacaactttagaaaacaaattaactgaccactaaaatgtactaattgccttggtattccttatatatttttcagagaaaactcaatatcctgtcttgaatccgggcataaggacataaagaacctgaaacacaaagataaagaattcatgccaccacctcagatcagtggcatgcagtgttaaaaaatcctcagtacaaacgatctgagaaatagaatacagtatttaacagtccttttgatttcagggttagaaagtgacatatatctactgctatacaaaccctcagtcatcctaaaacatttcgttaatgtgagacaagcaaaccaagctcaaagtccagaaattgcaaaagggaggcaggtttcaggagacgggtgcaggttgggggcaggcgcttggacaaagggaagacacagtgtgttaccttttcttccctactcataagctagaatctgctcatcctagttctctgactgggaacttcagctttgaagggaaatgggcaggtgttctcatccctccattgatacttagtgtcatctaggttcttagatctgtcctgtaggcaatacattctcgcaactgtgcaaatagtgatcctgccccaccattgcactgcctgctctatccacggctgtttccatccgctgggtgtctgtcggtacttactggaaactttctaggaggctgcagctctagagaagaaaatcctaccaaccagggcacgcagttcagtcgacaatgctggggaagggagaagagacgctattgattactcacagtttgcctctgagacgggaagcactaggaggagacacgccagcagcgccccgcagcgcccacccaggaccctcatttcgaagcgcgcggaggcgccggcagggacggtggcgcgtcgcggcggggaccggagcgctaggcgccgcggagctgcgagcctgtgcgcctcggtctgagccgtgctgcgcggcggcgccagcgacccagcgagcctcggcggaacagccgggggcggaggagaccgcccgctcccagcgcccagcccgagaggggaagtgataacaaggacatttccaggaagcttttcggagctgggggatgggctctagtgttggaggcctagtaaacactgctgagacatccttcttcaccagctccctagttgctgcttttcctccacagtgtgacgtttccaaaggggaaggggtggggaacgcagttctctgactggtcaagacaacttccagggttcaagaggacaggatccctaggttcagaagcagaaacagtgagacactgagttgtccctgaagatattaaccaaaacctggaagtcaatgaggactttaggaagaactatggtgatagtaaaagcaaatggggtcattttgatcatccacatgttttttcggtcttgtatgccatacaggcataaaaataatgtaaagaacatgaagaaaagaagggaatattagaataatctaccttaaaaaaaatcttgctccgataaagacttcagttgaaagtgaatatctatctatacatctacctatttattaatttaaaaaaattttttttttttttgagacagagtctcactctgtcgcccaggctggagaacagtggcgcaatttcggctcactgcaacctccacctcccgggttcaagtgattctcctgtctcagcctcctgagtaggtgggattacaggcgcctgacaccatgcctggctagtttttttgtatttttagtagagacagggtttcaccatgttggccaggctggttctgaactcctgatcgtgagtgatctgcctgcctcggtctcccaaagtgctgggattacaggtgtgagccaccacacctagccttatttatttatttatttatttatccgagacagggtctcactaggttgcccagactggagtgcagtggtgcaatcatagctcactgcagcctcgaacttctgagctcaagcaatcctcctgcctcagtctcctgagtacctaggactacagtcacacaccactatgccaggctaattttttaatttgttttttttttttttttttttttttggtagagatggtatcgctgtgttgcccagactggtctggaactcctgacctcaagtgatcctcttgccttggcctcccaaagctttgggattacaggtgtgagccacttctcctggcctgaatatctttttaataccacaaatttgcatcacattgccagtaataattgtcaacactgaaaatttatgtgtcctacactgtaacgtcaaactttgtaaaaccatctggaatctattaatatacaatttgacaatacatctttcaataaaattctgggtttttaattaatctcagaagttaactttgtgaaagtgatatctggctttagctcaatatgaattgacacttggtaatctcatttagccaaagtttggttttgatacagaccttaatatacaattaaaacctgtccaaaatttaactcttaatctagtctcattcataatcttaatcccatcatttttccagtgttacacttctccatatcatcttctaccaacatagtgtctacttatccacttcttcatctgtcttcaccagtaaaatgtaagattcatgagagcaggaatttttaaaggttttgttcacaactatattactagtgcttaaaacagtgactggtacataaacgtttcattctatttaagtcaacagtgtgtgcctgggaatatttatgccaaaatatcaacaattatcctgaaatgacagtgttaactagaatcatagcagcatgactcttttcatcattcagaataaaccagattacacactaaaaagccagaaaattacagtgttttagataagaagtgtttatttcttgctcattggaagtctactacaagtctgcatgactttccaagtaactatcttccatgtgtgaactcagcaattcatgctgctttgattttacaatccctcaaagtcaacatagtcttctacaattaccattgcaagagaagagagaacattgagaattgtgccccagctcttaaatacttttaccaagaagtgacataccacttacatttcattagacaaagcaaggcacgaggtatgcctgacttgaagagggtgggaataactgttatttcatgtgcctgtaaggaaagagaactagacatggtgagcagcacttatggctaccaaaccacttaagatattcaaaaactaagagtcagctttgctaagggactgcatgttggcaccaggaatgctcggtaatgttatcactagcagaaatggggaaggcatgaagtagagcagatgctttaatagtattgtttcattatgacatggctgagaaaaataaaatcaactactggcccaggccactgtgtgtatggagtttgcatgttctccccacgtctgcatgggttttctccaggtactccattttcctcccacatctgaaagatgtggatgttaggtgaattggtgtgtttaaactgtcccagtctaagtgagtgtgggcatgtatgagagcaccctgtgatggaatggtgtcctgtcaagggctagttctcaccttttaccctgagatgccacctatgatcctgaactggaataagtggacaaataattatcttacttgttgttattcatctttcttaatgtatagctcacatttatttcaatgtttactattactagtggttccatctttattttgaagtttggtgatgtttttgtgaccagaaatgtgccacaggaacttaattgatttatatcaatttgtctgtggtaaaattggttttattgtatgttattttgtttaaaattatagtttctaagaacctctggatgaagataaatgaggatttactgcaaaactggtgttgagtatatatttgtgaaaaaacagtcttgaatatagttctaaaaatgctcaagaaacatacacatcatgagatccttcagtcacagaaataataatcaaattccatcaagacaacatgttttaaaaaagaaaagcagaggggtaaggtcatatcttagaagttacatatagaaatccagaggaggaatggcctgggagatcagaagagaaccaggggttgtgctcacttcatcagcacatatacaacaattggaatgatacagagaagattagcatggcccctgaacaaggatgacatgcaaattcatgaagcggtccataataagttaaaaaaacaaagaagaagagaaccagggtagggtagtgcagtgcataactgtgaaagaccaaggcaggaaacagttttagaaaagttaactatattatatatatattaaataatagaaaagaaaaccgatttggtaattaggaagatataagttatatcaaaaaatatgctttcagtagttagatgggacagaagcccaatcatagtaaatggatcaaagagtgaatacaaacaatataactttagggtttgcaagacactagtttaagaaagtgagtcatgaaagtagagtcagcagaaacagtcctaaattggcttggagttaatggagcattgcagtcttatcctgccctgctctcctgtctcccaccatggatatttggaggtaggaggacacataccataagtgtttatgggacaggtgacaccaactttaaaatttgctatctattatttatcagaaattacacttgagcttcatttctctcatttcatcaccttagcaacctggaaaagtaggtattttaatttccatgttatagatagggttgttggagcttagaagaaaatatcccagaataaaggcctcagaagcaaagtttctgtctctaaccttctgttcctcgtctcttgcccctcattctcccactatgcaagccatagaaactataattcctctttctccaggtgcagttatagaaaccacaaccccctttccccaaagccagccacaaaccccaaaatattactctaaccttcttcctttccatgaaagacctgcccataaataaattctttgacttgcattgtttgatagtacgtcttaagactcccattctagaaagggtcctaccccataccctggaagaaggaatgctgaacaatcaggtcaagaggaatctgaacagacaggccttgctgagtttctccacacagtctgctctcattaggtcatatcctttttgaccaatgagagttcttcagggtttttcattcttcatcgaacccaagtataaaaatgggtagtcttccctgcatctttgcatctccatttgcaaggttcccatgtcacataaaacttggattaaataaatttgttatgcttttctcttgctattctttttgttatatgagtgttggctgtgactgttatgatgagaagaaaaggtatcaccccctttgttccccataaggcacagtattttggagatagcaagctgtatgagatgtatataaatttgaattaaaattacatgaggctgggtgccatggctcatgtctataatcccagcacttttgggaggccgaggcaggcggatcatttgaggccaggagtttgagaccagcctgggcaacatgatgaaaccctgtctctacaaaaaatacaaaaatcagctgggcgtgatggtgcacgtctctagtcccagctacttgggagactgaggaaggaggatcacttgaccccaggaagcggaggttgcagtgaatcgagatcatgccactgtactccaacctgggtgatagagggagactctgtctcaaacaaaacaaaacaaaaccaaaaaaagttacatgatttagtaaaggacagagactaatttaaaacctatatgtatcttagtctcaaatcattatattccccgcgaatacactgggattctcagtgccttctatcctttcatcaggatttgaaaatatttatttaagtagaaaatgaatggacacacagatccctacatattgtgcataattttttccctacaggaatgtccttgtcatttctttttctccaaagtatataaaagaaatgcaaatattacatacctctttaaaaaataaactattacaaaacagtcaagagataacaatcttcatcttgcagataccaaatagccagcaatttatgtacctaaaaatcctgaaacaaacatacatcaaaatggttatttatttatttttgagacggagtcttgctctgttgcccagactggagtgcagtggcgcgatctcggctcactgcaacctccgcctcccgggttcaagcaattcccctgcctcagtctccagcgtagctgggactacaggcgcgtgccaccacacccgtttttgtttttttttgtttttttttttttgtatttttactagagacggggtttcaccatgttagccaggatggtctagatcacctggcctcgtgatccgcccgcctcggcctcacaaagtgctgggattacaggcgtgagccaccgcgcccggccccaaatggttatctttgagagctcctgtgagatctcattttcttcatcttgtttctttttagtatttttcacattttctacaagaaatgcatttttcttttgtaatcacaatcccccctacaacaaatatcatacaattccgtttcacatatgtaacagtaataaacgttttagagattaaggcttcactctcatctgaactactgagaaaatttagcaagcgaatttcccccttgtctttaacttacaagaattgccccagtgtattgttcctgtagtcatgctgcctaagtcggccagaattctagagggtccccatccctgagcaaaaaacaaacaaacaaaaaacaagaaaaaagaaagaaagaaaaagaaaaacccatgcacaagacctgagatctctgaatctcagttggggacactggagaaaggaaaggaacagcaccgtggattggcaacacattttatgtaggtataaagataggccttgctggagatttgtcccggatcctccagcttatctccggacgctccggttgcctagttacgagaacgagctacctcgagctccgcctccttcttatagagtactcccctttctcttttcctagtctcgcgcaggggcgggtagccaggactcttcagccactcagaggcctctacctcaggacctcaaccgatgattgggcgagcgcagtacgggcgttgcctggggaacgccttccgcgcctcgaagtaacgtcagcacgtcgacgcggggcttttctttagccgggtcccgctaactcggctacggtgtatctgcgtctttggtcaggttgttccttggctaagagggcagtcgtcgcggacccacgcggttagcaaggcttagtgctcgggccggccgccttcacttccctcccggcttttcctcccgacttatccactttaggggcgtctcggagtgccggaggcccccggggaagagcggggtgccggtgtccgctccgggctcggatgggaagtggtgggaggagcgacccgggatgttcagtctgatggccagttgctgcggctggttcaagcggtggcgggagcctgtcaggtaggctggagccagctgtcctggccgtcctaggggttggagatggctgcgccccaggggcgaggcgccgccttttccccgcgcctggacgagtctatcccaggccgcaagggatgctttcattcccagggtgtcccgggagggagagattggaggatgtagccttgttgtctggtcgactttctgttgcgattgacaatgcttaccgttgttatattttaaataggtttgaatttgttaaaaagtgtgtgtgtgtgtgtgtgtgtgtgtgtgtgtgtggaattgaaaactatccattgtgtgtttttcctctgaagcttttgtaatggaaattcttttaaaaagagggggacatggaatatagttttcataatatccgcacattccattccaagtcacacctccacacagttgtatttgaggacgtgggcttgaaatctggctccactacttaataattacatgactcaaccattttggccccacctttcttaaatattaaatgagagtgataatactctgctttagaaatattgtattcaatgagaacaagtgatagtgttttcttaactgtaatgtagcttccaatttttatacggtctctagtaaaaccttttaattgaaagggtccactttttaacatttcattttgaaatgctggaagtattaataattagtacctgttacttgatattcattcattcaaaaaatatttattaagacaataccttgtgccaggcactgtcttaggaaataatcagtgaaattgatgcttttgaaactgaggcctaacctataaagagatcttgtgtttgttacacaaataatgttgacttcacatagttctagtctggaattgggccaagggtaagataaagcaaagttgtttttttttttaaattgttaacattttaagtatatttgccatgagaatgaactatcctttaaagaatgaatctgaaaagctacacttacacattataacagaaaatacatgtctagattggaaaaaaagtaactttaaatgaaactagagattcttccccattattagctcctaactgaatttgaatgttttaaatataagtagtaagatcaactctgtaagtcaaagatgggctgggtgtggtggctcacgcctgtaatcccagcactttgggaggccgaagctggccgatctttggagccctggagttcgagaccagcctggtcaatatggcgaaaccccgtttctacaataaaataaacgggcacggtgacgcacgcctgtagtccaagctacttcggaggctgaatcagtaggatcacttgagcctgggaggcggaggttgcagtgagccgatatcgctgcactccctgagtgacacagtgcaaccctgtctcaaaaaaaaaaaaaaaaaaaaaaaagaaaaaagtcaaagagttgttttaggtgcatagattctgatttatttgctttaattatattctggtctaatttcacagtatctactaagacttgagggtcattcataatagttgacccctcattttcctccgtgtctgcttttaagaaatgtatttggtttctgtgaaggcatgtatataacttacgttcttttaacgagaaacagtgaaaacgtgtaattcgaagaaggagtgttcaatttaattcatcattcttagtctttccttttcttagcagcttttgtatatatactctctggaatgatttgtttaaagagaagagttcagagaaaggagaatgtattgatttccaagtagaacagataattgaattttcttaataaagcattattaaaatttagctgcataacccagagtgtattttcttctttaataagcaccatctagatttgtcctgtccagtagggtaacaacgagctacacgtggctgttgagcacttgaaatgtggctagtctgaattaagatgctgtaagtgtatgtttaatacatagtgggctttgaaaaaagatttattatgcaaaaaagtcagcatcttatcagtcttttaaaagtatgattacatgttgaaatgataacttttgcatatgctaggttaaataatatattagaattaacttttttttactttttaaaaaatgagattactagagaatttcaatgtatatgttgcttatgttaacatttctgttggatcttactgctctggatcatagcctaatataaaggacataggtaaacatctcaatttggataactgtcaaagaatttgaacacaagttggattacccctgtcttctaagtccccttgttcaatgcctgatttataatagtggctgaataaatatttgccaaatattgtatgtagttcgatttttcttagtaataatcatcctgaagtaaataacattagcaagtagttccatttattttactggaataaatgagaggtgagcaagctaattttaaaaacaaaattttgtgcttttatggtgttctctattttttcaacagaaattgcctgtttgattattatgtatatatttgttttctgtagaatttcttattaagattcctcttcatgtttatattttatgaagatgaaatgtgaggagtgaatttgtaaaagagatgatgatggttattaatatactatatttgagattactttgcagatttgtttaatacattctgtaccccagtacccattgtatttgttcacctctcctcacttagatcctttcctagtgagcatattattccagacattggaatcagggattagatttgtgtgataaggacaaggcaggagtcagagatcaagtgttaaggcaccagtctaggtcagcagtcaagatcttataaaagtttaacgcttcatcccccttagtggagtactgaaccccacttatttggggtttggtatggccccattcatgaattttggttcagtttggtacggctccattcatgaatcaatgaatgtggaaataaactcttgaaattttattgttcctaagtttatcttttaaaaatatgttaccaaattgctcctcagaaaggattaaaaaagagaaaacacagtttctactcctaccaacagtacgttggagtgcctttttcactgagaaaatcaagagtcatcggtttttcatctccttcacattataggggaacctgctttctgctttgagtttctggggttttttttgttttgttttgtttttattactaggaagattaactttttttccttgcgcatttttgtttctctcagcagttgtccattgattactgttgtgttttttctattggggcaggtgtgttttcttaatgaatttttaaaaagaaattttaagtgtttgtcgtagctactgtttctctgtagtacaattgacacttgaacaacgcagggtttaggagcactgaaccctgccttgccagcacagacagaaatccacatataacttttgacttccaaaaaacttaattactaatagcctcctgttgactagaagccttactgataacatgaatagtcagttaccacatattttttatgttatatgtataatttattgtattcttaaagttagaggaaaggaaatgttaagaa

SEQ ID NO: 570 - DNA, 29943 bp, Homo sapiens
ccgaccattaaatgaatgtgtggctcagaggcctggtgaagcccctgccagcgggacctgggcctggcgggttcccggagcaggtggagagggctgggcacagcaggcgtcactgatactggggtttctcggtggacacagctgggaagtgtaggtcagatgtagatctggggtttttactgggcaaatctgacaccatttgagcatcagaatccacagcaatagcctcggacggagccacagaggtcagaagagcccactgagagctcagctgttgggatatgaaggggcggccagggctcctctctgggtggagtgaacccccaggcatgacgggaggagggcaggggtcccccgaacagcccagcagccatcctggaactccttgttcagcaagaaacaccgggaggtgacagtttgaggagaaacaagatatttacatcctcccacagcatctccccaaatacactgtttcatgacaaatagaaaacaggagccgaattcaaatccaatttagaaaatcacttccgatgtggtatccactaaacaccacactgcagccaacccagtccagccttggctgtgaggcagtgcccggggcctgtcctgctgaggccacaagagtcagacgcgcagacagctggggtctgaagggccctctgggctggcccaggagggctgggtgtgtggtctgtgagcgaggggcaactggcgctcctcctcaggactctggggagctcaggccacagcagaacagaggccccaggccctcactggcccatgggaatggcacgtggcgtccccagctctaccccagcaggggccccacctctccctccactggaggagacggaagccagcccagggcggagcccccaagcctccgggctccggtggttccgccaggtggacagcctctttcagcagccgtcgctccaggtatctctggcgtcggggtgcagagtctgtgggtcagtggtttgggctcctccccgtgaatgagggtattgtctcctccacggccaccgtggtgacgtccggaggggcctgcagggcctcaatgactgtggcctcaccttctgcctcctgtcttttccgctgtgagcacacgaatcgtggagaccctgcctgctcaggcccccctgggactccaggttctcgggttcattttactgctttcagtttgagggggtgggttctttcctgagctaccgtggctgtacttgaaagactcaggaccctcagagaactgggagcccccaccatgtacaccagaaacaccagccccagcggggagaggggaggtgggaaggtggaggggggagggagagggggaggaggatcaatacctggacggagacgatcaccttgactacatcacctgcaatacacagacacacaggtcagggaggggcagtgtctgatcaggggacacaggctcatggcaatggtctcacagcggtggcggaggcacaactcctgcttctccctgggagaccgtccccaagggactgaccctctctgagagcagaggaggccaactgtgttgggactgctagcccagcctgtccccaggaggcccagcatgggtgataggactgggggcgcccggcccacctccccagctgaggcccccaagtgcataactaaccctaattcaaccgtcatctatgggaggggaacaagcgcttcacagtggagaggccctgcccaccataccagcaggtgcccagttgggtgagactaagctgctgcccggcctaccctagagcctgaggccccgagacctccccgcattggaggccccgggtgaggatcaggtggctttgctgccgcctggctggaggatggggctgactttcccttcagacctcaatgcttagaagctgcgtccccgggggctgtgcacagggctcccagggccacagccgggtccacacagcggggtcagtgcccaggaggccaggcacaggaggccaggcacagcacaggtgcccagaccagggcggataggtggatgaatgaatgaatgaatgaatggccttactctcctcaatgaggacaaagccttgtccccagcagggcggctgttgaccctcagcccagagcttctcccagctgagcagggcctgtcctgctccccacatcccacagggggcaggcaggagcacagggtcatagagtgcgtgggcaggggtggctgagggctccacggtcaggggtcccaccttcccttcccccagggaggccagctgacacctgggctctggccacagcagaaagcccacctgccccagcctgcagtggctgccctgggaggagccgcggatcctggaaaagctctggggccacctcccaggcttggggtgacagagctccaagaggtgacggctggggacatgagccctgatggggccgccgtgtgctcaccccttggctttcttcttttcacacatatgattaggccaactgtggagcaaacaatgacgatgacgaggctccctgagagaaaccaccatacccagtgggagctgctggtcccagctccggccttcgtcaccagccagctgcacctgcgggagtggggccgaggacgtgggagaggcaggtgcagcgcccagtgttcactcagcctcagggagcctccctggctcccagggccccaggcagtgaagacaggtcccagggaggctgggctggtggcagctccaggatgagacctcagaggtctgtctgacttttccaagctcggctatggggaggtggagagaaggaaggaggagaagagaaacaaggagagactgggcaaaggagacaggacggcagagggagaggggagagaagcgggaggcagccagcagtgcagagaccccagagcacgggagaccagtggcagacaaggacagaaggtagagggagagccagtgtcgggacaaaaatggttagagctggagatggacaggactgagctggggccagaggacgaggagggcagagcaggatggaaggccccaccgccccctccctggggcagccatccctgctccatcccaggctccgctgggggaccccagctcctcccaagaagctctgaagtctcaggtcagttaggggcccagggtcagcatttgaaggtgtcctcccgaaggtggacaaagagcagagtgttcactttccccaacccctgaagcccaggggccctcccatggccctgacattcagggacacccacagccccaggggacaggggatctggaggcagcctccctctgggcctgcttctgggaaggcccatcctgagcctccaggaagctcagatctgatgaggctttgtctgggcccatggaaggggttatctggggcacacaggcttcagccctgcagctctcctggacgcaggcatgtgaccagggtgccgctcagggtgggaccttcaagcctttctgctggagaagacggtcatctcccagggaagcaacgtggagccccctccccagggcacagagctgggcctcccccgggttcacttacttggtctggtgctgacattcctccagggtcccattgggagagaaggtccccggggggcagttctgacacagggtgtcctgactctcggtgcctgagaagagagggacggacagagggggctgagggcaccaggccaggagggggctggcggctagggactgcttgtctgtgagcttctagacctgggtgctctacgggtgatgggaggaccagcggggaggggcaggctccctgtccagagtcttggaggtggggcctggggtggtggctctggctgtcccggccttgagtagctgggatctcatgagtccgggagtccctctgtgtccacatcctgcagtgctgcgggggctgcccggccagatgcaggccagggctggacacttactcctcctagacttagcttgaacagtggcattaaccatggtcactcccataaacccaggctccagaccaggggcccgagagcgaggcctggggactgggaagtcccagaaccccgaggtggagcaacctggggtggcccttccttgccccttcccctgcctccatcacctgttccccactgggctgcttccaggacagggctgaagtgggtgggcctggggctggccaaggttctgtctcaccagggcccctgggcaggccatgccgtcgaggaaacctggggctccagacagcggggcactggggaccagggtggaaatgggaggggtgtccgccacccaccgcttacctcccttctgcaccctctggcccgggctggaggtggcgtaagcgcggcacgcggcgcagtggtccccgtcctggacgatgcagaagtggcctgggctgcagccacacacggcgttctctgtcctggagcagttccggctcgcgcgcaggcccatggctggagtccaagaggaggggctgagaggggtacgtggaggccgggacaccatccacgggccaggacagcatccacaggccaaggactgctgccagggcgccctgccaggctgaacccctggctcagccaaacgaggtgcccagaggtacccagcatggaggacctgaggccgggagggacaccaagggacggcagagctgcgtgtgggacgagggcttgcaggaaggtcctgggagggcttcgttgatgggagaaaccagccttctgcccagatgggcaggacgccgagcttgcactgtcagttccagggcagggtcccgcaggcaggtcctcgccccacgtgcccacccagacacccaccccgcaaacgggtttcccatctgtgcaaaccaggccattccaatggcagaggcaggtagggtgagagccccacttcttcaggtactggtggaggtggggtacaagctgggcctgggcccctcctgagggcagcctcacctgccacctgtgcccccacatcctcagcccaagtagacaggtgctttcacaagaggggaggggcatggaactgggcatgcaggttgaggtgtgagccccaaatcccagcctacatgcatgaacccccaaagcactccagcttcctcttctgttcatggctagcccacctgccctgtgcctccctgtaggctcaggccctgcccccaggtgtgccgtcagccctgtcccgcaggtgcagtcctgcctggccgcagggagcactggccatgctgagcctggcatgaggctccaaggggacagagccgttggccgcatggacaggctctgcgctcagtgactcaaaggccacctctgggtctggttcccctttctgtctgcctggactcaggtgggcaccagcctccaggtgacctcttcccctgaggtcacagggggaaccaatatctggaggagaaagggacaagaagccctgtggggaagcagcaggcccgagtgccggccggagagtcccagcaccatcccattccactttgcagctagggacgtgggcacaggagaggtctgggcacccaccccgggcaccagaggagccaaggacgagggataagggtcagtcgccaagctcaggatggcccacctggcggtgacaaagtgagaggtgagacagaggtggacgggggccggaggctgacctcaaggcgtcccctgcagggtgcatccatggagatggggttgggacctggcctggggcagccggggccttcctggggcactgtggccatggagagagggtgcagggtgcgggggcatccaggctgcccaagcggaggctgggccggctgtgctggcctcttacctgggtcacacatttggcactgcagacacttgcttaggccattgaggtgggcaatgtaggtgcctggagggcagggttcacacactgtgcccgtcagctccccgcaggcctccttcacacgataacctgccgcccagagagtgggaacttcgcaagtctgcgggaggccccttcgggagcccacccatcactccacccgcgcccagagcccaagcagggagacaccagctaaggggactcaaatggcccatgagccccacgggacacagcagccccatcagccatgagcagagctgctctggggaaaatcggaaagttctggaagcacatggggcctcctgggacacctggcccggctctggtatgtgcccccgagcccatgtctctggccacggtgggccagccacgtctctcagacccaccccctgtgcagtgtgactgtgagggtcccccagggtgaagagtccaagctgctggcctgggggttctgccctcactgtctgcacacctagccccagggcttcatcacacccatggctgtgggggcagagaacacaggggtgtctggggcagaagggggcaagagtgtctgccctcggcccacagagctggcccgccaaagggctgcacctacctggactgcacttggggcagcactcggagcccactgggtactcgtcctccttgcaggacggcagagctggggcgtagcagggggctcccaggaaggtgagatacagcacctaagggggtcaggacaggcattgggagatgccctggctgccctgtgggctctgccaggcttggccccacagcctgaatctccctctgtgcaatggggaggagcggcagtgcctggtagagaggacagaagcgggccccaggccaggctcatggaacaaccttgccgaccgctggagcccgggatagggtggggaccgcccctcctccagccctgatgacgctgcctggcagcgcggagccctgggaactggaactctgccctcgccagggaccccacaccccacacctgggagcattgagcccactgggcagacaacctgccggcccccctgctggcctaggttggacctgctgacccctgaagagccagcaggggcagccagggatgggccccagaggctcacaagccagacagtgggtgacaggctgatcagggccacatcggggagggtggctctgccgtggcctcgttcctgggctggctgatgggcagtcgggggcccctgatggggatagtggctggacaggcaggagtgccacatgagcatggagagtatccccaccccacccacctgggtccagccccctgctgcacactgatcttatcacctgtcaccaaggtcagggctgccggggagttgggtcacctgctcgagggccccgcccagagacgcccagagacacccagcccccagaagtgcccacatccggccaaatgggggctcaccagctgcccgtggacggagtggtgagtgggggacacacgcaggaggaggtctgctgggtagggctgtggctctgctgctcaccccactgtggtgagcccagtgctgggggtctgggttgacccgagagccccaggcagcaggggacgggctggacgccggagccagcaacggccaggacaggggcatggggaagagatctgtgggaggccctggggtcagaactgggatctgcgagcagacggagaggaggctcgggggctcaccagcctcaagacgtcggttttgggggtggatctccagggaggaggcccccagtctccaggaggctccatgcctcaggctcagaccggcagctcgggaacccagctagcaggatgaactccagcagaggaactcagcgccattgctgcggctgtgggccagaagagaaagagaaagagaaagagaatccgcctcggtgtgacaagctgtgcctcagaacccgagcagcaggagagtgggcagcagggggtgtctggcagcagagaggggctcaggcctgctgggtggagcggcgctgggggacacaggtgggccctgcgggaggcaggagctgtccaggcaaagccgaggggaagggccggtatgaaggaggcgcccgatgggaggggcgagttctccccctgcaccattccagtccactccgggtttcctgtagaagggggagccccccaaagtccatctgtgtttccccacctcactcacacactcagggaccctcggctgctccccggggcgctgactgacatttttgccgaataaaggggccctgtgggtttcctgttcccatctcagcttctgctgaacagggtaaacttcccttccgaataaaaccaccagaatgcggtctggccaatttcagtcatagacccaccaggcctgtgtccctgcgtgagggggtgggaaaagcccagagtgcccctacccgtcccctgggaggggtggaagggcagctcttgctccccctgcagagacgctgcgcggactgggaaggctgccagcctcgcccggtctccctgtggaccctgccctgaccccaccccagcttcctggctccctgcaccccactgggcttccctgccccacagagcctggtggtagggagacctccggatggagacagcccacagtcccggagccccaaggcaggcaccagtgagtccctcgtgacggcctcgctccctgcatcacatggaacctcgtgacccacgtgacgacgccagtgcccccgtggccccttcctgctgctggacgtgatgcagtcaatggaagcccaggtctgtcacgcaccgcctgtgcttgcccagagcaggtcccagtcaccccctctggcaccgcctgctgcacaccaggaacccccacctccagcaagcccatctgccagacgcctggcccaggaccgccccctgcccctcgactgccccctgcccctcctggtcctgacttcagccaggtgaccccctccagggtccagccctggcccctgggggactcagtggcatctggtggaaaggaccttggggattgcgcccaccctcacctgcaggagagttggcagggtggccagccacaggaatctgtggcaggagcccggggacctgcaccccaactagaaagtgtgcagccctgcaggccggccctggagagggagcaggcaggggtgaagttaggccggctgtggtgtgcgacaccgtcctgtggggccaagcgtcccgagctccagaggcaggtgcactcctggccagcatccagggtggacgagcccagaccccaatactctgaggcagggtgggggaccaggtggcacccagtggaggaaaagcccccaagagacacgcaggagcatggactcccaccccacagctggagcctgggagaggagccccatctgctgtttccctggtgcactcacatcctggccctcagcgccccctgccaggaatgtcccccacatgcagagccatgtgggtcttgcaaggaagaagaagggggccccttgcatcctccactcccgggggccccaggagggcatgggggctccagggtgcagggacagcacgttccctcaccaactccccaagaacgcccaacctccaagagcagacacagcgcctacacctgccggtacggggctccaaccccactctctcagatacgtcctccagagtcgtctcatccaccccaccctggggaggagggaaactgaggcatggcaagagacaagactaacacaggcatcagtgagactcagcccctcctgccccttcctccatgcccctcctaccccgacttcagctcccacaccaaggccccaagcctgacatagggccccaggtgccaggcctcaagggggctgaagggagcccatctgccccaccgagggcacagacagtgccaggtctttgctgaaatgtcacctcttccttgaggccttctctgattgctgagtaagccctgtccccgctccctgctccccgtatccgcccgcctcggccctccgtcccttttctcccttctctgtggcctgcccgctctcacagaatgcagactccaggggtccagggtgttacctcccgggcagcaggaggaaatgtcctgggctccccacccagcgctcagcgccccccgctaagtacagcactcactccttcatccattcagcgtgggctctcccggcaccagcaccgccaggccctgtgcaggaccccagggtcatcaggaaggaaatgaggcagcccaaggaggcgggagacggggccctacccagcacccagccatctgcattgacacggctgcccgcaggatatcactgcccccatcccggggcccaccattaccagcagggagagggaggcaggtgagcaccccgagccccacgcctcctgtcgcggggactccccagacccaatgctgtgccagtgcaggccaggcagggggctgaggccgaggcctggtcattgccatcctggtcacgatctggtgaaggatttgagtccagaagccaaacgtctacagtcgtgtggtgcggacactcaggatggactgcccaggccatggggggctctgagggatgaagaggaaactgcgggggcgaggtgggctgcgcgtctctgagaaagtgtgtgagttgagtgctgctgcagagggaagctggggtccaccgctggtgagcggggaggggacgggacacagaaccggccgtggcccaccccgagacggaggcgcagacaccaggcccgttctgtgctctggaggctttgggcagctgtcaggctagtggacggtgtgcagagcagatggaggcgtgaggaggcggctccggggtcacctaggtgggcagccctcacaggggaggccgagggggagggcaggagggcggagcaggcggcggtgcaggaggcccgtggaacttggagggctctgtgtccagctctcatggcccagggcgggggcagctccaaggcctcgggcttggggacagaagggagaggacttgggggttgggggtggtcagagcattgtgggagggatctggggcagctggggcttcccagagggtgaggtgtctgctgggaattggggcagccccaggcgtccccaggcctccagcccagccccggttcctccccgctgcaggccagggtatcaattgcctgctgggaaacctcagggtgcctctgtctcaagtgcctgcccctgacactcctggccctgggctccccccgcctccccgtccgtctgctttccccacctcctcccctcccctggccgtctttctgcctcggggatggcgtcacctctcaccccaaatcaggaccctgggccccagctctgttccccacctcaccttccttgtgaccaactcctgacctcccatgggcttggggtgtctgtggccggaacattcctcagaccctctcctccagccccactctgtcccaccacccgggcatcccccacctgggttccagccctccaaggggccccacgctctgtgtccatgatcaggacactcacacgcacccagctcgcgcccttccttccagacattcgagctctggaagctcacagtcaccctagcttagtgcacagccacaggccaggcaccttcaacatccccaccttccaggtgaggaaaccgaggcaccgagagctgggggccaggccagggggtctccctggggggagcagaggagtgtcggacctcagaagaggctctgggggtctgagccgccactgggcgctgccttccaggttcagcagggacagagctcagggggaaggcacctcccgtcttggttcaatacatggacccctgaccctgggaaagggactgagccaggggaggcctcaggtcactgcaccatgaagttgtggggagctgcgggggcctctgggctccgagctgggcaggcacagcgtggggaccacgtgctgaggggaagaagcgtgccagggtggatgtctcagtgcacacacaggaacgtgaaatggctgagccggcccagagaggcagcggagcgtgtgcggggtggccggcggagaagcagcaggatcccaggcgggagggcacggccttctgagaggcaggttgcaggacaatactcagtgttttgatccaggaggtcctattagggcgtttcattgataaacgcacatttgaggtggagggtggccagtgtagaatgtgcctggcagctttcacagcaaaggagaattctagaaccaaccgaagtgcccctctgaagggagctggtcccgtccgttccagccgccgtggagtaacacagccagcagtttccctcctgccacgaaagctcgagactgaaactcaggatgaactgttttcagcccgggtcaccccagccctggggtggaggcccattgaggatggccgagcaggggcgggcatccaggcaggtccagcagtcctggcgggctgaggagaaggaggtcagggctcagggaggcatccgcagagggacctggcaggcagagctccggaaaggagggaactgcacagacagaaagctccagaaggctgcctgagggtctctgaggcctccggagtcgggcgccatgcatgtggaaggtggactttcagcatgggtgggaccctagggggctgtggacccccggcccctgggactcacaggtgggagacaggagttccgaccgccagggggagagtcctggaggatcctgggctgtcggcagccacccagcagggcccgtcctgggagtggggctggactcttcctgcaggaaaggctgggctggacctgctctaagaggcttcagaaccagccacacgaagaccaaagtgaagagcaaggagctgaactccacgcagaacacagcgcagcgtcctttaaaggaaggcccaaaacaacccaacaaaaatgccaggtgatcaaagccgtcacagcacaatgtccacatccaatgagaaattgctgctacgtccagatgcagggaagagtaaccatgggaatgtgggtcagtagcaacaggcccagaagggcagccacagtggaattgtcaggcgtggaccctgaaatgacaatcacaacgtcctctaaaggaaaatgtaagcctggtgtgagaaacggaggacaaaacaaagagccaggtctgaaatgaataacgtccttgtaggcacaccagtccccctgggcggctgtcacaggacgccgcggtctagctggcttccccgacggaaatgctgtctcaggcctggaggctggaagctggcgtgagggtggcagcaggtttcgctccctgggagctcggctgtggtctgcagatggcatctttccgtgtgtcctcacgcagtcgcttctctgtgtgtgcacttccctgacgtgtctctgtccaaacttcctcgtctgaggaggactccagtcattctggatcagggcccacccatatggcctcattcagccagtcacctctttacagtccaatctcttcatcccatcccattcttagcgtgaattctggagggatcctgttcagccaataacagtaggattaggccaggtgtggtggctcacacctgtaatcccagcactttgggagactgaggcaagaggatctgcccaggagttccagaccagcctgtgcacaggcaaaacctcatctctccaaaaaagacaaaaattagccaggcctggtggcgcacacctggagtcccacttacttgggaggctgaggagggaggatcagttgagcccgtgagccccggaggtcacggctgcagagagccatgatcacaccactgcactccagcctggccgacagaggaggccctgcctcaaaacaaaaacaaaaacaggaggattaacaacagattagacagctcaaaaggaaacaccagtgaacttgaagatatactatcagaatctaccccaaatgaaaaacacacagaaaatgaataaatgaacgtattctcaaagatctcctggaaaatatcgagctgcctaacagaagtgcagttagagtctcagagaaacagaaagaggcaggaacagaaaatcatttgaagaaaaagcagtgaaagttttctaaactacaagaaaactgtgatcccacaaatgcagaaagctcaacagaccccaagaggggtaaatagagaggcatgcactgcacagcaaatcctaatcaatgcccaggaaccagggacacagaggggacctggacaccggggtcaggtgaggccacctttgggtacaaagacgcaaagataagggccgtgcggacttgtccccaggaacagttcaggtcagaaggtgagcaaaacatttttacaatgctgaaagaacatttcacctttgaactccaaacccagtgaatctgtctgtcaaaaatagaccacgctcggtggcctccgcctgtggacccagcaactcggaggccgaggcaggaggatcacttgagccccaggattcaaggccagctctggcaacagagcaagaccttgtctattaagctacaaaaataaatgaactggaggctgggcccagtctaggggactgaggcgggcggataacttgaagtcaggagtttgagatcagcctggccaacatggtgaaatcccatctcagctaaaaatacaaaaattatccaggcatggtggcacatgcctatagtcccagctactctggaggctgaggcatgagaatcgcttgaacctgggatgcaggggttgcagtgagccaagctcccaccactgcactccagcctgggtgacagagtgagaccctatctcaaatatatatatgaaagcaaatcaaagactgaggacatactgacagctgagagaatttctcagcagcagacagatttgcatgacaagaaacatccaaggactttcttcaagcacaaggaagttttttcatagggaaattgtttctttttttttttttgagatggagtctcactctttctccaagctggagtgcagtggtgccatcttggctcactgcaacgtctgcctcctgggttcaagggattctcctccgtcagcctcccatgtagctgtgattacaggtgtgcaccaccatgcctggctaatttttgtatttttagtagagatggggtttcaccatgttggccaggctggtctcgaattcctgacctcaggtgatccgcccaccttggccttccagagtgctgggattacaggcgtgagccaccttgcctggcctcatgtggaaattgaaatctgctcaaaggaattatggatgaaagaaatggcaaatgtgggaggaaatttttttctcatttttaaatatcttcaaaaataataaaatgcttaacgcaaatatgttagtgatgcattgtgacatttaaagcatatacaattaaaacctatgacagtagtataagttatgaaagggaaaggcaagtgtgtgctggtgagattcttctgcatttcccgctgcgtgggaaggtgcaggcatgtttagtggtcacacaacctgaatataggctgtgataagtgcagatggatgtcacaaacccttcaataaccactaaataaggaaaacaaagatgtatcactaagaaggcaaccatggggatgaaatgaaatactacagaaataatcaaacagaaggtaggacaacgggaaatcagaaatatgaaacagcaaataatagaaagatggtgtgcccacatccagctgtataggtaatgactttgaatataaatggcctaaatagtccaattaaatacagaaatggccatatcagatacaaaaccaacagccaactaaaggctgactacaagaaacccactttacattttaagaaatgggctggttaagccaggtgcggtggctcatgcctgtaatcccagcacttagggaggcagaggtgggaggacagcttgagcccaggagttcaagacctgcctgggcaatatagagagaccctcttctgcagaaaaaggggaaaaaaagacacacacacacaaaagagaaatgggctgggtaaaagcaaaaggattgcagctggaaattacaagacagagctgcagagaccagggagtggtgcagaagctgagcccaggagatggcatgcagagtcgccccatgcctcaagtctgcaggtgagacaggatgtgtctttctaaaggtcaggagccaggcaaggactcccatcctaccacctgcactcaacatggtactggaggtcctagccagtgcaataagacaagaaaaagaaatggaaggcatagagattggacacaaagggggaaaaagacattgcctctttgcagagaatgtgctcatgtgtataaaagtcctaagaaatcgacaaaatgcctgtgagaactagtcactttattatcaaggtcacaagatgcaaggccaatattttaaaaactaaacattggaatttgaagtataagggaaacaagaacatatttgcatcaaaaaacaggaaatgcttaggggaaatttaacaaaatacccgcaaggccagtgaaaacgttgtcgagagaagtgaaagaagttctaataactggaaaggcatggcatgtggatacatcagaagaccaagtatgaggaaaatacccattgtcccccaaatggaccaatgcaatcccagtcaacattccagcaggcttggtcgtcgaaatcgagaaactgattctaaacatgtatatgaaaacagacaggacatttaccagccgaaataatagtgaaaaggaagagcgaagttggagtattttcatttcctgacttaaagacttactgtagagcttcagccattgagagagagtggggcgggcatgaggcgtgccaataggtcaatgaaacaggagcggccagagagagacccattcacagatgatgcaagcatttctgacagaggtgtcaaggtaatgcaatgtgaagaaggtagtctttttggcaaacaatttctggaatactggataaatgacaggggacaatggccttaatctttacctacacgacacaaaaaattagcttgaaacgaacgataggcttgaatgtaaagctcaaactataagacttcctgcgaaaaacattggagaaaatatctgtgacctggacgtgggcaaagatttcttagacaggacgcagaacacaagagctacgagagaaaatgtttgaaattgggacttattgacattagcaactcctgctcttggaagtatgctttccaggaaatgaaaaggcaaaccacgcattgggtgacaattccaacactctgagaaaattcttacaagtcaatacgaggacaaacagcactattgttttttaatgggcaagatttgaacttcaccaaagccatgaaagggtggtcagcatgcacagtcattcgggaaatgacgttaaaccactgtgagattccactccacacccgtcacggtgatggagaggaaaagttctgaccataccaagtgtgggaaggacatggggtaattagagctcccacgtgctgctggcaggagcctgaaatggtacagctttggacatcggtttggcaaattcttttagagagaaacacacaccttccctaggacccagcaactccactcctagtaaccaagtgaaatggaaggagttgtcctcagcaaaacgtgtgtgcgaaagttcacagtcactttctcggtgataaccaagagctggaaaccactgcaacacccaccagcaggtgaacggattaacacactgggctagggccacacaatgagatgctacgtggcaacacaaaatgaaccgtggacacacactgcacggcggatgaatatgcagacatcaggccacgtgaagggagccaggccccgaggcgccacgctttgtgattcaggtgaaattctgggacaggcagatctaacctgctgggagagagaggtcaaggatgatgtggccagggctggggaggggttgggaaggggctcatgttgctggggtgtcaaaacaaagcaaagggccacagacttgggggctcaagaaatggaaacgcaatgttgtcatggttctgggggctggaagtccaagatgcaggggcaggtggggttggttccctcctgggcctgcagatggtacctgctccctatgtcctcacagggtggtccctctgcccccaggacactggcgcctcttcttcctataaggacaccattcctcctgtgtagtgctggccatcattacgtctcttcaccttaatcagttctttgagggccccatttccaaacatagtcacactggggtgtagggcttagacctgtgaattgggggaaacgtcattcagtccatagaagctcaacaagggaactttcttggaaatgtcttcatcacaaaagtgatggtggttatgtgagggcaggcacttgccagactcaaggctcacaggctcacagcgggtgtactttattggacgtcatacggaccctgaagcaggtgatgtttccaagtgggaattggtaccaggctgtcctatgtctgtccatcccttgggtccgtctgcacggaacagacccgtggcccacaaccccagtgtggctgcagcctgatgaatccaggagtcttggcccagccccgaagcccctgggaggtccggccccaccctgggaaaagtccaggctgtgcccaactctcagaagatgttgacacccataggggccctgcccctggcagactgctcgggcctccttgggccgctccttccctgatagtcacaggctctgaggaggtcgcattccacctgctccaccgcgggctccggcaaacccaggtctccccaccccagccactcccggcccagccctgccctgggttcacttcctcaaggtctggtgtcccctcccccgagcactgtttgcttctctgtgtatgtatgtttgcccacatgtgtacacttttttaggctgtgttaatctgttcaactggtcaggacaaagtcccacagactgagtggctgaagccatgggcagcattttcccacagtcctggtggcgagaggtcccggagccagcgcaggcagggttggttccaggcagcgtctcttcctggcttgcagaagggaccttctcattatgtcctcacccggccttccccttggccagggcagagagagggcgcttggtgtctctccctccctacaagtccacctccaaatgcagcatcactggggcttaagtctccacacagaaaatcaggggagacacaattgggtccagaactgtctcggctggaattcgggttcccggcgtggctccaccagggcagcagccccagaggcaaagaggtctccttctccggctgagctcatccctggggctgaactttgctgagaggatcagctcccaggcctggccagccctccagtgagcaccaactacgctggctgcagggagtgcttgtgtctgaagaactccaggctggtgtgcccagagggcggctggaggggctcagaaaccattttcacttttctgtctcctccatgtctgcactgtttgggtttgtacccgcctgtgtcgcttttgcacgggaagtgagatggagagacacgtgaaccaccattgctggggttccagcatggggccccaggggacccatggtttcccagaaggaagctctgccattggacagccggtctcaggctgctgcacaggcccctccccgccctcagccctggcctgcgggaatcaggaaagggtggggtccagctgcattgcgaatggactaaagccactgatttgcacacttgccaatggctgaaatggtcaataaaacgtcatgtaccttttgccacagggaagaaagcacgcagccaaagagcgcaaagaggctcagaggaggcccgggtgccctggagagacgctgcgtcctgacgacacagcatccctgtcccgcagcggagatttcccagatgaaggattccccggcgggagacagggccctgcacacaggtcctctgccatgctgctcaccatgcctgtgtgttatctcaccatgaaaagtcacctaggccaggcatggtggctcacgcctgtaatcccagcactttgggaggtggaggcgtgcggatcatctgagatcaggagtttgagaccatcctgagtaacatggtgaaaccccatctctacgaaaaatacaaaaattaactgggcgtggtgttgggcacctgtaatcccagctacttgggagactgaggcaggagaatcacttgaacctgggaggcagaggttgcagtgagctgagaccgcgccattgcactccagactgggcgatgagcaaaactccatctaaaaaaaaaaaaagtcacctaaaggattaacagtgtcaaacagagacggaggctctcggaagtcacagcgtttgcagcaaggtggctcccagagctgggaggaaagccccgcctgcagccaagctcctgctccaccaccccaggtgcagaggggctgccccaggcgggggactccaactccctctcagccagggccaggcctgtggggtccgggccttctcagggccgaggcctcactgcccgagcacgggccctgcctgcggcagttacgcggatggttcctttttaaacgcaggagctgccgtcatcttctctcactcaacggtcatcatggaaagtgaaaacgacggtgcggctcctcccacggaggagagacaagctcacaggtggggaagccagaccctcgagggtgaagtggggggcacagccccgtcctccctcagatgccccgagataggccagggtgggagaaaggggcacctgtcccaggcactgggtggccgctgcccggcagagggtctctgcccccatcaaagggaagtggaggcccccagggtaggttctgtttggcctgcatttatgaagcacctactttatgtctggaagtcagggggcccggggcaggctctgttcagcccacatttatgaggcacccactatatgctgggcagtgagcactgggatggctgcccaggctggcctgtcccacggaggagagacaggctcacagcagggaagccagaaccccgagtgtgaagtggggggcatgggatcagaggtggcccagaccccatgagctggggctgcaccaggcacagaaagagcagtgacagcgactcatggcttcgggctgctcagctcctgcccgtgcccactgcaggaaaaaacaaggacttccgcctccctgcggtccctcccccacacccgcccacatggccaggacgtgactgtcaccatggggacttccgcagggcctggtgctttcccagacaggtgactgccagtctggtctcagcctcccctaagcaacattccaggatcctgcggaaagacccacccaggcctgggccttccctagtctgtgcaccactgcgtttgagacgctgggctgtgacccctggcggcagctccactctgctggagctggggcttgttttaaattatgacctaaaactctaaaaccctcgcctgtaatcccagcactttgggaggccgaggcgggtggatcacgaggtcaggagatagagaccatcctggctaacactgcactccagcctgggcgacagagccagactccgtctcaaaacaaacaaacaaacaaacaaaacactctaaaaccctcaaaggaaaacacaagcctcttgatgttagacttggtagtgatttcttgatttcttgggtatgacaggaaaaggacaggcagaaacgtgtaaaatagatacatggggctttacaaacaagaatgaatagaatgaaaggcaacacatggactgggaggaaatgtatcagataaggcattccgtctagaatttgtaaagaaccctcacaccccaacaacatcaaaaacaaaccactgggtgaaaaaatggaaaaggactagaatagagaagacacacaaatggccaccatgcccctgaaacaaggctcggtgccaccaagcatttgggaaatgggaaacgcaaatcagaacaacggggagaccacctcaggcccagcgggatggacggcttcttttaaagcccccaatacagagaataagattttttttttttttttttttttttgagacagagtcctgctctgtcgcccaggctggagtgcagtggcgagatcttggctcattgcaacctctgcctcccgggttcaaggcattctcttgcctcagcctcccgagtagctgggactacaggcacctgccaccatgccccgctaattttgtatttttagtagagacggggtttcaccatgttggccaggctggtcttgaactcctgacctcaggtgatccacgcactttggcctcccaaagtgctgagattacaggcatgagccaccgtgcccggcctggagaggaataattgttgctgaggaaggggagaaattagaattcccgtgcactgctggcgggaatgggacatggtgcagatgttgtggaaaccattagggcagttcctctaacaattaaaactacaatgaccatgtgatccagccactccgcttctgggtatagatcccaaaggactgaaaacagggacttgagcacatatttgcacacccaggttcacagccgcagtgtccacaagagctcgaatgtagacgccacgcaaaagcccatcaacaggtacaagaataaggaaaatgtggccgagaggtccagtggaaggtgctcagccttggaaaggagatcgaacacaggctgtgctatggatggatgttgaggaatttatgccacgtgccataagccatttatagaagacaaaggccattatgatgccacttctatgaggagcctacaattgtcaaatttatagagaggaagtagagcagtgggtgccaggggctgggggaggcagttagtgtttcataggtgagggttccagtttaggattgtcaacaaattctggagatggatggtggtgatggctgcaacaatgtggatgtacctaatgccactgaactgatcttaaaatgctccgcgtggtgaattttatgtcatgtatatcttatcacaattacaaaatagttttgaggctgggcacggtggctcagcttgtaatcccagcactttgggaggtcgaggcaggtggattgcttgaagtcaggacttcaagaccagcttggccaacatgatgaaacctcatctctactaaaaatacaaaaattagccaggcggaacctgtagtcccagctacttgggaggctgaggtgagaggatcacttgagcctcggtggcagaggttgcagttagctgagattgcaccactgctcttcagcccgggtgacagagccagatcctgcctcaaaaataataataataataataataaaagaaagaaagttgatcaaatcccatctttggtgtatatagggtgggacttggggaaacacagctgctctttcccaggggtcctctgcagcctgcccacctggttgagtctgtgaggcttctcatagggacatcctgggctttgctggagggggatgggcaggatggcaggggccaggggccatttgggatggagctggagcgctccagcatcctctcagccacagtggggctgcgattcctgctgctcagaagcaaggcgagccggccagagtggctgataactgagcgtgcggttggcaaaggtggttaccagggtttgttttacagatgaagaaactgaggcttagacaaggtggtgacttacccacagtgacccagctgggcggtgccagagccagcatctgaataagccctggtctgatgcaggtcctgcgatctccccacgccctgacagtgacctatctttgtgcacacacgtgtgtttgtgtactgggcacacctcccctaaggtttgcagggcccagggctagaacagagatgtaaacacgagaagaggcaggaaggtgtgtgccattatcaaaagaaaagagaggctggccaggtgtggtggctcatgcctataatcccagcactttaggaggccgtggtgggtggatcacctgaggtcaggagttcaacaccagcctggccaacatggtgaaaccccgtctctactaaaaatacaaaaattagccaggtgtggtggtgcgcgcttgtagtcctacttgggaggctgaggcaggagaatcgcttgaacccgggaggtggaggttgcagtgagctgatactgtgccactgcactccagcctaggcgacagagcaagaatccgtctcaaaaaaaaaaaaaaaaaaaaaaagaaagaaaagaaaagaaaacagaggcaacagaagcagaacctcagatgtgagtgtcagtagacaggtattttaaaataactcattcatgtgttactaaaaacaggaaatgccgtctaacgggatctctggatggagaattccacagctgattggaacctaaacgagagaaccaaatggacatcccagggctgcaggtcagtgtcatgagacgggtgatggcagactggaccccgtggcaggtggaccatggaggggagacagagacagggcaacagaaacggtgcaaacagccactgaaatacccgtgggaaagaaaagcacaacagagaacaggagacttatgtgactccgactcaacaagacgcattagttaaaagatctaatatatgcgtatggggcttcccagaataagaggaaggaaggaaggaaagaatgagacatcataagatagtgttaaaaaaaaaagaattcccagccgggcacgctggctcacgcctgtaatctcagcactttggaaggccatggcgggtggatcacctgaagtcaggagttcaagaccagcctgaccaacatggtgaaaccttgtctctactaaaatacaaaagttagctgggcatgggtggtgggcacccgtaatctcagctactccagaggctgaggcaggagaatcgcttgaacccaagaggcagaggttgcagcgagctgagatcgagccgttgcactccagcctgggcaacaagagcaaaactgcatctcaaaacaaacaaacaaacaaataaaataaaagaattcccaaactgattaaagataccaacccacagactcaagaagcctagtaggacttctgctgctggccacgatgctgcaacttgtcaatgtaaaataaacaacagagagactggctctcccaaataaagtttactgggggatggcaggggattgcaatctgggatatgcatgctgagggggaccgtaggtgtatctttcttttaggggtgggaagaggaagtctacacagattgttttggaataaacctccctgggtacaggagcttattgcagggttggtgattactcatgggtaacatgattgttgcgggggagatgtcttcataggagcagctgatctggaatgttgtgtgctgtcggagtccctgtaacagttctcatcataggcacccgagcatgagggaccttccgttgaggcctcccagctccgttttgcttgggtcctgacataagtgactctgccttagtattgacaattttcacacagtggagccagtttcccccatttgtgccccctcccccagttcatatgctgaaaccgaatccctaatgtgatgacattatgaggtggggcttcggcatgtgcttaggtgggtagtgagggtggagccctcgggaatgggttagtgcttttatttatgtattttattttattttgagacgaagtctcactctgtcgcctaggctgggaggcagtggcatgatcttggctcattgcaacctctgcctcccaagttcaagtgattctcctgcctcagcctcccgggtagctgggattacaggcatgctccaccacgtccagctaatttttgtatctttagtagagataaggtttcaccatgttagccaggctggtctcgaactcctgactacaggtgatccgcccacctcggcctcccaaagtgctgggattacagacgtgagccaaaacacccggccaaagttagtgcctttaaaaaggaggccccccagagccccctcatgccttccaccctgtgaggacacagcatgaagaagtgatctaggaaccaggaaggggtcctcgccagaccttgaatatgccggcgctttgatcttggacctccagcctccagaaatgtgagaaatcaatttctgttctttagaagccaccccatctatgactaagacaccctcccaccttcatgctactgagtggacaagcttacatgaaatgactgttttcacatatgtggcaccaggcagcccagggatgccggtgaaatctctgggtaagtctctttggcctctggtactggcagcttctcctgttaagagggcagtcctccacgagtgtctcgtgccccccacctctcacagggtgtgccaggaatgcaggccctgagtaccctcccccatttctcagggtggtttgccctgagagtcctctagggacaaagagcagcttgctcactgcttgctgcagaaacagctgactcccccagtgcagggctcctcagtggccacgcaaacctactgactgtgcagtgcccacccaggcctacccacatggcacccgtggaatttgggggcaaggggataagaccaaacacacaggtgagcacctgcctgccacgccatgaatgaaaaagtcctttgtctctgaccccggagtttcacgtcttctgtcagcatccctgctgcggtaacgggccagctcttcctttgtaaggaaagctaaaacccagtcccagagctggcaccacctggaggaggaagtgctcttccctgcccctccttggccatgtgacttgctctggccagtgacatgggagtgcaagcgacacatcccagctgtgcatggccgctgggagagtgtggcatggtttctccatctctcctccatgtcctcccttgtcaggagaacggcatgttccagagagccacagcttgctcagcctggaccccagaacgaaggaggcatcagaagctgagccacccgtggccgacaagaaacctgagtgggaggggaaacttggttgctgtgatcgacccaggcttgcgagttgttttggcaacacagcctagcaagagccgaccaatatgtcattgatgaaagaaagtcaacaggcgtgtagaaggagctgtctactgagcatgtctgcacttttctgaattatgttgcacttgagtaaaaagtaagcaagcctgtctatttactttaaatgatgtgtgccagatatgtacagtatgcagagttaagaaggtgccaccccaaaataggctgctctggcatagtcactattaggaattaaaggcagttaaaacaataacaggtgcaaaaagatcattctgatctctcttgtgtttcttaaaagcagaagatgaaattcccaggtgaaagatgctctccctacactagaaagctctgatcctcaaggatgagaagctgagacccagcaaatgctgtacagtccctgataaaatgcctctcaccttttcagccccccacatcatctagctgcttcctcaaacctcactgttctctgtccaactcagcacacgactgagtctgcttcactgggtcttcacttccttaggagggctcctgagccacatccaactttaatcaaatacactggcatgatgatctgtcttatcttgatttaactcttgggcccagccaggacctcaaaaggatggaggtggagtttttcagcccctacatatgcaaacacacacatagcatgtatctgagcggccacatgggctggccctgctattttcttatggcttctcagcctcccagccaccttctgctctgcatcactggagctgggaggctgcaagctcctttcccactctcctctgcccgttggcttccagtgaggctcctgcagcgatggcgttggtgggagatgccaggcgaggaattgatctcgcattctcgtttctgggaacgtctctgaaaatggctgaatcccgtctgggatcccagctcccaaggaggcggcagcttgctcactgcttgcacagccccagacggcagaggggccctctcctgcacagcctgagacagtggaggggccccctcctgcacagccccagaagatagaggggccccctcctgcacagcccgagacagtagaggggccccctcctgcacagcctgagacggtgggggggggcccttcctgcccagccccagatggtagaggggccccctcctgcacaactccagagggtagagggcccctcctgcacagcccgagacggtagaggggtagccctggtctctgggggctgcactcctgggctctggagctgccacagctcctccctcctagtgcttccccttccttgttttgctttttgccctttctgacatagtgacgacttccgtttcgcagtctggaccttcaccaccccagggcgagggcacaggcgaagcagcagcacccccccggggcctctctttatttggaatacagtgtgggggctcccccttccttctccagcccgcccaggcccctggagctgtcctggggcctggggagtgaggacccgtgccagcagcacagactctgccaggccgggcccgctcaggtgggagcccaggccgggtgaagctgtgacccggccctcaccccaactcggtgacaaaagctatcacagggctgcagtgggggaggaacaggacgcatctgccaggcacctgacccgcagtgcacttctgggagctgtgcttatctccccggggtctatttcgccccaaggtttggcgggttaaaagctgatatgcaaccggcacgacatgaacagtatttcatgattaaagacatcgcgtccatgtataattgagatgctgccgcatttgcggggattttcaagcgaaaaccaggccacgtggaaaggctaagccctcgcacccccccgccccccactgctgggacccccgccccgcgggagaccccggcccgcggtcccctatgcccgcgacccctgcgctcaccctctcccctcaaccctgagtccagcccagtctcgcgcgaggccgcagggagacccccgccgctccctggaccacccctgggcccaccgtacccagccgctccccggcgccccccgggacgaccccgagccggctgcccgcctcccgccgcattccgcacaggcgcaccgcgcaccgagggccgcaccgcccagctccgcctgctgcgccaatggccgacggggtccaagtcggcggcccaacggagaggcggggctaggggcgggaccaggacgcgggacagcaactgtcccgcaaggcccggattgaggaggcgggagggaccgaagcaggcggacccaggatttggcgccgcgatctcgaggcttggcctggagtaggaggggaaacaaggcgggactaggggcgaatccgagggggcggagcagggctcggggtgcggtcgggggcgtggccggggcgcgctgcggccatcttgggggcgggcccggggcggagacgagcccgaaggggcggggcctcggcggcagcaagaaaggcgggaccggggcatctcggggcggggcttggggctggatctatgagccgggagcggggatccaggagcgaggagccgggagcggggaacagggagtcggggagccgggaaccagggctggcagcggccgccatgagcacggtggaccttgctcgcgtgggcgcgtgcatcctgaagcatgcggtgaccggggaggtgaggccgggtggacgcagggcggtgggcgcgtccctggctccttgcccgggcgtcctggcagcgatggggtggtgggggccgcggggcctgggcggggctgggggcaacggggcgcgcccatgacccagccgcccggcaggccgtggagctgcggagcctgtggcgggagcacgcgtgcgtggtggccgggctgcggcgcttcgggtgcgtggtgtgccgctggatcgcccaggacctcagcagccttgctgggctcctggaccaacacggcgtgcgcctggtgggcgtagggcccgaggccctgggtctgcaggagttcctggacggcgactacttcgcgggaggtgcgtcctgttccccgccgcggcggcgcacatacccttccctaagctcagggcgttcggggccctttcctgcccaaccccg

SEQ ID NO: 571 - DNA, 89139 bp, Homo sapiens
gtcaggagttcgagaccagcctgaccaacatggagaaaccccgtctctactaaaaaaaattaaattagccaggcgtggtggcatatgcctgtaatctcagctactcaggaggctgaggcaggagaatcacttgaacccaggaggcggaggttgcagtgagccgagatcatgccattgcattccaggctgggcaagaagagcgaaactccatctcaaaataaataaataaataaataaataaataaataaataaataaagagttccccctatgagctgctagaagctggaatgcagggtccagggccgtcccaaatttgcaaccctagagtcttcagctgcaggatcttgggcaagttacttcctctctctatgctttgatctctctctctccataaaatgtggatcatgaaaaacaacccttttaggattctttccaaagatccaaggagatgtgtgttaagggcatggcacataacaactgctcagtgttactggtgattacttctattgcagaagcaggaaaacacagtggtaaaaacaaacaaacaaacaaacaaacaaacaaacatacacacacactctgggatcacactcctgggtctgaatcccagctctaccactccgtagctgtgtgacctttggacagttacttaacctctctgggcatcggtttcctcataggtaaaatgtggataataacaggttgtttttttttgtgtgtgtgacagagtttcactcttggagtgcagtggagtgatctcgactcactgcaacctccgcctcctgggttcaagcgattctcctacctcagccaagtagctgggattacaggcacctgccaccatgcctggctaatttttgtattattagcagagacagggtttcaccctgttggtcaggctattcttgaactcctgacctcaggtgatccacctgccttggcctcacgacgtgctgggattataggcgtgagccactgcgcagggcaagagctcttatcttataggctctttagaagattaaatgggttaatatttgtaaagggctcatagtaaatgctagttgttattctcatcacaatttacctggattattaggctgatgagtgcaatgcagttgaactgaagttttacaagggcagaaagcaggcctgtcttgttgaccgatgtgtcatcagggcctagcacatagtagaacctcagtgagcaattttggaatgaatgaagtatttcctttttacctgccaatatccccaaatgtaacaaaaaccatgactaccatttgctgagaatctaccctggagcaggccccctagtgggcatattacacggatcatctcctcgcatcctcaaaacaacgctgagacaggtggcatcgttccatttcacagataaggaaaccgcaggtcagagtggccccgcagcctgtgaagggaaaagccagaattttcgccacgtccactgggattcccaaatccaaatgttcagctactttctgccaccagtgtttccttcaacctgcgatccgctctcatggatgtcacagccaatcacgtagaccccgagagccctcatgtttgtatttctttgcttctaccatatgttccccctgcttcttactgaagaatagaagcagttcaatgcctcagtttccctactcataaaaggaggaaaacaacagtggtgttctcagaatggccttgaggacggcacaggtgaatcacgcctcaaacagagagagcctctgcaaatggaatagcctctctaccacttgcctatgaatccccccaccaccttgaccctcgggcacacatctttagatttgctgaccaccttctgagctgggtctcgctcctctgcccattagctttctttgcccaagctgatttatctgtcatttctccccctccagcctctatcactgtgcgtacacacacacacacacacacacacacacacacacacacacccctctttctctctcttcttgcagcctcttcagccactaaaattagctccatctctagtccacatccccagcacgcctgtcctggtttctctgggctcccagccacttgcgatattgtgtctcagatgccacacgctgcctgcctgatgtcacagccgcttcctaaaacaagaggtattttgagatcttggagggggtgggagcggggggaagggagggatttcacacatcttcctcccggggtgtttttaaaaaacgctgacacgagagatgtgtgcccccctcactgtgcccctcactcctatttttagtttcaaagcgtccaaaaaaaaaaaaaaaaaaaagcttcagagccaatgagacctctaagggccccagtgggtcaaatcttgatttaaaaaaaattccacttctgggtctatatccaaaagaattgaaagcagggactcagctatttgtacacacaggtttacagcagcattatttacaatagccaaaaggtggaagccaagtgcccatctggatgaacagataagcaaagtgtggtccatccacacaatggaatacgattcggcctggaaaagaaggaaattctgactcatgctacaatatggatgagactggaggacattatgctccacgaaacaaaccagtcacaaaaagacaaatactgtatgattctactcacaggggggacccaaagtagccaaattcacagagatagaaactagaacggcgggtgccaggggctgggggagtggggagtgtggagtagggtggggggagtggggaggggggaagggggagtcggggagaggggaagggggagcggggagtgagagtttcctgggggcagagcttcagttttgcaagatgcaaaagttctggagatggatggcggtcctggttgcacaacaatatgaatgtacttaacgccgctcaactaaacacttaaaaaatggtacattttatgttatgcatatgttaccacaatgaaatatatatatatattttttgagacagagtttcgctcttgtggcccaggctggattgcaatggcatgatctcagctcactgcaacctccacctcccgggttcaagcgattctcctgcctcagcctctcgagtagctaggactacaggcgtgcaatgccacgcccagctaatttttgtatttttagtagagacagggtttcatcatgttggccaggctggtctcaaactcctgaactcaggtatctgcccgcctcggcctccccaagtgctgggattacaggcgtgagccaccattagaacaatgagacaagcaggtcaggaggagatagcacatggacagggggtgaggatgttaccacctagtcatggcaggggcttgatgcccctggaagattttactggcacaattcatattacaaattatttagtgaatacttactatgtgccaggctgtgttctaggctctgggggaatagcagtgaacaaaacagacagaagtccctgccctcatggagctggcattctagtgggggcaggggattggcaataaccaataaacaagtaaatatagcttggcagatgctcttcaggggtgtagagggaaattaagcctagaggcggggagtggggtggcacagtgcaggtgaggcagttacatgttagaaggacacttgagcaaagacccaaaggaagtgaggggggagccaagcagatatctgggggaagagtgttccaggcagagggaacagcctgtgcaaaggccctgaggctggggagtgcttggtgtgtaagggacagcagggaacttgtgtagctgaagccgagtgagtggagaggagagtgggaatagagggggatgggggatcacaggggcagagtttgtgggtccctgtgaggagaatttgggctttttctccaagtgaggttgtgagcaaagaggagccaggtcctgactcagtggctcacaggtgccctctggctgctgtgtggggaacagtcctgggggtggggcaaggactgaagttaagagaccagattggggtggaggggcaactggtttagtccaggccagcaaagatgggggctggaccggggtggggctgtgaaggtggtgagaggtgggtggtggattctgggtagattctgaaggtagagccaataagatgtgctaacagattggatgcagggggtggagaaaaagaggcatagaggcatagaggaagatctggaggtctgaggccagagcactgcagggggttaaagccgcctttacctaaacagaaaatagggcaggaggagcaggtttgggtgacggtggtcttttggaggagctgtaatccctctaacacctcagagtcagctgcacacccatgttcatgacagcactcttcacaatagccaagatgcaggtacaacccaaatgtccatcagtaaaggaatggatgaagaaaatatggcgtgtatatgtacacaatgaagtactattcagtctttaaaaaggagcaaattccatcttttgcgacaacgtgcatgaacctggaggacattatactaagatgaaacaagccagacacagaaacgcaaatagtacacaatctcgcttatatgtgagctctaaaaaatttgaggccgggcgtggtggcccataatcccatcactttggaagcccgaggcaggcagatcacgagatcaagagattgacaccatcctggccaacatggtgaaaccctgtccctactaaaaatacaaaaattagctgggcgtggtggtgcacacctctagtcccagctactcaggaggctgaggcaggagaatcgcttgaacccgggaggctgaggttgcagtgggctgagatcatgccactgcactccagcctagcaagagagtgagactccgtctcaaaaaaaaaaaaaaaaaaaaaaattttaggccaggtgcagtggctcaacgcttgtaatctcagcactttgggaggccgaggtgggtggatcactggaggtcaggagttccagaccagcctagccaacatggtgaaaccccgtctctactaaaaatacaaaaattagccgggcctggtggcaagcacctgtaaccccagctactcgggaggctgaggctggagaatcgcttgaacccaggaggcggaggttgcagtgagccaagatggcaccattgcactccagactgggtgacagagcgagactccatctcaaaaataaataaataaataaataaataaataaataaaaattaaaaatttcaaaaaataaaaaatttgaacccatggaagcagagagaatggtggttaccaggggctggtggtggagggattggggagatattaggcaaaggatacaaagtttcagtcagacaggaggaatacgttttagagatcttttgcacagcatggtgaccacaattaatgataacgtattgtagtgtatgtttcaacgtactatacaacataatgtaatatacaacataaggtattgtatatttcaaaattgctaaaagagtagattttaagcgttctcaccacaaaaaataagtatgcgatgtagtggatatgttaattggcttgatttaatcattcaaaaatgtaaacatatatcagaacatcccattgtactccatgaatatatataattaatttttcagttagaaaaaaagtcaggctgggtgcagtggctcatgtctgtaatcctagcactttgggaggctgaggcaggaagactttttgaggccaggagtttgagaccagcttgggcaacatagcaagaccccgcctttataaaaaaacttaaaaattagccaggcatctggctcatgcctgtaatcccagcgctttgggaggctgaggtgggcggatcacgaagtcaggagatggagaccatcctggctaacacggtgaaaccccgtctctactaaaaatacaaaaaattagccaggcgaggtagcaggcacctgtaatcccagctactcgagaggctgaggcaggagaatggcatgaacctgggagatggggcttgcagtgagccgagattgcgccactgcactccagcctgggctacagtgcgagactctgtctcaaaaaaaaaaaaaaaaaaattacccaggcatcatggcgtgtgcccatagtcctagctactcaggaggctgacgtgggaggattgcttgagcctgggaggtcaaggctgcaataagccatgatcacaccactgcactccagcctcggcaacaaagcaagacgctgtctcaaaaaaaaaaaaaaaaaaaaaaagtcagctgaagaagatggacccccagggacatggaaactggtttgcacccagagccttggatcagggcctgcattgtggggaagtgaccttggtctggctggtaggcgggggatgcaggtcagattattgacctgggctttggtgtctcatctgctaataagggatgcaaaaagccccaacctcagaatctctgggaggcaccaatgggagaattcttgcaaagggctcagacagcccttccctgcatagcacccagcagaacaagagcaagtataagtattagcaatggaatggttgcagtgtgtctagctaacctctcctgggcaacactgcatcatccagtggccatcccctgggaactaagtcaagcagcaaacgtctggaaacagggtctttactttccagaatcagataatcacagaatcagcaacctctactccatgtattgagtgtggcagttaagagcttcgacactgaagtcaagcttcctcatttaaaccccaattccaccacttcctagccgtgtggcttggggcaagtcctctagcttttctgaacgtcagttttctcatctgtaaaatggggagattgagagtgaatgaaataatccctgcaaagccctaagggcacagcctggccacacacatgttatatctgtgttcactattgttgttgttattattatttttagagataagttttcgccctgtcacccagggtgcagtgcagtggcgtgatcatagctcactgcagcctcgacctcctgggttcaagtgatcctcctgtctcggcctcctgaatagctgggactacaggctactgttattactgataccttcatttgtcctgtgaaataggtacaatgagcccctgagatattaggttggtgcaaaagtaattgtggtttttgccattacttttaatgtactttggatctgtgtctgtccgcaaccaaatcttatggcgaattgtaatccccaatgttggaggtggggcctggtggaaggtaattggatcatgggggcagatttccgccttggtgctattctcgagatcgtgagtgagttcttgtgagattggacatttaaaggtgtgtagcatctccccactctctctcttcctcctgttctggccatgtgaggacacctgctccagctttaccttctgccatgattgtaagtttcctgaggccttcccagaagctgagcagatgctgccatgctttctgtagagcctgcagaatcgtgagtcaattaaacctcttttctttataaattaccccagtctcagggtttttatttatttattattattattattatttttacaaggtctcactctgtcgcccaggctggagtgcagtggcataatcattgctcactgcagccttgacctcccaggcttaagcaatcctcccacctcaccctcctgagtagctgggaccacaggcgcgtgccaccacacctggctaatttttgtacttttagtagagacaggatttcactgtgttgcccaggctggtctggaactcctgggctcaagcaatcttcccaccttggcctcccaaagtactgggattatgggtgtgagccactgtgcccagccaggcatttttttttttaattttttaaaaataatttgttttttgagatggagtctcactctgtctcccaggctggagtgcagtggcgcaatcttggctcactgcaacctctgcctcctgggttcaagcaattctcctgcctcagcctcctgggtagctggaattacaggtgcatatcaccatgcctggctaatttttttttttttttagaagagatggggtcttgctatattgcccaagctggtctcacactcccaatctgcccaactcagcctcccaaagtgctgggattacaagcataagccatcacgcccagccccagccaagcatctcgttatagcaatgtgagaacgggctaatacaggccccaattttcagatggggaaactgaggctcagagagacaacagtcttgccagaggtcagcagagcagcagaggtgagcaggaagggtgctctgccagcctgtcctcattttcccagatgtacactggggacaatgacggcacctaccaagaaagatgtgcctggaggattaaatgagataatttactcaagatattgagaatagcactaggtacaaattgtggatgaatgttggtgtttatcataactccctcgggtcactcggctgggcactggagaagcccatgactgtctgactgcagggtccagctccttattacagagctttgctgctgaacctacaatttaaaaacacacaaggctttacttgtttttgttttgttttgttttaagatggagtctcactctgtcatccaggctggagtgcagtggcgcagactcagctcactgcaacctccacctccccagttcaggtgattctcatgcctcagcctcccgagtagctgagattacagggatgcaccaccaaacccagctaatttttgtatttttagtagagatgggatttcatgatgttggctacgctggtcttgaactcctgacctcaagtgattcaccagcctcggcctcctaaagtgttgggattacaggtgtgagccaccgtgcctggcctgcctttgcctgtttcttcagaaaggacaagggaatgaaaaatcagggattgttccctgagccttcgctttttcgaagcactcagcattcctggtgcccaaggcttcccacattgtccccttggctggtacagctgctgaggcgagtgtgattctgaggttggggctttttgaattccctgtttgcaaataagagaggaacctcagctgctcctgaatccacccagagcaggctgggcagtccctgtttttctcctcctgctacagaacaacaggactggaattaagtatagctcttcttccttctgtccatcccctagcaatgtctgggcaagcctaacaaaagccatgaagcctgtattatcagctatgaattcattcattaattcactcattcattcattcactcactcattcattcactcattcattcatccactcactcattcattcactcattcattcattcactcaatcacccatttatgcattcaacagatttttactgaaccccattctcaagttctacacgaggctctgtggttctgtctttaccccccagaggaaggagacagatgattaaccaaatagacaacattaagaggattcacactgatgccacagatggccataaagaggggacctaaactggtatcatagtgggcatgcagtggggagatcagggaaggcttccttcctggaggaagagacagtatcatatcagtaaacatgtacttccttgaggcctgagagtgcccctttggcaccttggcccctcttcaaggcccctggactgcccccacaatgcagcaaacaatgagtacacatgtggcacaacaggggaacctcttttcaggttagctggtgtccctgccacctggatgttaaatactttatgtatcatgtctgggtaagaattaagcagatacagaggagggagcatatctcagacacaggcacacagcatgtgcaaagtccctggggtgagtgggcagaagctgctcgtggagaaggctggtgtccctttccctattttctccctctaaaatttgacagtggacagaaggaagcctggttctacagtggggcagagctgtgtccaaatcctggctctagccacacagaactgtgagaaggtttgaagatgataagctatgtaaaggatctaagacccagcagatgctcagttcatgctctctgaagttgatctctacgccggcctcggtttccataaacctaacactgcagaagggaagagaggtggaggcagctaagaaaagaaaagggccaggtgtggtggctcacgcctctaatcccagcattttgggaggctgaggagggtggatcacctgaggtcaggagttcaagaccagcctggccaacatggcgaaaccctgtctctactaaaaatacaaaaattagccaggtatggtggcgtgctcctgtaatcccagctactcaggaggctgaggtgggagaattgcttgaacccaggaggcagaagttgcagtgagccaagatcacgccactgcactccagcctgggcaacaagagtgaaaccccatctcaaaaaaaaaaaaaaaaaaaaaaagaaacaaaaagagttggggcgggagggagaagagttaaggtctccacatagacacccaaccagcctggcctctgcccccacctgagcccctgagccaatggaatcagagccaggtttccatccagctctgatcaggagtgggtaacatttcaacaaacaaaatccaaagccccagtggacagagggagccaggttgcgtgtctgtgcatgtcagcatggcagacaagaaatctcttcccttgcacgccaaccacctgtgagggttcagaactcagatatcacagtgagatttgataaaagctggaagcatctgaggaggctgtgtaatcattcccacttttctttccagcttgctgtatgatgggccctctgctctcagcagagtttttgctgacattttttcctccttttctctgtgcaagtgacacagtaatgacacgtcatctacattgattgctgagggtcagggatggaaaggaatctgaaaatatgctctgagggcccacagaagtcagggcaaaaggccccagggaacaggaatggggccccagtggccccaggtaaataccagatgggctctgttgccccattccttgaatctggaccagcttcattgcttgctttggacaacagtggccaacacgatgttgtgccattcctgggactagcccttaagaaggctgaacacttcctctttctcttagaatcccattgctgccacgtgaactagctcaggctagcctgctggaggatgaaaagctgccatgtgaactagctcaggctagcctgctggagggtgaaagaccatagggagtggagcacagtcattccagccgaggtcatcctggaccagtctgcagccagctaacagccaaacagaagagccacccagctgacccgcagctgaccaaagatgcatgaatgagctcaactgagaccagataaagcacccaactgggcccagcctaaactgccacccttcagaatcatgagctaaataaatgcttgtcattataagccactgggtcttggggattgtttgttacacagccgtattatggcaatatataactgatgcaaaggagcatacagaagaggtaaatatgagttacactaagacagagttttaaaataaaatatcctgattttattttattttgattataggtgcacgccaccacacccgactaatttttatatttttagcagagacgggatttcaccatgttggccaggctggtctcaaactcctgacctcaggtgatccacctgccttggcctcccaaagtgctgagattacaggagtgagccaccatgcccagctttctctttcttttctgactatcctgttcccctgtttcctggtattgccaaacaaaccacttgtcctcaaattttttttttttttttttgagatggagtcttgctctgtcacccaggctggagtgcagtggtgcgatcttggcttattgcaagctccgcctcccaggttcacgccattctccttcctcagcctcccgagtagctgggactacaggcgcccaccaccacgctcagctaatttgttgtatttttaataaagacggggtttcaccatgttagccaggatggtctcgatttcctgacctcgtgattcgttgccctcaaatctttgtctcaggatcagtctgggttctgggttcttcttttttctttttttttttttgacggagtctcgttctgtcgcccaggctggagtgcagtggtgccatctcagctcactgcaagctccgcctcccgggttcacgccattctcctgcctcagcctccccagtagctgggactacaggtgaccgccatcatgcctggctaatttttttttttttgttttgtatttttagtagagacggggtttcaccacgttagccaggatggtctcgatctcctgatctcatgatctgcccgcctcggcctcccaaagtgctgggattacaggcgtgggccaccgtgcctggcccagtctgggttcttgattgcaaaaccaaacactgaccggctatcttaggcataaaagggatttttaggaaactcagataatcaacagggggccagaagaggggatttgggaaatcagcaggaacaatgtagccagcctgaccttctcctgtagcaggaggccatgaaagagtccaaaccatcatgtttggatcacttggtccattttcaaattcctgggtaggaaaacgtgactggttgagttttttattagtttgttttttgagacaggatcttgccctgttgcccaggctgggctggagtgtagtggcactatcacggctcactgcagccttgacctcctgggctcaagcaatcctcctgcctcagcctcctgagtagcggggactacaagcctgtgctaccacccccagctaattaaaaaatttttaagagataggggtctcactatgttgcccagtctggtctcaaactcctgggcttggctcaagctatcctcctgccttggcgtcccaaagtgctgggattacaggcgtgagccactgcgcctggccctggttgtttaaatcacatgccctgactaccaggtgatggggtgacaatgaatccctttcaccttcaacttattagtgagggtgggatcccatagaccagcagtactttatagaaaggggaggattctccctaaattggaaagggaggtcagatattgggaacccaactaataatagcaaacgttccctacagttaactaactggtctatggaactgggcctggggaagtagtaataattattatcatcattataatgatagttattagtcttacaatagctaatataattgagcacttattctgtgccagtttttgttctgaatgccttatatgtatctcactgacttttaccttttgaggtaggtgcaattattattcccattccacagatgaggaagctgaggcccaatggactatatcactttctctttcttcagactgtccctgggcaagtaacatccataaacccagcccagcatgggtcagacattaactcattgaaccttgaaaacaactccataaggtggtagtattttgttgttgttttgtgttttgttttgtttgtttgagacaaggtctcgctctgttggactgcagtggtgcaagcacggctcactgcagacttgacctcctgggctcaagtgattctcccacctcagcctcctgagtagctggaattacaggcacacactatcacacccagataatttttgctttgttttgtttttgtagagatggagtttcaccatgttgcccagaatggccttgaactcccaagtttaagcgattcacccaccttggcttcccaaagtgtttggattacaagcatcagccaccatgccccaccaagtcaggggatgctactactctcattttccagatgaagaaatggaagattcagggaggtacagtaacttgcccaaggtcacacagcttggaaacagtggagtcaggttgggaatccactctaaccccaaagaccaggtcttaaccactatgcttccttacgtgtctatgtagactggctgtcctcatttagagatgcctgcacaagaagcagctgggttgcaaagcaatgtttaaaaaaaattattttttgagacagagtcctattctgttggccaggcatggtggctcacagctgcaatcccagcactttgagaggccaaggcgagtggatcacctgaggggagaagttcgagatcagcctggccaacatggtgaaaccccctctctactaaaaatgcaaaaattagccaggcatggtggtgtgcgcctgtaatcccagctacttgggaggctgaggtgggagtgcttgaacctgggaggcggaggctgcagtgagccaagatcgcgccactgcactccagcctgggcaacagagcaagaccctgtctcgaggaaaaaaaaaaaaaaaaaagagtctcggtttgttgcgagtccagtggcatgatcttggtctcccggcttcaagcggcccaccaggcagccacctccctgccctggtgagaggagaggagtcattaggcatgcaaactgtagaggcagtgggacagatgccccttggaggcaggctggcatttgtcatagcaattcgagaaaacaagacctcagtcggcccccaaacctgcggagagatggatggcaaggtcttctccagccccacagggaaaatggccaagaagctcagtatggaacaaggtcacctggccatctggcctttactcagtccctctccaccccagctggaggcagagggagggaagagaacattttagcacaatacggtgtgctgggagctgtccagggtgctgaaacctgtaacccgctaagcttccaacttccgctccttgagttagcgccgagtagaccccaaggcaaaaactagggtccaatggttaatttgggaggtaatgcaaggaattacaagtgaggaatgaggaagagagagattggtaaagggtacactagtgaatgggttttatgtgaacaactaggattcaattttactgaggcacctctatgatgctgtataacatatttcagtgttttcccactgagcaatggggaagccagggtatttatacactgactccctagctcactggttgagggatgctaccgaggttgttaagcatctggctcagcaaactctgtgatgccagagactgccctccaacagagatgtagagagatgggagtgtaccaagaggaagctgcaggtgaacttagacgtaagctaggtaaataaggcatggagaatttgtagcatctatcacatgctcccccacaagaatttaagtttttttccttcagttcaccaactttcgtgtgtgatgcaaaccctaggagctaggcactagttttactccctttttccaggtgagaaaactgaggttcagtgagttcaacccacattctcactgtcatagagggaggagcttcctctgactctgaagtccaggtcttaaccatggcgctaggccaatctctcatttcttgaaatctcttctgctcctgttttcccccagccatagtggaacccaagatcagggaggggaaggaaggatcaccctgacttcccatgtcagagagctctattcaaattctcaagtttattttccttggcaaacttgaccttagagaaatagcgtaggattcaagaaaatgggttctagatccagatctgccttagttcaaatcctgggtccaccacttatgagacagatgctctggcttgaatatttcaaaccttccaaaactcatgttgaaatttgttttatttattttatattattatttattgacacggggtctcaccctgtcacccagcctggagtgcaatagtgtgtgtgcattatagctcatgcagccttgatcttaaactttccagtctccataactgtaagaaataaattgctttttctttataaattactcagtttcaggtgttctgctataagcaacagaaaacagactaagacagtaagcatttaatgtctttgagcctcagttgctccatctgtaaatgggaataataatagtatttatttaaccttgagagttgaaataattttatttttatttttatttttagagacagtcttgctctgtcacccaggctggagtgcagtggtgtgatcatagttcactgcagcctcaaattcctgggctcaagcaatcctcctgcctcagcctcctcattagctgggactataggcatgtaccaacatacctggccaactgaaaaaataaactttttacagagacaggatcttgctatgctgctcaggctggtctcgaactcctgggctcaagtgatcctcctgacttggcctcctaaagtgctgagattataggtgggtgcctatgtatgtatataatatatagtatatcatattgtaagcacctcataagtttcagcttatcaatgttgccactgttgttaataacaggcattacattcctaaggacactgggttgaatacagctctttgctgaacttaacacaggcccagtattattctaggtttagagaagtgtcctagcagagaggctgagatcctgatccaccccttaccagctgtgtgactcccttgtgagcagcttaacctctctgagcctcagattcatctgtacaaaggctagcgaggctcaatgtgataatacacataaaactcttaatgtagtccctggcacatagtaagtactcaataaatgataagaataacgaccatggcagctaacatcattattatcactgtcactgctggtgttgttagaagatggaagaaaatagctcctgctgctaggaagtgatgtggttcctggtgaaacatggtccagcaaatatcatgacaaccaaaagctttgaacaataaaaagatcgatgctctctcaatggtataactcactgagaatgacaaaaagcatttgtgtcacagtggggaatccttttggtaccaaggatgactgatccatggaggggagaaactactgcagagagacattaaaataaaatgctgctggtatttataggaactgttgctggtctcatgagttagaatgctggttgtgttttgttgttgttgttggaatgctgtttacatgtgaaggcaactaagagcaggtgcatggggcaggggtgaagaaagaaaggaggtaagaagcaactacatgtatttattcaattaatcaaaaaggagagaggacatgagaggtgtatggtcaagacactgacccctctgagacttggtttcctcaactatataataaaaagcgaggaactgggattattctctgaggatccctttcttattctctggaaagaggccataggctagtcagggggcaagaggaaggaagagagagctgggctctagtggcagaacctgaggggtgatattaaacatttataccacttccattgcccaaaaagccagggttcctggctccatgacttgaagacaccttcttattctagatctcttgccaccatctctgtgtgactttggacaaaccacttgtttgtgagtaaaacagaagggctggacctgccagaatccatggagccttaaaatccaatgatgcggcccggtgcggtggctcacgcttgtaatctcagcactttgggagacagaggtgggcggaccacctgagggcaggacttggagactagcctgaccaacatggagaaacctcgtctctactaaacatacaaaaaaattacccgggcttggtggtacatgcctgtaatcccagctactcagaaggctgaggcaggagaatcacttgaacctgggaggcggaggttgcagtgagccgagatcatgccattgcactctagcctgggcaacaagagaaaaactccgtctcaaaaaaaaaaaaaaaaattcaatgatgcttcaagaccaaaaaacaacatctttccctgatggttcctgtgtagttgtgtcttttccttgcctctgatcttcaacaaaatggcccaaagcctgagacagtttatagacccttctaaaaaggaaccttccgtttcatagagtcataaaatgtcagagctggcaaagacccagagcttctctgtcttatatctcatctgatgttcagggcatctgccatagacttctggactatctgactatttctatcagtgtgttggtcccatcttctaaacagcttagtaaatttcccaggacactcattatcagaagtgttacccttttccggcttaacaaccatttattttactgagcatttattatgtgaaagggacagtgctaaccctgtgaataaaaaagaaaaaaaattgtgctcacccctctctggtgaggttcacagtctcttttcttaacatgcacgatttgtgttatttgatctcttcaatatttatatatatttgagaatgacagtaaaagaactgtcatctcagacatacagccaagcttctgaaatcttcctcttacacattttcagtttcatgatcagaacacaaatacaataaaaacatgccttacaagggtttgacaacattataaagttaggatttctctgaggctctgagttacaaagaacaaacagatgtccggggtaagatcttttccaccaaacttcacccaagaagaaggtaaacaccgtggtggtccacacaaaatgaatcacgttttaacgctgtggtttgcttcaggaatctgagagggcaacaggttaatcagaaagtactcattaggccgggcacggtggctcatgcctgtaatcccagcactttgggaggccgaggtgggcagatcacctgaggtccggagttcgagaccagtctggctgatagtgtgaaaccccgtctctactaaaaatacaaaaattagccaggcacagcagtgcatgcctgtagtcccagctactcaggaggctgaggcaggagaactgctggaacccaggaggtggaggctacagtgagccaaaatcccaccactgcactctgtcccgaaaaaaaaaaaaaaaaaaaggaaagaaagtactcattaaagtcatcactgtctcaatgtcaaattaatatatttgagtcccctcctctctgaaacatagaattaagtgtctactgtgtttctctaccattgacattggcagaaggctaggtctgcatgatgtgtgtgtgtgtgcgcgcgtgttttttctttctttttttttttttttttgagacagagtctcactctgtcatccaggatggagtgcagtggcacaatctcagctcactgcaacctctgcctcctggattcaagtgattctgctgcctcagcctcccaaataactgggattaccagtgcacaccacaccaccatgccaggcttttttttttttttttttgtatttttagtacagatggggtttcaccacgttggccaggctggtctggaactcctgacttcaagcgatctgcccgcctctgcctcccaaagtgctgggattacaggtatgagccacagagcccagctgggattttttttttttttaagacaaaatctcactttgttgcccaggctggccttaaacccttgggctcagggaatcctcccacctcagcttccagtagctggaattccaggtgcttgcccgctgcacccagctcatgcagaatgttttactttcccctccctgttcctagcttacaacccaacaggacactaaacagcaccttggaatttggagtaataaaatttgagcaatgtgcctcatttgaaggagatagaaccaccagacaaaaaggataactgactaccagagaaataagagcaagaaaagcaagtgaaagaaatgcatggagaattcaacaagaaaggagaaggggatgtgaaaggaacccaatctagaatagaaggtcttcatgataggatcaggattccctgagaatctaataaaaactacagaccagaaaaaaaaatatacatatacacaattttcttcttgcataaaatttcagtgggttcattcatcccaacgatgagctctcacccttaggacctatctgttctagatgaagtatttctcctctagaggaatgagtctagaatctcttccatcagatgacaggaaactagaagaaaggccaccttgttgtaagcagggagatacaaacacaagtgacaaactgacctactgaatgactgccttcagtttaatgatcacttattgggacccactaggtgtctgtattagtcaaggttcttcagagggacaaaactaacaggatagatgtatatatgaaagggagtttataaggagaattgactcacacaatcacaaggtaaagtcccacgatagcccatctgaaggatgaagagcaaggaagccagtggtggatccgtcagagtcctcaaacctcaaaagtagggaagctgacagtgcagccttcagtctgtggccaaaggcctgagagctcctggctaaccattggtgtaagtccatgagtccaaaagctgaagaacttggaatctgattttagagggcaggaagcattcagcacaggacaaagatgaaggccagaagactcagcaagtctactctttccaacttcttctgcctgcttttattctggccacactggcagctgattagatggtgcccacacagattgggggtgagtctgcctctcctagttcaccggctcaaatgttaatctcctttggcaacaccctcacagacacacccaggaacaagactttgcatccttcaagctgatcaagttgatgctcaatattaaccatcacactgctcaataatatatgagcttccctaagtgttcccataaccgtgttattatgaaaaaaaaaaaaaaacagggctgcaaaagcccatcaatgatagactggataaagaaaatgtggtacatatacaccatggaatactatgcagccaagaaaaagaacaagatcatgtcctttgcaggaacacggacggagctggaggccattatccttagcaaactaatgcagaaacagaaaaccaaatactgcgtgttctaagtgggggctaaatgatgataacacatggacatacagaggtgaacaacacgcactggggccttttggagggtggagggcgggaggaggaagatgatcaagaaaaataactaatgggtactaggcttaatacgtgggtgatgaaataacctgtacaacaaacccccaagacacaagtttacccatgtaatagatctgcacttgtacccctaaacttaaaataaaagtaaaacaaaaaaaaccacacagggatttttaaggctccttcctgccagcaaggtcaagccagcctcagccagcagaagccagcccccagggagcatgaattggcacaaccactttgcagagcaatttggcaatacctagtggggctgaggatgcacacagtatacaactcagcagttccactcctgggtacgtgccctagagaaactcacttgggagaaagcagggacactttgggtcaaaatagcccaaagctggaaacaatccaaatagataaatacacggcagcatactcctaccacagaatactatgcagtcatgaaaatggatgcatggaaactatttttattaatcagatttatctcatgttgaacacaaaagtcaggttagagaaatgtgaagtttgaaaaacagtaccacatatctctttttttctttctcttttcttttttttattttttattttattttatttttttgagacaaggtcttactttgttgcccagcctggagtgcagtggtgcaatcacggatcactgcagcctcgacctcctgggctcacgtgatcctcccacctcagcctcctgagtagctgggactacaggcgtgcgtcatcatgcctggctaattttttgcattttttttatagatggggtttcaccatgttgcccaggctggtcttaaactcctggactcaagcagtcttcctgccctggcctctcaaagtgctaggcttacaagtgtgagccatcacacctggcctttattaaaaaaacaaaaaaacaaaaaacaacaacaacaacaaaaaacattttttagggacagggtcttgctctgttgcccaagctggagtgcagtcatagctcactacagcgtcgaccttatgggcttaagtgatcctcccgccttggcctcctgagtagctgggaccacaggagcacaccaccatgcccagctgaatattttattacattttatttcattttgtagagacagggtttcactacattggccaggctggtctcaaacttctggcctaaagtaatccttccatctttgcctccaaaattgctaggattacaggtgtgagccaccattcccagcccacatatttcttatctatgcatgtagtcaaagtgtaaactattctcactctgatgctatttaaaaaatattttgaagtgtaaaaataggtagcatatatttcttatatacttaggcagccaaagtgtgaatacataaatgcaaataataaacataaaattcaggaaagtgcccctggatgggggagagaaaggaatgggtctagggagggagaaaacagggattagaaaggttagaaaggttttgttttgctgggcacagtggcttacgcctgtaatcccagcactttgggaggccatgccaggtggatcacttgaggtcaggagttcaagaccagcctggccaacatggcgtaaacccgtctctactaaaaatacaaaaattagctagatgttgtggtacacgcctgtaatccaagctacttgggaggctgaggcaggagaatcacttgaaactgggaggcagaggctgcagtgagctgagattgtaccactgcactccagcctgggtgacagagggagactcttgtcaaaaaaaaaaaaaaaaaaaaaaagagaaaggttgtgttttgatagcaggttactccattacttctctatccccaattctccccattcttctggtcaccttctctagccatgtgggtcttcttactgttgatcaaacatgtcagatacagtccagcctcagagcctttgcactggctgttccctttgcctgacactctgttccagctctcctcatggctcactcactcacctcccttaggttttcattcagatgtcacatgcccagtgaagtcttccctggcttccagcacccctcacccctgcctgccacacatcccatccctcccctgctttatttttcctctgtacccctcaccgccatctgacacactagattcattcatcaattgtgtccatctccatcagtagactctcagctccatgaggacaggggatttttctattttgtttactgctgtgtcccagagcctagaacaggacctggcacacagaagtgttcaataaatagtcattgaataaatgaatgtatacacaggtgtttgctctattattctctacttagttttgcatgggatcttgctaggttacccaagctggtctcaaactagttaggctcaagcaatcctctctctccagcctcctgagtaattggggttacaggcatgtgccactgtacccagctttatacacttttaatttttattttgtggagatgtggtcttgctatgttgctcaggctcgtctcaaactcctgggcccaagcaatcctcccaccttggcctcccaatgtgctgggatacaggcatgagccaccctgcccagctttacattttttaaacaataaaaaagttagccactaggctgtttctagatgagtttcctagtagactaagagaaaagtgcccagtaccataatatgcccttggaacccaccaaggtcccaagccaccgaactgtgagcacagccaacaaagatccctctgtgaacacccaagcccatgagagctagcccagagtccttacaacagactgctgacatctgaaggcctctacagaaacagcccaataggccacagctccttctgtgagaggcaacattgctctgaaacaaatctgcattgtgagagcccggccagcacagtgtgggtgctgcaacccatcacatccgccaagagagacagaacctggagcagcaacaaaacatggaaagctatgatcctgtaaatgattactatgaaaaaggtgtccagtgaagaagggtcttagaatagaagagcccagacttagctgagaggagagtagagagtgggaagaggaggaaccagccattggtaccagatactaatgtccctactggaatctaataaaagtttttaaggtccctgacagactagtaggtcattctccaaatccatttcccttttcttctaagcacaatctgatacttcccagcttcccttgcagtgatgtgtggtcatgtgaccgagttctagccaataggatatgaatggaacaggtatgggtcacaccccttccaaactcataaacctttccaagtatcaccttctatgctcacttctccttcctggtttgatacagacaagcatggagttattggatgatgtgggctgacaatgaagagccacaatatggcaagggtcagggtccgtcagtcattggaggagatgagcctgtcaactaggaacaattattttggacttttttttttcgagatggggtcttgctctgttgcccaggctggagcacggttggatgatcatagctcactgtgccctccaactcctgagctcaagcaattctcccaggcatgtaccaccatgcctggttaatttttattttattttatgttttacagatgggggggtggtctcactgtgttgcccaagctggtcttgaactcctgagctcaagtgatcctcccacctcagcctcccaaagtgctgagattacaggcatgcaccaccacacccagctcaattttgaattttctatgagtgacaaataaacttctgccgtgtttaagtcatttcctagctttggatcttttgttataccagcaagtgctacctcatacagggtgcttagaggaaagcatatacacatttcaaccacagttcatcatatatggatctgaaaactccttgaagacagtaactgtaccttatttagcttgcttttctcctttgtcataatcacaatcccttgcacccagacattctcaaaaaacattcaccaagttgaaataaaagcaagatatcctcaagcaaatcaagagacccatgcacgtacaacacttaaaaccttgagttctggaatgcataatcttctgttcatctcccagttccatcacttacttgctgggtggccttaagcaagttacactctgagtttctgattcctcagtggtcagatgggaatattaatatttcctaattcagtgggttgttgcaaggattaaattagagaatgggcataaagcactctggaagcagccaacaataatgagctattattttaattgtaacagaaagcatctgctgtaatatacagctgagacatggaggtggggtgttggcagaaaggaggcaggcgcataacaaggggagggagaacacaagggctcagccttcctgagcctggcccggaccacaccaaccaaaagcctcgtaatccttcagctagttaaatccaaagcgtatagcacgcgccacttaccccgttagcaccaccacaaagtccatgacattccagccattcctcaagtaggagcctttgtggaaggcaaacccaagggcaatgattttaattccagcctcgaaacaaaaaattccaatgaagtatggttctgtgtcatcctggaagggagagaaggcaaggtcagcgtcttgggctgggcagatgttgacaagatcagggaaccagcccacctagaaatcagtacctatcaccctctcacttcccctgaccctcctgcactcaccacccctcactgcctcttgcagagttctcttgtccaaagccttttgcgagcaaagccaatgcctagagaaggcaccttcctccttcattccttttgggccaacctcacatatcactcagctaaacagaattatttgtttgcacctgtcttattcaatacgacagtcacaggccacatgtggctatttcaattaaaattaatttaaatgcaataaaataaaaaacacagttctgcagtcacactggctacatttcaagtgacaatcctattggacagggcagatggagatcatttctgtgactgcagaaagttctaatggaaagcattggtttagagaatttacttgtcacatgcagcgttcaaggtatttgaggctagagcttgtgcattgacctcactcctaaatctgaccccttaggatggttctcagctggcatgtagattgttaaaggtttggaataggacttctgtactggctgataagtggccagtatcctcacctccagttcctctgcagaacctccggctggttctggcttccagctgctaatctatcatatttgaaattaagctacaagctcttctccatcagagccccaatgtgaatgttttcccatctgttacagcaacgtttctcgagctacaatcattttcactctgcctgaatgattttttttttccacattagcttgccactggtacttctacttgcttaccagtctttcaatggacgctttttatttagctttattttaagtgaaaatgcaaagatctagaaatcataggtttgctaggctagttatagtttttagaagactgtgacattgtgaaatgtatgtttggtctttgacactgtttcctggtgtacagctcctaaaacccttgggatctccaaagggatgtctttttgcaggctaaggattgactgatggctggcagcttctaggtagcttcaggatgggggttggtcaccgggaaaaccaaggcatgattagaggtttggatttaaatcattgaccgttggtgatcaacttgattttcagcccctctgccctcccagaggttggggggtggggctgaaagtcgcaaccctcgaatcatgccttggtctttctggtgaccagtccccctcctgaagctacctagaagctgccagccacacccttctcctatatctcaccctttgcatctcttcatctgtatcctttgtaatattcttgtttcttttttttcgcctcccccccaccaagatggagtttcactcctgttgcccagactggagtgcaatggtgcgatcttggcttactgcaacctctgcctcccgggttcaagcgattctcctgcctcagcctcccaagtagctgggattacaggtgtgcaccaccatatccagctaattttgtatttttttagtagagacgggctttcaccatgttggtcaggatggtctcgaactcttgacctcaagtgatctacctgccttggcctcccaaactgctgggattacaggcatgagctacagtgtctggccaagacataattattaacattaacaatgttcatttgagtatactgcctgaaattatgtcagatgccaaagtgggcagtttgagaccagcctaagcaacctagtgagatccccatctctacaaaaaaagataaaaataagaaaattaactgggcatggtggcacctgtagtccctgctactcaggaggctgcagtgggaggatggcttgagcccaggaggtggaggctgcagtgagctatgactgaaccactgcactccagcctgggtgacagagcgagactctggttcaagaaaaaatgaaaaggaaatttaggcttcccatgatctggctctgggctccaggactgagagcctcctctgtgccctgctccactcccccaaaaattaatgtcctgctaaagccaaggagaagaccctgagaaaagacatcactcaccagccgttcagacatcggggtcttgtcatcatcaggcagatgctgctccagtgcgaggacgatgcaattcgctatgatggtggctaaaatcatatattcaaagggagtattggggaattaaggaaaaatcttgttcaaagaaaagaagggtgttggaggtgcacccacccccactgaccccagtggaaagatctcaagccctctagatccttccaactcatcagcacaggtggaattattcgttctcctgtctggagtagatccctgcagatctcaaacccagatcaggtgacttctaaagggaaatgtggatattcaccttctatctcacccacaatattcactgaacacatattcattcagtacctgctgtgtgccagactctgttctgggctagggacacagttgagagcaaagcagacaagaggagaagcttcctcctgcttcccagaggagaagcaaataaatgagatgactacatcatgtatactatgctatacagtacactgcatataccatgttatacagtacatcatatatgctatgttatgtagtaagatggtgaagactatagacagtggaaggggtcagggctgcaatttcaaatatggtggcagggccagcatgatggcaggcacctgtggtcccaggtacttgggaggctgaggcgagagaattgcttgagccgaggaggtagaggctgcagtgtacaatgactataccactgcactccagcctgggtgacagaaggaggccctgtctcaaaaaaaaaaaaaaaaaaagagataaattaaaaatagatagaggctgcggtgggtggatcacttgcggtcaggactttgagaccagcctggccaacatggtgaaaccctgtctctactaaaaatacaaaaattagccaggcgtggtggtacacacctgtagtcccagctacttgggaggccggggcaggagaatcgcttgaacctgggaggtggaggttgcagtgagccgagatcatgccactgcactctagcctgggcaacagagcaagactccatctcaaaaataaataaaataataaataaataagtaaataaataaataaaacattatgatcagatttgacacctaatgcatgatccacagaagaaaaaacagatatgctgggctttatcaaaatttaaaccttttgtgcatcaaaggacgttatcaagaaagttaaaaggcaagtaacagaataggagaagctatttgcaaatcatgtatctgataagggtctagtactatataaagaacatttacggccaggtgtggtggctcacgcctgtaatcccagaactttgggaggccaaggcgggtggatcatgaggtcaggagatcgagaccatcctggctaacacggtgaaaccctatctctactaaaaaaatacaaaaaattagccgggcgtggtagcgggcatctgtagtcccagctactcgggaggctgaggcaggagaatggcgtgaacctgggaggcggagcttgcagtgagccaagatcgtgccactgcactccagcctgggcgacagagcgagactctgtctcaaaaaaataaaaaataaagagagaacatttacaacacaacaacaaaaagataatccaattgaaaaatggacaggaggctggaatagacatttctccaaagaagacagtcaaatggccaatatgtacatgagggtattagtgatcagggaagtgcaaatcaaaccccaacgggatactgcttcacatccactaggatagctattaaaaacaaacaaacaaacagaaaacaagtgttggtgaagatgtgaagaaattgaaaccctcatgctggtgggaatataaaatggtgtagctggccagatgcggtggctcatgcctgtaatcccagcactttgggaggccgaggtaggaggattacttgagcacaggagtccgagaccagcctaggcaacaaactgagactctatctctacaaaaaatatgaaaaattagccgggcatagtggcgcaggcctgtagtgccagctacttgggaggctgaggagagaggattgcttgagccccaggaggttgaggctgcagtgaaccatgactgcaccactgcactccagcctgggcaatgggagtgagaccctgtctcaaaacaacaacaacaaaaacaacaacaacaaaaaaacaccagtgcaactgccatagaaaaccattccttggttcctcaaaaagttaatcacagagttaccatgtgacacacagtaactccactccaaggtataaacacaaaaggatcgtaagacaggtattccaacgaacactcatacacaaatattcacagcagcactattcacaacagccaaaagatggaaacaacctaaatttcaccagtgggtgaatggataaacaaaatgtggtctactcatagaatggaatagtattcagccataaaaaggaatgaagtaggccgggtgcagtggctcacgcctgtaatcccagcactttggaaggccgaggcaggcagatcacctgaggttgggagttcaagaccagcatgaccaacatggagaaaccccatctctactaaaaaaagtacaaaattagctgggtgtggtggcgcatgcctgtaatcccagctactcaggaggctgaggcaggaggattgcttgaacccgggaggcggaggttgcagtgagccaagattgtgccattgcactccagcctgggcaacaaaagcaaaactccgtttcaaaaaaaaaaaaaaaaaaggaatgaagtactgatacatgatagaacaggaatgaaccttgaaaacattatgccaagcgaaagaagcagacataaaataccccatattgtatgattccatgtatatgaaatatcccgaacaggcaaatccagagacagacagcagatttgttgttcctggggaatggcaagggaaatgggagtggctgcttaatgttttagaactagatgaaggtgacagttacacaacattgtgagtgtactaaacgcctctcccctcccctctcctttcttttcttatttatttttacttttatttttttaaagaaacacaattttgctctgtcacccaggctggagtgcagtggcatgatcatagctcaccgcagccttgaattcctaggctcaaacgatcctcctgcctcagcctcctgagtagctgggactacaggtgcacaacaccatgtgtgcctaattttttttttgtaagagacagagtcttactttgttgcccagggtggtcttgaactcctgggcgacctttcttcctcagcctcccaaagtgcggggattacaggcatgagccactgtgcccagccctaaatgtcactttaaaatggttaattgtgttatattaattttacctcaataaaaaaaaaattacagtgatcagggcagacctctgagaatctgttcttccaagacccgaggcaggggaggggtcgtccagtaagtatctctagatgccccatttgcattctctccagtttgcataggtaaactcctccctgcatcctgggaactgtcatttgggtttaggaggcctccctccctagtgtcccaccagaggatctgcagggcaggtggggagggtctatcttgttcatttcatattagctcctaacctgctgatcagctggtaaatgggaatgtccgctgtctccctgccacacccctcagaagtgtcccacgccaacaggctctgcatatggatctggcaatctctgaggaggtgtaagcgctggagaagcggctgcttgagtgaaaaagccatagggtgttggttactccggagcaggatttcccaacctcagcactaggtttaggggtggatcattctccttggtggggctgtctgggcactgcagcatgttcaacagtatccctggcctgtgtgtgctagatgccagtagcagcccctcctgtccagtgatgacaacctcaagtggtctctaaacattgctgagtgtcccctgggggcactgaaatcccgcattctgtagagagatcaattagtatgtcttggggaacttgaccatgctaaacctctcccctcctcgtagctctaacctttggaaaattaattggtttcagtctcctcttctgccctggagttaggtttggcattttggaagcaccataaaaccatcccttccaggccggagggagagtggaacctgctttccaggtgggaaaacggagtctgaaatagaaaccccctcagtaaaagtctcggaaagccaggaaaaccaggcttccttttgtcaccagcttcagcctttgcctccagctgaaagcacactctgaaaagcaaaatccgagactcagggcaatttggggagccaacaaaagccggccttgccgacgatcatctctgattggctttctgcctctgagctgacaggcattaggagcccagagaacaaagctgggctgtgttgcacaaatactccactctgcctcaccctgcagcctggaaaataagagacaatatttgtacacagagcagcaacgccaagcccttccctggtctcctctcgctatgatttgaagctgacttcgctttctctccctgccaactcagcctccttacacgcgcttctgccatcccactcctccggttccctggtctcctgcccctcaatggcagggatgtgacttcctttggaccggctctggcactgaaggttccaggaagagtcccagaagtccaccatgcagcatgcagcacttttatgggctgcaatatcagggtttcaactggccagtgttgcctggatttcagacccagggctctctgggtatggcaataaaaccttagcacgtaggcaaaaataaagaggttctactctcccaccttgcttcattttcttacttcttatcaaacacagatactcacactgcttttccaacatcatcccccctccctctgctcacccgcacccccgcaagtgtccacagacatgccccagatggacatctgcaacaatgacctcagacccttgctactcaaagtgtggtcccagaaccagcaccggttaggaatgcagccttagaccttgcatccacctgctgagtcagaacctgcatttaaaaagatcgccaggggatttgtgtgcaccgggaagtttaggaagtgctaagtgcctctatttcagggataggaggaggagctcaggtaattgcggttttgagtcatccagaaagaggtgggggttcctgtttctcctccaagctttctcctccacgttctgaccccagggggagaactgaacagccctgggtaccagccttctgctcccacttgggtaaagagcctgagaagaaaccgaagattttgatgaaataaaagcaatgttggaatgcgacaaaagcagaaaagaaaatttcagcctaatgcatgtggaagtattcaaagccttcccatggatcccatctcactcaaaagcaaaaacaaagtccttccagcaccagcaaggtgcatgacctgctcccattacctccctcccctcatctcctctattctctcccttagtcactcagctacagcaacgccggcctcccttttattccccaaactccccaggcacatttgtacccaggggcctttgtacctgctgttcattctcctggaatagtctttccccagacatccacatgactccctccctcacttcctttaggcctttactcaaaggtcacatccatcaacccccttagcctgcttatttttttctttctttagtccccgtccccagtcaagcatctgctatttttttccttctttatcttgttccctgtctctcccacgagactgcacactctatgcacgtggggattttttgtctactttgttcactgcttcatcctctgtgcccaggagagcattctctatatagtagatgctcaaaaaacaccagtggaagggcctggtgcggtggctcacacctgtaatcccagcactttgggaggccgaggcgggtggatcaccagaggtcaggagttcgagaccagcctggccaacatggtgaaaccccgtctctactaaaaatacaaaaattagctgggcatagtggcagacgcctgtaatctcagctacttgggaggctgaggcaggagaatcacctgaacccgggaagcagagtttgcagtgagccgagataacgccactgcactccagcctggacaacagaacgagactccgtctcaaaaacaaaacaaaacaaaacaaaacaaaacaaaacaaaacaaaaatcaccggtggaggaaatgaaggaaggggacatgggtcctgctgcctagaaaccccgacttcatctcaagccaagtctccatgagcatgttaaggacacaatgaaaccccctgaaatatgcaatgatgtacttggtgcccagatgaaagaaagatgggctgctgagttcttggcatggtaagagatgcctcgcccgaggcagaagccaaaggtttcactgggtagtcgagctggggggcaggcgaggctttctcagcccaacctcaagtcatgcctgatcctcccgatttagaaagcctgagttctaactcacagctgcggtgagcaatgcctctgttagctgagctgagcctttctgctccctgattggctcggagagaaagcacctgtgtcagcgggatccagaaaaatcagccatcctaggaggccaaagcggggcgggggctgaaagaagagaagcatccctgatgggaggaaaagctggcttccgaaatggctctcggaagtcaggatagcagacagccctgcaggcaggtgaggagacacagagctctatacacaatgaaattgatcaggacctgcagaggccccagagagaggctgtatgtgaccctggaaaagaccaagtttgactctgcgtagggaagaaggagggcttgcatctgagaacaggaccttgctcttcagattcagaacatgaaggaaaattctcaaagtgggcgtggctgatggttcccatcccttagcaagaccttgcagtgtccaagtaatccttgcatccctctgtggtgcccttcaccctcatctcatttcaagcctcctgtggttggtgcggaaatcaaatcaggtttgtcaactctttgtgaccttgtctccactatggggactgctgatgggtgggttctaaggaaacagatacttgtagcagttagccaggtcattgagcttgtgtgaagaagccaaacagacctcattttcatgtaagttccatgctcatcacaatcaccaggaaaaagagtagagggtaccagaaccctagatatatgggtttaagacatattccttggtccattaaacacataccccaatttcactctgcaatatgatcaactattatggggccattaacaagcacagcgaccataattacagctgccttgtttccaactgcttctttgggcagataccgtggtaagcactttgtttcagttaattccttgcaacatttctacaaggtgggttctgtggtaagcctcattttccacacaagaaaatccaggctcagagagattaaacaaattttcaaggtcacataggaggtactggcagagctggggctcacacccaggtctgcccaactccacagtctatgcctttttttgtttgtttgtttgagttagggtcttgctctgttgcccagggtgaaatacagtggcacgatcacagctcactgtagccttgacctcccaggctcaagcgatccacccacttcagcctcctgagtagctgggactataggtgcatgccaacacacctggctaacttttaacatttttgtagagatgagggtctcaccatgttgcctaggctggtcttgaactcctgggctcaagcgatcctctcaccttggcctttcaaagtgctgggattacaggtatgagccactgtgcccagcccacagtctatgcttttaagctggtggtccccaaagaccactcaggagctatcctggttagaagatagatgggtttgcctttatttaaaaaaaaaaaaaaatagaatgcaggtgcacttggggccctaaccatatggattagaccaaatgggttacacctcacccaagtcccaaccaatggccacagtttagtaaaggccaaccattgcatgctagtccacgccctcataagcccatctcaagtaggaattattcatgactatttcaacttcaaacaatccaaacagtctccagttcccagacatgggctttaaaatcttcaacacacagttctaaccaaaatgaagcctggaaaagatctctccactcgctgatcagcctaagactcttagcagggatggcatgctaacaagggcaaccctagcgctgcccgggatgttttcagcaccacggccagcggcaaagaggcacaagtttaatttcacttgcacccagggatgggaatccccggggagagaaaacaaaaccagcagcaactattaacactctctgagacatctgcaaagacctacatttcacatacagggtagaggcaaaaaagattaatcatgtcatcaggaaaatcaaatgaagagaaaattaaaaacagtatcaaataggtttgtgtgtcatttgtttttcatattatccaacaatgtccaacactttggttctgaaatgagaagtctactcagggctgctaaatcatgcttctgcttagaaaactggcaatatctgcactaaaaaatagtagtgcagaggagttgaaaggatttggggatcagacgtggccttgaccttgggcaaggcagtttccttctctgagcctcagtttcctcatatataaaaggtagaaaatagcatcaacctcataggttgtgtgagaatggaatgagctgatacacacaataatctattacagggccctgcatatagtaagtgctcaaggaatgtgagtgttttatattgtttattttggttcccatgatgactagaaaatttaatgtgggccaaatgcagaggtagatgcctatcatctcagccctttgggaggccaaggcagaggatcgcttgaggccaggagtttgaggacagcctgggcgacacagcaagatcctgtctctacaaaaatacatttaaaaataagaaaactagccaggcatgttggcacatgcctgtagtcctagctactcgagagactgaggcaagaagattgcttgaacctgggaatttgaggctgcattgagctatgatcataccatggcactccagtctgggcaacagagcaagaccctatctcttaaaataaataaatacatacatttttttaaaaaagaaaacttaatatgcttataaaaacaggatacaatttatctcattgtaatcatgcaataaatgttcattactttatgacaattgctgctaatagtaaataacttttccaattttttttttttttttttttttagagaccgagtcttgctctttcgcccaggccagactgcagtggtgctatctcggctcactgcaagctccgcctcccaggttcacgccattctcctgcctcagcctcccgagtagctgggattacaggcgcctgccaccgcgcccggctaatttttagtatttttagtagagacggggtttcaccgtgttagccagggtggtctcgatctcctgaccttgtgatctgcccaccttggcctcccaaagtgctgggattacaggcgtgagccactgcgcccggccaacttttcctatttttgcccttctaggtcttggttccttttcttttctttccttttcttttggtttcttttcttttctcttctcttctcttttctttttgagacagagtcttgctctgccacccaggctggagtgcaatggtgcaatctcggttgactgcagcctccacctcctgggtgcgagcaattctcctgcctcagcctcccgagtagctgggactacaggcgtgcagcaccatacctggctaattttttgtattttttagtagagacatggtttcaccatgttggccaggctagtcttgaactcctgacctcaagtgatctgcccacctcagcctcccaaagtactgggattacaggcatgagccaccgcgtccagccttagttccttttcttcaaggagggagggaagggacaatacctaccgtcatcatagctgaacagacctctcaaatctgaaatgtttccaagaacatactgcagtgcatgcatatgtgtggtccactcactgaatattatactcaaaataaatgttgccaaaaaaaatcttcattggacatttcatgtaaatggaattaaacacgatgttgccttttgtgtctggcttctttcactcagcatcaacttttttgttttgttttgttttgttttttgagatagggtctcactctgttgcctaggctggagtgcagtggtatgatcatggctcactgcagcctcggcctcctgggctcaatcgatcctctcgcctcagtctcctgaatagctgggactacaggcacatgtcaccacacctggctagttttttgtaaattgttttgtagagatggagttttgctatgttacccagggtggtcttgaacacctgggctcaagcgatccgcccacctcagcctcccaaagttctgggattacaggtgtaagccactgtgtccagccacatcatatttttgaggttcatctatgttgtagcaaagattagtatttcattcctttttaaggcagactaatatctgaggaaggcatatcacacttggtttatctgttcatccatggatggacttttgggatatctcatcctgttgactacctagaataggtaaatccatagagacagaatgcagatgggtggttgccagaggctggaggaaggtggtggggaggggagaaggagagagactgcttaatgggtacaaggtctcctttaggggtggtgaaaatgttctggagctagacagaggtggtagttacataacagttggagtgcagtaaatgccacagagccgttcactttaaaatggttaattttctgttatgcaaattgcacctgattttttttaaattccattttggttttgcttttttttttttctttccccttgactctctcctcagggttcccatcatgggcctttactcattgcactttaccctgggcgacacagtgaggctctgtcctttttttttttttttccttttctttttttttaagacggagtcttgcacctaacctgggtcagcacccaggctggagtgcatggagtgcagtggcacgatcttggctcactgcagcctccatttcctgggttcaagctattctcgtgcctcagcctccctggtagctgggactgcaggcacccaccaccatacctggctaatttttgcatttttagtagagttggggtttcaccatgttggccagactggtctcgaactcctgacctcaagtgatctgcccacctcaacctcccaaagtgctgggattacaggcgtgagccaccatgcccatccgagactctgtcttttaaaatactgctgctgctgctgctactttcttcaataataataataataatcatcatcatcatcatctgaccacgcatccttgtgcacttgtgagaatttttctgcagaataaattccgtgatgtgaaattgctgattttttttcctctgagccctcaaccatttagagaagcatgatatggacggttttcaagagtccttccctctctcttttaaatttccattatttatttatttatttatttatttatttatttatttgtagagatgggtctcgctatgttgcccaggctagtctcaaactcctgggctcaagctatcctcctgcctccccacctcccaaaacactgggattacaggcgtgagccactgcatccagctacagggaagttaatgttttaataaaagctggaggaggcaagggaatgagccctgtttctgtctgggagaagagtaacccaggaggggaagcagccagtacaaagaatgtgtgtgggaaaaaatttgaaagacaaacacgaaattgctagcagaggttatctctgggaggtgggatggggtaagggcttttcaccttctaaatgacacactacacattttttaagcttttaaaaaaccacacaaaacaacaagcccatattcttttcataattaaaacctttttttaaaaaaagggggatgccaggcatggtggctcacacctgtaatcccagctactggggaggctgaggcacgaggatcactcgagcccagaaggtcaaggctgcagtgagctgtgatcacttcactgcactccagcctgggtgacacagtgagaccctatcttttaaaatgataataataactatctcaccatacatccttgtgcacttgtgataattttcctgcagcataaattccaagatgtgaagttgctggatgtcagaggggatgcacactgactttttcttttctttttttttttttgtgagacagagtctcagtctgtcgcccaggctggggcgcagtggggtgatctcggctcactgcagcctctgcctcctgggttcaagtgattctcctgtctcatcctcccgagtagctgggattacaggcacctgccaccatgcccagctaatttttttatttttagtgaggatagggtttcaccacgttggccaggctagtctcgaactcctgacctcaggtgatccacccacctcggcctcccaaagtgctgagattacaggcatgagccaccatacccggcccacattagatattttctggatatttacagggctatattttacagtttttaaaaagtgagatgagtgagtgtgtgtgtgtgtgtgtgtatgtaccttctgaaattaaatccataatttaaatgtataaattcctctgggccaaaaagtttaaacatggaagaattaacatgactcatggaaaacacacaaatacacaaaagtaaaataaagatcccttgatgaaaacagaaagaaaaaacaaaacaacaagccaagttttaaacaaaaagtattaatcaatttcagactctcggggtcgggaagagagtgaggagtgaggatgcttcagtgtcagattccaaacaagaactgaagaccttctccctgtttatctttttttctaggtcagtaaagttctctagggacctctgagtggtgtgaggtctctgtctcctgattcaattttcaaccactttcccttatatgttcactctaccaagggggaatccttttcctctctggcaatagtgacatccctgttcagtggtcagtaaaatcctccatttccctggtctctctctacacagtccatctacttcatggtttaaacttaaacctggaggtcaggcgcagtggctcacacctgtaatcccagcactttgggaggccaaggtggccggatcacttcagatcaggagtttgagaccagcttggtcaacatggtgaaaccctgtctccactaaaaatacaaaagttagctgggcatggtggtgcgtgcttgtaatcccagctacttaggaggctgaggcaggaaaactgtttgaacccaggaggcggaggctgcagtgagccaagatcgtgccgctgcactccaacctgggtgacagagcaagactctgtctcaaaattaaacaaacaaataaaaaacctttaacctggaaattccctgcagaccatcaactctaagaccaaggtggggccactggcagcctcaaattagttcctaagaacaaaaggaaagctcagctctggaatatgtccaccatcatggcccccagaaaaaccagtgagaagggccccaagaaagcaagagaatcaaagaaagaccttcccaactcagataaggtggaaaaggtgcccccaagaagtcaggtgaggtgaggagggctccctcaaaagcaggtgtagccaagaaggcccccaagaaagtcagcaaagccaaggaagtcttccttaaaccagccaatgccatgaaggtccctcccagtgctgctgggctcaatgggaagtccaaagtcagaggtagcaccagcagccaagatcctgagatccacaggaaaacagaagctgggagctaagactccgacggaacctgttaacatttgatgacctccaatttccctgtggagagaccattgtccatgctggtcccctgcttccttgatcactggaggatgtccctacctcttcatcaataaccaatgtctcctccaagccactccagctatgcatgctcagaagctacaccagccacctccaaaacacctgtttccagcatccttgtcttgaaccacctcttttttttttttttttttttttttttttgagacggagtctcgccctgtcgcccaggctggagtacagcagctccgcctcccgggttcacgccattctcctgcctcaggctcctgagtagctgggactacaggcgcccgccaccacgcctggctaatttttttttttttttttgtatttttagtagagacagggtttcaccgtgttagccaggatggtctcgatcgcctgaccttgtgatccgcccgcctcggctccccaaagtgctgcgattacaggtgtgggccaccgcgcccggctgaaccacctcctctttaaccacctcccagctcactaactcccttaaatgcaaaccaacgtccatcccatcgagccctgcaacccactgaccccgccatttctcaggaccctctcctgccttgtcaaccttacataggttgattatatcgcactttcttgcctcctgtttctctcctggaaaaaatccatccctgcatgaactcaactagttgccttccccatacctgggcagtggagcattcctgaatgagatcaactatctgggctggtgacattaaattcatgatgctaaactcaaatgggcatttgagaatcccagcatcctatatcagagaagacacccgtgcatattggtataatggatgggaatgacccaatttacagaaatcaatattcttccatcattaaaacctccacccttgactgaaaattttccttcagccaccaaccaatttctctactccccttcatgaagagttgccttcacgtgttcctgccacttcctcactgcacattcttctcctaccctccccaggctggtttctagcccccatcactcaaccaaaactcttccaaagaggatcaccaaagacccccaggctgccaaatcccagggccatttttctgtgcccagattacttgaccatgcccttcttaatgttgttctagttttcctcctatcctcctggtctctacttctcaatcttccctttttgctcctctttttctatccaatctctaaatgttggtcttccctggggcttaatcctaggtaatcaccctttatctatctctatcctctttctagagcttgcatgcatttcgatgtattttgccattctcttgttgccctttctccctaaaatatccactcattgccctgtttggcatcctggtagaggcagggctgacttctgtgactgcatcatccaagccctgcaacgctgccctccaccacatcttctgccttctgggttggcttggccaacgggaggcaccagcaagagatcagagaggagggggagttggggcatttctccatttgatttcctccctgctacagtgtgtggtcttagcaatagctataccactctgtgtcttcttagagcatctcataggagtgtctatattagtctcctagggcagtcatgacaaattgccacagattgggtggcttaaaacaacagaaatttattctctcgtcatcctggaggcaaggttctgaaattagggggtttcccttcaaaggctctaggggaggatccttccttgcctcttcccgcttttggtgcctctacatgtcttttggcttgtggctgcagcactccattctctgcttctattgccacatgactttctcccctgtaccttctcatataaaagcacttaccatggaatctcgagtccactgtaatccaggatgacctcatctcaatccctgactcaatgacatctgcaaagatcctactttcaaatgaggtctcaggttctgaagttccaaatgcatctgaatttttggtggacaggattcaaaccactacagtgtccaaggcccaaactcttccattccctccctaatcccatgtctctttctctattaacctttgttatgaattgtaccaccagctgcctagtaaggagctcaatcaggtaaggttaccctaagagaccttcccagttcctacatcttcctccccctacagctgatgtatcatcagaccccaccaattctacttccgaaattagactttgaatcctcctgctcagcattgcctcttcagcaccacccaaggtcaagccactgtcccttcccacagaaatatctataatctcagtagactccaaagtggtctatccatttcattctccagagagaagccagggcattatgctaagtgaaagaagccagacacgaaaggtcacacagtgcctgaattcatttatatgaaagagccagtataggtaaatccatagaaacagaaaacaaatttgtagttaccaggagtggtgggggttggggggataccgggaggggaggatgaggagcaactgcctcatggatacagggttttctggaggggtggtgatgaaaatatttcagcactagaaagaggtggaggttgtacaatattgtgaatgcgctgaatgccactgaattgctcattttaaaatggttaacttatgttgcatgaatttcacctcaatacaaaaattattttattgagacaggatctcactctgttgctcaagctagagtgcaggggcacaatcacggcttactggagcctcaacctttggggctccagcaatcctcctacctcagcctcccgggtagctgggactacaggtgcacactatcacacccagctaatttttaatttttatttttatttgtagtgatggggtctccctatgttgcccaggctggtcttgaactcctgggctcaagtgatcctcccacctcagcctcccaaagtgctaggatcacaggtgtgagccaccatgcccagctaaaaaatatatagacaggtagatagatatgtatatatgtatacatatatatgctttatatatgtaatattatatgtttgtatatatgtatatatatttaaagtaaagcagttctgtcccatcccacttaagcttctctgaggacttctcattgcatgtagaataaagttcacctccggaacttgacctagaaggtcttgtgtgacctgtctctgccaacttcttgggtgtcttcccacctgtgagtccctttgctcatcagactctagctacactggctcatttttaacatgatgaacttgttccttccccagggcctttgcacatgctgttccctctgcctgggattctcttcctccctctgtctcattctgttcacactctgctctgtgcttaacaaccttcaggtcttcacttacgtggtacccctgtacttctaattatcctctacgcaaagggcctgtagtaggttacttattttattttatttttcagagatggggccttgctctgtcacccagcctaaagtgcagtggtgcaatcatacccatgctttagcctctggagcctctggccatgaccttatttagtaaaacggcctctgcaagtataattaaattagagatctcaagatgagattgtcctggattatctgacgggctcaaaatccatcgacaaagatccttataagagacagaagaggccaggtgcagtggctcacacctgtaatcccagcacttcgggaggctgaggagggaggatcacttgagcccagaagttcaagaccagtctgggcaatatagtgagatcccatctctatcaaaaatttaaaaattagctgagtatggtggtgcacgcctgtaagtcccagctgctcaggaggctgaggtgggaggattgtttgatgctgggaagcagcagttgcagtgagctataattgcactgctgtactcttgtacagggtgacagagtgaggccctgacaaaaaaaaaaaaaagagagagagagaagaggaagagaagacactgacatgaaggagaaggccatgtgaagacagaggcagagactgcagtgatgcagccacaagccaatcaagccaatgtatgctaacaactaccagaaactggaagaatcaaggaagcattcttctctagagccgtccaagggagctcagcactgctgatgccttgattttggtcttccagccttcagaactgggtgacaatatatttatgttgttttaagccatatagttcatggcaatttgtcctggcagccctaggaaacaaacacaggaccctgctggttttctcccaaacacttaccacaattagtaattatgtctgtatttgcctattccttattttatgccttcttttcctgttacaagttccaggagggccaggaggaaccacatctgtcctgcccactgtcatgtccccaccatgtacatcccagttccaggcacatggcaggctcccccccacccccctgcctcccaaaatgtttattgaatgagcaaatggatccacctctccttcatttctctttacatctcagcggcagtccttcttgcatcttccaccttcacttctaactctgagctgttgcattagcaactccagttaaacagattttctggaaagccccggcctcccaatgaaacctccctcacttgctccccactgcacttccccaaatatttgggtctgcctcgccttttccatcactggttctgccatccatgaagattctccttgaagctttatcattaaaaaataaacccacatattctgtgtctccaaaagaagcttttacttttgcaaactctattgatttaatcctagaggctgctggcagcagtcccaggagcttaatcaatatgacaacacccagcgcagacagaacatcaaggagcctcggccaagatctcctgctcgggtcttcactgaccccgactgaatctcttacaaccatgaagacagatttacagtagggggcaggatatttgcaacagctccaggatcttgcttaggtgagcaaaaggaaatgcctccaagcttgaggcgcttcagagctatttgttaatttgcgactatggccgattcccataagactcaaggaagatggaagacaacaacagaaaaacattgcaggttctagaacctgattataaactccctggtggggtgagcaggggaggaacaggcaaaggggaggtgggaaaaagaagatgaagatgtcaagagttaaaaatgcaaagagtttgccaggtgtggtggcttacgcctgtaatcccagcactttgggaggccaaggcgggcggatcacaaggtcaggagttcgagaccagcctggccaatatggtgaaaccccgtctctactaaaaatacaaaaattagccgggagtggtggcagacacctgtagtcccagctacttgggatgctgaggcaggagaatcacttgaacccaggaggcagaggttgcagtgagccaacatcacaccactgcactccagcctgggcaacagagggagactccgtctcaaaaaaaaaaaaaatgcaatgagttaaaacagacattccttcaccccttagcagacactaagtgaccagagaaggagaaaaaaaggtcatagaaacaaggaggttgagaatgactaaatcaatgccccaggctttagaaaccattaatctcctcgaaggagaagtcaaacacttctcacattttattcaagattgaaaaacaggaaaattagaagcactataggaagaaattggaaagcaagaaatatttgttaatcagaagtttacatgcatgtgacatttccaaacctattgagcccttataggaaaatatgaatatccatccctaaaacatacatcaacataatcttcctggagacactgtgattagatatcagccccaaaatgcagataatgaggtatacagtcagcctagtctatgtcctgctgcagtaacaaacaatccccagatctcagtggttgaacacaccccaggtctatttttctactcatgctatgaagtgggatggggactgatctatgtcatcctctctccagcacttactttgagagagggtccatctttgtgcatccatgacagtggaggcaggaaaaaggaaacatggtgaatcccatgctcacccttaaggcttctgtccggaaggactcacgtcacttcccctcacatttcattgatgaaaccaaatcacacagccatacctaacttcagggaggtggggaaaatgacactctactctgtgcccagagaaaaacaagaaatgttagctgaacaaggtaaaggataccccctcaggaagatcatatgacttgcccaaagtaaagcagctttgaaggtgtcagaagtgggacctgaattcaagactaaatggtccatgtctttttgcactatcaccctgaacttggcaggagttgagaattaaatctagatagcagtgaagagaaacatcaatggaggcagggggcagaaggaacaagggaaaataatacatcaagtaagggagaaataaaaggagccagaaaattacaaccagaacataattaaaggagtttcatctttagaaaccaaaacacattgtgaaaagtagggaaaaagtgggggagttttacactcttttcagggagaggcaaacagtaacgggatagtgcaggggtttatatgaggctatataaggaggcggggacacaaccatgaaagaaacttgtacacttcttgttcttcctctgaagctgccatcttggctcagactgaaggtccaacaaatgctagttggtgcaacagcagctcaggaagctggggccagggcttaccaggacttccatcagctgcactgttcctccctggacattttcctgctcagttctgggaaatctggacaagagttggatgatgttccagaacagatggtgctagcttggttcttctgatcattcctcccctatccctaacccaagccagactggaagtaagaagggatcctggttctgccaccctcccggccagcaggtgagaattctacacagccaggtaggtcagtttagcactagagcagggattctggaaggactcaccatcattgccaactcatcatcaccatttcagttttgagcacctatgatatgccacctgagtactttctgtgcatgaatgcattgagccctcaccacctgtctgcctagaaatcctactggtcaactttcaacttatatccagaattagtagtttccagaagctgggggaagggagaaactggaagtaactactaatgggtgcagggtttcctttaggggggatgaaatgttctgagattaaatagaggtgactgttgcataacagggtgactgtagtaagtgctgtggaattgcacacctcaaagtggtaaatttcattttatcacaataaaaaaattcattttatcacaataaaaaaacttaaaaattataaccagaatccagccactcattattatctccacagacaacaacctggttccacccccactattacctgccaggaccaacactgtcacctccttcctaattccccagcttctgccctgcctgcccccaaccttcaaagtctgttcttttcacagcagccagaggagcctatgaatatctgagtcaggtcacgtccctcctctgctcaaaagccctccgtggctcccagctccctcagagcaaaagccaaagtcctccccgcagcccataaggccctccaaaacctgtcccgtcacctctctgtccttatccttgcaccttccctctctcttgctcactggcttcagccacatctgcctcctcactgtcacacatgtcacatatacccctacctcagggcctttgcaccagctgttccttctttctctagacatcctcacagcttcctcaagtcttggctccaatgccatcgcctcgataaagctctatctaatacagcaactgcctccccagccctttctctgctgttctcttcccattacccttataatcttctaaagtactatgcaacttacctactatttttgtttcttatcatacatctctccccatgagcatgtaagctcccagagggcagggacttttgtctgcttcctgtgtcttgaagagtgccttggccaccatgtatactccttcagtgtttgctaaacaaatgcacagccccatgaggcaaggactgttttgcccattttatggaggaggaaaactgagactcataatcaggtatgcagcagcaaactgtctgaattcacagcccaaactcaacacagcgatcgttccttattattattcacacagcaaagatggaccaggcagtgttctaagggctggggatgcaacagaagacaaaatagataaagctgagccctcatggaggtgatgctgtatctggttcagttgtttcctgcccaaactctcatccactctcacttttggctctgacagtggcctctgagtaacacagtgtgacatgccttcaactatgatctgaatgttctatagaagccgcctttccattatgcaactgtggtggcttttcttttgttatacgacgattatttgtcaaccccactatctttgcactcaaccatgggccccctgggctcagagacctcgtgacagtcatcttctcatcaccacatctgcaaatgtgtgggtggatggggcagcaacagtccacctcctccaagaagcagtccctgatttttcctccccagacaaatcttcgtctctctgttcttggaaactcaaagaactaagcacctccctcgagctgctgtgcaaatgtgtgtgttgtgttttatttggttcttccgtattttcactctggaagtcgacagttctggccagaatgccacccgcccccacaaaataaacatgtcattgtgataaatgttatgaaagaaatggggtgaagtctaattcagacttggggtgagttgctgggtcaggaaaagctctaaggatgttccttttaagaggaaacctaaaggttttattattgttgttgttgctgtcatttttacagacagggtctcactctatcgcccagcctggagtgcaggacgcgatcactcactgcggtcttgaactcctgggctcaggcactcttcccacctcagcctcctaagtagctggaactacaggcatgcattgccacgtccagccaattttttatttttttgtagagacgggtcttgctatgttacccaggctggttttgaactcctggcctccagcgatcctcctacctcggcttcccaaagtgctggggttacaagcgtgagctaccacacctggcctaaaggatttataagggttcaccaagtgaagaattgggcaaaggtataagtatttcacagcagctttgttcataatggcccaaacgagaatcaacagaaatgccaatcaacaggtaaatggataaacaaactgtggttatttccagatgaatgctattgagcaacagaatgacagaagccacagtgctcactcatccaacacatatttatcaactgcttactgcatgccacctgctgatctaggctgttctagtccacattggtgggtaaaaccaaaagatcaggtgtggtggctcacagtaatcccagcactttggaaggctgaggtgggtggatcacctgaggtcaggagtttgagatcagcctggccaacatggtgaaaccccatctgtactaaaaatacaaaaattagccaggcatggtggtgggtgcctgtaatcccagctactcaggaggctgaggcaggagactcacttgaatccgggaggtggaggttgcagtgagcccagatcgtgccaccacactccagcctgggtaacaagagcaaaacctcatcttcaacaaaacagaacaaaaaacgaataaaatcaccttcccttgtggagatcatagtgatgtagggtgacagatagcagacagatgagtaagtaagaaggtgaaaagttccaaaggggaaaataaggcagaagggcgggaggcaaatgctgagaaggtggcctttgagtgaagtcctgaaggagaggagggagaagccatgaggtcacctgagagaagaacaatgcagacagaggaaacagccagtgcaaaggccctgaggtaggactgtgcctggtgtgtctgaggaagagtaaagacaatggcaggagctgggtgagtgaggccagagatgctcgtgggcttttccaagtgatcttctcgggctttctcccaaggcagagaaaatcagcaatgggaaaggaaaatggcaacttctggagcttgggaagaaaagaggaaagaggaaagaaaaaacgaagagagggaagaggaggaggacaggcctgagctcagagtcctgccaccttcactcttcatgtcttatcagacaaacaagcctggagtcaggagagcccatgtcccagtggcctgccatgctgtcctaaaagacagaccaacagagagaaagaaaggctggcctttaagaaaggaagggcaaagaagaacataaacaaagcaacagaaaaagtaaagctaatatataataacatatactataccagccgttgacaaactctggcccatggcttgtttgtgtaaacaaagttttattggcaaatggccatgcccattcatttacgtattgcctgtagctgcctttgctataatggcagagtagagtggtcccaaagagacagtatttactagacattttctagctaatcctttgcagaaaacattttctgatccccgtactataacaataacatacaactatattagcatattacgtatttgtagcatatatagttgacccctgaacaactcaggtttgaattttatgggtccacttatgtagatttgtttccaataacagttacaccaagcgtgcttgtctttctggcctccccttccacctccacctctgccacccctgagacaacaagaccaactcctcctcttcttcagcctacttaatgtgaagacaatgaggatgaagacctttataatgatccctttccaattaatgaatagtaaatatattttctcttccttatgattttcttaaaataatactttctcctccctagcttactttattgtaagaatacagtatataatgcatataacatataaaatctgtcttcatcgactgtttatgttactggtaaggcttctggtcaagaatagactgttagtagttaagctttgggggagtcagaagttatacacaggctgggtgcgggggctcacacctgtaatcctagcactttgagaggctgaggcaggaggatcacttgagcccaggagttcgagatcaacctgagcaacaaaagcgagaccttgtctctaattttaaaatttctaaaaaatagagaaaaaaagttacacacacatttttgactgcacaggaggtcattgccccaacccctatgttgttcaagagtcaactatatttatctatgaatatataattacataacataaaatggtttattactattataaataacatgctgagttcttaccatgtgctgggcactgggctaagcttttctgcctatgctcttgtattgaatctgatcaaaaactcatcagattaggacaatattattattgttgttattattcattgagaccgtggactccgaatctagatagcctaggctgaaatcccacttttgttgcttgaggggtgcaagacctcagatagtgagtctctctctctgtttcggttttctctttttgttacacgggatgataacagtacccacccctcagggcactgaaaggatgagctaaattgatgcaagcgaggtgcctggcatattgaccagaactctcattaccatggctgtccttattttacagatgaggaaactgaggcacgggaaggtgaagtcatgggcagccaccactgccagaagtggagagctggcaaagttggggagagggtgataaaaactaggaatcacggctctcatgataggtggacctagaagacagcactggggaacttggtcctgtctacctctcacctcattgtcctagacctgggagtgggcagaaggcagggacctgctggtcagctgccagaggcaatgaggggttgctcttccgttctccatggaggggaagaaggccggttaagcttgaatggtggaagctaagacagtgacagccctatcatcacagatccttggaggagttcaaagaagtgggtggggcggggaggggacagaccattgttacagccgctgggctgaccctgggggctggagatgaggatgcacggccagtacagctggaccagattggagtcaggcgggctcacaccattgttaacatgcccagcttcaacgtcacttgtatacctacttctggttgccaagataggctacaaagaggtaggagcaggtgaggggcaggttgcttcctgcccctgggacccaagtccacctccctggacccagcctgagggaccgtttctaggtttcacctccaggaaagtgactgcttggttcaggcagcgatcacttgctttctgttctgactccatcaaggcatctttccccacccagcctcaggttaaggtgaggggcttgccaggggcacagactgcctgcagagacccccactatctcagttctacctcatctcctggagaagacagctatccaagcagaggaccccacactcaagcttggcatagaatttatctcccttggagaacacggaaagattttcacttaaagggaaagaatttgcagaacaaggaaagaagtaagggagaaaaaaagaagagagcagatactggcatgtagagggaactaagaaccaataaccatcaccaccactgctaccaccaataataagaatagcagtaaggaggccgggtgcggtggctcacgtctgtaatcccagcattttgggaggctgaggcgggcggatcacgaggtcaggagatcgagaccatcctggctagcagtgaaaccccgtctctactaaaatacaaaaaaactagccgggcgtggtggtgggtgcctgtagtcccagctactcgggaggctgaggcaggagaatggcgtgaacccaggaggcagagcttccagtgagccgagatcgtgccactgcactcccgcttgggtgacagagtgagactccgtctcaaaaaaaaaaaaagaatagcagcaaggcaaaccttctttttcttttttccacctgagaacctagtttcactttgtgaaaaagacaaagtgacgtgtccactaaaccttcttctccatggactgaatttctcagttccccctgcagtcagatggaccatgggtattggctgtcttccattaccccaaatccactctccttccttctttacccttctaggactgtcacatggggggctgacctgtgtggatgggctcactgggctcccagccctctggctttggacaatgggggacatttattctgccagcttcctgttaggaaatgctccctctctctctttctctccccccttctttctctcaacttgtgtgtgtgtgtgtgtgtgtgtgtgtgtgtgtgtgtgtgtgtgtgtctttgtgagtctcagtctctctctgtctctgcctccttcctctcttcctccttctctatttcagtaagggcccacacctttgtaagctatctcttaatttgattcttaagctatctcttaatttgattcttggtctgtgtcttccgtttcctactgggaccctctctcatacaccatgggatgaaattccagtccacagaatgcaggcagaagtaaggttcactacttctatatgtggcctcccaaaacttcctgtgtgagccttcatactcttttcctacaggccggaagtgaaggactttctgatcttaggggatggtggagccacagatggaaagagccgggtcctgaaatcaccacatggaatgccacttgctgattatctgattggatttagggtgagtgagaagtacattcgtattgccttaagctactgcagacttgggggttgcttgttacagcagcaagcatatcctaatacacctttaagaagactgctcttccccacttggagaagttggctccaccccaactccataaagtcatgtgacccaagcctaagccaatcagagcaccccgttctccacctcccatttccccacagtgattggttctggcatgagcacacgacctcagcaacagccaatcaaaagcaagaaagcatttgctgaaaattccgggaagatagctgaaaaagagagaagaatctctctctgaatatggtcttgggcagactggagggctggaagtgcagctaagtcatggataatggagccagctgcaaaaagtagagccaagaaacagaaacagaggcctaatggtgttatctgatccctagatccaaacaagcctgaagctggacactcctgagactcttcagtctcatgagccaatacaatccccacttcttgtttaagcccctttgagttttccacctcttccaagtaaagggaactaagggattcacataggtaaatataatgagtccacaccatgtgtcaggcccactgacctcacagcaagtcaacaggtagatatttttactttaattcccattttataggcaaggaaatggggaccttttaaattggccaggagcacctcagtagggaaattatttgcaaaagagtatgtttggggattgggtgtgtgagcttgagtaattgggattgggctgaaagtccagaaaccaatcctgaaaccaacatcttttgtatgatttcaagagtgccaattaacttcccccgttctataaaaaatggagataaaaacccttccacttctcccccaccaattccatagtgtcggtttgggtaacaaagtaaggtaacagttaaaaggtgctctgaaggaaaggctagcaactcatccttgctgttgttaataaacagtcattgttgaattggctccagaaaccctgggggccaggggctgtccagtgactctcttggccagaattccaaagaccatctgtggcaaatacatcctccagagcacatacccttggcaggatcacaaactgcttttctcacccagaaaacacaaccagaaaagaaacagagatagagagaggggagagaggggaaaaatcatgccagctcaaaatttcttttaatctgatcaatgatttccatctccacagccaccatgccagcccaaggcacacttccctgaatgagtgaaatcatttcctaattggtctcatggctttttattcttgctgtattccaatacattctccatgcagcaaccagtggaactattcacagacataaaatcattgtattactgcttcagtagcctgacagtgcctttaggataaatatcaaactcctaagcaccttccacaggacctttgcacatgctgttccctgtggccaaaacatcttttccaccattcccacccctacaatagcagaggcccactaaagactcagtttatcagcacttccctggaagatgttgtttcacatgtttcttttagagcaagccagacttgtccctttttgcaaggcctataacattttaaattataagtagtaataactatttacatgtcatccttgccagactgtaaactccatgaaagccatgattgcatctgtcatatccgtcactgtaactcagtgcctggcacacagttggcactcaataaatatttgtggcttcaaaggttgagtataaaaacagaccagatgaaagaaggtaaaagttaaacagtcaagaggttgtcttgcagatcattggggcaagaatgggctttttaataaatgatgctgggacaattcttatggaataaaaaggaaattggacccctacctaccaccacatataaaaatcaatcccaagctgattaaagacatacagtgaacacaactgtaaaactttcagaaataacataaaatatatccatggcctcagggtagaaatgattttcttaaataagatacaaagcccacaaactataaaggaaaagatttctaaaatcaaccacatcaaaattaagaactgttggtgatcaaaagacattataaaaaagatcaaaagccaagccaagagaaaatattgcacaacatataatgatgaagaatcagtttccaggctatgtaaggatcacccacaaatcaatattttttttttaaaagtgacctaatcaaaaatggacagagcatgtagaggcacttcacaaaaaagcaagcttgaatagtcaataaatattttaaactatgttcactctaatttgcaatcgggggatgcaaactaaaatcacaatgagaaatcaccatgagaaaggctataacttaaaaacctgacaataccaagtgttggcaaggttgtgaagcatcttgaatgctcacccaccaccggcaggagtgtaaattagcacaagcactttggaaaattgtttggcagtgtttagtcaaggtgaaaatgtacaaatcttagtatccaacaatttcacacagagcgatgtgctccagagagacccctgcaagcgagcagcagaatccataaacaaccaacaaagctgcttatgccagtgcccaaaagagaacaaagtcacatgctcatcatcaatgaataaacaagatcatgaaggagctgcagtgaccacaatgaggatgaaatctcacaaaggtaactgcaaaccaatgaagcaaaatacaaaacaactcctctcacatgattttattcatataaaactcaaaaccacataatatctgactatattgcttcaggatgcgtacttaggtggtacaaccacacaagaaagcaagcgaatggttcccatacaatctccaatagtggttcctccaggagggaaggagtggctgtgattgaggatgagcatgagggagaatctgatggtggccctgtggctcttgacctgggtaaaatgggtgtacgcttcatggtttggtctttaaaatgttcatctatgttcctacactgctctctaggtttgttctgtctctctctctctctctctgtctgtctgtctctctctctctcacacacacacatacacacacacgtcagttaaagactaaaaaagaaagaagacacatacaccaaccaacagtttatgctgagaaagagaaaaggggaaaatacccagacagaaaattaaaagataacatagacacaggaaatgaaaagagatgacgagttggcaagacggcgagggtaaggaaatgagaactggagagacagaaaaaagaaaaaaataataagatggtcaaggataacaggagaaggggaagatacaagaagcaatattctctctcttctttctgtctctctttctctacctccatatctctccctctccttcatcccttccatctttgtctctctctcttttccctcaccattgccttccttgcacttcctccatccaggtccttctctccccttccatctctgtctctttctcaccttccacttttctttctctctcatctctctctctctctctgtgtctcctctttgtctcctctgtctcttccttcttccctacacacgcagcctctctttcttttaacacttatttatcaggtggctaccctgtgctggacacagtgctaaaaaagaggccctggctgggggaaatgggatggcatggcccaccgtggttcccaagcatcagtggcacggacgcctgcccagggcgcctcatcccagctccagcatggacctgtgggccgcctgccactctctccccatcattaatttcactatcaaacactcccagcatcacaagttgtaggtcttatttattaaatatttaactaggagaaacccagctgagatgaaacctctcatttgtggcagccacaggagagcagaacatggacctgctgctgggattaagccaggctgatgagtagaaccagggtgcccagagggggaaacaggtgggggcagcccccagtggggagaggaagacccagaaatgcagggagctgggctttcacacagtctcacctggatggcgagaggttgtcagccagggaaggcgagttcaaaaacccccaaaatcagaataggtcaatctatacagacagaagattagtagttgccaggggctgggggagcggggagagacagggagtgagcgctcagtgagtacggggtctcctttttggggtctttgaactacagagaggtgatggttgcacaacactgagtgtattaaatgccaccaaactgtacactttaaaatggttaatggtcaattttatgttatgggaattttatctcaatgttttaaaaattaaaaaaaaaaaaatcccacacccaaacccattaaccattagctctaaggctgctgacctcattttttaaaattcatgcttattacacaggcactgcttactatcaatccaaggcactcgctcagcattttgggtttctttcttttttagaaatagggtctcactcttgtcccccaggctggagtgcagtggcaccatcattgttcactgcagccttgaactcctgggctcaagggatccccccacctcggcctcccaagcagctaggactacaggcatgcaccactacacctgggtaatgtttaaatgttgcccaggctggtctcaaactcctggcttcaagcaatcctcccatttcagcgtcccaaagtgctaggattataggtgtgagccactgcatctgaccctactcagcactttgaatcatcccatcatttacttctcacagccctgggagggaggtgccagcaggtctctagttttagagagaagggagcttgtggttcagagagggtaagtggcttgcccaaggtcacacagctccaacttcagtctacctgcttagccacctaatgggctttctgctaactctggctgaactttagaaacccttggggagttttcaaacattccccactccaggggaagccctggacaaatctctccagcatctgtgggggtggagcttggggcatcagcattttcctttttcttttcttttttttttttttttttttttttttgagacagagtcccactctgtcacccaggctggagtgcagcagtgccatctcagcttactgcaacctccacctcccaggttcaagcagttctcctgcctcagcctcccaagtagctgggactacaggtgtgtgccaccacacctgggtaatttttgtaatttttagtagagatggagtttcaccatgttggccaggctggtctcaaacttctgacctcaggtgatccacccgccttggcctcttaaagtgctgggattacacacgtgagccaccgtgcccagcctcagcatttttaaagcttccaagtgattagaaggtgcagtcaagatcacctgaggaatctcactgaagagcagattgggattgagcaggtctggggtaggggatgagattctgcatttccaacaagctcccaggagatgctaattctgttggttcagggaccctggcaacatgtccagtaggatgctctagatctgcactattcagcacagtggtcactaagccacacagggtcatcgggcacttcaaatgtggccagtgaaactcagggactgtttttattgtaattaatttcttttcttttcttttttttttttttttttttttttttgagacggagtctctctctgttgcccaggctggagtgcagtggtgcaatctcagctcactgcagcctctgcctcctgggttcaagcaattctcctgcctcagtctcccgagtagctgggactgcgggtgtgcaccaccatgcccagctaatttttgtatttttagtagagatggggtttcaccatgttggccaggatgatctcgatctcctgacctcatgatctgcccgcctcggcctcccaaagtgttgggattacaggtgtgagccaccacatgtggcctgtaattaatttctaaaattgcaatagccatgtgtggctactgcctaccttatttggcagcataggtctcccgggctcaagagatcctcctacctcagcctcccaagtagctgggactacaggcatgtgccaacaccctcggccaatttttgtatttttttgtagagacggggtttcaccatgttgcccagcctgctctcaaactcctgggttcagcctctcaaagtgctgggattacaggcacaagccattgagcccagcctggtctgcatctgtaagtgatccaagactatggccaagggtgagacaaacaccttaggggagcaatgaagaaattaggaactcacttgggtcctccacctttcctttctcagcactggccacctgttcaggggccttcacctgtccccttgggtctccccaacgaatccctgcttcactccccagagagaaccatcagagcctccccacaccagcccctgacttctcctactcctcagatcaccctaaatcaagcccacatctccccttgggtttcctcctatctcagtttctcagttgtatctcctgtcacctccaaatgcagctaagatcacctgggagatctttatttttgagccttagtacttaccacactcaaactatcctttacctgtttatctggtccttggactccctctctctccccacccagaatatcagccacaccagggcggggatttttgtccgtgtgtttatttctctctgtgttttgtccatctacgtcccagtgcccatgccaaggaggaaattaagagcttgctggtcattagagaaaagtaaatgaccagcaatgactacctgctgagaatttactatgtgccacgcatgatgttttacagtcaccatccacttaatccttgcaacattcctgcaagaaaatgctacactgcttatcttatagatgacgaaacagagtggttaagattaggtagcttcccaaaagccacaccaccgatagaaacctagtcctagcccaggcgtggtagctcacgcctgtaatgccagcactttgggaggctgaggcaggaggatcacgaggtcaagaggtcgagaccagcttggccaacatggtgaaactccatctctactaaaaatgcaaaaattagctgggtgtggtggcgcgtgcctgtagtcccagccacttgggaggccaaggcaggaaaattgcttgaaccgggaggcagaggttgcagtgagctgagattgtgccattgcactccagcctgggcaacagagcgagactccatctcaaaaaacaaaagaaaagaaaggaaaagaaaagaaaagaaggaaggaaggaaggagaaagaaggaaagaaagagagagagagagaaagaaaggaaagaaagaaagaaagaaagaaagaaagaaagaaagaaagagaaaagaaagaaagaaaagaaggaagaagagaggaaggaaggaaaggaaagaaaggaaagagaaaggaaaaaggaaggaaggaaagaaaggaaggaagaagggagggagggaaggagggaaagagaaaggaaaggaaggaaaggaggaaggaaggaaaggagtaaggaaggaagaaggaagggagggagggagggaaagagaaaggaaaggaaggaaaggaagaaggaagggagggagagaaagacaaaggaaaggaagaaggaaggaagaaaggaaggaaggaaggaaaggaagaaacctagtcctagttgagctcagactctgtcccttaaccatcgtcccgcgacatctcttgcccactcgcacaccaacctctctggaatgcaaatggtttcccggagaaaacttgagtatttttccctctgggtttttatccttgctgtgccttcacctgtctcataaagtttctccatttgctagatgtgtgaccttggcaagcagtgttagctctctgagtctcagtgtgcacatctgcaaactgggggcaaaaataagtgccatgagctctgggggctgggatgaagttctcataaactgccagggcagttctataaagcttaggggctcataagctccccacagagaggagctactgttactgtaactattcaccacaaagcagagagtttccatgtcctcctgggacatggtgcttcctctttatcagggatggagtgaaatcctgacatgagcaagggcaggagccaagaaaagggcctttccgtcatgaatgtggaaaatggtctgtttgcttttcatcaggttttgggggttggggacatgggggatcctgtttggtcagttagaggagttgcagctggtcctaaagcttggagagcttgcactaaatcttgtggctgccatttcgctttgaaataaaggggctgtctaagggccaggtgtggtggtgcacaccgatagtcccaactactcaggaggctaagctgggaggattgcttgagcccaggcggttgaggctgcagtgagccatgattgcaccactgtgctccagcctaggggacagagtgagacctcacctctaaattttaaaaagggcttgtcagcaccaacagaggtacacagaggcgcacacacactattgcactggggagggaggaggccgatacctataacactaatacatcagactcttatttggcacccactgtgtgtcaggtactgttttgagtgctgctttcctcacaaccaccccacaatgcaggcactaatgttataccacttttactgatgaggaaaggcaggcccagggggctaagtgatttgcctaaaatgatatgaatggaaataagcagagttggtatttgaacctaggcagccaggctccacagcctccctccctccactacactggactgcctcaagccccacacagagccatgacatgcctcaatttcaacagaaacttgctcaatccctcaaagacatcggtaaagaatgtgcctgagaaaacagaggaaaggatatccaaacagcccacagagatctggaaaatgctctatgtcttaagtcaccaaagaaatgcacaggataccacaacaggatttcactttcacttatctgattggtgaagatgtaaaatcaagggagggcaagcctgattgggccacgtcgtcagggaaaggggaccttggaatttgaaagggcacagacttcctgtttcttgcaacctggcccaaaagcctgacatacaaccttgccataccatttccaggaatctgtcctagggaaacagtgacagaagtgtgcaaagacttctctaccaggatgctcactgcagtgtgatcagtgttggtggaaaaacggctggtctcaaaacaaatatacaaaaggaagcccatttttgttatgaaaatcaaaaagtttaggtatatcggggggaaaaaaggagtggttattccatttcctttggaaaaaaacaaaatcctcaccatagttcacaaagcccagaataagccaaccttgtcacctccctgccctcacgtcctcccattcacctagcatacagtaggtgctcagtcaacatttatgaatgaatgaacgcactccttcccattcccctccatctctaagctgatatgctccagggtctctctcctgtacgttcctaagggtgtggggatcaaggggatatagaaacacagtccataccagcagcattcaccatgccaggagaccaaagaaagtaaggcacgattttcaaacagggcaacagaaggggaaggagagagaaggggaggccgccgcagttttcattccaacattttccagctctgggtgagatttccttctatacactcatctatatttacatcaacgaatctgtcggtagcaagcctgttgcttcttgtgtgggatctaaagttcacagaaagctggcttagacacccagctaggaagacaaactgtaaattaaatttaagtcacccaaaaaccctaaatccacccactcctcttgaagaaacccatgacatcgattacatcaagatttctcaaccttggtattactgacatttggagctggataattctttactgagaaaggctgtcctgtgcattttaagatgctgaactgcatccctggtttctaccagccagatgccagtagcatcttgccccctccccctacattcgtgacaaccaaaaacgtctccagacattgccaaaagtccccttgggggaaaaattgctcccagttcaaaagcactgctttacatgcagcccaggaaaaattccaaaccatttaactgttctttctctgttccttgtcatcaacatcctgaatataccagtcacctgttctcaaaattccttctacagattcaaagaaagtggtaacagcagagtttcaattatgggcttggagtgccatatatagacaggaatttcattcagaaaactatcagaaccttggacagagattcacacacaaagatgtttactgcactgttatttataatggcaaaacaaacagccagagattgttacatgaatataatacacgtataaagtggaacattatcagatattaacaacagtcttttctggggttgccaccaacccatacagcaccactgtatgaatttaaacaagacacccctttctctggttgtgaaattaaacaagacacccatttctctgattgtgaacttaaacaaaacacccctttctctgtcaaaaattgtcataatagcttcatcttgctagaacaagatacttaagcttttatcagctggggtactgaaatagtagacatacaagctccatgatacttaagatatgtgacatgctatctttgtgcagtgcacaacctgtgcaactatacatggtggcccttattttttcaaggatacctagtggcatggaaatgtgttcctaaaagtttacatgcataaaaaggtatgggatgaaatacattaaaatgtcttcagagatttttttgtggatgagagagtatacatatattttatattcttttttgtacatgagatgttcagtaaatgaaaaggataggcctcttggaggaggtaacttttgggctgagacctaaatgaagagaaggagttagccatggggagacctggagaaacagtgatgcaggcagaggaaatagcttatgctgaacagaaggaatgtcatgtaatgcaaatgacatgggtgtgagtaaaatggtcagcagggctgagacagaatagacaatgaaaggaaggtagacaatgaaagagatgagatcaaagacaaaacagggaccagatcacatggggccttaaaggaccttgctacatcagtgtgttagtccgttttcacactgctataaaagtaatttataaagaaaagaggttcaattgactcacagttctgcatggctggggacgcctcaggaaacttacaaatcatggcagaaggcaaagggaaagcaaggcacgtcttacatggcagcaggagaggagagagaggaaagaggcccacacaagtttaaaaccatcagatctcatgagaactcactatcacaagaacagcatgggggaaatcacccccatgatccagtcaccttcaccaggtccctcccatgacatgtgggtattacaatttgagatgagatttgggtggggacacagagaaaaaccatatcaatcagtaatctgtaatctctgactagtgggtaagaatctggggcatttacccaatctgcttggaagagaaagagtctaccagtccaccaccacatgctatcctatccaccaatggagcaaaatccaaggaattccactttcagtcccagtgctgaaacaaaaccaggtgtttccagaattttaataatctttgttcaataacactgtttactttcctcaccattactcaattaaatacttatgcatgatatagtgcaggaactttggggggatgtgaggaaggcaaatcactgtcccctaccctcaaggagctttctaattacataggtaaaacctaagcatataatatttatttatttatttattttgagatggagtctcgttctgtcgcccaagctggagtgcagtggcatgatcttggctcactgcaagctccacctcccgggttcatgccattctcctgcctcagcctcccaggtagctgggactacaggtgcccgccaccacgcctggctaattttttgtatttttagtagagatggggcttcaccctgttagccaggatggtctctatctcctgaccttgtgatctgcctgcctcggcctcccaaagtcctaaacatacaatcttattgatttttacaaaagtgtgcaaaattcacttgatactggaaaaggtacaaataaggtggtaagcggagagacttggtcattcccaagtcaaacagaacaccaaatatcagggagacccacacatagacagctaccctaccatacacccttatatccaacatccacccatccacccacccattcaaccatctatcatccactcatccacccatccagtcatccatatttttacccctcaatccagtctagtcatctgcctatttattcatccagccatatattcactcatacaccaatccatccagtcatccatccagtcatccattcacccatccatttgtccacccacccatcgagtcatctaccaatctacttatccacccacctaccctccaatcacccatccttccttccttccttcatcccatccatccatccatccactcatccatgcatctgttcaaccatccatccatccatccatccatccatccatccatccatccatccacccagacatccaacactaactgcagaggatgcctccatcccctctaaaccacaaacatccagctatgatccataacttaaaagactgcgttgtgatcagaaacaggccacaagtcaaaaatttgcattctgacaactctttcaaagacaactcaagtctctaaacatttctgaccattccaatttgtgtaagacccaaacactccatgtccttgtaaggccctcagagaagctaacctatatttggtgctctgaagtatttgatgtcttcaaagacggtgcccttagggagaaggtaagactagagacagtatagttagaggaaggggaagctgtggggagattggagagtctggcaatggggcataacaaatgagagaaaaagattagaaacatggaagaaggattgctgagacgtggggaaaatcctacttgggcctaggaatcatggaattctagtatggacaatcaatgagaccttgtgattgtgttctccttggcttatatattggagcaacagtgattcagctgatcattcagaagaatgggttaacaacacagacgccaaaaataacagagatcaagggagttgagagacttggcaagaaagagcagaatattaacacttatgcagcacctactgtgtgccacacactattctcagcagtggatcagagaagcccaaatatggccacccacataagtccatccatctatccactcttccatgtataaacacatatagtgcttcctaagtgtcaggcaccactctaaacatcagatgtattaactcatttaatcctcccagataggagctattaggatccccatggagctattagaatcaccactgggacagactgggaaactgaagcacagaacacttaagtgacttgcccaagatcacgcagccagtgactagtagagctgggatttgaaccccagccacctagctccagaatccatgctctcaactcaaccatgctgcttctctacaaccatatcaattgccagtgtctaaaccacaggttctgactctcagaatacaagcaggaccaagagctaaccggttgacccagcctcttagagaaaatgatgagtaagctgtgaaatgtcttagctcctgccataaatgctgatgaatctcagctgattctaggtgaagctagatttccaagtacacagactaaaattaacacctcgaattcattcattcaaaattattgattccttacagcagcattgttcataacagcaaacaaacaaacaatcccccaccccaaactagaaacatcccaaatgcccatcgtcctgcttgaacccgggaggcggaggttgcagtgagccgagatcgcgccattgcactccagcctgggcaacaagaatgaaactccatctcaaaaaaaaaaaaaaaaaaaaaaaaaaaaaaaaaatatatatatatatatatatatatatatatatatatatatatatatatatatatatataaatttatgttgttaaagctgggtacggtggtgcatgcctatagtcccagcttctcgggaggctaaggcaggaggatcgcttgagcctaggaggtcgaggctatagtgagccatgatcatgccactgcactccagcctgggtgacagagtgagactctgactcaaaataaataaaataaaattcattgagttggctacttcacaggatgattatatatgccatgtgctttctgggtacagtatcttttaaccttcttacaattcctcggacataggactactgtccccgttttacagaggagaagactgaggctccacaactgtgagctggagctgagatttgcagccagggtggactgttcccaagctctatatgtctcccctccatccaatatcaccttccctcctcttttcctccttacagcctccactgcttgtgctgttaatcaaacagacacattcctatgcagacgccacaacatgccacgaacacatttcactgcagtgatggtcagcatagccctcccacccacacacaccatgcccatcattctcaataaagaagataataaagatcatggagataaaagaacgtgacagactctggaagatcagaatccatgtaacaccactgcgggccaagttttaagtctgccccagagtctcattgaagacaaatccatccacttttacaaaaaggtaacatccagacttcgccctcctgcaaatgctgttcgtatgaaaatactttaaaaatcagtttaaaattacatatattttttacacataggcctaaaatgagaacagaacttaacagcatgaatattatttactggcaagtgggtgactaagttgggtttccctcatggcttcagagaggggactcttgaatcctgttatttgggggctgggggtgggaggctgctaatttctaactgcaggtgccgcctgagcaacaggcacctttaaggaagactcacggctgctcccagtctgaacggcagataaagccgtgtctgaccgaagcgagatgtcaaaacttgatccggacttaactcaggcatttcccttcatagctggaatctctcttgtattagctgccttaaagacggcttctaaaagctgcattcattccaataaaaagtcttggcttttcagagggaataagtaactgactctccccctttcttggtcaacggcaccatctcttgcaccattcttctctctcaggtgttaagaactcaccattagggtgaccagcgtcccagtttgcccaggactgtgagtttccagagatgctaaacccaggatagtcccaggcaaccctggctgaagggtcaccctactcagataagaactgaggcccagtggtttttgaaacctaagttgctgtgcccactcatggttccctcgccaggaatgttccttgtttttcctatttttttagggagtgaggagaaagaagaccaaagtttggaaggggaggggggtacctaaattctaaaccaaaagttgagcaaagtttttctgtggagtttgcagtggacacctggggtggccatcctgggctgcactctcgaccggccccaaaggaagagacagggagtgcaaaaggggaagagggaagctaattatatactttaaaactccctcaccttgtcacccacagagagagggagggaccaaaggaggaaagagaattaatttttaccttagactcaagggaatagaaaaatgggtcaagtggccacgaattttttttcccctgaaagcttccagagagaacggagaatgcaaaatgtccaaaggtggctttaaagagcgccacgatcaggttaatcaatccacactgaccagtcgcagggggtggtgggggggggcacttcgctcccattcccacccagaaagcctcttttctggccggtttccaaaaaaagaacactggaacctaaatgactccatagtattacggctctggcgttttggggtttttctctgtgctggagactgtgctggccatttttcacgcacgaccccatttaatctcctgagagccctccaagggagatgctactagaaggaatatcctcatcatgcatgtcaagaaataggctctggtgcccaagataacatggctggtgaataatgtgaacctgggccagtctgacccagagtccggagtgttttccctctcctctctgccctctttcagagcaggcaccatcccatccggcccttttctcaggagctgagctggcattctcggaaatgcgttactgcacggctcttaggctctgatcatttctggatggagtccaccttcccggcggtgctttttattgctgagaaagtgtatatgtgtgcttgctactgggggggaaacagggagggggaagcataagccctacgcacccaacagatgcctcccactccaagtccctgaagaaagacttcattctcaaggggccgctgcatccaatctactcaagcactaacatttcagaaactttcattggtctgataatctcatggacagtctctcaaccccctgcaactaaaacccatcaaaatcctaaaacgttggcacaagggtagatcagatagatgttatacaatttagttaatgggtgaagacaggtaccttttctcatttgctcagcaaacgtttataggacgcctgctttgtcccacacactggggttgcagtggtgaagaacagggtaaagatcatgggtctcacagcctcagagcttgactttttcctggggaatggtagaactaccagggaggggtggaaccccacccaagagaaccccttctttctctctctctagtgcaggcacatagctttgaatgacatccttaatctttcttatttctctgaccgggatttaacactattacttccactcctttccatagatccacatccttaatcctaagccatcgaggccagacgtgctttggaattcagaactcagggcttttagacgcattgcaaagatgggaatgtaaaatggtacaaccacttaggaaaacagtttgagagcctcttataaaattaaacatacacctaccacacaactcagcaatctcactcctgggttaatttacccaagagaaatgaaatgtatgaaatgaaatgttcccactaaaacccataagccaatgtttatagcagctctattcataatcattgaaactggaagcatcccaatgtccttcggctgggaagcaaactctggtccatccatatcatggaatcctgctcaacaccaaaaaggaaggcgctactgtcacaggcaacagcatgaatgaatctcaaagtctgagtaaaagaatccacattcaaaaggctatatactgtgaaattacatttatatgaccttcggcaaaaggcaaagctgtagggatggagaacagatcagtggttgaaggggctggagaagtggggtgctgactcaagaggggcactgtgggggtattttagggttgatgaaactgtcccatatcttgatttgggtggtggccacaactacatccatttgtcaaagcttgcagaccagtatgtcaaaagggtgaattttgctacaaataaattatacatcaataaatctattttttttttgagacagagtctcaaaaaaaagtacagtggtgcaatctcggctcactgcaacctctgcctcccaggttcaaatgattctcctgccagcctcccgagtagctgggattatagacgcacaataccacgcctggctaatttttgtatttttagtagagacggggtttcaccatgttggccaggctggtctcgaactcctgacctcatgatccaccggcctcagcctcccaaagtgctgggattataggcgtgaaccaccagacccggcccctataaacctgatttttaaggaaaagaaaaatgataacaagatgtctctatgatctaacctggatactccaaccctagcccatgaacttaccacatggggaatccctagaagctagctagaaaagcagaatcccagaccccacccaaatcctgctggaccagaaccatcctgttaacaagacaacttccatacacctgaaagtttgacaggactacaatgcagacctaacagtcaggagctgaagcagcacctcatcatcaagcacatctaacatttctgctgcaaaacatactcaaatgcacaccaagtagaatgaatgaaaactgtaaattaagacttcaaactgaagtcagttcaggttaggttttacctctatatgagctcgtcttttggtttttggagctttttggattggggaattgtggataagaaattgcaccctttttgaaaatactcccattggaaaagccgtgctaaattttacttcgcagaattttgctcctctggaaataccagccaagccggtctagtacaaggatcacgtaagtgacaccatcctgccctctacggcagtaccttctagaacattctatctctcaggacaggccaagagtctgataacctgctcccatgtctcccagcgcttctcatgcagaaagtttctctttagagagcttttcttaaaaaaaaaaaaaaaaaaaaaaatgagaggagtgccaatcagccaatgtccacagatgtcaaagtgatgtcacctgatgtcaatgtgactttaggtgtcttgttaagatttctgcaaaccggatgaaaagctggaattctacgtgtaattcaggcaactgtgcgtgataatacactgacctgcttccagtgttcctccgatggcctgagtttctacatcatgttcagtgggagacctggtggcacagggagggctggaaagatgacattcaccttggcacttggtagaaggagtgagtggcattaagtggggagggaactctaggaaggctgacagatgctcctttttgagctgacagatctgagctcttcggcaatcatcagagaccctcatggccctatttgaatcacaattccagtcaatgaaaacatgaaaccaaggtgtgtggtcaagacggcttgctgcctggcatgagaaaaacacggcaatgtaaatttgaacatcaaagacttccatttgggtttcctcacttaggaagaggggaaaaaatgaaataaatgaggattcttaattgtcattgatggcttcaagtttgacccactgagggatgaaagaggaagaaatcatagtgacaaattgccccgagtgtggagaaagcaagactgcatccttcaccagtgtaccatgccagaatttacatttggaagtagcactcttaggccctgtgagcataccgacaagttcatggatcattcactcacttctcttaaacaagacagggaggaacctgctttccatatcgacctgcaacccttagtcaacaccatttccaaatacacatcccacaacacatgcatcaaaaagtagcaggggcgattccactcctatctaagagaactgtgggaaaaaaataatagaagacacaagaatgttcccagtggcacaaacagaaatgacacaaatgcccatcaacagtagaatggatagattgtagtagagtcacatacacagatgtgagcaaaagaagccagtggcaaaagaacgtactgtgtgactccatttacatgtttaaaagaggcaaaatgaaccttagaagtcaggtgagcggtacccttgttgggggagcaactaggaggcggtatggggagggggacttccagggcactgatcgggacctgggtgctggatacgtgggtgtgttcattttgtaaaaatctatgcatctgaatatatgtacttgcctgtacatatattagactttatttaagtacctacacactttttttttcactctcaggatatgctgaaacatttttttttaatggcagaaatatttagattaaaaagtagaatgttctgccctggtatcgtgactctgacattccacgtgtctttctctttacactggcctgaattcttttattcactacctccctccccaggtctctgtccatcccctctcatctccaaccctcccacccaccccgccaccgccctccgctccatccaggacagagaaagctcagtcctggatgacccagctcgatgacagattgtgaggtggggagttttcccttccagagtagggctgtataatgtgtttgttacctcgggtcaaagagaacaaaaacagtctgcagagagcataatgcacaaactcatcataagagcaagaaagccccgggcgagctggccagagaatagatgaagtggcaagcaacactcgcaattcacctgcctccctctcccacgattcccccttccgaggggccactgcaatccccctctcccccaacagccctccaatctgcaggattcaggctggacagaggtaagctaaggacacagcagaagggctccccacctccttcctttcctcttagaagtctccaaatccaggctccagaaggcgatctaaagccattttcaatgaggaaacctgtcagccgagcaaagccctctcactcctggagctaactgggtgtgcacccatgaataccctgtcctcctgcaaggcactcccactcctcactctgttgataggcagagtaatcaagccacccctgagcacttcaatgggcctgggatggtgaggaattgctaaccttaagaaccagcctctttaagagtctgaaacttaggaagcaaagacctggcacctgctttgggcaccaacggagatggcatcgtagttagaggtatgctcccctcaaaagcacctctgctgaacttcttaattttccccaccctcaaagtagaccactcacacactccaaaacctcagtgccctctgttgcaatcccagcacccaggatccaagcgccaggctcgattttgaacccccctgaagtgagtccctctaccacccgccatgctcctcaaacagcaacccccggagaccacacagggcccagccccgtttagtctataactgcaaaaccacatacaaaagggataggggactcatcgctgagccccagggacccatccagcccgttcatttttacacagagggcagctggttggaactgtgcggagaagcggcacatctgggcatggcacagtggccagccagcctgggcagcagggtgtgtcccccctcctggaatctgggtcatgcttagataactgctagaaagcccgactaattacccacccttgcctgcctacatctcgatagatgttaagccctcctcaaggtttatttcaagcaggcagggatttaaagaaacacagaagatctgcattttgatagcatctccacagaagaaaatgtgggcttcacctttttcctctggatctttgattaaaaaaaaaaaaatttaaaaggcatttacctacctaagatgtccacatgggtgctgattctcctggtgttccctctcggctactcggggtaggaaaagctggacatggtgctctaaaatggacccaccacctcatttgctgttgccctgtctttcttactgaaagtgtccagatcaggtcttcccaggccaggggcccagataaagcaagtgggatctctttctcgacacccccaaagatgatgaggttccccaatcagcggttaaaggcaatgggacctgcacacatgagggaaacataagcgccccccagcccatcactatcctctccagataggaacagcggcccaccctggggtactcacttcggccagtgctggcttctcagtgtgaaggccacatggactccctcttgctcttagccctgggagcccccaagcgccctgccctaaaagtgcggcggccccccaccttggggaaagcagtagtggagaggctgtccagcttcccctgcgtggactccagtgagcgacggccaagaaaacccaaccaaggcccccatagttcccctgccctggccagaagcgcccaggcccgagcccgctccaagctcactccgtagaactccaaaccctccggacttggctcgaaagcccccaccaaggctcctgcacgaccccaggccccagatctcattctagagtcggtccttgggaaggatccactctccgctgcccaccccccagccccccacaaacccattcccaagcctccagggtagctcaacccagctcggggtggagagattctttcacactcctcccggtgccccctctcccagcccctggaagacccccctcctccccacctcccatcaacccccgggtctctctcccagcctggaagaggggaggcggagggaggagggggaggcgcagctgctgctggggttcgggcaaaaggatatggccattcggtgatctttttggcgtattttctcaccacgttgtcttcgctgaagaggaagagagaccggttaaccgtgaggcagttctgtcggacggggatggggttgtagagtgccatggtccgcgctctctgcgccattgactgcttgtacatcctttgcgccccgggctgcccgccctgccggctgcccccggctcctcgcccgcctccgctgcccacgaccaccccggcggctgccccggagcctcctcccccgtagcgggccggcatctcgtctccgaagcgggccattctgcaaagagcaaagggctccgggttacgctgcggcgaacgatgcggaagacgccgccgccgccgccgccgccgctgatgctgaggctgccggggctgggagcgcggcggctggagctacgactgcggagacgctccacggcccagcccatcgggcggcggcggctcggcgcctcgggtcgggggctcagaaggcggctgcccgggccgagccggggatagcagctcgggacatcttcctggctgaccccggagaaggaggggcgggaggagggtgcgggggcggggcgcgggggcccggggaggaggggggaggggagagagaagcgaggcaaaaaataaccgaggaaggaatccaggcaatccccagtccacccactccggaaaaaaaaaaaaagagacagttaaaaaaaaaaaatccacccaacgcacaccccctttaagacgcgaacggtttgcaaaggacgccccccccgggacgcagtggaagcttcaaattcctccgaggtccgggtcaggctggcatcttgcaaaaggagtgcgctcggcccattaaaaaaaaataaaaaataaaaaataaaaaaatatatatatatttaaaaataaagaaagacgaaacccaggtctgggtggggagggcaaaaaaaaaaaaaaaaaaaattaagtgcccttctgttttgctggagttcctagaccttaaaaatgctgaaagatctgtagctccaaaaataaaataaaataaaaacaaagaagatgaaagggaagggaaagaggagggaaggggagtaagacgctccagagggttcctaaggagtcttcacaccgcagggtccaggtttaaaaaaaaaaaaaaaaattttttttcttcctgaatcaccaacggctgcctcttctgctcccggaggaagtgtgagtgtgtatgtgcgcacagcgtttcgctcaatggtgcctcatcttggggttaaattgcagcagtgaaatcctgaaaattcccaacagggggaaaagagagagagagagaggtatgcgccctccgcttagccactcaatagctgcccctggatgcggcaatgcctctccaccctccaaatccctccacctcctccttctctaggttttgctaaaataagactggtgtggagggttgcgggtagaagaaggtaaagaggaaaaaaaaatgggcgcaaaggtctgaaccactggccagcaaacggaaaaggggagcaattgatgagtttaacagtagaaggacccacccagagtgtcgacacatgagggcccgcgaccaatcgtggaggctcgtggaggcgcgggggtaccgggctcagcggagtttgtgggggagagaggggagcgtcgcatggttgggaggcagggaggggggaattggggtgcttcctcctcccctgggaggaaagcctgttttccaccccgttccatttcggttgcagacagccggacgctccccagcatcttgcaaggagaaggcaggatggaggcaggaaaaaaacttaaaagacagaaaagagaaggggatttgtgtctagaggtgcgattcgtcagtctctaaacaaatttgctctgtttagcaaaagaccatttttgaaagtggagagagtggtttggggttacttctgtgaacgtttcaaatcacaaggactcctgcaagttggaattaaaggtttattctaccttggagaccccagaggtgacaagtctgaactcccaggaggaaataattaaccaggtcctagttggctggataggggttctgggtggtatagtttgcttgatactcacgtctctccagaaccactttgattacttcccattctgctttttgtgtggtgaaattcaataagcacaaagaaaaatgcataaaacataaaggtacggagttaagaaattggtctgaaatgaacactcatgaaatcaagtctagggctagaaatggaacatcaccacctctgcagaaccccctttgccaacacgcttacacagccccttattccagcaataatcgctacctgactttatggtattcatatcttgcttttttaaaaaaagtttgactaccttattatgcgttcctaaccaatacaattttactttgcttcttttgggcttttatataaatggaataatcatatagtatatattctacagtttcttgtttcttcggttcaacattatgtctttaagattcatctggcagggcacggtgtctgcgcctgtaatcccagcactttgggaggcagagcatgaggattgcttgaggccaggggtttgagacaagcctgggcaatatagcaagaccctgtctctccaaaaaccttttttaaaataaaaattaaccaggcatggtgatgtgaacctagtcccagctacttaggaggctgagatgggaagatcccttgagtccaggatgttgcagtgagccaagatcaaaccactgccctccagcctgggcaacaaagtgagactctgtcaaacaaaacaaaacaaaacaaaaacaaacaaacaaaaaaaacaagattcatacatcctaatctgtttcgaattttagaaaaattcacctgtttgttgtcacacatggctgtgattcattcactttcactgctgtatagtatttcatcaagagaatatgccacaatttgtttatccatcatcttgttgatgggtatctgttttttttccagttggggctattaaacattactgcctcaggtacctttggtgcagataagaatgcatgtctctaggaatagccttaggtgtggaatgtctgggtccacaaggtattcatatcttcaagcttataagatgtcatcaaactgtcttgcaaattcaatgtaccaagaaaccattgaattttcatggagcttgtatacgcagaaaggccaaatggagaggaatgggaaaaggatgaaaaaggcaaatattctttcaagccttagctagttaaatcctagttaattcccttcccccctcgccaccccacacacacatatcaatattcgagttcttttggaacactctggaaagatgatatgtctttatataaagtccccgttctgtgccaatgcaccaactattatacattgccccatagcactttcaagattttctaacttgtcacgatatggatgaaatgattaaaccaagagtgattggaattgcaaggagatagaattgtgtgggattcagggagaaggaggggcttttaaggcgctcaccaaatatcagtgatttttgtacttgacattgtttcagatataaaaggtgaacagcaactaatatgaaacaagaagcgagcccatgtgttcagatgggaagaaccagtcatatgagaggagctgagttgaacttatcatttgttctgatggacctctctgagaagattattcagttttagagcaggagcattacctgcatagatctgtgaagaccccagagtttttcaggaaagagtgacatctcactgatggagctcctgccagggtaaatctcccactgagtcttcacagcagccccgtggaacagatgcaaacactgagggtgagggagacttaaaaactttcccaaggtcactaacgtggatctgaacccatttctgactcttgtattctgttggacagaggggaatttggtacaaccactttggaaaaccgttggctgggtgcagtggctcacatctgtaatcctagtattttggtgggcagaggcaggaggactgcttgagcccaggagttcaagagcagcctgggcaacatagtgagaccctgcctctacaaaaggaaggaaggaaggaagggagggagggagggagggagggaggggggagggaaagaaagagagaaagaaaagagaagaaagagagaaagaaaagaaagagaaagaaagaaaagaaaaaagaaaagaaaaggtcaggaaataaataaattagttgagcatggtggtgcatgcctatagtcccagctactggggaggccaaagtgggaggattgtgtgagcccaggagtttgaggctgcaatgagccaagatcatgcactccagtgtgggagacagtcaagtctcaaaaaacaaacaacgacaacaaacacataaaaagaaaaactttttggtcatttctattaacatggccatttgagtatcctatgacccaacaatgtcactcctgggtatacacccaggagaaatgaggatatatgccctagaatgtgcagcactattcatacttgctaaaagttggaaatttccaaaataccgtaatggataaatacactgtagaacatggaattttatgcagcaataagaaaggacaatatggagctacacacaggtgcatggatgaattttacaaactccatgctgaacccaagaagacagacacagaacagaacatggtgtataattcctgttatataaagtttaaaaaaaaatggtgcacacctgtagtcccaggtatcctgattcccagctactctggaggccaagacaggaggatggcttgagcccaggaattcgaggcttgcagtgagctacatgatctgtgctccagcccgggcgacagagtgagacccaatctcttcttttaaaaaattaaataagtaaataataacattaaaaaatgagcaacactgatcacctttagaagtcaaaggagtagtcgctttgagggtaaagggatacattctggaagcatctccatctgggtgacagtggcatgggtgtgctcactttttaagttttgttcattttgtaccttttcactgagctgcacgtgactgatttgtgcagttttgtgtgtgctgcctacttaaataaaaaatatttgtaggctgggcatggtggctcaagactataatcccagcactttgggaggccaaggtgggcagatcacctgaggccaggagttcgagaccagcctggccaacatggtaaaaccctgtctctacttaaaatgcaaaaattagccgggcatgctggtgcatgcctgtaatcccagctactcgggaggctgaggcaagagaatcacttgaatccaggaggcggaggttgcagtgagctgagatcatgccactgcactccaacctgggtgacagagtgagactctgtctcaaaaaaaaaaaaaaaaattcgtgatgctcctgaagtacagcccaagcagcaccacttgtcatgatgatttgtgattgttctctttgcacactttgaccatgaagcccctatacaacaaaatcagacatctttactggaggacaaagaacagtcctccaggatgccccaaaccgtgcctaggcagcagagaagctggctgtgtacagaactgccggcaaagtgttgtgaacattcagattcctgagccatcccacactctcttttatttattcagcatgtccctggggtatagccagttttggcaaccacagctctggaagggggcaaactcaccatctctttcttggcattctctagtgttatcaaaggaggtgctgttggcattttcggtgcaacacttgttgctcttcagggctgtcctgtgcattgcggattgtttagccttcttggcaaatgcccactaaatgtcagtagcatccctagtcatgtgataaccagacatacccacatacatttgcaaacacctcctctcacctgccatcaaggtgacagaagagtctacactttcctctcaccaaatggcatttccaaagtttgcctgactacgaagtttggtgtgctggggttctcctctccttcctaggaatcttctcaagtccttcaacccccaattgctcaatacctcttttccagaaagaacttaactcatttactataaagtgtggcagggctccatgtgcattatcttatagattcactttgcagacataacatttctgtagccaaaggaatgaatctctaacaccagaatcttacctatcacctagcaaatgggaatggatgggcaagaagtcattgcagcctcctcaaatgactgtagtaggtagttcctggacccccactaatacaaattactaatgttgaccaggtagaaagatttagaatgttattagcgttgcagacagaagcagtttaacagcaggcagccagaaaccagccccaaccattggttctaatctttaacacatctgccagctggaggtttaatttatcaatcagcagcagcattactatactggctttaagaatgttattcaattgaacggggctagcatctttgaaataaatgccccaaataaataactgcaaatcgcattcatttgactgctaaaacaattatcagcaaatctagtcatgttgagttgcaaaaatggatcggccaaaagacatttggtctctgccttctggtctggatacccatggggaatgagtatcaagatctttgggaggtggaggataaaaatgacaaagccaaatttgatcatccagacatctacgggtcatgatgtaggcacccaagagtgaattcagagacggaatgtggctgcgactttgggcattacattgcatagcagcatgtgctctgcaagcttccaaaaacgaatgaggcaaagcctaattctggacacagacctggtttcaaatcctagctctcgaaattcctagtagtgtgcatttggaaaggtgcttcccctctctcaacttcagcttcctcaataaaatgaagacaagactccttaccctacaggttgctataaggatgaattaagatcaagcagaggccaggtgtgatggctcatgaccataatcccagcactttgggaggctgaggtgggtgcatcacttgagcctaggagttcgagaccagcctgggcgacatggtgaaaccccatatctactaaaaatacaaaaattatcccggcatggtagcacacgcctgtagtcccagctactcagctactcaggaggctgaggtgggaggatcacctgaacctggaaggttgaggctgcagtgagctgtgatcatgtcactgcattctagcctaggtgatggggtgagaccctgtctcaaaaagaaaacagacaaacaaacaaacaaaaatcaagcagataagccctcagcataatgactagcatacatattatataagaattcatggtaagtagatttttaaaaaatcaccatagtcggccgggtgcggtggctcatgcctgtaatcccagctcttagggaggccgacgtgggcagatcacgaggtcaggagatcgagaccatcctggctaacacagtgaaaccctgtctctactaaaaatacaaaaaattagccgggcgaggtggtgggcgcctgtagtcccagctactcgggaggctgaggcaggagaatggcatgaacccgggagatggagcttgcagcgagccaagatcatgccactgcactccagcctgggcgacagagcgagactccgtctcaaaaaaaaaaaaaaattcaccatagtcaatcttccagacctgaaatttgtgaatatcactgactaagattgattaaatattaccttatttttaacttcttaaataaacattttattttggcataattttagatttacagaaagtttgaaaacgtagtacaagagagttatcattatgcccttcacccagcttcctctaatattgacttttttttttctttgagacaggctctcactctgttgtacaggctggagtgcagtggcacaatcacggctcactgcagcctcgacttcctgggttcaagcgatcctcccactgcagcctcctgagtagctgagtagctgagactacaggcatgtgctaccatgctccgataatttttgtatttttagtaggtatggggtatcaccatattgcccaggctggtctctaacttctgggctcaagcgatgcacccacctcggcctcccaaagtgccgggattatggtcatgaaccatcacacctggcctctgcttgatcttaattcatccctacagcaacctgtagggtaagaagccttgtcttcatccctagtagctgagaccacaggcacaaaacaccataccaaactaatttttttttctttttttttttctttttttgagacggagtcttgctgtctcccaggctggagtgcagtggcgcgatctcggctcactgcaggctccgccccccagggtttatgccattctcctgcctcagcctcccgcgtagctgggattacaggcgcccgccacctcgccgggctaatttttttttgtatttttagtagagacggggtttcaccgtgttagccaggatggtcttgatctcctgacctcgtgatcctcccgcctcggcctcccaaagtgctgggattacaggcgtgagccaccgcgcccagccccaaactaatttttaattttttgtagagacagggtctcactctgttgtccaggctggtctcaaactcctgggctcaagcaatcctcccaccttggcctcccaaagtgttgggattacaggtgggagccactgtgcccagcctcattttgtctccttagtctcctctgatctgtttcttcgtttctcacaaccttaataatgtctaggagtactgatcaagtactttgtagaacgtccctcaccttgggtttgtctgttttcatgattaaactggaataatggatttgagagaagaccattgcacagaggtgcagtgccgttctctttgcatcagatcagggtgtaagatagttacatgacttaccattagtgatgttaacctcgatcccttggttaaggtggtgtctgccaagtttctccaccatcaagctactgtttttcccaatacctactctaccttctgaacagtcactaaggcctacccacatgaagtggaggaagagggataaatatccccttctggactgggaagtatctatccgtattctttagaattctttcataaggaggccgggcacagtagctcatgcctataattccagaactttgggaggctgaagcaggcagatcacttgagctgaggagttcgagaccagcctgagcaacatagtaaaatcccatctctacaaaaaataacaaaaattagcggggcatggtggcactcgcctgtagtcccagctactctggagtctgagataggaggatttcttgagcccaggagttcaaggctgtagtgagctatgatcttgccactgtactccagcctcagtgacagaataagaccgtatttctgaagaaaaaaaaaaagttatatatgtaggcaatttggcaactaccataaaaacatacaagaactatcaggggataatgaaagtttgagggataacagatcatttacatagtgtcagagtatcttcccaaagacaactgttaattttaatggtcaaaacagtaacctgatagtggagcaccctggcagataagcaagtgacgggcaaatcacgtgcctcctagaatgacataccaagaaggctgcaacatcgcttctaggaacttctgccaaaaatgcatgatttgaataattggtaaacaaccatgttcagattaaggggcactttatacaataagtattctttggaagtgttaatgtcgtgaagcccagataaagacagaacaactggtccagagtaaaggaaatgtgactgaccaaattcaacaagtgagccaggacctccttttgctacaaaggacgctattggaacaattggtgacatctgaataagatctgtagattacataataacagtgttcatatgctaatttcctaattttgatcattgtgctgtgcttatgtaagagaatgccctgttttgggaaacacactgaattatatagggttaaagggccatgatatctacaaattactctcagtggtcaacggttggggtaaggagagaaagagagagagagaggataaagtaaagtgtaagtggtaaaatgttaacatttgagaaacctggataagtgatataggcgacttctttgtaccagtcttacaactttttggtaaatctgaaatttcaacaaaataaaaagttaaaataaatgagtggctacaaaaattgcagaggcacaaggttcattcattctcctgactgtatggaacatctgccatgtgcccagtaattttgccagcacagaacaaggcagacagaatttcccgttgtcgtggag

SEQ ID NO: 572 - DNA, 37814 bp, Homo sapiens
caaagatactgcaccatggccaaaagtgatttattcctagaatgtaaggatggtttaacatacaaaaatcgatgcagtattctacattaacagaaggaaagagaaaaactgaatgatcattttaattgatgcagaaaaagcattaaattcagcactctttcatgataaaaaacaaacagactaggaatagaaggatactgcctcaacttaataaaaggcatatatgaaaaacccgcaccaaacatcatgctcaattctgaaagacagaaagcttttcatctaagatcaggtataagatgaggatgctggctttcactactgctattaaacatagtactggaagtacaagccagagcaattaggcaagaaaaagaaatataaggcagccagattagaaaggaagaagtgaaattatctctgtttgcaaatgacaggtcttatacgtagaaaaccctaaagatatcatttttaaaactattagaattaatacattcagcaaaaattgcaagagacaaagcacataaagtcagttgtatttctatacactaatgatgaacagtctaaaaggaaattaagaaaacaattcaatttataatataaaaaagaataaaatacttaagaattaactaaatggatgaaagatgcatacaatgtaaaccataaaacagacaaatggaaagctatcccttgttaatggattggaggacaatattattaagatgtcagtattacccaaagtagatatgcagattcaatgtaatacctatcaaaatctcagaaaagcagaaataaatccatcctaaaatttgtatgtaatttcaaggaaccccaaaagccaaaagagtcttgaaaaagaacaaagttggagcactaatacttcctgatttcaaaacttactataaagctaaaataatttaaactatgtggtactgcataaagacagctttataaaccaatggaatcaaatttagaggtcataaataaactctcacatatatggtcaaatgatttttcacaagggttttatgaaactccgaggggaaaggatatcatctttcaacaaatggttctgggaaaactggatatccacatgcaaatgaattaggttggacccttacctcgcaccatattcaaaaataaaatggatcaaagatgtaaatgtaagaactaaaactatgaactcttataaggaaacagagcaatagctttgccacattggatttgacaataatttcttagatatgacagcaaaagcacatgcaaaagtaaacaaattggactgcacaaatattaagtactgttgcattttaaatacttttgctcactagacattatcagcagaatgaaaaggcaacctatgaaatgggagaaaatattcgcaaatgatatatctaatgttcataggtatccaaggtattaatatccataacaaatagagaccttctaaactcaacaacaattataaaaacaaacactccaattcaaaaaatggacaaacaacttgattagacatttctccgaaaatacatgaattgccaggaaacatatgaaaagatgctaactatcactaattattagagacatgcaaatcaaaaccactatgagataccaccctcattaggaagattactattaagacaaaataaatattggcaaggatgtggataaattgaaacccttatgcactgttagtgggaatgtaaaatggtacaactgctatggaaaacagtatggcaattcctcaaaaaattaaaaattgaattaccatatgatccagcaatcccatttccgagcatatacccaaaataatcacaagcaggatcttgaaaaaaatatttgtacagtcatgttcatagaagcattcttcacaattgctaaaatgttgaagcaacccaagtgaccattgacagatgaatggataagcaaatgtagtatatatgcacaatggaatattattcagccttttaaaggaaggaaattctaacatatgctacaatgggatgaacctttgaagacattacgctaggtaaaataataataaagccatgtatgaaaaacccacagcaaacatcatattcaatagtgaaggactgaaagcttttcatctaaaatcaggtacaaagcaaggatgcctgctttcactactgctattaaacataatactggaagtcctagccagagcaattaggcaagaaaaagtcataaaaacacaatattgtgtcattccacttatataaagtgcccagaacagtcaaaatcttagagacagaaagtagaatcgtgttttccagagcctgttaaggcaggggaaatgagaggttattgtttaatgggtacaaggtgtcagttttaaaaaataaagtgttctggagatggatggtaatgatgtttgcatagcagtgtgaatgtgtttaatatcatggtaatgtacacttaaaaatggttaagataataagttttatgataggtgtttttttaccacaataaaaagttttagacaaaaaaaggaatgaagtactgatagatgctacaacattgatgaaccttgaaaacataaatattatgttatgaaagaagccagacacaaaagatcacatattgtataattccattaatatgaaatgtccagaataggtaaatctatagagattgaaaatgaactagtgtttgcctagggctggaacaaaggagttgttgagaggaaatgggtgtgtgaccactaaaagttgaattgtatggtattagtatatgaattatatgtcaacaaaaaagatgttacaagaagtattaatggaatggtgggcaaaccataactgtggagttgaacatgtaagaaaaatgggttttccaggactgattgatatatggctcatatctcctatgtttaactagcctgtagaagattttaatttctggccaatttccccatcaataacatagagatcataatatttgccttatttttgtgaagattaagtgagttaatccatgtacttagcccagtgcctgatgcatacaaagtgcttaacagggactattacattacatagttttccaaaaggatgaaagtaggttctagagtatctttattgatattccaaaatgaaaataataaaatttttaaaattatgtgtggaattctgtaagaaaaatagttgctacattatcaaacattttttaacttatgaaaggtttagatattaatgtatcaatttcaaataaatgttaaatattacaattatagaaaccttgtgcgatataactgagcattaaaggtgaaatggatagtgtaaaaatcataataacatccccacttaaatggaagtcagagttccagttatctcaaccacctaaaaccaagctgtaaacaaaaacaagtgtaaaagatgtgaaagcaataatgcaaagctaatacagtttgtgaactaagcttgagccatttttaggacagtctttcacagtcctttcacttactttagtctcataaacccaggtctctgaattcccagcccagaaattaggacgtgataatttcaaaaaagaaaaacagttgtgttgttaaaagtaggtactctgacaccagaaaaaaaaaatgcttttaaagaactcacagctcagcagaaatatgcttaactatcccaaagacagtataagtttcagtggaaactttcgttcacagatcaggattgtgttagttttcacggtatgtttgtggtatttcagaggctaccatgcacagtgaggaatagatttcatcttatgccataccccatcttgcttttgttttttagcagtctggctctgtcacccaagctggagtgctgtggcacagtcatggctcactgaaacctctgcctcctgagttcaagtgattctcaaaggttgacagactgacatgcagaaaacaaaaaataaaaagaatgaaaagcaaagacgacctagactaaaagaaaatttttttgtctcttctaacggcaagcagagacaaacattaaattgcaatatcgtacaatcattcaccatctgtaattcacaatctatagtgacaatcttgagcttctaaaaaaggttgatttcactattacctctttagtaaggcagagcactattagttttcaataatttcattcaatttagcctgttgagctccttaacttctgggcccactgggaggtgaataattcataacttctacatgaaagagctcacagactgaaaaagaaaataggcttaaacaaagggagcacagtgtgacacacaaggtacagatttagcttgaaaaatggaggaattaattaggaggagagtgacaataaaatgatttctacaaagtgttgacatcagagctgacatttttttttttggcgggagggagacctgagttttattattactcaaatcagtctccccaagcgttcagggatcagagtttttaaggacaatttggtgggtgggggtaagccagtgagccaggaatgctgattggttaggtcagagatgtaatcatagggagtcgaaggtgtctccttgcactgagttcctgggtgggggccacaagatcagatgagccagtttattgatctgagtggtgccagctgatccatcaagtgcagggtctgcaaaatgtctcaggtactgatcttaagggcagtgtatccttaaatattgtagcctctagctgcatgattcctaaaccataatttctaatcctgtggctaatgttagtcctacaaaggcagtctagcgcccaggcaagaaggaaatttgttttgggaaagggataaactataaactaagttcctcccaaagttagttcagcctatgcccaggaatgaacaaggacagcttggaggttagaaacaaggtggagtcggttaggtcacatccctttcactgtctcagttacaattttgcaatggcagtttcaatccctccctttgggttttataacatgttaatcttaatgtgttggctagtgaagaccattctaacttcttcctgctgatcaggggcatagtggtggtaggtgttgacccaagaagagaggagtggaaccactttgcaactgtctgagcatactcatgcagacctggctgtggttccaaggcttgcatggcaaaggcattagtattgtcatctatagttttagtaccacatttaaaggaacagtgtactataaagtaaatactgagtactagggtaagtagtgcaatgcccagttttaaaagtaaacatttgcaagataatgtttagggctaactatgacgtgaaccccaaaattcctgtcctctggagaccaaaagaaagtatttccacatggtcacaaggttaagctcttaaggatacaaaactaaatagagaaaattcatctggtattggtttcacggacctgcagcaaagtttgtacctcaccagcctgccaggctggcttgaaaagcaggcttgtaggtgtcctaaacccatgttctatcctgtgatatccctctctccattatataaagacaaatttttagcacaaagtgtaccagatttgctacagcctaagactagcctcacaaatccttttttttttaaatatattaatcaaacccttgcagaggagacaaccagttacacttacacttacaaacacacccacaaacagactcacacagagagaccagaaactcgtgtggtaagaatttcttaccctttctgccggcatactaggttttcaggttccctttctctgcagcttccataagaatggagcagtttttgatgaccctgcttgctgtgccatagctgtgagggtcaagccacttaaaaaaagaaaatcatccttttctgttttatgaagccataggcaaaagattctcagttttgcaagatgctgcccaatggtctgcatggggaaccgaattaacatttttcatcccagcaaaatacatacaacaaaacagacactagtcaccttgttcagcacccaatatcaacctgacaaagctcaaactttctcctgttggtccctgttgtctttgatccactccagatgggaagggatcacctccagatggtaattcacattgggatctctggtcaaggtgaagagcgaatagccaccctgagacaggcctgttgagctttctttagggatcaccaaatgtgaccagataaataagggggggttctgagttaagtctgctggacttccataagcaatttcttcagaggtccccttcacatatacaaaaacacacaaagatgagacagacagaaggattccaaatctgatccctaaccaacaactccaagagtatcccttccaaactatcctcctattctccatctgagaaatctccctgaaatcttcctgatggagaagtctccttaaccaagactcttcctactagttagggagagccaactgagacccccccaggagctgaactgagacagacaccccacagtggggctatatccaaaccaagacccccaaaggagctgaactgagacagacaccccatggtagagctacagacaccctgcattggggctatggacagacaccccaccatggggctacaagaccagttgggagaaggaagaaggtgtttgcagctcctaggatactcaccaacccagacaccccacaatggggctgcagacagacaccctaccatacatagggctacagacaccccaccatggggctacagagagacaccctgtgatagggctactgttatgagatgtctccccagaactatttctctcttgcaattaaatccattcatattatgaaatgggagagttccctgaccccctccctcgtggaacttgtgacaggggtgcagctcatttgctcagccactgcgctcaaataccttacaggatggggagcatgcagacaggcaggtgcaggagccagggcgagcacgtttggtctcaggactcacagtagcatctcggggtgtgttacaattaatgctcttttagcagttgccatccacagacagctaagtgttacaccagctcagtggagtcagggtgacagccttttacaccctgccctcttggtatccgggtccttgtcccatatccaggaagaatcaggtcacatggacttaaaggatggtgaatgcagggattttactgagtgatggaggtggttctcagagggataggtgggaagctggaaagggaatagagtgataagatgatctttccctgaagttcagccatcccatctcctctctgaccatccccagccgaactcctctcaacgttcagatgctccttctcttctcttctcttcttctctgctgctccactctgctgctcttctgattgtggatcccggggtttgggctttttatgggtacaggataggggcatggtgagcaagagtggtcttggaaaaggcaacactgggatgtgaaaacaggaatgcctgttcccatttagagccgtgggtttccaggcttgagggtggggccttttctggggaactgctctcttctacccgctatttccttgcctcctgtccatatcagttgggttggcagcaccccaccagtagagagagtaccagagtcagcccccagtccaagagaactaggcccacttgggctgacctctggatccatcgctggaggcggataccaaaccacaggcaggtagcaacaagggcaatcccagaggagcccccaaatttgtaactgcccagtaggttcaccttgcccactgcctagacagagcctgatttatcaagacaggagaattccaatagagaaagagtaattcacacagagccggctgtatgggagactggagttttattatcactcaaatcagcctcccagagctgagttttgaagaataaaaagaattgtgcaaaaaggataaggcattgtacatagagatgatagcatttgccaagacatagaggcatcaactagttaactccaggatctttaggtaattcagaattgctggctcaaaacatgcaagatggggccaggcacagtggctcacacctgtaatcccagcactttgggacattgaggtaggcggattacttgaggccaggaattcaagaccagcttggccaacatggcaaaaccccatctctactaaaaatacagaaacaaaacaaaacaaaaaaatagccaggcatggtggagcacacctgtaatcccagctacttgggaagctgaggcatgagaatcacttgaacccaggaggcaggaggctacagtgagtcatgatcatgccactgcactccagcccaggcaacagagcaagactgtctaaaaaaaaaaaaaaggcaagatgaggtatggcgtaacatgaaatctattttttattgcccatggcagcctctgaaatactacaaacatactgtgaaagctaatgcaattctgatctgtgaacaaaagtttccattaaaactaatactaaccttgggctagttaagcatatttctgctaaactgtgagttctttaaaagcagcaatggcattttaggcatttctgtacacttagtagtatatatatttaagtctttaatgaatatttattgagttcacattactgaactcatgaactaataatttgtgagtaacttacgtgctttatgctattaagttcatcactttttctgatacttaatcacgaaaatggaagttactgaagaaattagtgtttttgatcagggaagagagaggaataaatttctaaaatggggcattttgggaaagtgcagaactctagtaaattaggataatcagaggcaccatgaaaacacagaacttgcatgtaggtgaggaaggaatgatgaggggatgttaatgacatactttgcaattttatagaatacagcagttctaggtaccctctccctctccctacacattccatttaatgtcttcttccttctcccctctaaagtgggtaccctctggctatcgataactatacaagggaagaaaattaagaacatgtaagaacagggtgatttagcaagaagtaggtacatgaagcaaaggaagctggttcttattcaaggacttttcctttgatgggctttatgctttttaaactctgacgatactagatatcaatagatgactgtatttcaactataggcattgaaaaatgtatttagaatttatgactcatcaaggactatgagattttacaaatataagatcaatatatgtaaacagtgccatgtgtcttccctctccactgtttaatactagttacgtgtataaattttaaatgtgcatagtctgaaatatgatcccggaaatagataatacttcccaattatctgtcatcatttactatactatgtatagaaataaataagtaaacaatatgaggaagagaacagtataaagttgggcaactctctacattttgaataaatgatttcacttagaaaagcaatatttatttaatgtaggtaaccaagaagaaaatttaaataagttgagtgccaggaattgagaacatgtgaccatgcacatctcctataaaactgttcaaagtaacacactttataaaaaatgtttagattctacatagattcatgaaattttaaatcacttaaaaatagttattcagaacatatgtgcaaaacactgtttttatatatttggaatatatcagcaaactaatatattccttaggagtcaattacttcaaccacctagaacccagttgcaaaaaaaaagtacaaatgtcttgaaaacaataatatgaagccattaaaaagttttgtgagttaagtttgagcaatttttgtgaaaatctctcacagtcctttgatttactttattctaataagctcagatctctgaatttctagtccagaaagtagaatgtgataacttgaaaggaagggaaagaaaagaggtgagatgttttaagtagattactttttgaattttacacctgtacatgctattgttaatgcacattcatttatagaacacaaagactttataattgtaatgtttaacacacatatatttgaaatgggtacattgacattgagatattttgtaaattaaaaaactgatcatgtgagaaatattttctttaaggaatcaaaaattctcttcaatggagagagaggacaataaataataaacatactaagtcatatgatagaagttgacaaacaatatgcaaaacataaagcaaaatagaatcagaagtgtcagggtgtgttctggtagtgagattgaacttttaaatattgtagtcaggttaaaggttattgaggtaacagttgagactttcattatagttatatgcagatttcacatataataaaatctacctatatacaaatatatagagagacatatatgtgtctatatgtgtattatatatcagatatatcacatatctggataccattataatgaaaatatgcctaactatcaaaaaactcaagaccttctttttgttattcgctctcatgtgtcacaccaaaggctggagaccttaagtttgcctttaaccctcagcagcaggacaaaaccacttctagcttgtattccagaaatacatttcttaaaacaagtgctctaaggaaaaaagcatttgcaatgtaattattttcatttgtttagtagatttttacagccttatttcatgtgttcagcacctttgagcatatgtccatttgccataaggcaaaagtttaaagggatttcctgcagtgatgcttttgttttctcagtatgtgattagaagtcttgtgatcgaccttaactgaagaaggatttaataggaataaattatggaaaagaaacgaaatgaatcagaatttagcttttgagaaatcaacaaacataatttactttttaaattatcaataagaaaaccctctgtttataagtggtgcctcattggctaataattactccttgaaaatatctacccatatcattgaatctaagtgccatttactaagatgtcctatagttttagcttttctcagtgcagattaatagcagaagctgtacttcatccagacaaaaatatttaacatcaaaagcaaaaattaagaaataaggaagctaaacaccaagcctccatttaaggtatataaatagtattgatgattagcgataagaataatcatcttctgctcatgtgccgtgctaaagcaaagaataactgactcacatacacaaggaaaatgctctttaatttgctctgttgttataaaagttcttttaagtctctcatattcatattcacttatattctgtactgttaatatcacttcacagaaagactaaaagtacattttggtttattaacagtaatagacatagttataaaatttgcctgtggttaaatttatactcaacttattctcaaacagatctgaggctgcttgcagtaacattgatgtgaatggtaaatacagacgaagaggaagtcaatatgctaaccctaagtttgctcagtttctgaagatacctttatggcaaaaagccaggcagtaaacggatccagcaaaagtgccaacacccttcattgggaaaacttcctctcttgaacctttaaatcaggatagtgcttttttatttgacacctatgatggtgtagagcttcaggttttaagcagccagttttaaaaagaaaatacagtactacaatacctagctcttgcacgaggaagaagaaatcacgagtgttcctcaggaaaaacttgttatcctcgcattaatttttaaagtaatttctcaggtggcatttttattaggggtagtgagtgatgtaagtgacagggccttcagtagcatttttacagcaaagtccagacacgttcctaatggttgtttcctacaatgaccttaaacttttttaaaagcataactgtaaatctcagtaaagatgattctgcattgtcacattttcttggtaatagtttgacaaactacacttcaaaaaccacatgcttttaaaaattgggatttttttaaatttgaattcttccaaatattttatcttcacctttgcctcttgaataccgcatgtcttgtagtgacaatccaaaagcagtggtggctacatatttttcttctctggccttggcacatttcttaagctaattacaaaacttagatatgcaagagtacctttggcattagcaaataatgagcacatcttgtctctggatccagatgcaaagagagactatctcccaagattacggattgccacaattgagaggttcatgtcagcaaccagaatactctcaaaaatgtaaatcagattatatcctttcatgactttccaatgctattagaataaaatacaaactccttaccttacttccaaggtcctacataatcaggccccttctcaccctgtgatctcacctcctaccactttccagttcattcattatgcaccaatcatcctagccatgtttcttcctcaagtataacaaggtctttcccatgtttgatacttcctcctgcctggaacgatcttctgcagatattttcatagctggctccttcctatcgttcagatgagagtggatatttttatcttgttcctgatcttaggggggacaaaatgcccagtttctcatcattcactatgattttaggtgtagcgtttttgtagatgctctttagaaagtttgagcaaattcccctttattcctcgtttgctgagagattttgtcatgaatgagtattgggttttgtcaaatgctttttctacatcattaaaatgatcacattattttttcttctttagcctgtggatgtcattgattacatttattgattttgaaatgttgaactaccttgcctacctggaataaatctcatttcgtagtggcatatcatcctttttgtacattggtggatttgattcactaatcttgttgaggagttttgcatcaatgttcatgagagatcagagtctgtagtttttctttcttataatgtctgtttttggcattaggataatgatgtccttatagaatgagtcaggaagtgttccctttgcttctattttctagaagagattgtggagaattggtatcatttcttgcttaaatatttggtacatttcaccagtgaaacaatctgggcttagtgctttctttcttggaaggttattaattagtgacactattttttttaatagatataggtctattcagattgtttttcaaggaggtagtgcattttatctaagttatcaaatctgtgtgcatagagctgttcatattacttctttattatcctaaaacattcatgggatcaatagtcatgattcctctctcatttctgatactggtaatttgtgttttctctcttttgtccttggttggtttggcttgaagtttattgattttattgatcttttcaaagaaccagctgtttggtgtcattgattttctctattgttttcctgttatcaatttcgttgatttctcctctaatttttatgtttcttttcttctgcttcctttaggtttaaactgaccttcttaggccgggtgcggtggctcacacctataatcccagcactttgggaggccgaggcaggcggaccatgaggtcaagagatcaagaccatcttggccaacatcatgaaacctcatctctactaaaaatacaaaaattagctgggcatggtggtgcacgcctgtagtcccagctacttgggaggctgagacaggagaactgcttgaacccaggaggcagagattgtagtgaggtgagatggcaccactgcactccagcctggtgacaaagcaagactctgtctcaaaaaaaaattaataagtaaataaattgcccttcttcatttagcttcctaaaatgaaatcttagattactggctttgaatatttcttctttgctaataaacagtcatccctccatatacccatgggttctgcatctgcagattcagccaaatgcaggtcaaaaatgtttgaaaaagtaaaaccaataaaaataatacaaattaaataccaatgctctataacaactatttacatagcatttacagtgtattagatattataagtaatctagagatgatttaaagtttacagaagaatgtatgtaggttatatgcaaatatgacaccattttataaaaggaacttgaacatctgcagattttggtctctgcaggaggccctggaaccaatccccatggatactgagaaatgaccatgtgtacttaatgttataaatttccctctaaacattgcttttgttgcatcccacgaattttgataagttgcattttcatttattttgaatattttctaatttatcttgagactttgacacatgttatttagaagtattttgcttaatctccaaatatttggagactttcgagcaatctttttgttacttatttctagtttaattcctgtatagtctgtgaacataacttgtgtaatctctatactcttaaaagttgtttttggtttatttttttgagacagagtcttgctctgtcacctaggctggagtacagtgatgcaatcttggctcactgcaacctctgcctcccaggttcaagaaattctcctgccttagcctcccgagtagctggaattacaggtacccaccatcacacccagataatttttgaaattttagtagagacaaggtttcgccatgatggccagattggtctcgaactcctgacctcaggtgatccacccgcctcagcctcccaaaatgctgggattacaatgtaggaatgagccacggtgcctggcctgtaaagttgtattttgtagctcaaatgtaacctattttaatacatatctattcaagcttgagaagaatgtgtattctgccattgtggaagtattctataaatttcaattacatcaagttcatctagatcaaattgatagtactattcaggtcaactatatccttactgactttctgcctgtttgacttatgaattacttactgaaaggtgttgaagtttgtaactgttacagtatatttgcctatatgtctcacgtaatttaaccctttgttgttagatgcatgctaaggattcttatatcttcttggagaattgatttccttattatgtaatgcctctctatcttgatcattttccttgttctgaattttgtattgtctgaaatcaatatagctacttcatctttcttttgttaagtgttagcatagtatatctttttccatccctttaatctatatatgtcttcatatttaaagtgggctttttgtaacattgttacttttttcatatctttttctgccttgtcttgtttttgaacattttatactatccattttatctcctctcctctttttgaaaaaagttagttgctccagagtttgcaatatatatttttaacaaacttaaaactaactgaaaactaacttcaaataacagtatactgtttcacatgtagtgcaggtacctaataacagagttgtcccagttcttactttctgacccttatgacatcattgtcatccactccacttatccatatgctagatattgtttctattattactttaaacagtttaaagtttagtgttaagaataagaaaaataaaatattttatcttcatttattccttctctaacattccttttttaaatataaaactaagtttctgacctatgtcattttccttctccctgaagaacttcttttaatatttcttacagggtagatctgcttgcaatgaattccttcagtttttgtttttctgagaaagtaatttttcttcacttgtgagagataatttcactggatgtagaattataggttacagggctttttttttcttttacaatgctttaaatatctcactctattttattcttttttgtatggtttctgacaagaaatctgctgcaattcttgtccttaatctcccatctggtggctttcaatatatttttgcctttggttttttgaaatttgaatatgatatgccctggtgtagatttttcgtaattatcctgcttggtgttctctgagctttctggatctgttgtttcctgtctataattaattctgaaatgttcttgtgccattattaattcaaatgtttcttctgtcccattcactccttcttctcttttggtatttcaacaatgtgtatgttacatcttttgaaattgttccacagttcttgggtgttctgttccttttttaaattcacttatctgttttatttcagttagggagttttctgtttccctatcttctagcttagtggattttttcttctgttatgccatgtgtactgatgatcccatcaaaggcattcttcacatttaagatagtgtctctgatttttagcatttccctttgattcttagagtttccatttctctgcttacattccccttctgttcatgcctattgtctatatttttccactagaacccttaaatattaaccataacttcctggtttgataattccaatgtctgtgtcatatctgagtttgattcttatgcttgctttatctcttcagactgtttttgtttgtcttttagcatatcttgtaaatttttgttgaaagctagacatgatcagatactaggaactgaggtaaataggccttaagtgtgaggttttgttttaatatggctaggaggtgggttgtatttgatgtttgctgaagttgcacatgccataagcttccaatttctctagtatccgttttccttcctatagtatttgggcctccctgtattagtcagtgttcaccaaagggacaggactaataggatagatgtatatatgaaagttagtttattaaagagtcttggctcacacaatcacaaggtgaagtcccacaacaggccatctgcaaactgaggagcaaggaagccagttcgagtcccaaaacctcaaaagcagggaagccaatatcagccttcagtctgtggccgaaggcctaagagcccctggcaaaccaatggtgtaggtccaagaatccaaaagctgaagaacttggagtctgatgttcgagggcaggaagcatccagcatgggagaaagatgaaggctggaagactcagccagtctggtctttccaccttcttctgcctgcttttattctagctgcgatggcagctgattagattgtgcccacccagattgagtgtgggtctgcctctcccagtcctctgactccagtgttaatttcctttggctgcagcctcacagatacacctaggatcaatactttgcatccttcagtccaatcaagttgacactcaatattaactatcacacttcctaaggactcctcttcaagagagtctgtgtttttcagctccttcagctataattcagttatgacaatagagcccgattgatatgggggtgaagtatgaagagaatcattcattctagaatcttatgattaaatttcaattttttagttggcctgtgtccctgggctgtgacttttacaagtgtttcttaggttctccctccatcccagtaggtgaaacagaagggctcaagaggaagctagagttgaagaaactgtccttcccctacagaggataaggccgtgataatgtatttttccctggagagtaggcctttgttatgagaatgttctaggcctacttttataatggttactttccccctctatctacagaacattttcatgtctcccaactgaaactatgcacactaaacacaaatttcccattttcccttcccttcagctcctggaaaccaccatcctgcctcctaacaatggagtcttttgcatttgccataatgtttttgaggtttctccacgttatggtatgtatcagtatttcattcctttttatcacagaatagaattcattgtatgaatataccacattttatttatctactcagtagctgatagacatttgggttgtttctacctttgactattataaatattattgctataagaatgtgcatacaagtctttgtgtcaacctatgtgtttatttatattggttagatttctgtgcatagaattgttggtttgtacgtaatttttaagaagctaacaatctgttttcaaaagtagctgtactgtgttatgttcccatcagcaatgtatgagaattccagtttctctacagctgttaatacttggtattttctgctttttttgtaacaaccattctagtgaatgtatactgctatctcattggcattaatttgcttttcccgaatgacaaatactgttaagaacttttcatattcagattgaacacctcttatccaaaatgctaggaacctaagtattttggatttttatttttctcaggttttaaaatgtttgcagaatacataccacataagtattcctaatccaaaaatctgaaatccaaaatgctccaatgagcatttccttttcatacaattgttgctgggcagaatgagtgggggaacattacagatgtggaagtccaattctcttaccatctgcttggagtttttttccaaagaagtttttttctttatggccctaggatctgtctcatcctcatatatgagttctggactgttgctggggaaaatcacagctctgtatatttttggttttctgtggggacagtgaaaccagcttgcttctgtactgccactttaaaaccagatgtctgccaaaaaatttttattttaatggtaataattagcataaaatttgcttttaggaccattgtaagccacaaagataactatagtagcacaatttgtaaatggggttgatagggagtggcacataaacagaaatcctaaaggctgaacatgtaaaatcacaactacttttatgcctgtctttatctggtctaacatggcagtaaaccaaatatgttttgacaaagtgacagcaaactgttataatgattgccactcccttttttcttctttttgaggaagcaggaaaatgcagagcagaacaaatagttctgtttcagactctacccctttccctggttccaggctaaacaatacccaggtaacaagcataaataaataacatcacaaagaattacacaatacccaagctggcgcaatttaaagaaaaaaaaaagatgacatgaaaattgtagagaaattttgtcaagataatgtgctaatagggtaaggagtgagtgaaaggacagaggagtcaaagataacttatggcttttagcttgtgcaaatgaaagaacggcagtttactgagatccaagagaaccagcgtgggtgaccagaactcgataagttgttttttgactatgttatgattaattaagcaatcaagtaaatatggaactaggtagttgaatatgtaagtttagaattcagataataaagcactagatatatataaatttgaaagtgatcagcgtagacatggttcataaagccatggggcagggggaagacagagaggaaatgtagatgagaagaaaaaaaaaaagagattggagaacttagcttcaggattacaccttaggttacacttaagtttagctgtcaggaagaagaggaagaaccagcaaaggagatccaggagtaaccagtgaggtaaagaaaaagaaccagaaagaggtatgttccagaagccataggaagaacatgtttcaataaaaaatgctcagctatatcaaacctgctgttgacaggtgaaatacaaagaggattaggaatcactgttttgacagtagtttaagtggaatgatggggattctaaactaaataggagaacagaaagtagacagcagtactgacagttcttttcaaggagttttactctaaaggggaaaaaagaaatggggcaggaggtagaatggcacaggaattcaagtagaggaggatttatcatgaagctaatgaagtctaagtttcagggcttctcacctgtgcaggccacttctatggccctgggaggggtcctaacaatgtatttatgtgatatgtgaaaataagtttttaaaaaaatttccaaaagtaaaacattttaactaaaataagccattttctccttccattccaacttctgtccatcaaacattccctctttggttggctgcagacacttctggattctgactaaatgagagttaaattagtaatatatttaatttgcatttatgttttgttttaattttgaacaaaacattattttcaagtataacaaaaataattaaattgaattaaaaattattttcctttttctcttaaatcctgaagaactggaatgacaaaatatgacccattcaagtctaaagcactatgaaaagtaccaagaattatacatttctagtcattaatttatgaagtaatatagttatttttggctgtagtctacttgtttttttcattttttgaagaaatacataatcaatgtgaagcaaaatagacttgagaaagaattgaaacgacaaaaaaaaaagaaacgctatgagataggaagatgaatcagcaaaatatgcactcttttacagtagattcctactatatccaagaacaaaacctccttattacacagggtaaaacagaattcaaaaggacattgtatttctattggaattctttagacttttctgaaatgtcaagacagccataatttgattaatattaatctgaaacagcagcaagtcaccatgtctgaaaaatattgtatggacactacaacataactacatcttgatgcacactaaatagtaatgtatgtgaaacttctctttatttcccaagaccccctaaatgattttatgtaagctgctagattttcatacaaccctttcctagtctaatatacaaatatatggtcattcagtctctcctagaagaatgtgaatgacacagaatctgccactctaatggggaggccatattttttggtttattctgcttcataatacagcaaggacctccctgactacaaacatggatcagagcctctcatcttggaaatattgcccccaagttcacttttattttcgtttttgctctttgctctcatccttcctcaacgattctccacacttctcacttttcattctctacacatctacacataattcttttttttttttttttggcattaacaaaaggcatttaaaagagcataaagtgaatgtccctccctaccagtgggcatcagagagaaaatgtgttcctgggatcacaattgccacaatagtttcaagtctattaagacacttgcatagctgacaaatcccagttaaatgaattttgaaattacctccaccttacttgtggtgggcttcttttcaaagggacaccagatactgccatctgtatgatacatgtggattctcaacagtcttaatcaacttgttgcttttgatgtcccctccttcttcaggaccaaatagatgcattcttgaaacaattttaaaccaagaactgactttttcccatttttagaatgtactcattataaaacaaggctatttttgcggtagtcagacaaaggcacagcctccttcttttagatgtattttttaaacacttcatgtttttaataaggagaaaatgaaatctatatttcaacactattggaatatatataggcaacatgggtggaatggctattccttgccttattatgccatggaataaaaatactcctactcattttccctctttaaataatgtaaagttatgtatagataattcaacacaaaactacttgccaactcaaaaaagattttacaaaagatataatatcttaatatgtggtgttttattcatatattttgcagagctgctcaattaattgaagtttatattgggggattaatcagacataaggaagaaataaaaaacttacaatgaagggaggcaattattaaattgcttctgctcagcagaaaatgttttcttcaggatctcaaccatgaatacctaaattctgggcagggaaagcaggagtataatagaaatactaatcaaaattcacaggacgttcacactgctttttcttttaaaaaatgttgtatttgatacatacaaaagaatatattggcatataaatttaaaagtataaaataataaaacttacctatcaaattaaaaacattaccaatgttcatgacctacctattccatctccctgtcttaccaaaaaaggtaaccactatcacaaattttaagtatattattacatgcctttaaagaaaaagttttatccattatgtgtgttattcttaaccaatatgttgtttgatttacatacttgattttgagctttatttttgaaatggtacaatacaacatagacggctacttgtttttttctcaacagtttaattattctctaaaatttataaatgctactgtatgcaattatattcatttgttttttgccactgtataacattccgctatcacaaaataccaaattttttctattcattttcctgtctattgactaaatgagagttaaattagtaatatatttaatttgcatttatgttttgttttaattttcctgtctattgacaggaaaatgaatatttgggttttttcaaggctcgtatgttttcatttaaattttttctttcataattgagattttattcaatcagtacatagccattatggataatttgtaaacaagtcctaatgtaagttttctaaagtattaattattccattcttttctaaacagtaattgtagtgactttccaacttaaagctagaggcaaactttccttaagaaaatatatcaggccctagtaatttcaaatattgataaactgttaggtttaaagccccactaattaacaatttagtatcatactgctatacttcaaaatttccaaactttaacaattctgatatatggagagccaaaatgagggagcagttttctttaggagcaattctatttgtttttaaagcaagaacatggagataggctttaagtaatttaaaatattcagagatattagtggataattgtgactgctaatggccattttgttaaattcataagatacaaaaactgcccttcctagcagccaatacagttaacacccaagactgtcaaatcctcccttatgttgacatcttcacattttaggttgtacagaaaaattacaggcatatcatttctttttttaaagaaagtacatacatgcaggtgtgcactcacacatgcacacttgtgcacacacacaacttccttctaaaatatgtgtttttagagctatttaaacaatcttttatttacaacataggtaataaaaatatttatccagattataatgaagaagatacaggaaccataagacttggtaactatattaatcagatttgattttttttctctccttaattaaagactagaccctcctcagttttagtttctctactttctgcaggaaagttgtctttagtttcttagatggccatttcagcctgtttgccttttgctccccattttcctttgcagttttttggctgaagatttatcctttcttcctccctttttggcttagtttcaatttttgtaggaagtggctaggaaccttgccgaactattcaagagctcctccttaactctcacttagctaatgtgatcatcatctttagtttcctggcagtgttttgtggtggggagcacagatgcactgtgcaacccttcacaaagccaggttgcattgttgctgtatctaagtacctcgcataagcccaatttatatactcttcatgtatagtattttaaaatataaaccacagaataaataatcattattaattagtaaagctaatgactgtttggtgctgtggtttcaatgttccctccaaaacccatattgaaacttaatccccaatgtggcagttattgagagatggggcctgcactcatgaaaaaatgtgtccattaacagattaatgagttatcatgggaggggaaatggtggctttataataaaagagagatctaagttagcacattatcatgctcagtcctcttgccatgtgataccccacactgccttggaactctgaactctgaactctgtagagttcccactggaaagaaggctttcaccacatgcagtcaaccttggacttcccagcctccagaatggtaagaaataaatcccttttctttataaattacccagttttaggtattctgttataaacaaaagaaactggactcagacatctggatttatctaaatgcttatccttttatctcatcctcacttcttgtatgtgagaccttcctattagggtcttgttcatttctcctggataatccattgctggcatggactttttccatttttaaaatctgtgactgtttttattctagttcttaacagatcactcttctgggtacacaattttaggtaggaagttattttccttcagtaatttcattactgttgccttctagcttccattgttgctcttgagaaatggctgttagctaactgattctttttttatatatgatgtcttttctctctggctgcttttatgatcttctccttgtcctaagttaattgtaatttaactattatgtgtctagtagtttttagatatctggcttgggatacactctgattcctgtatctgtggattcatgtttttcgtcagttttgctaaattctcattcttaacatagaatattgcttctcctccattctatctattcattccttctgaggctataagatcttctcattctgttcaccttatatcttaacctcttcttatattttttaatctcctatctcattgctacatacagtaagtcctcacttaacatcattaacaggttcttggaaactgcaactttaagaaaaatgatgtactgtataatcaaaccaattttaccataggctaattgatacaaacaagagttaagttcctatagcatacagtatatcatttcacttaaagatgcggtttctaagaacctatccatgacatagaggaattactatactaggtaatttcttcagttttactttccacttcactaattttatctttaactgtatttaatctgctgtttaacctagccattgagctttttaaagtgttttagtgctaaatttaataaatatacaaaaaagaacataaatatgtaattatatagcaaatatacatgtacaatattccaagtcaacaacacaagtaccatagaaatctgtgtgccccttcttaagtatacctttcttcatctttctagaaataaacatttgctagacttttatgataattgttttatatttttgtcacctatatataaatatttagacaatagtttgaacaaattgtattgatagattcttttgtgtcttagttcttttgtgtctttctgttttatttaagattgactaaaattattgcttgtggttctggcttattcattttcattcctgtatagtcatattttaagtactcactagtcacaagtgtctagtggctaccatattgaaaagtgctgctccaaccaaaggctggggcaaaagtaatttttgtttttttttttttgttttgttttttttgccatttaaaagtatggccaaaatcgcaattacttttgcaccaacctataaatataaataggaggtgaattgctcggtcataggaaatgcatatatttgactttaaaggataatgccaaaatgttattcaaagggattgtaccaatttacattcccaccagcaatttatgagatcttatccatggaattttaacttcaacatttctgtttttttaaatgtttaccagtttcttataaatgatataaatgaacaatttgataaaaaggcacacaggggaaatctagaagggtcctgagtgcaggagcttctgtccccatggagttggggtaggcactctactggcacagagatgtgttcaccaatttggaagcttcccaacatttctatttttaaattctaaaatatctctttaggttctttttcaagtcagtcttgtcatattgttactttcttggtacttgctcatttctgtgatttcatcttttgtatctaaattttatacatatttattttatactgtatatctcttataattccaatatctgaaatcattagactcttaatctgtttgttgttctgctgactcttacttgcagttgcttatttatttatgtctttggtgatttttaatagtctttaatttttaataattaatttctaatagtaaatattttacatatttatttgatctgagagtaatagtccaccaaacgtcctattaacttcttatactctactgtggtttcttgggggttgtaagaggataaaaatcatgcatatgggattgcagttgacaaatattaaaataattattcattctcgtttgtacagcagtgagtaaaaaataaaataaaataaaaagggcaataattatttattatgcttttttatttctccaaatttcctaccataaacacataatgcttttaaaactatgaaataataaaataatcatggaaccagaatatttgccaaacacaaaatcaagtagcaaaattttatttgcattatgaaataggattttaggtcacttcctaagaggctagttattcaaaattaaggtgtccccttctttgtgctttcctattccacactgtggataactctatcaatgcagaggcttaagaggaaatgatttctcgagatgatttttgaaatattgcttctgatagaagctagaatttctacccatctgggagcaccttagccccggtccagaatccctggctcaatgctggaatcccttcatcattagacataaccatgtcttgttattaaaatggatatagagacatgacttacgggtaagcatatttaggtatggtatttatacctaaggaaaggagcccaaaatgcagagaaaatagcagggtgaggagcacagaataaaaaagaaaaaactataactgggagttaattacaagggttggagataaaaacagaccttgaggcctattgttggttacttggataatttcccactatggctattctctgggatacggccttttacttagtcaagcataagacacaagcaagaatttccaggtagctgttttctccaagtgctcgatcctagagattagtactgacctagaatttaaggtccatctttgtcaaccctcccagaacatcagaagtcttccatggtttttggcatcctgtggggaataatggtcaagttacgcagtttgaaattaggaaaaaaaaaaaaaaaaaaaaaaaaggaggaggcggaggggaagcaggagcagatagaactatatcaaacagatgagcaaacttagaggttttaaatatttaaatattaaatagtttttgttaacatttcagcatttgggacagcacttgggcctgtgattcctctgaaagacttttctggagggtaagattttcctttggaaagggttgttacccccttttatttacttattttaaaggaagacaattcgataataaactatttcagtgggtgatttgtagcggtcagtaccgtttactgaagacgtttaaaacgtcacagaccgcagccaacgcccttcccaatacctgatgtgtgaatttccttcatcttgtggtttggcgtgggttttggaggaggagtttcagaaaacggtcaacatcggcacagttagggctttataaacaggctatccagagttcgactcctcctcctgcactggctagtcttgagagcctcttcccgggaaaaactcgggtggaaagaccatccgaggggagtgagccgcagaatcacgtaggggctgcagcgcccgccgccggctagccggtaatgcgcaggcacagggaggggcgcacgcggagaaggggtaggtacggcgggcttgcagcaggcaaggcaacctgcttccagtcttcagccgcacacccagaaggagggagtcgctggccgggagatcgggctccaggttttctgtctcactccacgcgcacaaattggaccccaagacacctcactccgttgccacttacccacccatcgtgggacatactcagcacacccatctgacggctgctcttgccctgcctggcattgttttctgagctctgctttctgagcaaggcctactcccccaacccttccccactgcggttaatatcttacaaacttgacagtggaactggggccaaagtgaccattaatttgccgggtagggtgggaatcagaatcctggtttatccgcttcatagatgtgtaatcttggcaggttatttaaactttctaagctactttttgaaacgtaaacacacattgtagaatgttaatttagcaacctcagatcagtcctgttttcgttttttccactgccttaagtcataaaagggcttccttacctactacacccagccaattgcaatggcaatccagctagcaattttaggtagtatcttcccatacaattcatcatatccatctttgccagattaaatttcttaaaaataagcttagtcattactccccatccccatctccagttaataatcattacaaaatgactcacgctgtcttcccaactctatctcatcctactcttctacacatattccttgttgactgtacccatctcctgcactttctggcattcatatcttcacttgtggccctttctccactacacagttcccctttccacatttctgttaaaatcctacccatcctgcatggtcaacttaaatgccatcttcaggaagccactcctgattttcccagtgtcctcattctctcttccagaccgaagccttttgttatgatacctatcttgtattgcagttgtgtacctctgttatcctttctacttatcttttccaattatacatcttagggtccttgagggaaagaaccacgactttttcatctctgtatcctcacaggtgctttccaaaatatgaactaaaaataaggggaggatttagaaagcttctgatcattttcatttcgattgaaacattcaaagtttcttttgagagtgcaatgttgaaattggtagctacaaattagttgtaaatggagagcaaggggaaggaaactcatttcttaaatccctgctcagtacttgcaatgtgacaggtgctttcacttatgtttgctcatttcttcacaattctgtgaggtatcataccatttacagatgagaaaactgaggctcaatagagtgactctgctaacgtatcacagctttgagtggcaaacctaacattttgaacccccttctgtagtattacttactgaaaaaagtagaggaactagtatttctacaaggtccttttcaagaatcaaaggagatgatgttaataaatgcccttcctaaagtatgttaaatataaggtattaattatggggaatatgacataataggtaaaacaaatagatatcataccatttctatcatttaagcacaacagtaccttgaataaggcatccagtggactagagatcaacaggcattttaatcttaatattttacactgatgtgcttttttttttctgagacagtctctctatcccacgcaggagtgcagtggtatgatatcagcacactgcaacctccgcctcccaggttcaagcgattcagcctcccaaatagctgggctaatttttgtattttttctagagacggggttttgccttgttggccaggctgatctcgatctcccgccctcaggtgacccacccgccttggcctcccaaagtgctgagattccgtgagccaccgcagtctgatgtgctttttaaaaatgacaactccaattttgtaggctgcatttaaaaatacagtaagaataaggctgggcaaggtggctcatgcctgtaatcccaataatttgggagacaaaggtaggaggatcgcttgaggtcaggagttcaagaccagcctggacaacatagtgagaccccatctctacaaaataacaattcactgggtgtgttggtacccgcctgtgatttccagctacttaggaggctgaggcaggaagactgcttgagcccaggagttcaaggctgcagtgagctgtggttgtgccactgtactccagcctaggaacactgactctttaaaataaaaatttaaaaagatgagcatttaactattgtattggcaggtggctgagtccatcacataccatttatataattaaatgttcacatgacaccagaatctgttttgcaacaaaaaacaaaaataagacatggtccctggtctgaaggcttccaatctgaaaggtaataagacacaggcaatgaaactatagggctataaaactatatttaaaaaaatttttggccgggcgcagtggctcatgcctgtaatcccagcactttgggaggccgaggcgggcggatcacgaggtcaggagatcgagaccatcctggctaacaccgtgaaaccccatctctactaaaaatacaaaacattagccgggcgtggtggcaggtgcctgtagtcccagctactcgggaagctgaggcaggagaatggcgtgaacccaggaggcagagtttgcagtgagccgagattgccactgcactgcagcctgggcaacagtgcaagactgtctcaaaaaaaaaaaatttatttttgcatgaaaaatttccaggactttggtgataagcagcgaaatcaatgccttaagtagattttgaaatggtatattaaaaaatggtactcatttggatactgtaagaaaatactgattaggtttctgggatataatggacaaatgattctcaactcatggcaagaagattcctccctgggtatcagaataatttgaggtggaacaaagaggctatgaagtttcagaacaaggtggtattttctgctcttgctttaatttcctttattgtaaaaattcagttaacatcaaagagagtgtctttttttttttttaaggaagaatgctttaaaaagagataagagcagtgccaacatgaaaaccaaaaaaaaaaaaaaaaacagtgcaacggggtgccaaaaaaaagggggaaaacatctgaaataagggggaagagtcaaaggtaaaaatcacaaagcaatggaataattaaaaagataacaaaaggttaactaggcaagttagaccaggggaagacttaatatgaaatttgtcctaggataaattattaaaatatttaaagatataatctaaagctcctactgaaatagaagataaatttaaaacaattttgattaaaaagagaaaatatactgtaaaatatttatttaataaaaataattttataatctatacagaattgaataaaaagtacaacaaattattttcacttatttacaaaactgcatacagtacaacttgcacattgagttcagcattctataaatatggccacataccaagatgtgaacatattcttgtcttatataagaaaaggctcaggttgtatgccacaaactttgaattaaattccagggaaatattgctttggtaacatgaacaatttgtaccacattccattaaaaaaagatttaataaaatccctcaaacagcacttttctacttgtttcggagtacacaattcccaaattagcacaaacaaaacaaagcaaaaaaagaaaaacagacagaatgtaaaatgaaggttgctacttttatgatatcacttccctttcccttccttagctagtgttcttttcctttcccttaatagtaaaggatggtgaatagaaaatgacctattcttatccccatccatttgcttctaggattcctgcttaaaccaaatgagtatgtcgactttgcaatcttgacacactattattaacactgttcagctgtgtcattctaaaaaagttaataccccagttaaaagcacctatctagattcttttcaagataaggcaacaaagtcagctttaaaatagttttcatgtctgacatatactagcagccccttggtagactgatttcagaattaaatgcatatagaacattttttcaagtaacttggtaatgaaatcactagcaattttaagcaaatattcaagatgatctacctttagaaacaaaggcagatttaaggtaaaaaaatgcaggaatcacatctatcctagttcctgtcccattgaaataattgaaaagaggctcagtttatgaaaaaggccttggactaatgcaattcctattgacatctttacttggataagaaaaacaaattaatataaaaactataaatagggatgaaattattaaaaaaagatttttcattttattttggaaataaaagggaatacaaatacaaatggcctagttacatctttagcctatatatgaacttttaatcttggaattaatagtccttcatattgaagatttaaagacaagcaagcgtaccttaagctttcttaagtctcttcatttagcaggcttcaaaacttgccttattttctaactaaatgagcttctctgggaagcatatgaataatgcaaaaacgtacttctaaacaaattttacagaaataaataatcgtcacaatgggaaccaagaacattcatatgatgaatttttttaaaataacttaaaattagaaatgatacgtacaccttaaaatacagaacactaaaccagaacaaatattgccagtgatagaataactatgtagaaagaccaatgtacatgagtaacacagaaataagaattaaattgaatagaggcagatgctgttagaacatatttccatccatcatgacttgcaacattttgtggcctctgtggagccctggtcccaccaggccaagcatctggctaagtagatacagacatatgtgacctataaaacaccaaactcacttgctaatgaagtatacaacaccatgtgctgctttgattgctcttgactggtttttaaaatcaagttcacttttgaatcagaaaaaaagtcatccttaaattagctctcataaataatccatgaaataaactttacttctggctcctctgaatagtatcatgttattcccggaacacaaggtattagtcaagtggctgctgtgaagtcaagaaatgcacattcataaatatatgtctacgctttaaaaaatcaaacacatccaggcagttgctgtgcagagttcttgctataagaagaagcccttcagcagtatattatgaagtggttacttgagaacttgattgtggatcttccagctttctacatttcttcataacactgactgcaccactggccaggaaaaccacagcgatgagtgcaaaataactggcatagatcaaaaactagaagggggaaaagcagtttattgaattatcaatgacaagaggattactctataataaagtatattcagaatttgtccataaagcctcaaaaaatattgcatacttacaccacgtgccagaccctgaagacacaaagcagcatcacagcacggtggtactaaataaagcctgactgcctgagtgtgaatcctgacttcatcccttacaagctgcgtgaacttgattgagatacttcatctctgagcccttcttcacttacaaaatggaattcatagtagttctcactttacagcgatgttggtacccatcagtgagatcataaatgcttattagcacaatgctaatgctgttagtattacttttattgttgttgctgttattgttataattcagtcctggtctctgccttcaagctgataggtgggtacaaataggccaaattctgaagatcaagaacttctctatttttccccagaagagggcagcggcaggtcaactatattccattacaggattacttaatgtaagaattcttccctaagacaattttttttttttaagttctggggtacatgtgcagaatgtgcagatttgttatataggtatacgtgtgccatggtggtttgctgcacctatcaacccatcatctaggttttaagccctgcatacattaggtatttgtcctaatgctctcccttcccttgcctcccaccccccaacaggccccaatgtgtgttgttcccctccctgtgtccatgtgttctcattgtccaacaccgacttatgagtgagaacatgcagtgtttggttttctgttcctgtgttagtttgcggcggatgatgccctaagcgaaattttaatgtgactatatggtttattaacatcatcatcatcatcatcttcttaaaataacatactaaatacttacaaactggttcaaaagtacaatgagagtatggccttaaatcactgagccagtttctttcaatgttggctacacttctgcaggaagccattaatcaatcatggcagttagggtttcagcaccacccataaaatcctattattccacgtgtttaaatccaccatttctataagaatctgctgacaaatttccacttccaatgacagccatgtttccctcaactgtaatagtcctgggaactctcccttatacagggaggatggcaagcacttaagtttctctcctactttccatcctgaaataagttttggggttagatgttggtttaactctaagctctggaacactactagtgatggtatggacaagtcacttaacatctctcagactcatcttcttcatgtctaatacagcaaccctacaaatcctatataaagcacttgacacgtagaggcactcaatgcacattgtctattattactatttctctcttagatcgcttcagtaaaaacaaagttaattacggctaatatgttgggaagaaatcatttgggttgggatgggggtgggagtaaatacttcttgattcattcagttgcccattttaccaaagtacaaaacaagatatacttaaaactcacaatgcatgaaggcatatacaactatacaattcctgaacgtaaaaagtattcacattgttgttgggtgttggtgcaagtttctcaatagtcataagttacaaatcataatgttgttcatcagcagcaaggcattaccgtggtatttgggtgaggggtgttttaaataaagaagggaggagacttaaagagttgtgagatgaagcagggaatctcaaacatgggatacagtattccaagcatagatttaagtatagagggaaataatggatgaggaagcagaaggtcttggtctgtaaggaatcaatattacctctcagctgaaacagccccattgggctgatgagttacactcgggaatgttctaagacctgacaatcccaacaccctcccaggagaaaagaactaaggataggggagaagatgttgaatgaaggaaggagggtatgcttttactttacatctgttccctattgtttggatttgttttcattaagcatacatatacttctgtcaccctgatcaagtcacacatactaccttcgatgccaaaggagagatcttacctgagtggtaatttctaatccaaggccactggcatctaccacaattagagtgagcagcgtctgcagtgccagggcaatgaaggtatttacaccaaatactagggcatagcgttccatgctgaggtttgcagcaatttgaaaacttaaaaaaaaataaaagagtgaataaataagaattacttctggagtacttataatatttattctaaataaaagtaaacatttatctttaaacatgaagagtccttctttctactgtcaattgcctttccaaccaaatgaaaacattctgcaactaaatgatataaatctcatgcaaacatctgaaaacagtaggaacatacaaacatgggaataaacaaaacttgcctaaatgcttcctcaggagaaaaactgataatgcacatataatacaatgcttcctcccatttgcctcatttaactagaaacttgaatattttggtttgtaaagaaaccaaaaaatttatcctgttacaatttttcctaaggcttctatgagccaaaatacatacgttgctatcgtgatgagtaacatgtagatgattctgaagacaacataggatgcatagcacacccaaatgttacccacagtgtccatgatatacactgcagcagcaatcaggagagaaaagagagataatgtcatttctccccaagttgaccaggatatttttatataaccaactgcaaacacagcaacagcacctacagaacaaacaaaaaaaatccaattattttgctacacaaatgctgttgcaataaattaaaaactcagcttagattattaaattttaaaatctgcaaacttataaacagaatagctcaagattatggagggccttgaaactcacacagaaatttctgaacttgatggaatcaataaaatggagccactgagatgacagactgaattaggagaggtggcaatgagatgaaaatgcaggacaaagacacagggacattgctaaggaaaaaaaatgctgcagctgaagcagaggcaagagtcaaaaagaaccatagcttctaatttggcatcatggcaggatgagtcatctctccttcaaaccaaggagcagtctagaacatggcaaaagggcttctctgccttttggtaaaacagtgatgatgataaggatagctaaaatctatgaagtgttttctgagggccaagacagataataagtgtttacagaaatcatataacaccatccaacaacctcaggaggtaggtcaacaaattagaaatgaacaatagagtaagatggtcaaatacacaggctctgaagccatcctgcctgagttcaagtcttgactttactacttaccatccatatgaccttgagcaagttattaacctaccagtcccaagtttccattgcaaaatggggataaattctacctatctcaggaattttgtgaggattgagttaatgtatataatgtccatagaacagtacctagcacatattaacattcaacaaatattagatactattgttataaactattatatattgccattcaaaatttcacatcaagtgacaaaactacccagtaaatacagagataatggaaacttggataaacaatcttgaaaattattatattaggtttactcaaagcttataaaaaaattccagtttgttagtcatagtcctgctccacttgagtacttctaagttgtcctcctaaattgtaaaatctagctcaaaataatcattttttgaggctatttcaaatttgggaggggtgaataaatctgattatggctggcttaactaccagaggaatccctcccccaccacgaccctctattatcctgcattgcttacccagtaaggttgaaacggcctccacgccaccattatagatagcagcatagcgagaaggcatcactttctcccacaggccctgtgtgtagttcacaacttgaaaatagccacaggtagagagggcccaccacacagaccagcagagaagagggcgagaggagtagcacatcaggaaatcattccatagtactttcaatacaaggagacggtctggcttgggttcctacatagcaaaagggaacaatgctcaaactctgatgaaggcaattatatagaaagcaatttacaggcccaattacttacctaacagacttttttccttgtgaaaactaactgcttacttcataaacttattaacaaatacatttatcccctctggcgaaaaatatgttctcataggatttttgctttaaatgcactatagcattaacacagctgtatgtaatcaacccagcaaaagatgtactgtttacaaaatgaagatgatga

SEQ ID NO: 573 - DNA, 41536 bp, Homo sapiens
ttttttaagacggagtttcgctcttgttgcccagactggagtgcaatggcacaatctcggctcaccacaacctccacctcccaggttcaagtgattctcctgcctcagcctcccaagtagctgggattacaggcatgtccaccatgcccggctaattttttgtatttttagtggagacagagtttcaccgtgttagccaggatggtcttgatctcctgacctcatgatccgcccgcctcagcctcccaaagtgctgagattacaggtgtgagccatcacgcctggccctaattttgtatttttattagaggtggggtttctccatgttggtcaggctggtctcgaactcccgacctcaggtgatccacctgcctcagcctcccaaagtgccgggattacaggtatgagccactgcacctggccattaatttttgtatttttaatggagatagggtttcatcatgttgcccaggctaatagactttattttttagagcagttttaggtttataggtaagttgacgagaaagtgcagagttcccacccatgtctgctgtcctacagacacatgcagtgtctcctgctgttaacaacttggatttgtattgtacatctgttacaatcggcaaacctatcttgaggcatcctttttttttttcccagacagagtctcactctgtcaccaggctggcgtacagtggtgtgatctcagctcactgcaacctccgccccccaggttcaagtgattttcctgcctcaacctcccaactaactgggactacaggcacgcaccaccacgcccagctaatttttgtatttttagtagagtcagagtttcaccatgttggccaggatggtctcgatctcctgacctcatgatgcgcccccctcagcctcccaaagtgctgggattacaggcgtgagccactaccccttgcccttgaggcatcattatcacccaaagtccatagtttatgatagggttcatgcttttttttttctttttttttttttttttttgagacagtgatgcagtcatagcttaagccttctgggcttaagtgatcctcccacctctctgcaccccagcctcaggtgccacagcatgcaccaccatgcctggctaatgtaaaaattttttgtagagatggagtgtcactgtgttgcccaggcttgtcttgaactcctgggctcaagtgatcctcccacctcagcctcccaaagtgctgggattacatgtatgagccactgcacctggccaggcttcactcctgatgttgtatattctgtgcatttggacaaatgtacaatgtcatgtatccaccattatagtatcagacagagtagttccactaccctaaatattctctgtgctctacccattcatccctccctcatccccagcccctggtgttactggtggaggatgtgcaggttcttggcattttgaacaaagaattggacaaaatgcataaaacaatgaaagaatgaagcaaaaaaagcatagatttatcaaaatgaaagtacactccacacaatgggagtggtctggagcaagcagctcaagagcactggttacagaattttctggggtttaaatcccgagaggtttcccattggttacttggtttatatcctctgtaaatgaagtagtggcccataactagtctgattggttggggaaggtgaccaacagaggctgaagtgaagttacaaagttacacctctatgcagatgaaaactaggccagtgaccagtctcattggttgcaggaagaggtactttccatttttcatctgcgacacagaaggcgggggttgcctctgatccttttgttatttggggcatggaaagtttgggttttccttttgattcagttccaggaagtcagcattaatcacccttaggtttcttgcctccataccctgttctcatacctcatttccccccgaaagacatgatcctcataaatctttatgggaggtaaagggattgatagtctttcttctgtaactgctttatgctgacctgaggcacagtccctacgtactggggaatcacaggactctctccccgccctgtctagtggagacaggatagcttcttgatggccaggggtggtgtctccacctggaactggctggaaacattgtcacatgatcatctgaagcttgatggtctctaggtgacaggaaatgaatttggttaagagtttaacaaacatggtccaaaaaccaaggcaagtatagtcattactaatgggctggccagaggaaggagccatgaaccccaacttagcatttttgaccaggagccccatgactcagatagctgttgttgtattttagaggcccagttgggtagtttttgggtggcatttgttactaatcctcattgttcggcataaaaacagcattcttcctctagaaaaagacctaagcccccctttacagcagttaggagatctcatccccttctgttttgccaagcaactgctgctgaggcatctatttgatttcgtatggtgatgatactttggccaatgtctctattttttcttttttactttgggcaatgtcattcaagctttccataaaatccttggaaaagcattggtaataggatagggatgttacaacccggctgactcccattcccagtcccgcggttatttgtagtcctaccaaaagggatgtgagttggatggttcatttgtgtctggcaattgcagttaaaggtataatgagggattggttcttgggagctatattaatttcacaggctaaataaacaagtgtaaaggttctagtccaattggctggtaaacataagtaagaactagttccacacaggtaaaaggctcctagtttttcaagacaagaattttctatggtaaacatgtgggttagcttgttgttttcactttcccaagtggttaaggtccctatgaaggtggccccagttaaaggctggaaaggaccttgggaaatattctgagttgccccagcagttctgttttcccattggaggtaattaggcttagtgtctaccaacaagcatccagaggtgtttcgtactggggaaccaaaagataactagatgtctgaggattagtgcagtcttcccaagggaaaatatgatcatagctagtgggcttaccttggcagtacttagactgtgtatcctttgaagtgtccttatctagggatggtttccatgaaaaccatacaggttttctaaatgacacagtctgggtaactgcctagcttatgtaatcatgtgaggggttaataatctctagggtgtagttacactgatgacttttcaaggttcccagggcctgaccaaaattttggcttctcttaatacaaagtggcacctggaattttagctctgtgtacattgatattgggccccaaatgggtttctgtgggatgcaaccccagaaagggtactctgatagtactggagaaggtttactgcttgtcctgtcatcgtagttcatgtttttttccccaaggccaaagattgggctgggattggggtggtagtgtatttgaatgatgctggagataaccaaagccaacagtctttgccagagctgggctggtggtatttaactgtctttgagttaaatgtaaagtttttaataaatacccagaatccattaactgctggaggggtaaagtgaagctctgttgtaaaataaagctgattcccattatgcgtggtcctgtatacacaggctgtgggtgaccattatggaaccaaaaaatacttatttgttattttgtgctatagaataggaacttcaggggtggatacctatgctgtcaggaatgcttgttataagaattaattaaaacactttgcttaattattacaaaggaagttattccatttgtttagaagaaagcaattaaattgtagaagtataacaatggctactattatccagtttaaagtaactaagcaacaaagacaccaaggaaagttggtaggcttttacttatcttttggctgtcttttaaacaggtacttcaggtctttcacaagtcacaggtgtagtggctgatgggagcttcaggttcccggtctgggacttcacataacacaggcttgacaccagaaagatgtatccaactatctaatcctagtactttgaccccagaaggcatggccagtactgaaaatggtcccttccactttgattgtaattattgagcaggtgatccctccttctatgttttaacaggtaccttgtctgttggcctgattttgggttggtggttagttcctggtgtggggagcttttgagttccaaactcttgtaaagcctgctgaaataatcccaggttaactaggtattttactaaactggatgtttctggatcagagattagatcattagttaaaaatggccttttgtataacatttgtgtgggctcataataattttttctctaggggaattatggattcttaagagggctatgggcagtaagcagatccaagtttctgatgtttcctgacataggaactcctattttagagttagctaagctctttccacttttttggaggattgaggtctccatgctgaatgtaaataatagttgattctgagaaccttagcaaccccttgagttatttgggagacaaaagatgggctgttatcactttggaggctttgaggtaacccaaaccaggggattatttcctttaagagaacctttataacttcattaaacttctctgttctggtagggtacacttcaacccagccaataaaggtgtctgttagtactggcagaaacttttatcctttgcaagctggcatatcagtgaggtctaattgccagtcttcccctttaactttagccaatatattcacacacagaatcccttctacaattaatttttcataaaccttctacagcttgtcttttaaccctccaaactttggcaagaaatccatattctcatgccttttaccaaaagtacattctactttttttacatgaatccttttcacgacttacacagaccttctatgacatgcctggactttctgacttgtcctaaacatccctctttaaacaaccattcatttaactttagggcaagaatttaccatacaggatcctgtctcatacaaaattattattgctacatccttccctaccaagaatacatcttcatatacataactttcttcacctctctctcccgtacttactggtttcttactaccttgtttcataaataacccttttttttaagtcaacaacctgaatcaacctttagacaacctctgaactacacaaaatcatttctttcttaccaatagcacatcttttttggcaccttttgtatacagaatcatttgttaactagaattcttatccttagtaaccttaaattttagtgaaaccctaaaaagcaagaaatcctgaactattagatatgagcattttatagatgagaagaattccacaacttttagaaacatatttccccgtatcataatccttcctttttatttacttattatcattatgtttttgagacggagtcttgctctgtcaccaggctagagtgcagtggcacaatctcggctcactgcaacctctgactccctggttcaagcaattctccagcctcaacctcccgagtagctgggattacaggcacgtgccgccacacccagctcacttttatatttttagtagagacagggtttcaccatgttggccaggatgggctcgatttcctgaccttgtgatccacccaccttggcctcccaaagtgctgggattataggcgtgagccaccgcacccaacccataatcctttcttaattggaaatgacccagatatccaatgaacatcaaaaacaattttaagattttaagttacacaaagagtttacctaaaacatttatcccaatttcatttactcaattctttcattttaacattttatctagattacttctgaaaactaagatagtagacaccatcctctaaagttatttccttgttagccatttttttattaccaatgaatatcatttgctcactgaaaaaaagcctcaaagttaaatacacaggtatttttgccaataactcagaagattcagctaacaacattaaattagtctgatttgtttatttattttttgagacagagccttgctcttttgcccaggctggagtacagaggcacaatctcagctcactgcaaccttcatctcctgggttcaagtgattctcctgcatcagcctcctgagtagctgggacaacaggcatgcaccaccacatccagttaattttttttatttttagtagagatgggttttcactgtgttagccaagctggtctcgaactcctgacctcgggtgatctgcccaccttggcctcccaaagtgctgggattgcaggcactagccaccatgcccggccaaactagtctcatttgtcaaagaaagcatacaaaccaggaccattttttgttttggctgggttaatacctttataaccttctgtgccaaacactgacaccttaaaatatcttgcaaagacaaatataaaaccatatatgttgacaattctgaagacatttctattttcattttaccaataattttaaagccaacttctttagtaaagatttacttaagtcggctgggtgcggtggctcacgcctgtaatcccaggcaggcggatcacgaggtcaggagatcaagaccatcctggctaacatggtgaaaccccatctctactaaaaatacaaaaaattagccaggcctggtggcgggcacctgtagtcccagctacttgagaggctgaggcaggagaatggcgtgaacccgggaggcatagcttgcagtaagctgatatcacgacactgcactccagcctgggtgacagaacgagactccatctcaaaaaaaaaaaggaacagcagcacaaatgcctggatacatgcaactccatctcactttcccattcaacagcaaactccagattccaaacaatgttggggccaaacagtattgcaaaagaatatcaagtgtttcctccttagattatcagggtcaaatttattccagtcgttgaggatgcagccaagcagggagtcagatggaatagatggagtgtttcctattattgtctgtaagagagaaaatcctagggagggtgtagtactattcctcagaacctcagcctagggtgtcccctttggagaggttgaggtctggagttggatcccctagaggatccccctttggggtccaatcttagagtgtcagacatctctgactttaggtgggcaccagtgctgctttatatgttttccctccagtggcgatggtctactgtgagctttcctttggttcctgggcgtaatcccagacttttagtatcccactaatttcagtgtgatgtatcttcctgcattcctcacaggactaaggaggttctgaaacattgcagagttaatagtaccaaggttggtggggtattctctgtgaaggaaggatccagcggtatgtgaaagactgagattgagaatttctttctttcttttttttttttttttcttgagacagagtttttctttttttgagatggagtctcactctgtcgcccaggctggagtgcagtggcgcgatctcggctcactgcaagctccgcctcccgggttcacgccattctcctgcctcagcctcctgagtagctgggactacaggcgcccgccaccacgcacggctaattttttgtactttttagtagagatggggtttcaccatgttagccaggatggtctcgatctcctgacctcgtgatctacccgcctcagcctcccaaagtgctgggattacaggtgtgagccacagcgcccagccttagacggagttttggtcttgttgcccaggctggctggagtgcagtggcatgatctcgggtcactgcaacctccgcctcccgagttcaagcagttctcctgcctcagcctcctgagtagctggggattacaggcgtgtgccaccatgcccagccaatttttttgtatttttagtagagctgtggtttcaccatgttggccaggctggtctcaaactcctgacctcaggtgatccacccgccttggcctcccaaagtgcagagattacaggtgtgagccactgcacctggctggggttgagaatttctgtgagattcagggaaagcaaattgatgcagaagcaatgaccgtcaacctatgggatcccctcagtgaagtctgagatgtagaatgtctactgaagcttgtggatcccaaaggtcttcagacagtcaaatcgagtaagagaaggtaagtcaaatgcatgagatacattatcttttgcccttacaggctgactttaaggagaattttgcataagaaaagaggatttaagtcacctgaaatatgcgtgagttcgccctggatgagctgccgctgccagttgcatcacagatagggatcagggactgtaactggaaaatagagaaaagagtcttttccccttctgggcagggcagctatccccatttacgccttggccttcaggcaacaccagagggtggccctggccagctgccctcagttaccaaggaactagtaggaaacggcagctgaaagattttctgaaaaagagaaaaaggaaaaggactaaggtccttcacccgaactgggtggtagcggtcaggcacttccacacagaaatctttccgtttcaccagagagtggctccggccagaaacttacagttgcttgcatgcttatgtgctgtccaccaaggatccgtaagttggaaagggaaaaagagagagagaaaaggattcccctatatggaaaagggaaaacaaaaagagaaaagaaagaaatcccaaacctcgagcctacctcctggctggctcaccaaaatatgttaccagtggagggtgtctatgttcttggcattgtgttcttttacttttttttttttgagatggagtcttgttgtacccaagcgagttaaaaatacgccacactttgagacgaattaagagtccttaattaagccggcggccaaagagacggctaatgctcaaaattctctcggcctcgaggaaggggcttgattaacttttatacctaggtttaggaaggggagagggactcaaatgcaataagtctacagaagtaaaaacatgcaagaatcaacagaagcaaaatggttacagagagataaacaacttaaacggttacaagaagagcaacggtaccacgtgcaaggttctaaatctttcattataattagatatatagggtctatgccggacacaaactcaaggttttctgttgttatctctttgagaaaaatcctgggaacttcatacattgttggtgttagtgccttatcagttaattgggctcttttgaaatgctgaggatctgtttacccaggccaactccttaggaaagggggttgggtaaggagcccttagtgtcttgtaaattaaggggtcaattggagtttgtccggccttcccagctagagagagtcttatttacatgagaagcaaggctaggtgattaaagagacaagcaggacaaaattcaaagtaaccagttagagtaaaaacaagcttaggcatttcagtctcactctgttgcccaagctggagtgcagtggcacgatctctgctcactgcaagctccgcctcccaggttcacgccattctcctgcctgagcctcctgagtaggtgggactacaggcacccaccaccacgcccgtctaattttttgtatttttattagagacgggttttcaccatgttagccagtatggtctcgatctcctgacctcgtgatccacccgcctcggcctcccaaagtgctgggattacaggcatgagccaccacgcctggctggttcttggcatttttaacaaagaattggacgaaacacacaaagcaacaaaagaagcaacaaaagcatagctgtattgaaacaaaaatgcacttcacagagtgggagcaggcccaagcaaggctcaaaagcactggtcgcagaattttctggggtttaaataccctctagatgtttcccattggtcacttggtttacaccctatgaaatagtggcccatgaccagtctgattggttgtggaaggtgaccaagcagaggctgaagtgaagttacaaagttacgctctatgcagatgtctgactggttgcaggaggggaccaatccgaggcactttccatttttcatctgcaacacagaaagttggggggagttgcaaagggagtagcctctgatccttttgttacgtgggcatggaaatttagggttttccttttgattccgttcatgaagtcagcatgaatcagccttaggctccctgcccccagaccctattctcctgcctcactggcaaccactgatctttatcctgtctccatagttttgcctttttcagaatgtcatagttggggtcattcactacgtagccttttccgactggctgctttcactaagcaacatgcatcgtgtgtatcttcataccaccctctcacgtttcccccaggctggagatgttgagtttatctgaatttttctcgtgtcttcctgctcctccttccttgtaactctctcgcctgcagcctctgttatttcttcctctgaaggtgcacccaggcttacttatctaccctcctccctgggccatgccctgcacaccatacctcagtcatgtcatcctggattctgtttactgtcagtctttctgtttggcataggcatccctcttggctggcctgtgaggacagcccctttcctcatttcatgctcctaatggagaagccactgcaagatatttaatgtccttcacctgattttccatggccacgcaaaacctggacacaactcagccacccactgacttctttcctgcttctcatcctcaaatacccttcattgggctgttgtttcttttgaaaacatcctcccatgagggattccacagtgattccccagaggaaccacagagttgggatgaggacagtgcaagtgtgagagtgctgggtgtgagggcactgggtgtgagggcaccaggtgtgagggtgctggttgcgagggcaccaggtgtgagggtgctgggtgcgagggcaccaggtgtgagggtgctgggtgcgagggcaccaggtgtgagggtgctgggtgtgagggcaccaggtgtgagggtgctgggtgtgagggcaccaggtgtgagggtgctgggtgtgagggtgctgggtgtgagggcaccacgtgtgagagtgctgggtgtgagggcaccaggtgtgagggtgctgggtgcatgcaaggatcttgcccaggagggaagagagcttttgattgagaggagggaaacatcctctcagaagtcaagggatggccacagagtgtagttaatgtgttgccaaaggatccttgtgtcctcatgagctcagagagtgaggcatgagaacttgaggtaggccgcagtagtgttgaccgtggtggccatgcaaacataatgaacagagtgacaagcagagtggaggatctttaggacctggacaaggatcctgagctgggagcctctgccactcatttttagaggctccgtatcttcaacagagaggaatccccaccaggacaataacaaggatggcaagatcaaccatattttgtaatatcagtgccagacactgtgtgaggctcacatagtgattcattgatgcctcaaaataaatcttgtaggctaaacattcttactccgggctacagcaaggaaaatgaacctctaagaggctaaggacctgtctgaagtggcaaacggtggagcccagatgcagccagtcatgctgatcatgctgcttcagagaccatgcagtcttttctggagagtcttctattgggtcaattctggaatgcttaaataagtttttctctgtttgcagcctgaagaaatggtagaattggtgcattaagaatatgaagtcagtgttgatgtctgagatgcaattatgagatccagaagtggaacagaaactgatattctaggactaagcaccagttaggagtctgtgtttgcttcctgtggctgctgtaaaaaatttccaccaacctgttggcttaaaacaatgcaaatttattctctaaaagttctggaggccacaagtccaaaatcaatgtcactggatcaaaatcaaggtgttgatatggttgtgctccctctggatgctccaaatggaaaacacatttctgtcttttccttctcctgttggttgcagcattctttccagtcttcagatatcttctgctgtgtcttctcatcacctcctctgtgtttcaaatctccctctgcctttctcctataggaacacttgtgattacatttagagcccccctggatagtacagaaaaaaaatccccatttaaaaatttttagcagggtgtggtagcaggcacctgtaatcccagctactcaggaggctgaggcaggaggatcacttgaacctgggaggtggagttgcagttagccaagataatgccacttcacttcagcctgggcaacagagccaggctctgtctcaaaaataaacaaaacaaaataaaataaaaatactaatcacagaagggtacattggcttggctgtaatcccagcactttgggaggccagtcggggaggatcacaagagcccaggagtttgaggctgcagtgagccatgattgtgctgttatccggtctgttcaacagagcaagatcctgactgtagaaaactaagtaaataataataataaaattctaatcacatctggacagttcctttttcccaaaagttcacattcacagagtccaggggcttagaacatacatactttttgcaatggttaatggctttatatcctgcagacccagttcattctgtggatttctctttttatcttcacctccctgcttattctcttttttgagacagggtctcactctctcacccagactggaatgcagtggcccgatcttggttcactgcaacctccacctcccaggctcaagcgattctcctgcctcggcctcccgaggagcttagactacaggcgcccaccaccacacctggctaattttttttttatttttattagagatgaggttttaccatgttgaccaagctggtctctaactcctgacctcaggtgatccacctgcctcagcctcccaaagttctgggattacaggtgtgagccactgcacctggcccctccctgcttattcttattcttctgccctctatttggggactagtgttacttagtcacttctttattatgtttgcttgtattttgcactttaccactgataccatgtttgctgatccatccctccctttcacagcctgcatacggattacagtttgtagtttggaaacaaaccagagacacttccattaaacagttgtctccttcatctccccctccccctccccctctgatgcttctccagtaacttaggcattttggatttctttcagactggaaagctacccttgaggagaataggttgaattctgaaaaagatcgagctagggaagaactatcccaccacgtggaagtgtacaggagtggaccggaggagccaccctctttggtattaggaaaagtgcaagatcagagcaaccagttaagggaacaccaggagaactccttgaggttcatggtactcacctcagagagactgtttgctcaaagggaacattgtgagcttgaacttgggggaggttattctctaccttctactttaagccttctacctacaacattacctacaagtacaggtttccctaagcccaactcacaagttaaagagttgaaacaaaattcagctttcattaatcatgagaaaaatggagcagatgggaagcactgtgagagtcatcagtgtgctagagctttctgtcagagtatttacttgagtaaacttggaaacgttgaaacaggaaagaaaaacccttatgaatatattgtcagtggtgactctctcaactatggttcctccctttgttttcatggtagaactttttcagtgaagaaaagtgatgactgtaaggattatggaaacctcttcagtcacagtgtgtctctgaatgaacagaagccagtgcattttgggaaaagtcagtatgagtgtgatgagtgcagggaaacctgttctgagagtctgtgccttgtacaaacagaaagaagtggccctggagagacccccttcagatgtgaggaacgctgtgctgccttccccatggcctcatctttttctgactgtaacatcattcagactacagagaagccatctgtgtgtaatcagtgtggaaaatctttcagctgttgtaagctcatacaccagagaacacacactggagaaaagcccttcgaatgtactcagtgtgggaaatcttttagccagagctatgaccttgtcatacatcagaggacacacactggagagaagccctatgagtgtgacctgtgtgggaaatccttcacccagagatccaaacttattacacatcagcgaattcacactggagaaaaaccgtatcagtgtattgaatgcagaaaatccttcaggtggaactctaacctcattgtacatcagagaattcatactggagagaaaccgtatgagtgcactcactgtggaaagtccttcagccaaagctatgagttagttacacataaaagaacgcacactggagaaaaacccttcaaatgtactcagtgtgggaaatctttcagccagaagtatgaccttgttgtacatcagaggacacacactggagagaagccctatgagtgcaacctgtgtgggaaatccttctcccagagttccaaacttattacgcatcagcgaattcacactggagaaaaaccgtatcagtgtattgaatgtgggaaatccttcagatggaactctaacctcgtcatacatcagagaattcatactggagagaaaccgtacgattgcactcactgtggaaagtccttcagccaaagctatcagttagttgcacataaaagaactcacactggagaaaagccctatgaatgtaacgagtgtggaaaagccttcaatcgaagcactcagctcatcaggcatctgcaaattcacactggggagaagccgtacaaatgcaatcagtgcaataaagcctttgcaaggagctcctaccttgtgatgcatcagagaactcacactggtgagaaaccttttgagtgtagtcagtgtgggaaagccttttcagggagctctaaccttctttcccatcacagaattcattctggagagaaaccctatgaatgtagtgactgtgggaaatccttccggcagcaatctcaacttgtagtgcatcggcggacacatactggagagaaaccttaggagtgcagtcattgtgggaaagctttcatccagaggtctcccctcatcatgcaccagaggacgcatgtcggtgggaagagctatcagtgtgacgtgtattaagccagcggttgtgactcattgaacatcagaggacatatcctggagaaaagccctacgaatgcattgattgtgggaaagccttcaatgatcgctcaacccttagtaaacacgagaggacacacactggaggcaaaccctatgaatgtgaccattgcgagaaagcctttagccaacggtgtcaacttactaggcagcagagaattcatactggagagaagccctgtgaatgttaacaaatgtggaaaagcttccagttatgatactttccttattcaacatgagaaagctcatgggcaagaaactctatgaataaccaagatggagccgggtgcagttgccaacacttgtaatcccagcagtttgcgaggccgaggcaggtggatcacttgagcccaggagtttgaaaccagcctgggtaacatggcaaaatcctgtctttacaaaaaatacaaaaattagcctagcatggtggcgcatacctgtagtcctagctactcaggaggctgaggtgggaggatcacttgagcttgggaggcggtggttgcagtgagctgtgatcatgccatcacaccgctgccttgtgagagattgagacactctaaataaataataaccaagatgggaaatttccctgccagaccttgtttactagaaatcaggtggccaaaacatgactctcagagtggggcttcatgaccatgtgcatcagaattgcctggagtgtgcactgaaactgtgtattaccaagctcactctagccaactaaataaaaatctctggcagtaaaatccaggagtctgcagtttctaaaatcacacaggtgagtgggcatggtggctcatgcctgtaatcccagcactttggaaggctgaggtgggtggatcacctgaagtcagaagtttgagaccagcctggcaaacatggcaaaactgtctctattaaaaatacaggccaggggccgggcacggtgcctcacacctgtaatcccagcacttaggtaggccaaggtgggtggatcacgaggtcaggagattgagaccatcctggctaatatggtgaaaccctgtctctactaaaaatacaaaaaaattagctaggcatggtggcgggctcctgtagtcccagctactcaggaggctgaggcaggagaatggcgcgaacatgggaggcgtagcttgcagtgagctgagatcacactactgcactccagcctgggcaacagagcaagactgtctcaaaaaaaaaaaaaaatacaggccaggcacaatggctcatgcctgtaatcccagcatttcgggaggcaaaggcaggcggatcacctgatgtcaggagttcgagacccacctcaccaacatggagaaaccccgtctcgacgaaatatacgaaaattagccaggtgtggtggtggtaatcccagctactcgggaggctgaggcaggagaatcttgacctgggaggcagaggttgcagtgaaccaagatcaagccattgtgctccagcctgggcaacaagagggaaacttcatctcaaaaaaaaaaaaaaaaaaggactctggtgaggcttggtggctcatgcctgtaatcccagcactttgggaggctgaggtgggtggatcacttgaggacaggcattcaagaccagcctggccaacatggcaaaaccccatttctactaaaaatacaaaaattagccgggtgtggtggcacacatgtgtaatccagctacttgggaggctgaggcatgagaattgcttgaacctgggaggcagaggttgcagttagctgagatcatgccactgcactctagcttgggcaacagggcaagactgtgtctcaaaaaaacaaacaaacaaacaaaaaaccctgagctggctgtaatggctcatgcctgtaatcccagcactttgggagaccgagcggccaggcagatcacttgagcccagtagattgagaccagtctgggcaacatgttgagaccccatctctacaaaaaatagaattagctgggcatggagctgcacacctgtagtcccagctactcaggaggctgaggcaggagtattacttgagcctgggggtgggggggatggtctcacctgcagtgagctgagatcacaccactgcactccagcctaggcaccagagcaacactgtgtctccaaaaacaacaaaatattggactctgaatatttcagggattcggttgtgctttaactttgttgctcagttggtttgattgtaatcagaactggcagcatgttaatatggaaaatacttatcaggggatgtgaaaacaggagcccaagtagtatgttcacagaaggttacaagcacataatttaaattggtccactcagcaacatgtttcctaaaagaaaaaaatgtaaattgacagtagtggggagactagaagaggccatgtctgcatatttatttatttatttatttatttatttatttaagacagtctcactctgttgcccaggctggagtgcagtggtatgatctctgctcactgcaagctccacctcctgggttcacgccactctcctgcctcaacctgctgagtagctgggactacaggcacccgtcaccacgtctgtctaattttttgtacttttagtagagacaaggtttcaccatgttagccaggatggtcttgatctcctgacctcatgatccgcccacctcggcctcccaaagtgctgggattacaggcatgagccgccacacccggccgcatttatttttattttttgacacaggctgttgctctgtcacccaggctggagtgcagtggcgcagtcatggctcactgcagcctcagcctggatcaactgatcctcctgtccttgcctcctaagtagctgggaccataggcatgtgacatgaagcctggctaaatttatttttttagagacgaggtctcaccatgttgcccaggctggtcttgaactcctgggcccaagtgatctccagccttggcctcccaaagtcctgggattacaggcatgagccatagtgcatactattactgcacatttaagcaggataagagccaatgggagggtgagcatggtggcttatgcctgtaatcccagcactttggaaggccgaggcaggcagatcccttgaggttaggagttcgagaccagcctggccaacatggtgaaatcccatctctactaaaagtacaaaaaattagccaggtgtcatggcatgtgcctgtaatcccagctactcgggaggctgaggcaggaaaatcacttgaacccagaaggtggaggttgcagtgagccgagactgcgccgttgaactccagcctgggcaaaaaagcgaaaagcgagactctgtctcaaaaaaaaaaaaaaaaaaaaaaagggctgtgtgcggtggctcacgcctgtgatcccgacactttgggaggccaaggagggtggatcacgaggtcagatcaagaccatcctggctaacacagtgaaaccccgtctctactgaaaatacaaaaaatcagccaggtgtggtggcaggtgcctgtagtcccagctacgagggaggctgaggcaggagaatggcatgaacccaggaggcagagcttgcagtgagccaaaatcatgccactgcactccagcctgggcgacagagtgagactcggtctcaaaaaaaaaaaaaaaaaaaaaaaaagatggaagtatagccaatagcgaaacatacagaatgaggaaggctggagagggtcaggcgaggagaggctgtggcagcagatgtggcagccccagcagagccatagactgatagaccagaaagtgggttaatcgaaggtctgtccatgaaactcagactcttccccatttttttttcttgcctggcattacctatctggctgtgggtagcaaaaattaaagtagggaaggagtcatgtgctaaaagattagttcaggggacaagggaatctgatgtattttgctctgcagcaagggctgctttattctggcatttcagaactttttacctgatagctggttctcgccctcttcaccctcgagcaaagcgtactgttaaagcagccccgcctgtctgtggagcttcctgtctgctttctgatagtctcttcaatatgggtgggaggcaaggagcaaaagataaagtctccatcatgagagaaggtatctaagacagcagaaaagacagatattcagaggaaccaaatattctttgttttttgagacggagtctcattctgttgctcaggctgtagtgcagtggcacgatctcggctcactgcaacctttgcctcccaggttcaagcaattctcctgccgcaatgtcccaagtagctgggattacaggcacgtgccaccatgccaagctattttttgtattttcagtagacacggggtttcaccatgttgaccaggctggtctcaaactcctgacctcaagtaatccacccaccttggcctcccaaagtgctgggattacaggtgtgagccaccgcacccagcagaatcaaatatttaaagcattttgttaacgtaaaagtgagtcaagaaagggttacaaggccgggtgtggtggctcatgcctgtaatcccagtactttgggaggccgaggcggtcggatcgtggggtcaggaggtcgagaccagcctgatcaacatggtgaaaccccatatctactaaaaatacaatacaaacattagctgagtgtggtggtgggcgcctgtaatcccagctacttgggaggctgaggcagaggttgcagtgagccgagatcatgccattgcactccagcctgggtgacagagcgagactccatctaaaaaaaaaaaaaaaaaaaaaaaaggtctggtgcggtggctcacgcctgtaatcccagcacttcgggaggccgaggcaagcgtatcacgaggtcaggagatcgagatcatcctggctaacaggtgaaaccccgtccctactaaaaatacaaaaaattagctgggcatggtggcgggcacctgtagtcccagctactcgggaggctgaggcaggagaatggcgtgaactcaggagaaggagcttgcagtgagccgagatcacgccactgcactccatcctgagcaacagagcgagactgcgtttcaaaaaaaaaaagagggttaccagtaaaaaataagacagactgggcgtagtggctcacgcctataatcccaacactttgggaggccgaggcgggcggatcacctgaggttgggagtttgagatcagcctgaccaacatggagaaaccctgtttctactaaaaatacaaaattagccgggcatggtggtgcatgcctgtaatcccagctactcaggagtctgaggcaggagaatcgcttgaacctgggaggtggagattgcagtgagccgaggtctagtgccattacactccagcctgggcaacaagagtgaaactccgtctcagaaaaaataaataaaaataaaaaataagatactttgataaaatagaacaatgagaaccagaacaggctctttgaaattacaagtaagattgttcaatgttatagatacaatgtttagtgagaaacagaatgcttgttgcctggtgctgcaaagaaatagcactcaaaacataaatttaattctctcagcaaggccgtttttactttctgcagaaagggtgctcatcacagatggaacaatggcaagagcacacctgaacaaaggagggaagcaatttttattccttaggcagtttgtccctgctactgtgtcctgtctccgttggctggagccagcctgcacaatctaaactaaaactagattagctaacagtttaaaacttttctaaataggtaaaagtagtggaaagacgaaggaaaagaggaagttgcttatgccagatatggaaggagcataggctgtaagctggaacgtgaccatgagcatgtccagcacaaataacttggttaaggtacagggacatagaacgtactacgtgcctgtgagcatgtttaccagctacataggatagggcctaacaaagacttactagcacaaagcaaggaggtttcaaggaagttagtttataaaagaaactattattttttaacacttatgatttattctttaacaagaagggaaactttgaagaggaacttttactttccacattgaacaaataagtaagaaaaagaaagggaaacttccccagggctgaaaggaaattttcaggtcatgccattattatcagaattaataagacccatgcatcgtggaaaactgagaacaccacgactaaaaacagatggcaggctgggcgtggtggctcacgcctgtaatcccagctctttgggaggctgaggcaggcagatcacctgaagtcaagagtttgagaccagcctggccgacattgtgaaacctcatctctaataaaaattcaaaaattagccaggcatggtggcagccgcctataatcccagctattcaggaggctgaggcaggagaatcgcttgaactcgagaggtagaggttgcagtgagctaagattgtgccactgcactccagccttgggcgacaaagcgagactctgtctcaaaaaaaaacaaacaaaaaaaatgtcagggtcgggcatggtggctcacacctgtaatcccagctacttgggaggctgaggtaggagaattgcttgaacccaggaggtggaggttgcagtgagctaagattgtgccactgcactccagcgtgggcgacaaagcgagactctgtctcaaaaaaaaaaaaaaaaaaaaagatggcagggctggcatggtggctcacgcctgtaatcccagcactttgggagaccgaggcaggtggatcactctaggttaggagtttgagaccagcctggccaagatggtgaaaccctgtctctactaaagatacaaaaattagccaagtgtggtgataaatgcctgcaatcccagctactcaggaggctgacgcaggagtatcacttgaacctgggaggcagaggttgcaatgagtctagatcatgccactggactccagcctgggcgacagaatgagactctgtctcaaaacagagcaaatggcatggcagaaccttctctagagaaaatagttttgaatctaagaaaggaatagctttaatctagaaaaggaatagggcaagaaaaggaatgtttattcacccataacttaaaaaaaaaggtaattttaattgaaggcttcaaggtaaattgtgctcaaactatacaaattctgctagatggttatagttcctatgtgaaggtaactttagaaagtagtgttcacttgacactgatgtgagtaattcttgctggagggggcaaaaagctcatgaaatttgaataaaggaggaggagatgcagtcagattgttgattgacccttcagggaatggcatttgcatagctgtgacgtgaaccctaggtattggctttttttttctttttttttgagaaggagtctctgttgcccagtctggagtgcagtggcgcgatcttggctcactgtaacctccgcctcccgggttcaagcaattctcctgcctcagcctcctgagtagctgggattacaggcacgtgccaccacgcccagctaatttttgtatttttagtagacacagggtttcaccatgttggtcaggatggtctccaactcctcaccttgtgatccgcccaccttggcatcccaaagtgctgggattacagggatgagccattgcacccggcctgtattggcttttaatttttaggaagtaacacatggctgtgacctgacaacttcatagtggccgtagggtagggcactgttgtcattattcctgtcactgacaatgtcagccccacctgcagatgtgggagagtagatggggaaagtagtagtggagagtagaggtttcccttaccatccttttaggaagtaggcttttaaacatgatatgtaagtttatttagaagatgaaaattaaagcttgaaatgtaatatgagaggaattggcagcggatgtgagtcagatcctcacctgtcagagcaggaagttagtgaaaactaaagatgattggctggatgcggtggcttatgcctgtaatcccagcactttgggaggctgaggtgggtggatcacctgaggtcaggagtttgagaccagcctggccaacatggtgaaactctgtctctactaaaaatacaaagattagcccagcgtggtggtgggcacctgtaatcccagctactcaggaggctgaggcaggagaatcgtttgaacccaggaagtggaggttgcagtgagctgagattgcatcactgtgctccagcctgggcaacagagtcagactccgtctccaggaaaaaaaaaaaaaaaaagactaaagatgatcaaagattagaattacggaggtgtcctcaagaagaattggaacagatatggttaaaagtggctggaggtgggtgcagtggatatggtggtgcacacctgtaatcccagtgctttgggaggctgaggcaggtggatcacttgagcctaagagttggagaccagcctgggcaacatggcgagacctggtctctacaaaaaatacaaaaattagccgggcatagtagcacatacctgaagtcccagctactcaggaagctgagttgggaggattctttgaccccaggaggttgaggctgcagttagctgttattatatcactgcactccagcctatgtgacagtgtgagaccctatctcaaaaaaaaagtgatgtcgggaggctgagaggatgagtgactggggcaggagatgagtactttcccttttaagcccatagcatttaattccctggtggttcacttcttatttggataactaacaaattatttcaaatgtgtgcctataggtgagagaagcaatggtacatgaggaggtaagcatttgatttgtgggattatgaacaactgtcctactctccttttgattcggtgtctctgtattagtgatctgacaatttaaaaaatcaagcaagagcaggctgggcgcagtggctcatgcctgtaatcccagcactttgggaggccgaggcgggcggatcacttgaggtcaggagttgaagaccagcctggccgacatggtgaaaccctgtccccactaaaaatgcaaaaattatctgggcgtggtggtgggtgcctgtaatgccagctacttgggaggctgagcaggagaatcgctggaacccgggagttggagattgcaatgagccgagattgccccactacactctagcctgggcaacagagtgagactccttgacaggaaaaaaaaaaaaaaaaagcataaagaaaagatgtcagacttgtctgtttggccagtttgagtttatttcagcaggcagggcaggaaggttccttggcttcctagaatcccctggagttggatgggtgtggtggcttacacctgtaatcctaacagaccaaggcccaggtggaaggatcaactgaggccgtgagtttgagattagactgggcaacatggcaggactctgtctctgcaagaaataaaaaaccaggtgtggtggcacgcgcctgttgttccagctactcaggaggctgaggtgtgagatcacttgagcctgagaagttgaggctgcagtgagctgagattgcaccactgcattccagcctgggcaacagagtgagaccctgtttctttaaaaataaaaataaaaataatcccttggatttaaagggagtgggttagtccttgaagatttgattttccagaattcttatcaagaagaagttgaggcgggagaatcatgaggtcaggagttcaagaccagcctggccaacatggtgaaaccccgtctctactaaaagacgtggtggtgcgtgcctgtaaatccagctactcaggaggctgaggcaggagaattgcttgaaccgggacctgggaggcggaggttgcagtgagctgagatcgtgccactgcactccagcctgggctacagagcgagtctccttctcaaaaaaaaaaagaaaagaaaagaaaaaaaggccgggcgcggtggctcatgcctgtaatcccagcactttgggaggccgagttgggcagattgcaagttcaggaaatcgagaccatcctggctaacatggtgaaacccatctctactaaaattacaaaaattagccgggtgtggtggcgcatgcctgtaatcccagctacttgggaggctgaggcaggagaatcgcttgaacccaggaggcggaggttgcagtaagccaagatcgcaccattgtactccagcctgggcaacaagagcgaaactctgtctcaaaaaaaaaaagaagaaagaaaccaaaaaagtagaaaatcatattatcatatactttaatagcacaacaaaattacaaattaataattgtgggtattttagaatatatatgaaacagctatttggtcaaagaggaaataaaaatactacatctgtttaagtaaaaataagtactctgtatcaaatgatcaacatgaatacaaaataccaaagcttgcctaaagcctaggccgggaacgatggctcacgcctgtaatcccagcactttgggaggccaaggtgggcggatcaccaggtcaggagatagagacccgcctggccaacaggccgaaaccctgtctctactaaaaatacaaaaaattagccgggcgtggtggcgggtgtctgtaatcccagctatttgggaggatgaggcaggagaatcgcttgaacccgggaggtggagattgcagtgggccgagatcgtgtcactgcactccagcctgggcgacagagtgagactctgtctcaaaaaaaaaaaaaaaagcctattctgtagacaagtgtgtctcacgttttttgtctcaagaccccttcacactcttaaaagtcactgaagaccctaaacagtttttgttttgttttgttttcccccaagacagagtcttgctctgccgccaggctggagtgcagtggcgtggcctcagctcactgcaacctctgcctcccgggttcaagtgattctcctgcctcagcctcccgagtagctgggattacaggcgcatgccaccacacccggctaatttttgtatttttagtagagacggggtttccccatgttggccaggatggtctcgaactcttgatctcatggtctgcccacctccgcctcccaaagtgctgggattacaagtgtgagccaccgtgcccggctcctaaacagtttttgtttatgtaggtcctatcaatatttggtgtattaggaattaaaacggaaaaaaattaatatattttattaatataatttttcaaaatctattctatgttaatatataggttgagctgtgtctcttcccaaaattgatatgttgaagttctaacccatagtacctcagaccttatttggagacagtgtctttaaagagctgaaatgaggtcattagagtgagccctggtccattatgactgttgtccttataaaaacagaaatttggagacagacaacttgtcacgcatacagggaaaatgacatttgaagacaaagtcagacatctacaagccaaggaatgccagagattgccagcaaaccaccaaaaactaaggaaagggatggaacatatactttcttgtagccctcagaaggaaccaactatgccaacactttgatctcagacttctggcttccacaactgtaacaataaatttatgtcgtttaagccaccccatttgtggtatgttgttaccagagccctcatgactaatacaacatattttttaaaaagcacctactttacgaaaaacagcattttccaaaacagaaatagggagaagagtggcattgtattatattttttcaaatctccttaatgtctggcttcacttaaggcagttgagttcccatagctccatgttcccattgcatctgttacaatatgactcatccagcagcctctggaaaactctattgtatattcctatgaaaatgagagaggaatagcactgggtagtccaggagaatggaaaaacccaaacgacaactaaaacaagcagtaggcaaagaaaccacagaataacaaaacccaaaataagggagagaagacagccaaaaccctggtcagggtgacaggtccatgactcttccaggcaaacccaaataagggagaaagggggtggtaactggggtggggcagggggagggtggtgcctgaaatcccctccttttccagataccgaatgactattccacccataattaaacacccataaaatgagaaatgcaaacaatgttgggtgtgactcaggagccaggagcccccccacacttgtctcccgtgtttcctttcactttgcaatgaaagcttcttgcctttctgcttactctgacttatccctgaattctttcctgtgatggcttcaagaacctggacaccaactggcactggcatccggtgaccttcctgagccctctggcaacaaaagaaaaagccaacatctcattattattatgaatttagttttgaacccaccgatcccttgaaaggatctcaggaacgcccagggctccctgacccacactttaagaactactgcaatagacaaactcctaccttataatcaaggagataaacaagaactagaaaagaaaaaaaaaataggctgggcaccgtttttgtaattccagcactttgggaggccaaggcggatggactgcttgaaatcaggagctcaagaccatcctaggcaacatcacaaaaccctgtctctacaaaaaatacaaaaattagccaggcatggtagcatgaggctgaggtgggagaatcccttgagcccaagaggttgaagctgcagtgagctgtgatcacaccactgctctccagagtgggcaacaggtgagaccctgtctcaaaaaaaaaaaaaaaaaaaggaaagaggaaataataggacatcaaaatcacagattccacaccattagaactaggaggaaagctgagcccagtgactggctccaaaatgaatacacagggccgggtgcagtggcgcattcctgtaatcccagcactttcagaggctgaggcagataagattgctttgagctctggagttcaagaccagcctgggcaacatggcaaaatccagtctctacaaaaattggcccagtgtggtggctctcacctgtgctcccagctactcaggaggctaaggatgcaggatcacttgagcctgggaagtggaggttacaatgagccaagattgcagcactgcattccagcttggacaacagagtgagaccctgtctcaaaaaacaaataaacaacaaaaaaagaacacacaggtttcccctaaagagaatagatctttgcacacctgcccctacctctccaacactggtggccactgtgcaggggaaggcaatagatcctcctagtaccttctctgcctacagagaaggggatgctgcctgggagctttttgggactcccaatagaagacagatttagtctcctggaaggctgcctgatccagttcccacagcagctgccacttgctcaggtgagtgaagacatctgtcaaaagtcagaattttatttttattttattttatttttgagatggagtctcactctgtcgcccaggctggagtgcagtggcgcaatctcagctaatcgcaacctccgcctcccagtttcaagcgattctcctgcctcagcctcctgagtatctgggattacaggtgcccgccaccacacctggctaatttttgtatttgtattagagacaaggtttcaccatgttggccagggtggtctcaaactcctgacctcaggtgatccacccacctcagcctcccaaagtgctgggattcactcacaggcgtgagccaccacacccagccaaaagacagaattttaacaaatttggttaaagatcgaattggcttttatttgtgattcatgaatctgggcagcctccactctgcaaaacggaatgagagctcccacggggcaaatggtagaatagtggtttttgtaagatagagaaaaggctaattagttaacactaggttacttttcttgtaaggattaaagcagaggggacttccttattatgctgctcaggtagactggaaatctggtttgtttagggatctacctgcttaaagtatcagtctgattatgtggcatttagcctaagtgactctgtcttggtttggtctggtctcatgaggcctagagcaggagctcagtccaaaaccatgtcctctcataattttgtgtaacttgcctaacacctgctccttctcaggaacgaggcccagcaaaaagcagagacggtacagggccagaaggatctgagagagtgtggccagcttgagccctcaggagtcggccagaaggatctgagagagtgtggccagcttgagcccctcgggagtcagctcctccgtccccactggtaacgtcttcaccccttcaacacggtgtgaagggccatgtcatggttgatcttcagtccctcagactacaccatcagccccatgggggtgagcaaataacaagtaactatactgttccctgctatgtgtctggctcttggtaaaatttaaaaaagttaaaaattgttgtggtttgaatgcaacatttttgaatggaaatctgcttccccatttttcttttttaataactttttattttttttttgagacggagtcttgctctgtcacccaggctggagtgcagtggcctgacctcggctcacggcaacctccgcctcccaggttcaagcgattctcctgcctcagcctcccgagaagctgggactacaggtgcccgccaccacgccgggctaatttttgtatttttagtagagacggggtttcaccatattggccaggttggtctcgagctcctgacatcgtgatccacccgcctcgacttcccaaagtgctgggattataggcgttagccaccgcgcccgacctttaataaacattttaatggactacaacagacccacagaaaaagacacatcacaaagtgaacacccacagggagaagcaatagggctgtcagaggcattcgacccagagcgactccattttgagtgagggctaggaaaatgaggctgggctgcattcccagaaaagtaggtattcctaacctctagatgtttacggttaagggaacaaattaataatgggtactaaaacagacccagacttgggagtgtccagatatcccggtatctagagaacaaaggcattcctaattttgctttaaaaataatatcgattcttgaaaaatacagtaagaaaattaatcctttttcacaaacccttgtagcagagcacatctccccaaaatctatttttagcccaaatatacacaagcattgtacctagggtgcatacgttcctcttactttcaggaacgtcctactgtctatggggtagctgtttcacaactttactttctcaacaaacttgcttttactttgcactgcggactcgccctgaattttttcttgcgcgagatccaagaaccctcccttggggtctgaatcggacccctttcctgtaacacaaccaccgctcccagcctccccgcttccagccgctaagcccaaagtcttttatatgaacaaacctctaactcgtcctgtgactttgatgcgtgtgcgttttaggcaccggggagcagagggtaaagcggcgcagctccgggcctcctcccgcgcaagttcccgagaagagcaggtccggcccgcgcagacgtgcacggtccccagccattaggaggagcagacggtccccacccccacaatcagtcatctctcggggtccgcccttgcttcctgcccacgagtgaggcctctggttgcccgcaacctaaggggcatcgcagccccgagcaacaccgcccccaccagccttagctgagtgctcccattggccagaggccagcgggtgggggctcccattggccatcggccataatgcttccattggtcgaaggccagaccagcggagactcccattggccgagggctgtggttcgccgcacggcctactgggagttgtagtcgccgcgtcgccggtgcggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggtaacaataacaacaataacgacggcggcgggctccgggcaagcgtctcccgcgcagactgaccctttcacctcgcggcgcgatgagagcggcaccgctgttaatgcccttgacacgtggggaaactcagacgcgggtcggggcgtggtgaccgtcctggctggtcagagagggggccgggattccaaccaggcgcctggcccccgaatgcgcatgctccacgcggctctgtcctccccagggctggggtcggtcattcccgagagaatcgagcaggcccatctcctgcgttctgctccgccccgccgacacccttgcccattccaggaaggtctgtcctcgtgttgactgataacagtaattgtagcgttggccgggtgcccagatggcaagaatcatcgaatagagatgctttaacgcgtggagtcagcggacacccaccgggaccccagcaccgcggagcccctgccctggggcttgggcacaacctcttgggggcaatgatgggtcaccacgcactgagtgtgatgagagtgaccaccagggtcgtcccctgcgagactgtgggagaactgcagtgcagggcggtcagtgtttgcagggccatctggccatcagagctccactttctagacaaagtggttgcggcctgtgttctccataaagctgcctcgcgtggcaggaaacaacaataattatccttcctcaagctctgcaactttgaaattatacttttttttattttttgtcgttggtttgttcatggggatttgcattatttcagatttggtacacaaagtgagacttgataatcttaggttgcaggttttcagatgtgtgttgctccaaatttgcatgaaatgctaccacgttttattttgttcttgctgtggatgggggacaaggaatgagtcgtaagaaaggcttgagagaaagtgtattagttacctgttgctgtgtaactcaaaacttcgtgacctggaacaacaataaatatctcacgagttctgacaggagtaatggaatgtcctagctggtggttctggttcaggcccatgaagttacagtgaagatgtcagcatagctgttgtcacctgagacctgagtctggaggatccacctccaggatggctcactcacatgtctgttgataggagacctcagttgttctccatgtaggcctctctttggaactgctagggatccttgcaacatggcatctggcttcccacagaacaagtgatccaggagagggcaaggtagaaactgtaacaccttccatgacctggattcagaattcacactcttgtcacttccacggtgtcttactggttacaaagtcaaccttgttgagtgttggaggggaccacaccagggctggaggtcattggcagaggtggtgggggagcatcttggagactgtccatcacaggagacaaggaccagaatggagagcttcaaggtccagtgttttatctggttatctgtgtctgctgtaacaattcactacaaattttgtggcttaaaacatttgttcttaggttctggaggtcagaagtctgaaatcggttttctggtctggaatcaaggtatgagcagagctaccctccctaccaaggttctagggtagaatgtttcctcgtcttttccagctgtgagaggtacagaccttctattccttgcctcatggccctttgcctgtcttcaaagcctgcattgtagcatgttgcttcagtgatcatattgccttatgtcttctatagtcatagctccctttgtctacctcttataaagacacttgtgattgcatttagggcccacctggataatccaggataatttttctgtttgaaaatcctaatcacatctgcacagttccttttaccatatatagtaatattcacaggttctaggaactaggacctggatatccttggaggccattatatatctcagtctaccatagccaggctgagaggagccatccagtattcagtgatgagaaggagccattcacgtgttttaagcaggactggcatagggttgaaaaaatccacttatgcattaggggctggtgggaagggagatactggcagctcaactaaggcagtgggaaaaagagaggagtggttaggcccagtgaccaggtgttggctgatgctggggtgaaaagaatatgtaaaggagaaacatcagagcacagccccaccccttcaggctccagaagtgcaagacaagagggaaggctgcagggatctgatgtagggcagaaagaacatcatgagacaacaaggagtgggcttctgctagaattccaagaaggaagccaagaggaggcatgaaggacttgtatgatgccactgagaattctcatggcttggacagaccagtactcagtggacgtggtgtctaggctgtcaccagtgactcttgcagaatgggtgatgatgggaggtgggggcaggaggcacgggaagcacaaatcaaaattggtgggcattctgagtggaggaaagcgaagacacagagacaggagcagagacctcagttcccaaccaaaggcatctttctgtatgtttcctattagagccacctgctacctgtactaaaatttctttcttattttttaatctactcatgtttttcttaaaaggaaatgtccttttaaaattgaagtatttggggcctggtgcagtggctcatgcctgtaatcccagcactttgagaggccacagcagatggatcacttcaggttaggagttcaagaccagcctggccaacgtggtgcaaccccatctctactaaaagtacaaaaattagctgggtttggtggcacatgcctgtaatcccagttatttgggaagctgaggtgggagaatcacatgaaccagggagatggaggtcgcagtgaaccgagattgcaccactgcactgcagcctggtcaacagagtgaggccctgtctcaaaataaaaaataaaaaaattgaagtatttagtatatgtggttttgttttgttttttaacctagcagcaacactggtggtgtatagttttgatttttcatttccctgatgactaatgatgttgaacatcttttcatgtacttatttgccatttgtgtatcttcttttatatattcttcaaagaaataactatacagattctttgcctattttaactgggttgtctttttattactgagttgtatgtgttcattacatattctagatacaagtctcttatcagatatgtgattcccaattattatctcccattctgtgagttgtcttttcactttcttgctaatgtcctttgaactacaaaagtttttgttttgatgaagtccaattgattacatttagttgcttatccttttggtttcatatctaagaatcccttgccaaatccaaggttacaaagatttatctctctgttttcctctaagagttttatagttttagctcttacttttaatttaatttaatttttttttttttgagatggagtctcactgtgtcgcccaggctggagtgcaatggcatgatctcggctcactgcaacctctgcctcctgggttcaagcaattctcctgcctcagcctcccaagtagctgggactacaggagcacgctgccacgcccggctaatttttgatattttagtagagatggtgtttcaccatgttgcccaggctagtcacgaactcctgagctcaggcaatccactcgtctcagcctcccaaagtgctgggattacaggcgtgagccactgcgcccagcctcttacatttatggctttgtttctattttattttatttcttttttttctcttcttttttttttctttgagacaggatgtcactctggttgcttaggctggagtgcggtggcatgatcttggcttgctgcaacctccactttccagactcaagcactcctcctacatcagcctcccaagtagctgggactacaggcagcctggctaatttttttcaaattttttttgtagaggcagggttttaccatgttgcccaggccagtcttgatctcctggactcgagtgatctgcctgcctcagcctcacaaagtgctgggattacaagcatgagccactctgcccagccagcctaatttgttttgagttaatttttatatatgatataagatagaagtctgtgttagtttgaatgtgtctcccaaatttcatgtgttgatagtatttgaaggtggcgacttttgggagaaatttaggattagataaggttatcaggattggactcccttgatgggactagtggctttagaaggagagagagacctgagctggcacactcttgccctctcgccatgtgatgccctccaccatcttatgtcataacaagaaggccctcaccagatgccagtaccatgatattagacttcccagccttcagaactgtaagaaataaactcttttttttttttttttttgagtcggagtctcactctgttgcccaggctggagtgcagtggcgcaatcttgactcactgcaagctctgcctcccgggttcacaccattctcctgcctcagcctcccatgtagctggaactacagacgcccaccaccacgctcggctaattttttgtatttttagtagagacagggtttcatcgtgttagccaggatggtctcgatctcctgacctcgtgatctgcccgcctcggcctcccaaagtgctgggattacaggcatgagccaccgctcccagcccacaaataaactgtcttcatcaaagttattgaaagagagagagagaaaaaaagcaactttctttataaattacttcgtccttaggaggacaaggcgagaggatcacttgaggtcaggagttcgacaccagcctggccaacatggagaaaccctgtctctactaaaaaatacaaaaattagctgggtgtggtggcgtgcacctgtagtcctagctactcaggaggctgagccaggagaatcaactgaatccgggaggcagaggttgcagtgagccaagattgtgccactgcactccagcctgattgacagagtgagactcccatctcgagaaaaaaaaaataataaattattcagtctgtgatattctgttacagcaacagaaaatatgctgggacagggactatctttactcttttccatgtggctatccagatgtcctgtaggaagtgtttgtaaaccacttaatcattatacagcccccaaggggtgatgctttgttgacatggaaactgggaagcaaagatgcttcttggggacgaagtgactgagccaagactctgatccagaaatatctggctttcaagcatggctgcagaagggctttgtttatgggacacattttaggtaatgttgcatcaacttataaaaatcagaatttttcacgtaaaggccaggcgcggcggctcccgcctgtaatcccagcactttgggaggccgaggcgggtggatcacttgaggctaggggttcgagaccaacctggccaacatggtaaaaccccatctctactaaaaatacaaaaattagccgggcgtggtggtgcgctcctgtagtcccagctactacggaggctggggcaggagaatcacttgaacctgggaggcagaggttgcagtaagtggaggtggcaccactgcactccagcctgggtgacagagcaagactctacctcaaaaagaaaaataatttttcacataaaaatctgacctaattttcagcttctcttcagagatgagcagttctgacaaagggacctgtattttcccgtaatcagtgagttctgagtccctgctgctccttcagacagggtccatgctccccatcacctccagtcccaccactcataggtaagtgtccttgtgggctcttaaactggcccacttctgtcatgtgagcctgccttgccctgaaagcaggcgaatttctgaccccagccctgtgtgcttctcttttcaggaaggatggtgaacctgtttttttgttttttttttttgagatggagtctcactctgtcgcctcagctggagtgcagtggtgtcttggctcactgcaacctccacctcctgggctcaagcgattctgctgcctcagcttcccaagtagctgggattacaggcatgtggcccagccaatttcactttgtatctaagtattagtgagtgtattagttagctgctgtgtaacactgtcctaaaacagtatctgttttacttaaaacagtaactgtttctttagctcacaaacctgcaaataagtggtttaggccagtctctgctggtaccctcgtctgtcttgttagatgtaggtcagctctgcctggcgttgttgatcttggtgagtcctctcacatgtcctcactgtacaacccacacctatgtgtagtggcctaataggtgcccagtgagacctgactcccatcattcataacgtgcagtctctcgtgacacaggcctgcctgttttctccttttccattcttcctctgccagaaagcactgatggagatagtccagctgattgagaatgtgtgtgatgtttcaggaaccagtgaccttccgggatgtggctgtggactttacccaggaggaatgggggcagctggaccctacccagaggatcctctaccgtgacgtgatgctggagacctttggtcacctgctctccataggtaagccctgcttcgcaaggtgtgatagctgattctctctgggttataagtcatggggcctctggtgtgaggacctgaccttgggtcctcactccctatggggagtgcatgaagagggaggtctgcccttttccatcaccatgcagagcttcaccatgttgtgaggtgcccacgtgtcctcacagtcgggagtctggtctggagcctgggcttgttgtttctctcctgagcagcccctcacctcctgtgtttttccccatttccaggtcctgagcttccgaagcctgaagtcatctcccagctggagcaagggaccgagctatgggtggctgagagaggaaccacccagggctgccatccaggtgagaacccactatgtgggagcagctaatgggagcagcctagcaggtcactggagatgcacttcatggaaagggtggtggttggtggtcctgaagaccaccccattcactaggagtatacaggactcagcatagagtcatgctgacagctctcagtataatgagaccaacaaaggggaaaggcgcgtggggataagttcagaggaagccaggcatgagcctccagagtcccctcactgtggagtcattcaggatgtgccaggctcccccagcactcaggtgtgacacctcatgagacatgagctctaccagggaatcttgttaagagactcagtgctaggagttttgactgaggctgccacatagacactctctgcctagcacagaccaaggttccagactaccaggagaaagccagtgtttggaataaaccacatagtgtgtgcagtgtgggtgtagtaaaccactctcatcagttagggttgtgggaaccatccccaaatccaaattctcagttgcagccaaaggctaaccttgtgaataggcttctcctaagaatgctggtttcaggcctgccctgttaaatcttttctgcacagtgctccatagccttctcacctgtgctccccatcttctaagctcagaggtcatcacctgtgctccagtgctgagaatcccaccccttcctccctctctgcttcatcttcccttataggttccaggtcattccctctctcaccatccttctcagcatgtcctttctgtggcatcatttctaatatgtgaacctgcccttcatcttctccatttcattcttgcatgtccagattctttgtgttttgttttgtttttaagacagggtctcactctatcgcctaggctggagtgcagtggcgtaatcacggttcactgcagccttgacctccctagttcaaatgatcctcccacctcaccctcccgagtagctgggattacagacatgcaccaccacgccctggtaatttttgtatttttagtagagatgggattttgccatcttgccaggctgggctcgaactcctgggctcaagcaatccacctactttggcctcccaaagtgctgggactacaggcgtgagccaccatgcccagcttttttttttttttttttgagaccgtctctgttgcataagctggagtggcagcagtgtgatcatggctcagtgcagcctcagccttcctgtcacaaatgatcctcctgcttcagcctcttgagtagctgggactacaggtgtgtacccccacacctggctaattttctttttaaatttttttgtagagacacagttgcactgtgttgcccaggctggtctcaaactcctgggctcaagcaatcctcctgtcttggcctctcaaagtgctgggattacaggtatcagccactgcacctggcctttttttttttttttttttttttgagacagtctcactccgttgcacaggctggagtacagttgcattatcttagtctcctaggctcaagtgttccacctacctcagtctccctagtagctgttactacaggtgtgtaccaccatgtccagctgatttttttgatttttttctttttcttttttaaaaattattttactttttttctttttttttctttctttcttccttttttttttttttttagagatggggtctcgccatcttgtccaggctgcaggctgctcaaactaactcctgggctcaagcaatcctgcctcaacctcctaagtgctgggattataggcgtaagccactatgcctgactttttgtttgtttgtgtgtccttttttttttttttttaatagagatgagatctttctacactgcccaggctggtctcaaactcctgagctcaaacagtcctcctgcctcagccactgaaagtgctgggattacaggtgtgagccactgtacctggtcacatgtctagattctgtaaacttgttccccacacccttctttattctcttatgaggaagaattgtgtttagctataaataccctaaaaccaggttggagcagctcaaaataaagaagcatttttcttgtaaaacaggagccctgagtctgctggtactgtcttggcatctcagaggtgccagggctgattgttctgtgattttcccaggctgtccttgggattacagtgcagctgcagcagctccagccatcacagttgtgctccatgcaggaaggaggggaagaggtaggaagaattctgccagccacatctgtccccttttggcagaactctagatgtcacctgctggggtctctttagccagaactaggtcacctcctcttgcactgaccctagttgctagagaggctggaaagctaggggtgtctagattgtcataattggcttgggcgagtcatggtccccttgctgtggcttgtgtgttggtaccctgaccacattctagagtaaatagcatctggccatgggatgtacaaccagcaatgcctgcagattagcctcccacccaaatacttctgatgccacccagggctttctgattctgcagaaaaacacatatgcccccatgatagcgtatgacctatcaac

SEQ ID NO: 574 - DNA, 29375 bp, Homo sapiens
gccaagaaaaggctgcattgcgctctagtcctaacccttacccctgcccaaccctcctctccctccagcagctcctgtgggatccagccccagccccaggggccagcctggcactcactgatcttctccagcttctgatcgccatccttgaacagggcaaaggtggccatcgccagccttcgatgcagctgccagtgtgcgccagagtcagcgaaggcgatacccttacggttgttggacgcgatgtctagagttgcctttagagagcaggcaaggctgtaggaatctcacaccatccaccccactcttgcccttacacctctggtccctgctttccttcctggaggagaaggcaggtacctggcatgctgactcccatgtgggcacagccccactgcactccaccatgactgcaaggacttggtaggacagaccctaaggcctcctactcccaattccttcagaaatacagtagatcaaggagaaagaaagaacccttaattagaatgcagcagcattggggttcttttcgctgacagggtgccctctgggcttctttttgctcatcagtttctgaccacaggaaggcaactctggatgggataaactctctaaactatgcctgtccagagggtagggagcaggtgagcttgtagaggctgaggactgcacagatctctgcttttccctgagcccttagctgagctaaaggcacagctcacctcactcaggtttacccttccattgcaagcctgcatacccagccacaagcccacatttggagagtgcagatgttttgtctacccagtctggacttgggccgagccgcctcctcctagaggtgccccccaaagcaaaagggtccaaagcctcccttttccatttcctgaccctgaagatccacatgactagccttctccatcttctctgcccccgggaggaagccagcagaggtgggagctaggtagttggtcagcagacctggctgattggtccaagaaaaaataaaccaacccttggcttgatcaaagctgagaggctggcagggcacagtggcttacgcctataatcctagcactttgggaggctaaggtgggaggatcacgaggtcaggagatcgagaccatcctggctaacatggtgaaacaccatctctactaaaaatacaaaaaattagcgggcatggtggcatgctcctgtagtcccaggtactcaggaggctgaggcaggagaatcacttgaacccgggaggcagaggttgcagtgagctgagattggccactgcactccaggctgggcgacagagagagactctgtctcaaaaaaaaaaaaaaaaaaaaaaaatgctgagaggctgggggccctgctgagtgggaggctcatcagcaaccctgaaatgtcattgtagaaaactgcccctgtgagcctgagtagctggaaatagcaccaggaaagcagcaatcccagcctgcaatagctaggctaattctccccagcagctttcatggaggacagtagtcactgcccccattttccatgaaaagtaacatgaatcctggctgtataaggggcacttactgtgctgggtgctaggctaagtgctgtacatgcaccttctcagtccattagagaagtctaggctcagagagaggagtggagtgaggattccttgacccctcagaccactgtggtcctcccatcccacctcctgggcagcctggtagaggagacattcctttaattcttcctgcctaatttagaggctgggtgggggtctgaaggttcactcccttcacatcatcccactagtctactttgggaagaattacaggttgttggagctggaagccccattctaggcatggtctgaagacctgaacaatcccagggggtggtgaagggggcagggaggagatgggcaccacttaccatttgaggccgcccagagaagtccttgcccttcttaataagcacctccttggccagctggtggtggccgacaatcactgtagtcttggtgcccatacgaaccgaatagatggggccatattttttctgcagcttgaagaagttgttatgcatatggccgtgtctggggaggaatggcaggctgcccaccaggggcagggacaggaggctcttggggtacttggcaccagggcaccttctcttgggccaaaacaaataagctagggtaagcagcaagagagccacgagctcccacatggtggctgggtgccggcaggcaagatagacagcagtggagtagaagagctgtggcaactctagggcacaaggaggccttttaaagggctaccctgatcttcaccttgactttgtgttatctcttgccttgtggaaagattctcctggagcccagccaggcctgagctcatatccagaagggagagaggcggtgggagtgaaggcctcctcaagggctggctcaactccagggcaaacctccggaggaggagctaggtaagggaggtcagttgatcaccctctgaggagctccccatgcttgaatgactccagagtgcgaatggtatctgggctcaggagtcaaggcttggaactttccatgttgcaaaatcaaaatcactggacagatgacagattcaggagggtcacaagtagcagggactgttaaaggtcttttatgcttctttttttttttttcagagtcttgctccatcaccaggctggtgtgcagtggtgtgactgtccatgcagccctggccctccagcccatgtggttttggcagcgataagggctgtgggttaatggtccccaaaataaaaatgtacatgtgtatgggaacgaaaggggtgctaagctgtggggagcggtggaagggaagggagagataggtcagtactaggaatgccagaggtgggaggccgtttcataacatttcttgttgatcaaaatgccatcaacaccttctttgctcatcagcaggactagcgtactgggggaacccacccccaatatttcaacgtaggttctttctataagtgtcagccggctgagaaataaagagagacagtataaagagaggaattttacagctgggccgccgggggtggcatcacatatcggtaggactgtgatacccacctgagcctcaaaccagcaagtttttattaagggtttcaaaaaggggagggggtgtaagaacagggagtaggtacaaagatcacatgcttcaaagggcgaaaagcagaactactaataagtgtctaacaaagatcacatgcttctgagggaaaggacaaagggcaaaagcagaactaccgataagggtccaacaaagatcacaaggcaaagggcaaaagcagaaccactgataagggtccaacaaagatcacaaggcaaagggcaaaagcagaactacagatgagggtctatgttcagcggtgcacatactgtcttgataaacaccttaaacaacagcaaacagggttcgacagcagagaaccggtctgaccacaaatttaccagggcggagtttttccccaccctagtaagcctgagggtactgcaggagaccagggcgtatctcagtccttatctcaactgcacaagatagacattcccagagcggctgtttatagacctccccccaggaatgcattcctttcccagggtattaataataatactccttgctaggaaaagaatttagtgatatcttccctacttgcatgtccatttatagcctctctcaagaaggaaaatatggctctttctgcccgaccctgcaggcagtcagaccttatggttgttttcccttgttccctaaaaattgctcttattctgttctttttcaaggtgcactaatttcatattgttcaaacacatgtcttacaatcaatttgtacagttaacacaattatcacagtggtcctgaagtgacaaacatcctcagcttacaaagataacaggattaagagattaaagtaaagacaggcataagaaattataaaagtattatttgggaactgataaatgtccatattaaaatgaaatcttcacaatttatgttcctctgccatggctccagccagtccctccattcagggtccctgacttcccgcaacatctctccctttctttttatataaatgtgccgtggcgatgaaggcttgctcgttctctcggttttgatgcaggattctttgactggtctggcacactaaaaacaagccgattaaacagagaaacatgattccaaaatttcctacagtggagcccccagtagacttaatccaagttgtggagtttagtccagaaagactttctgccacctgatctaacgcctcagctccaggcacaatggataaatgagcttgagaggcttcaaaaatttgtttctttaatttagttatgtccaaggataaattatcttccctacccagaaggtgtcctttgaccatttcccatgatcagtctcgttgtaggaatatggtgtgctatagaaatcagaagtgttgcaatcgaactgcatttgcatgtgatgttcgagactcattagctggtccccaagccaaataacagactgtcttaaatcattagctaatttttgatcaatgccttgttgaggattccacatttgggtggaattgccttaccaatcattaacaaaattagccatttgaatagattggtgtaatgccactccggcagtggtggccagtgcagtgactgtaattaggcccatgatcacagtgattaaagtgaaaacaaatctcttgatcttttgagaattcgttgtaacacttcattaattaaatgtactgagggggaagattcccaagttctgggtaaagttactggtatccagattccttctcaagctcgaaccaacattacacttttcctgagtcaaaacgggagttaacacaagtggataaatgacaattaatgcattggacggtttgattgttcatccaaattttgatatttcccactaacagcatgtaaggaggcttaacacaactctgtataatagtcaggctggaggtaaacaaagcagaatgtttgaatctacgttgataccgagggggaggagtggcggtggcaacgcccaatgtttgatgccgtaaagaagcaatccgaggtgcccggggattctgaagaggtagggggacatacctgggtccagaagaattatcataatgccaatcagagtcccataaaggaggactggcatcaaaaagaggaaaatggtccaaaggggatttatcatgggtttcagaatcacggatgtgaggggtggtagtggggacaacagaaagaaaagtttccccttcccatactcgcagtctggacatggcaatagccaatttccaaagttctgggtgttctgggctcagaatgggggatatcataagaggcctcgggtggcagggggtaatgctcttatcttcccattttaagggacagaatgagctgaacctcctatgcaaagtaggatgatgatcctcgtcctcccaataagaaataaaacaagtagcctccaggcattcccttccagcagaagagcaactgcttttcaaatagccctttggtgcccagtctcttactaaaccatatgagtcattttttaatagtactgcatgtgaattaacacaatcttcccaaattaaagatttagatgggccctcaaaaattttaggacatggttttcctacaggtttatattgaaagtagggggtatctcctattactccccctttcatttgtcttaaaggagaaagggagaggctggagaccaaatgtccccgttcccctgtggctgatctctccagaaggtacgcagcccagacttgagtttctagatggatacaacaaggtgcatgtccgaggcacagaggagggtatttataaccgtaggaacattaaatgcagtgccttcttttcctggttgagtggggcaacggtcatctgtagctccaggcatccacacactatcattagtatagatttccgcaggagcatccatccaggtgagaggttgaataagtggaggaaaaggcacataagcccagcaagaataattttgtgtagcaggtaaatcaatgtgaggggaaactggtgagacagaaagtataaggaagagaattattaaataaaacctattgtaagcaagatccagtgctgaaggaggaatagaagaataaggggatgttattttcaggctaatagaaatggtgagatttttaggttcgtaaggagaaaaagaaagggaattaggagaagtgggattagttagaggggtttctgttgccattagggaggattgaaccagacccattttgatttggcgtgccagtttctgaggagttggcacagatctcaccaggtatgagggtggtctctgacgtggacgtctcttccctgtggtttttattgtcagtattcacatgaagtttaagtcttctagtgggcacccagacaggggattgatgatctcctggtgaaacacaagcataccctcttccccatgttataatcgttccaggtttccaggtattggtctgggaattaaaggcaaagaattaggtagtaaatttagaggaatggtactacagagattgaccgcccctccccttactctggagcatagataagcgttgtactgagacagaagaagaggctgggacacatctgggttggctgtaggtaaatttgtttgtgctgggggctgcgttgggaccgattgaagcagaaaggcaacattcgtctgagtctgaggtgtcccatttgaaattggggcctaggactggccccatttcccatttccctggttctgtggcaagggatttccatctatatcagacttagagtggcaagtacttgcccaatgtttacctttacaacaacaagggcaaacagtagcaggagcatttggctgtgttttttgagccggcttggctgcctttaagtttttaactgtgcaattttttcgagtatgaccaagttgaccacaattatagcaggctccaagaaaagaatcagtcgagccagtttgattgccgtccttcatggcccgtgcccacagaatagctttgtgggcacagaatagctttgtgtctgatccaatgccttcatatttaatatactcaggcaacacctcacgatcaggtaaattttgttgttggacggaatgcatggccattttacactcatggttcgcattctcaaaagctaacattcgaagaagaataccttgagcgtgctcatcagagacagatttttcaacagcatcttgtaatttagctaaaaaatcaggatataattcattgtgaccctgtttaacagtagtaaaagaaacaggagcttggcctggggcgcgtaatttatcccaagctctcatacacacctttgttacttgttccacggtgagagcatcaaagcctaattgggcagtagtgtcagagtaattattggagcctgtgagctgagcctgagtaattagaatgccatcagcccgatttagctgagcctgcagatgggcctcccgtgaccaccaggtacagaattgtaaatgttgagatggagttagaacagcttttgccaaaagtcccagtctaaaggaagcaaaatgacctcagtacaaagagtctgtaataccattttaacatatggagaagtaggaccatactgagtacaagcatccttgaattcttttaaaaaggtaagattgagcagcgcctatcgatgcacttgtaccccttgagcattgcaaggttccagcatgaacggataagcccacgcctctaatccacttgtttgttttggcgtaataagcattgcatggaaatttcaacaacaggcacatgagacagagttggcacagaagtgacaggaaaattatgtgtagataagggaaactgaggctgaggaggttggaccagtatgagagcgtgagaaaggggcaccagaggagcagaagaggcagaagcatactggtgattattgcccaatcctgtgcaaccagagtggcaggggtgtccacatgtgaagaagggtacagagaagcaggttgagtggatggcaaagtgaccagttgaggaaccgaaatgacaggagggtgaggggctgtggtggatgggggagggcctgcagaattacaggtaaattgtagtttagttccggagccattagatggctccggaggcaaaggctgcaaaggtttgaagagggaagagttagcatagatacagtcctgggctgtccaagtcggggccgtgggagctacaagtactggctgttcgtgaaaagaaataagatcatcagggggtgacgttaagccaaagtcactggagttagatattgaatcttcaatatcctcaggtggggaaggagtaggcgaagggagaggctgatcaggtaacgaaggccgtgcgggagaggaaggttgaggaagaggtggagggtttccagattcagaaaactgtggtaactgcagggggtgatgggattggtatgtcattaggacggcacataccaaggcccagtcaccccaaacagtgacgggaacataatttcctgttgggaccagttcccggaattttgcaccaacacgatcccatagttccacgtctaatgttcccttttcaggaaacaaaggacaatgttcttccactgccctgaatagggtgaccatattttccatgggtacccaaactcccccctgttttaacaggagtttaatatggcagagataagcataatgtttagactctgagtgacccaaagttagcctggacaatacacagacaacttaccaatcatcagagagctgaacaagcatttctgtggaccagaccaatgaacgtttctccgcacctaccaaagggaatcaggttcccacatgcaattaggagaaagaaaaccacattggtgtgccagatattgggggaaccagcccccaatatttcaacataggttctttctattttccataagtgtcggctggctgagaaataaagagagacagtataaagagaggaattttacagctaggccaccgggggtggcatcacatatcagtaggactgtgatgcccgcctgagcctcaaaccagcaagtttttattaagggtttcaaaaaggggagggggtgtaagaacagggagtaggtacaaagatcacatgcttcaaagggcaaaaagcagaactactaatatgggtctaacaaagatcacatgcttctcagggaacaggacaaagggcaaaagcagaaccactgataagggtccaacaaagatcacaaggcaaagggcaaaagcagaactacagatgagggtctatgttcagcggtgcacatattgtcttgagaaacatcttaaacaacagaaaacagggttcgagagcagagaaccagtctgaccacaaatttaccagggcagagtttttccccaccctagtaagcctgagggtactgcaggagaccagggcatatctcagtccttatctcaactgtacaagacagacattcccagagtggccgtttatagacctccccggaggaatgcattcctttcacagggtattaatattaatattccttgctaggaaaagaatttagcaatatctttcctacttgcacgtccatttatatcctctctgcaagaaagaaaatatggctctttttgcccgaccccacaggcagtcagaccttatggttgtcttcccttgttccctaaaaatcgctattattctgttctttttcaaggtgcactgatttcatattgttcaaacacacatgttttacaatcaatttgtacagttaacacaattatcacagtggtcctgaggtgacatacaccctcagcttatgaagataacaggattaagagattaaagacaggcataagaaattataaaagtattatttgggaactgataaatgtccatattaaaatgaaatcttcacaatttctgttcctctgccatgcctccagcccatccctccatttgggtccctgacttcctacaacactagcatcctagcagtcatggtgacagtgacattgaaggtgggggctccatcggtgctcttggtataaagataggtcagttccccatcctgcagcagtaggtcccagatcacagaacatttctggcccccaagtgtcacctcattcacaaaaaaacttgaccagtctttgccaaccaggacatcaacctcagctggcttgacgttgatgaaggttttcccagggatggtggcctggatggaaggcaagtccttgtagcccacgatggctgcatcctacaggtcccttccaccacgaggttgtcgatgtgggtgttccaccctgccgtgggctgcttgtggcactgctgccacctcgcagacaggcaggggaggcggagagctcagggcatgcactgtggtcgggaccactgctctgctatccgtgcagaagcccttgtactgccacttcctggaagtgatcattttaagcatttatatggcatcaatctttttcactgtattgatccaaatgatttcaagcataagagaatggacagatcggttttgtttgtttacaaaaaggaaaatggggccagtcatggccaaggttaacaaaacaaagggcaaagcttaactggcttagtgtggactccaatcattggaaagactgggaagatggttcagatgaagccatgtctgattttgattatttctctgagatgatgaaccacatgggtggtgaagaggatgtagatttagcagatggagcagatgatcattcacaagacagtgatgatgaaaaaatgccagatctggagtaaggaatattgtcatcatctggattttgagaaagaaaaataacttctctgcaagatttcataattgagagaattcctggccgggcatggtggctcacgcctgtaatcccagcactttgggaggctgacgccagcagatcacaaggtcaggagatcgagaccatcctggctaacacggtgaaactccgtctctactaaaagtacaaaaaattagccgggcgtggtggcgggcacctgtagtcccagctactccggagactgaggcaggagaatggtgtgaacctgggaggcagagcttgtagtgagccgagattgcaccactgcactccagcctgggtgacagagcaagactccatctcaaaaaaaaaaaaaaaaaaaaaaaaattgagagaattcctgagttgatagctctaaagacagatgctgtatttgcctactttaatctatttttcaacctgtttgttttttaaaaggcctcactaagggttgatatgtaccactgtatggggcaattttcagtcagctaaggcaataaccttatgcctgaacatttcccagacttccatgaagctgttgaagtcctaggcaattgatgcagcagttgtgataaatacaaacatctcacctaagtctccttttcttcataacatacatactgacatgatagaaagctctcagcttagggaaagagaactaaattttagattataggacatggattcaaaagtgactggaacaaattggctgacaccttactggtaacctgttattcctcttgtgttattcttcaggattgttccactaaagcttatttcaaaaaatttacctctcgggctgggcgcagtggcccacgcctataatcccagcactttgggaggccaatgcaggtggatcacatgaggccaggagttcaagaccagcctgactgacacgccaaaaccccatctctactaaaaatacacaaattagctggtcatggtggcgtgcatctgcaatcccagctacttgggaggctgaggcaggagaatcgcttgaacccgggaggtacaggttgcagtgagctgagatcatgccactgcactccagcctggatgacagagtgagactctcaaaaaaaaaattttttttatattaccagatgaaatcacagccccaaggtagcagacattcttggtgtcaatcattatagaagagatgggccaaacaggagttgttagttgaggctcacagaggtgggagatggcatctgatggcatctgtcccactctctgggagtggtctgtctgcaagtttagtaaggatggagtgaaggctgctggaattaggcaggaaggcagcaggtagggggcctcatgatgaagaagagctggccaggcctcataagccagactgcctggttgcccattactcagaattttcaaatgttgttcagatttttaaggccatttgcagccagaggtatgggctgggatgaaacctatgagaaaccttcatgcaagaaaggggatttgaggtaggccttgaaggagagctaggactgatgcaggacagacagacaggcaaacctctaaactggggcttagcccaggagggttcttggcttcacccaggaaagaattccagggcaagctggtggtggtagccagcaagcagcagcgcacagagcagaagaggtactgctcctcgtggagcagggctacccaggggcagtgcccccaaagtcacagctcagaggcagagctgcactcacatttacagtcacttttaattatatgcaaattaaggggtggtttatgtagaaatttctaggatgaggtagtaattttcaggccatcaagttattgccatggaaaggggtgttaatatccgggtgttgccaaggcaatggtaaagtgacatggcacactggtgggtgggtcttatggaaagctgcttctgccctggacctggttttttgttttgttttgttttgtttttttttgagatggaacctcactttgttggctcactgcaacctccacctcccatgtgcaagcgattctcatgcctcggcctcccaagcaggtgggactacaggcacccaccaccacactggctaatttttgtattttagtagagatggggtttcaccatgttgactagggtgatcttgaactcctgagctcaggcaatctgcctgcatcagcctcccaaagtgctaggattacaggtgtgagccactgtgcccggcctgccctagatctgtttaactggtcctcaatttggtcaggtgtctgagccctgcctccagagtaaggttcaccttcctgagtccagtcctacctcctacctcagaactgttaggtagagatgtgaaggagtagggagagaagggtgttgctggaagggagagtagcagaggctggaaggagcatggcaggaggggaatggtgatggccttagctgaagagacaaagaggtgtgttgtgggggatccctgagaaagatctgaggggtacattgtgtcaggctctggagccctggaatggaagggtataaagggtatagggaggctgtaggagctattgagagcactgcagcagggagcagcaaggtgacagtggtgttttaggagggtgaaactggtgttggtgcatggggtaggctggatgaggagatcgtgtgtaaagcctgagagctggactgacaagtggagaggcctgaatcctaagatccaggcaggggcctcagtcgggtcaaccagctggtagggaaatatgaatggctactttctactcctacagagactgccaagctgacctgatatttcaccccaatcagaaacaagaaatgggaatttaaaacacacacacacacaaaatgtgttgcttcacactctcatcaccatattataaaagttatacatcataattgcagaaatttggaaaacacaaattactaaaactaaatatttttaaactgtattttttaacctaaatgaggctgtatttttggcatgaatatttttctataactttcctattattatttctctttcttctctcacttttgacaatgtccgtcttatttttttatttttagatggagtctcactctgttacccaggttggagtggaatggcgcgatcttggctcacttcaacgtccgcctcccgggttcgagcgattctcctgcctcaccctcctgtgtagctggaactacagatgcgtgccaccatgcctggctaatttttgtatttttagtagagacggggtttcaccatgttggccaggctggtctcaagctcctgatctcaggcaatccacccacctctgcctgggattgcaggtgtgagccattgcgcccagcctcttttgacaatgtctttctatgttgcccaggcaggactcaaactcctgaatgattgatattcagaagtgaaggggcagatcctgattgtttggtttgcaaaagggggttcactgaggtgagttgtcataaattgattgaacagatttctttttctgtttcttttcttttttttttttttgagacagggtctggttctgtcacttagtctgagcgcagtggtgcaatcacggctcacttcagcctcgacttcctgggttcaggtgatcctcccacctcagcctcccaagtagctgggactacaggcgcacatcttcacgctcagctaatgtttgaatttttcatagggatggggtttcaccatgatccccaggctggtcttgaattcctgagctcaagtgatcctccctacttggcctcccaaagtgctgggattaccagtgtgagccactgcgcccagctgaacagatttcaaatgagttctggtaatatattagttttctactaccacattaccatgaatattaccagaaactttgtggcttaaaacaacacacatgtattatcttacagtcttggtgggttaggaacctaagtatagcttctctgggccatctacttagtgtctcacaggctgcagtaaaggtgtgggccagggttgggttccatctggaggctctactggggaagaatctgcttcctatgtgcctggttgttagcaggattgagttccttttgattgttggactgagagctttttttttttttttccgctggctgtcagctggaggcccagaggtaggtgactagatggtacttgcagttccttgtcacgtggagttctccaacgtggccactcgcttactcacagccggcaagagagagaggctctggcaagagagaggctccagcaagatgaggggaatggtgatgtaacatgtaatcttatgtaacatcatcatgtgtttcctatcacctgtgcatacactatcgattagaagcaaatcaaagatcatgtccacaaggaagagaagaggatcacacaagagcaagaacaccaggaggtggggtcaaaggctaccctgagcggccagtctgtccaccacaggtagctacgtgttaccatggctatagaacattccatcttttcctaagtttgtggatgtggagcaactggagtggcatacactgctatcggaaatgtaaagtgttaaaccactttggaaaatggtttggcagtttcttgaaaactgaaacacttaccatatgatccagccattccactactagatagttacccaagagaaatgaaaacaacccacataaagacttgtgtacaaatgttcatagcagaatattcataatattccaaaagtggaggccaggtgtgatgggcttatgcctgtaatcccagaactttgggagggcaaggcaggaaaatcacttgagcccaggcaacatagggagaccctgtctttacagaaaaaattgtaaaaattagccaggcatggtggcatgaacctgtagttccagctattccggaggttgaggtgggaggattgcttgagcctgggagcttgagctgtggttatgccatacactccagcctggatgacagaggagtgactctgtctcaaaaacaacgacaaaaaccaaaaccaaaaaacaacaaaacaaaacaaaaacccaaaagtggaaacaacccaagtgtccatcaacaagagagtgaataaacacagtgagaactatccatgcagtggaatatttctcagcaataaaaatgaacaggctagttatatgcacaacaacatgtcaaatcatcatgctgcaagaatgaagccagacaaaaaaagacccccctcccctcaaaaaagcctgtatgatgctatttatttgccattctagaaatgcaaattaatctatagttcccaaaagcagggcagtggttgcccgggtgagacagagaaggagagatggactttaaagggcacttggaaacttctgagggtgatgaaatgttttgcatctttttttttttttttttaattgagacaaggggccgggcgtggtggctcatgtctgtaatcccagcactttgggaggccaaggtgggccgatcatgaggtcaggagttcaagaccagcctggccaacatggtgaaaccccacctctactaaaaatacaaaaattagccgggcgcgatggtgcgtacctgtagtcccagctacttgggaggctgaggcaggagaatcgcttgaacccgggaggcggaggttgcagtgagccaagatcacacccgtgtactccagcctgggtgacagggcaagactccgtctcaaaataaagtaaataaataataaaaataaataaataaaatgagacaagttatcgctatgttgcccaggctgctgatattgaactcctggcctcaagcaatctttctgcctcggcctcccaaagtgctgggaatacaggcatgagctactgctcccaccctgttctgtatcttaatagtggtggtggttcacagatgtatacgtctgtcacactcatcaaatcgtacactttaaagaatgtggttattgtgcaggccgggcgtggtggctcaacgcctgtaatcccagcactttgggaggccaaggcaggtggatcacctgaggtcaggagttcaagaccagcctagccaacatggtgaaacccatctctactaaaaatacaaaaattagccaggcgtgatagtgggcacctgtaatcccagctactcgggaggctgaggcaggagaatcgcttgaaccagggaggcaaaggttgcagtgagccaagatcgtgccactgcactccagcctgggtgacaaagcaagactccatctcaaaaaataatgttgttattgtacataaattataacataaattcatgcacataaactcaataaagtttattaaggacaaaaagtaaacagtaaatgagattcaacggagacatatgaatctagacacttggaagaggaagtaatgttgatattgaatacaggtaattttgaacaaaattttcaatacaataacattctcacatcttttattaactaaaaaagaaatggagctacttgaaatattttattttttttttgagacagagtctcactctgtcgcctaggctggaatacagtggcatgatctcggctcactgcaacctctgcctcccgggttcaagaaattctcctgcctcagcctccagagtagctgggactacaggtgcccaccaccacgcccggctaatttttgtatttttagtagagacggggttccaccatgttgggcaggctggtctcgaactcctgacctcaggtgatcctcccgcctcaacttcccaaagtgctgggattacaggcgtgagccacggcacctggcctacttgaaatattttacatattaattcacttacaaggtggttaccatcagtttggtattaatacaataaagaggttatcaataaaaattactagtgatgttgagcatttttcacatttatcagccagttgatttttttttttgaattgcctacttgtgccttttgccaatttttctattagattgtttttccttcttcatttgtttacaggcctatctgcctcatcagcctgggagttccacagagacaagaactgtatttcatttctttctctatccccagcctagtacagtgtctggtatttagttcatgaaatgtttgttaaaattgaatggaatgaggccaggtgcagtggctcacgcctgtaatcccaccattttggaaggccaaggctggtggatcattagatgtcaggaatttgagaccagcctggccaacatggtgaaaccctatctctactaaaaatacaaaaattagccgggcctggtggcaagcacctgtaatcccagctacttgggaggctgaggcaggagaatcacttgaactcaggaggcggatgttgcagtgagctgagatcgagccactgcactccagcctgggcaacaaagcgagactccatctcaaaaaaaaaataaaataaaataaaattaaataaaatgagacaagttatcgctatgttgcccaggctgctgatactgaactcctggccttgagtgacccttctgcctcggcctcccaaagtgctgggactacaggtgtgtcaccatatggataggttggccttgaactcctgacctcaagtgatccaccttggcctttcaaagtgttgggattacaggcgtgagccaccacgcctggccccttgtctcaattaatcaaaaaaaggcctaggcaacagaacaagactctggggaaaaaaaaatatatatgtatatatatatgtgtatatatatgtatatatatgtatatatgtgtatatatgtgtatatatatgtgtatatatatatatgtgtatatatatatgaatggaatgatattctcataaccccttggaaacattattacttctgtttaacagatgaggaatataagacagaagctgagtaatttgcagccacacactgctaaatggtagcattgggactgtaatccgggccttctgattctttttaattatttgtattaattttaattttattttatttttaaagagatggagtttcgctatgttgcccagggtggtctggaactctcaggctcaggtgatcctcctgcctgggtctcccaaagggctgggatttcaggcgtgcgccgccatgccctgccgcaggctttccgattctgaaccatagagtcaatgaaactgtcctccatcccctccagagatgtttgcctggaccctgttttcctcaggatatcaatgaatagttcatgagtttagtgagcaaaggtcaacctccatcaggcgcatgcgtcccttccttttcccatggaggaagagacgcctcttttccttccgctttgcttgtcttttggccccggcgactcaccatcgtcagtgcgcaaccgttcgctaactgaaatgatggcgactggaacgccagagtctcaagcgcggttcggtcagtccgtgaaggggcttctcacggagaaggtgaccacctgtggtactgacgtaatcgcgctcaccaagcaggtgctgaaaggctcccggagctccgaggtgagctggaagtggactctcccggcctgatagtccggggagtcgcagtctttcgttgctgtgggaaggaggtcgcgttgcatcttgggaattgtaggctgtgaagtacttgctatgagtaggtcttcttcgcggaggcgcgtgttgcattctggggtgtgcagtctctttggttagggacagtgtgtgagggttgggggaagaagcgatgccatgggaacctgtgctttaaaacagctctttgggaggccgaggcgggcggatcacctgaggtcgggagttcgaaactagcctgacaatcatggagaaacccccgtctctactaaaaaataataattaaaaaaatatatagccgagcgtggtggcacatgcctgtaatcccagttacttgggaggctgaggcaggagaattgcttgaacctgggaggcgaattatatatataagtattatatattacgtattatataatatatatacgtatatattatatataatgtgtatgtatatattacatatataatatacatatatattatatataatatatgtaatatatattatatatattttcaactagaggtgtttatagttaaccacctgtaaatattcaacatattcatcataataaacgtacatttatttagcattttatatatgctagacactgttgtcttttatggagtttaattcatgaagtctttagaatgactaattgaaggaagtacttttccttttttttttttttttttgagacggagtctagctctgtcgccaggctggagtgtagtggtgtgatcttggctcactgcaacttccgcctcctgggttcaagtgattctcccgcctcagcctcctgagtagctgggattacaggcacgcaccaccacacctggctatttttgtattcttagtagagatgaggtttcaccatgttggccaggctggtctcgaactcttgacctcatgatctgcctgcatcagccttccaaagtgctgggattacaggcgtgagccaccgctcctggcagcattgcttcttgagcagtctccacatagctattttgtttgattagctgagaatttcatgtgtaaaaaactcattccacagtattcatttaacaaatacttattgggtgtctgctatgtgccaggaactgctctaggtacacggaataaacaaaactaaatccctctacttgggaagtttacattttagtgaagagacagacgataaacaagtgaaacagaaaaaaatcaggtggtggtaaatcctgtgaagcaaaattaatctgggaatagagagtgatgaaagggttaatctttgtttgtttgtttgttttgagacagaggaggagtcccactagctctgtcacccaggctaaagtgcagtggcccgatctcgggctcactgcaacctctgcctcctgggttcaagcgattctcctgcctcagcctcctgagtagctgggattataggcgcctgccaccacacccagctaatttttgtgtttttagtagagatggggtttcaccatgttggccaggctggtctcaaactcctgacctcaagtgatccttcccgctttggccccctaaagtgctgggattacaggcatgagccaccacacccggtcgaaagggttaatcttaaacagatgatcagggaaggggtctctggggagagagcctgtgaggagaaacacactgacatttgcccacagcataatgagtggttatgactcataggcttgtctcttgcatgcctgcgcttctcctcctccatttgagttgtgtgcttagtgagggtccattgtgtttttttctaaacatcatgtgtctgtgggctgggcgcagtggctcatgcctgtaatcctaacactttgggaggccgaggcaggattgcttaagcccaggggttcgagaccagcctgggccacatagtgatatcttgtctctgtaaaaaaaggaaaaaaaaaaagaatgaaaacaattttttaaatgtgtgtatggcacttatgcttacagttgcaactacgtaatttaatgaaataatacgaaaaatgaaatatgagtaccaaaaaagagggttgctattgctatgaaaactaagttgaaaatcagaaacacttgttgaagatgagtagctaagacaaattgttattgagttaattatgaacaagttaatggtaaaagcctaggagaaaaatttatagaaatctaaaaagattctgtagtgaagattgttttacaggtgtattcaagatgttcttccattttaaagaaagcaaaactagaaatctcagatggtatgttatgtgtctggtctgtttatgtaggaaagtgatgcagaatgccaatgaatatatcaaggaaaagccttggctttacattacaacagcccctgccttcaaggcaaccacaactcccattgagtctgttttctaaatgtctcacaaatcctttgtttctttttttcttggctacttctgtgtttcaggccatcctcattccttgcttagagtactgctgtgtcatcctaaccaatctctctgcctcattccccactctagtccacctgcttaccacatttctaaaacagaaaaatggatcatgccatttttctctagaattacacacaaagatgaattctaaaccctaacttttaagtctcagattagaagtcacttcttttagggacctttcctgaacacctacccctgtaatcagttagacactcctgccccactacatgctcccggagcagccaatgcttccccatcagcacttaccataaggtgatgtaagtgcctatgttccctttgtaacccctccagattctgagccccgttatcactcttaaccagagtaagggcatatgttaaacactcaacaaatgtttattaaatgagtaagtgaatgaagtagattgttggaacccttttttttctgccatcggtttgtaagtcaccatctcccatctataggagtttgaagtttacccttaaaagtagccacaggaggaacaggtactctcataattgttggtgggaatgcaaagtggtacagccctaaaggagaggaatttggcaatatgtagcaaaattaaaaccccacagtcacaaatcacagtcctgtgagtccatcccaaacatatgctggcaaaaagatgcaaagataggagatatttgtaacagtaaaagctatgagataagatccaagatttgagaattttttgtaccactacttaccgtggcaaaagactgggaacagcctccaaatccgtcagcagagaactgactgaataatgttatggtcacctgtagagtgtggtactctgcagttgtaaaagagcaatggattcattaggagatagcaattgaataggagattcaatatgtattgctgcagataaccctcagggatctattgcaaagtgaaaacagcaaggtgtaggctgggcacggtggctcatgcttataatcccagcactttgggaggctgaggcaggcaaatcacttgagcccaggagtttgaaaccagcttgggcaacatggcaaaaccccatctctacaaaaaaatacaaaaaactatctgcgcatggtggcatgcacttgtagtcccagctactctggaggctaaggtggaaggatcacctgagtccgggaggttgaggcttcagtgaacagtgatggtgccactgcgctccagcctgggtgacagagtgagaccatgtctcaaaaaaaaaaaaatatatatatatatagagagagagagcgagcgagagagagagagagagagagcaaggtgtaaacaagtacacatagtatgttacattttaagtaggaaagtggtatggaggaaaataaatacatgtgtccattgtttaaaaaggaacaatggaaagaaaaccacaaagctaataaaaatagttatgcatggggctgggtgtaggggctcatgcctgtaatcccagtactttgggaggctgaggcgggtggatcacctgaggatgggagtttgagaccagcctggccaacacagtgaaacctcgtctctactaaaaatataaaaattaggtgagcgtggtggcatgtacctataatcccagctactcaggaggctgctgcaggagaatctcttgaatccaggatgcggaggttgcagtgagccaagatcgcatcactgcactccagcctgggtgacagagtgataccctgtttcaaaaaaatgaaaattaaaaaataaaaaaatagttttgcatatgggggagagaacagggaaagaaagggacagagatggaaaatcctattttattgttttgactttagacatccagaaggggttactaactttaaaactttaaataaagttgccctgtgttggggaagaaatctggcaatcctagttactttgaagtcacgctacccttttcactagagtctccctgacccaagagaacagggaagggccggtaggatacacataacagtagctccttttacttggctgaatttaggtatgccaggagcagggtgcagtattaggccagaaatctctgttggtctctgcttgcctctcagtgctaatgtggtcagctctccttgactgtagaccatccagccaaatccaagctctgcttttctcttttggactcaggacccattaaactcagtaacctcattaaattctgcctgcacatttctcctttcttttcttttcttttttttttttttgagacagagtctcactctgttgccaggctggagtgcaatggtgcgatctcggctcactgcaacctctgcctcccaagttcaagagattctcctgcctcagcctcctgaataactgggattacaggcacgtgccaccacgcctggctaatttttgtaattttggtagaggggttttgccatgttggccaggctggtcttgaactcctgatctcaggtgattgcctgcctcggcctccgaaagtgctgggattacaggtgtgagccaccgcacctggccatctcctttcttttctttttcccagccctgtctggtcatcttttatggggtggttccccattttaagccctgagcttctcctcatggcttccccacaccccccactgtttctcttattccattttttttttctttttttttttttgagacagggtcttgctttgtcgcccaggctggagtacagtggtgagatcttggctcactgcaactttcgcctcctgggttcaagcaattctcccacctcagcctcccaagtagctgggattacaagcgcagccaccatgcccagctaacttgtatttttcggtagagatgcggtttcaccatgttgcccaggctggtcttaaactcctgacctcaagtgatccacccaccttggcctcccgaagtgctgagattacgggcatgagccaccgcacctggccttctcttatttcatttctaaatagctgtattcctctgtccttttcagccccattctaactcttgcatctttactactttcaaacaaccccaaatctcaaatctgcctttaaagaattacgagtcatgttctctcactggacttgtggagccaaagtttttttgcagacttctcttagcacttaatgaatacactgtgccaacagcccagcagttaggaagcacttgatttctcaggcagtggcctttgaaacagatgtcgggtccatgccagaactgccatagtgccaatgaaatgaattttcaacatgaacaaatagaaaattatccttcattacattttgagtgtttgtggttgtatagggtggaggagtgggagaggagagagggtagtagtgtaacagctgcagagagaagattacaggaagtttgggaattttgattattaccattttatttttgtcttccagctgctaggtcaggcagctcgaaacatggtactccaggaagatgccatcttgcactcagaagatgtaagaaacaacttttttttttaatgatttgggtttatgtatatggtttgtgtggccacagggaagtggaaatgttctatttctctctctcttttttatgcagagtttaaggaagatggcaataataacaacacatcttcaataccagtgagtatgccccctccagcaactatttgctgcagaatcattatccctggtctgctttcatggactttgtgcttcagcactttcctgtggaggccagagtgggagtaaaggtgggggtggccaaggatgactttctcgatggcaaagatgcctgagactacagaagaagtgggggtaaaggatgagaatcaggagcagagtccaccctttatgaacctccccatgttaaattgagggctcctcagagagagactataaaccctgtaaaggcagggcccgtgccaggaccatgctagcactgtacttggcacctgtgaggccgttgatcagtatttgatgactgactgtgcccaaggtctcttctgggaagttaagttgggtcctctactagggaatgaagtataacatacctgtatcctacatggtacataggtaagtgtggcacctgctacatataaatcatgtagggaattttgaaatataagaccccctctttctccattataatttgctcttcatcttatttcatgttgttttatattttatgtacttgatattatacttatgtacctcttagaaatatatggttggggctgggcatggtggctcacacctgtaatcccagcactttgggaggccgaggagggcggatcacctgagatcaggggttcaagaccagcctggccaacatggtgaaaccccgtctctactaaagatacaaaaaagtagccgggtgtggtggtgggtgcctgtaatcccagatactcagaaggctgaagcatgagaattgcttgaacctgggaggtggagtttgcagtgagtggagattgcacctctgcactctagccagggtgacaaaagtgaaactctgcctccagaaaaaaaaaaaaagaggctgggcacagtggctcatgcctgtaattccagcactttgggaggctgaggcaggtggatcacctgaggtcaggagttctagattagcctggccaacacggcaaaaccccgtctctactaaaaatacaaaaattagccgggtgtggtggcacacacctgtaatcccagctactcgggaggctgaggcaggagaactgcttgagcccgggagacggaaatggcagtgagctgagatcgggcaccactccactgcatcctggcgacagagtgagactctgtctcaaaaaaaaaacaaaaaaacaaaaacaaaagcaaacaaacaaaatatatatatatggttaggaatttcactcttcgatatttaaatagctaatgtttgtcataatcattagtcattctttgggtatctacatattaggtattaggtatgtgaccatttgattccatatacacagactaattttaagccatgcatgtagtctgttgaaccacatttctcactctgggagaatgttactatctgtttgggtttagattccatcttttcagcagctctgcactcagacaggaatccctgttcaatagcacaatcttaggataggatggacagaaatacaggatgtgacataagctgaaatttcttctgcctatatgtattatctggtcataaatgaaacttattagttcacttatgtgtattttcctctttccttttctgatttaggcaagaagctattcagaagaagtaagtaaccccaaaggtagaggagtagggaaccaactgaagcaggctggggggatttatactgctgggtccagaatcaatacaaaaccctggttgacacctgccctcaaattgaaatatgctctgggatactcacttgggatttaaagatacagcatatttcaaaggtgtgcagtaactcaactcactgctattaatagtaaaactttctaaaagttatggggtatagagaccaaccttaaggagtagaaaaccttttacattggtaatattcattaagcagagtaaatgtgcaaaaaccattaaacagccttgttttctaaaatggattaaatttgtcccttgcaacattgtttacattactaattggctttgcaaacctttcttcagagtttaaacacttctgggacacaactggaccaatataaattttgatttacatgcaacagtatttatgcattaaagtacagatagcttgtacaggacaggtgtagtggctggctcatgcctgtaattgcaggactttggaaggctgaggctggaggattgcttgagcccagagtttgagattgccttgtgcagcatagtgagaccctgtctgtaatggaaaaaaaaaatttgtaaatagttgtacaaagatgtctttattattgctcatttcagataaaccctgtctctattctaattcctagtgttgaacagtcatcggatctacaggaccagttgaatcatctgttgaaatagaatgacatgtaagagtgctgtaggactcctttgcctaatgctgaggagtaaataccttacacagctgtcctctgggtttggttttctattttcttctccaaaagttaagttagaaaagttctgtgttagggccgggcgcggtagctcacgcctgtaatcccagcactttgggaggccgaggcgggtggatcacgaggtcaggagttcgagaccagcctggccaagatggtgaaaccccgtctctactaaaaatacaaagaattagctgggcgtggtggcgggcgcctgtaatcccagctactcgggaagctgaggcaagagaatcgcttgaacccaggaggtggaggttgcagtgagccaagatcgcgccactgcactccagcctgggcgacagagtgagattccatctccaaaaaaaaaaaaagaaaaaaaaaagaaaagttctgtgttgatgtacagtttctcctaagaagaagcgaggtggttgaattttggaagcacttcttgaatcggattaacccatgctcttattgaattttttcatctgctctgtttagtttgatattaaagcaaaattaagaggtcttagtttttcctatagaacttttaatatgtcaaaagctatattgtctaaatttcagtacttaagcaaatactgagtagtgttttaaattcagaaatagagcttctattatgaacacatgagaatgatttttttctcttaatcattattaaggaaatattttaatttcatggtcatataatggtgataagtaatacctgattgtttccttttctgttctagtaactcagaggagatacgtgttttatttgtgatagcaaattcctaaatgaacattaggcaagtggtatcattatcaggccagctgcagcctcttgccttgacctgcattcctagaatttctttgttgctgtaattcttgattaagtgaccttgactttcattttgtaattttgctaatcatcagcaaattcacttgcatgacgttactgccaaatatgaaggcagttgaattattatgagtgattgtggcagaggtttgtgccatggtgaaaactttgatgtttgtctgtgttcattggatccatctttttaaatgacattaccatgagtctgttgtcaaacctaaatatctttgtttgaatttaaaatgggactctatattgttgtagttcaggtcttcattgactaagagattgagagaaatctgacataagaaaatattgttttcactgcaggaataaagaggaagtaacagtgaatccaatatagttcatattgttattgtccaatcatcaagttaactaagcattatcagattacgtttatttctcatacatatggatattaacttaaggtaaaaaagctggatgtgaaggatctgaaaaggcattaatttatgtactaattctataaacatgtattaataattgcagtattattaaatacagatggactcaatgtacctttgaaaagaccactaatttagaaaacaaagctaagtgcagtcattacaagaagcaaagaaatacttaagttagaaaaaaattaaaatgaagggatg

SEQ ID NO: 575 - DNA, 20001 bp, Homo sapiens
atgctggcagatggggctcatttggaggacagtggctgggagctggggtcagcgaggggactgcaaatattgtcccatgaggcagagccgaggcagcttagcctggagatgcatgcggggcctgttttcttcctcacacactgaaaggctgttatgggcagagagcggatgctggcggtagccccagagaggagggagggaagcgcagaaggtgccctgtgatggtgccgcctctgccgctcacagcctgcccagtggggctctgagcccctccatccccttctcacttcacactggtggctctcatggggtgctttctaaacacaccagttcctgaacaccaggaaaacactgctagttcagtagatcacagtggtagtggtgtgtgtgtgtatggggggacacaatccccatctccttccccgctcccctttttccttgagttatttgagtaggttttgctttcttaaaatccaatgacccacagattggaggtgcctgcacctccttagccccaacatggggaccttagtccctcctaagctggcatcatggcagctgagcatcgatatacccagcccatggctctgaccccagttcctttgtggccctggccatgccagccagacctactggcgaggacgaagccccctgtcatctctttgtgtggtgttgtttggaggctgactctctgcaccacaggggccatgggcatccccttcctcacctagggggcatcaataggctcttggggtgcactgccacctctggctacccatgccctgggtgatgggggcaagcccaggggaagcaggccacttgctcaggaccctagactctcagcacggcactcctgatacccaggagcattcaggaggcactgacagttgttggtgggggttggcgggggggtagagggagagggaaatacatttttaaagataacctggaggcaaatataatatttatacttatttatcctcagagctcactcacaaggccccagacatgtctaatgagcaggaattgcaaaatggccatgagtcctacttgtttgcctttgcagagtctctgagcagtcacatggacccagatttttcaactgtgtgaccgctgcaggcaaaacggctgtaaggaacaccaggacgtgcagcaagtgcccgactcccagaggcatcgagccacaaaactgccaacccaggaaaatgaggcgctcccttccacccccctcttggcagaacacagagcatttgcacttacacacgtgtgtcctcgcttcgtgtgccgacacgtgtgcacacacgcaggcacacagagactctgtgtcttcatggcctccctcatgggcctgcaggcatacccttgtccaaattcatacacactcccctgtctattcagacatgttgtccacagggacaggatgctccgtggctaagggctggttctggatgggggctcttccctgctccgctcactctggacaccaatgactgtaaacactatgtgaaggggcttcctatgcagaaagtcaacaacagaattaactgagaccagcacagtctgctctggaacgagaatgacatacagtttactatatggttaactcaagcatctaggcatagtatctatatgcatagttatataaatacatatacaaacatatatgtatacatagaaatagaaaagtgtatggctagagaaaatgtacaaaaatatacacatgctgcacaattggacctgacactaacttccagatcttcctcctgcagagtgatgaagcctttcactggtggggctgcatgtatccaggctccccagattgggtcaggtctgctgttttaaggttgggaagtcacaggtgttccttttcttcacagcacttcttacagttgttattctacctctgtctgtgacactggcttttccacaccgtgttgcactggtttgtaagctccagaagggtagggccatatctctttgcttagtatatatttcaagtgcccagcacacagcaggtcctcagtacatagacggctgaatgaaggcatggccctttcttctgttgttttctttttgtgtcccatagcaatccagtcgcacacgttgggaccaggagggtcacttcttttaatgctgacagcattgaattccagatcttggtctgaaaagtgcaaatttctttctttctttcttttttttttttgagacagagtctcgctctgtcacccaggctggagtgcagtggcgtgatctcagttcactgcagcctctgcctccccggttcacgccattctcctgcctcagcctcctgagtagctgagactacaggctcccgccaccatgcccggctaattttttagccaggatggtctcgatctcctgacctcttgatctgtctgcctcggcctcccaaagtgctgggattacaggcgtgagccaccacgcccggccgcaatttcaaatacaacaccaacgccaactgtattcctaaggaggtgattttcttctcctttgtaccactggtagcctttttttttttttttttttttttttgagacagagtttcgctcttgttgctcaggttggagtgcaatggcgtgatctcggctcactgcaacctctgccttctgggttcaagtgattctcctgcctcagcctcctgagtagctgggattacaggcacctgccaccacacctggctaatttttgtatttttagtagagatggggtttcaccatgttggccaggcttgtctcaaactcctggcctgcctgggctgcaggggttggggtgggtgattgtttgggaagtcataatcagtttgggttttcttttttttttgagatggagtctcactctgtcacccaggctggagtgcagtggcacgatctcggctcactgcaagctccacctcccaggttcaagagattttcctgcctcagcctcccgagtagctgggactacaggtgcccaccaccacgcacagctaattttttgtatttttaatggagatggggtttcactgtgttagccaggatggtctcgatctcctgacttcgtgatccgcccaccttggcctcttaaagtgctgggatcagtttaggttttcacagggcaaagttatttctagacatagtctggcctggaaaacattcttttggcgggagcagcatgttctaaaagccatgctgtgaagtcttcatatgcaattgcactgggtcatgcctgaccagttttactacaagtcagaagaggaggttgatagtctcttgactgatcagggctagggcagtgagaaatcctgacccactcattatgctaatttctatcagaacacttgctccggcttctgggtggccagatgcctgtcccctcacctccaaagcaaagaaggaactgcagttttctggatgccacagatttaatgcagttttctggatgccgcatggtttaattggaacaaaccataaatttctttaatagacagttggctttgctaatgactgttttaaagaagggtttcagggctgggtgcggtggttcacacctgtaaatcccagcactttgggaaacaaaggcgggcagatctcttgagtccagtagattgagatcagcctggatgacatgatgaaaccccatatcatccatctctataaaaaatacaaaaattagccaggcatggtggcatgctcctgtagtcccagctactcaggaggctgaggtgggaggatctcttgagcctgggaggtcgaggttgaagtgggctgagattgccccactgcactccagcctgggtgacagagtgagatactgcctcaaaaaaacaaaaaaaacaacagaaaagaaaaaagggttctggttaaaagctctaaaccctacatcattcttttggggcagaacgcttctgacacataactggcttataaacccgagtatcagggcacctcatttattcacccagcaagatgaacttccaggtctcactatgtcatgggtgggtgggaaaatccatggcgcagatgctggtctgcagtcctcatgactggtcgtcacgtagtgttccccactctcatctttctgtttacttgggatgtataaataaagcaacaacaataaaaacatagagcacagttagctccccaaacacctcccacagcgttaggcctttctccttggaaaattcttttggtcctgtgcagtggtagtggatgctgtgtgtgactgccggatcccttctttgggaagaaggcactcattccccggcttctggagcattggctgctccccgtggagtccctttctgggaactgctcttggctgaagacacccggccagctccacgttctgtctcctccctgggggcagtccacatccggtcttcggctgtgcaagggcacaaaggccctgcccctggcctcaaatcgaaccttctctgaagtcccagccaagtgccagagctccctgtgggagcagctgaggccttcatttagactgcattacagttcaatttctctctctgtccaatcctgcttccttcacccttgacacgtgttgagtttcttataaattccatttacataaatctccatctcagaatgtttcctggggaatctgacttgcaccagccacctgggacctttgcagcattccaatgcttgatgcttttggcgtacatgtgaaaccgcatgttttacattgagaaagtctggcatgaccatagctagtcctgggtagccaggattcagggtcaagtgtggtaagatctcaggtgctctctgactgaagtttgtgggattttaaattcaacccaagacttccactgagcttaacgctttggatagtaggcagggcttgccaagtggcatgtttatgcccatgcaagtctgacttctgcatctctgcctgtgctcaaaggagtgacctgcctgtacctgggacagtcagaatggagctggaggatcctcaacacttcctccctttctcttcacttgggggccttcagaaggagaatgtgaagctcaagagttcatgtgaaacacggatctgagaactgtgcatatcctgagtctgtttgcactgggatcccttttggggagctaaccctgctgactttatttccaggatcctctgtgatatggtttggctgtatccctacccaaatctcatcttgaattatagctctcataatctccatgtgtcatgggagggacctggtgagaggtaattgaatcacgagggcaggtttttcctgtgctgttatcatgatagtgaataaatctcatgagatctgatggttttataaaggatggttcccctgcacacagtcctttgcctgctgccatgtaagacatgcctttgctcctccttcatcttctgccatgattgtgaggcctcctcagccacatggaactgtgagtccactaaacctcttttactgtataaattacccagtcttggatatttcttcacagcaatatgaaaatgggctaatacactctgtcagctgcctgctgcctggatttggccaataagaaacattggtgggcatctggatggtggaggaagagggagaacctaggatatttgtccctttccctttctgtcttggtggcttctctagctgcggctgcatcccctccacggctccaactcctctaggttctgtggctccggtctcttgagtggccctggcccatgacattacctcctccctttgtctctccaatctagaggtgacagtgacttcctgcttatctttggtcacctcactgtcacctggtgggggttcagtttctctatgacctatgtaaccaattccctgcactaaattcctcctattataaattcttaaggtgatttctgttttcatggttaaactctgactcatacgagaattttgttgttctagtggagttggggtctaatttaaacaggggatgatctgttgagctctgtctgtagaacaactggtctaatgactgaatcattccacaaaactgccaacagatcaccctggatcacccctactctgtcctgcccccactttcatcttagaatccagtcatggaagggctcttttgaccatgtctgccacacccctcccccgctttttttgagacagagtttcattctttttgtccagtctggagtgcagtggtgcgatctagactcactgcaacatccacctcccggggtcaagcgattctcttgcctcagcctcccaagtagctgggattacaggcacacactaccatgcccagctaatttttgtatttttagtagagacagggtttcaccatgttggccaggctggtctcatactcctgatctcaaatgatctacctgccttggctgggattataggcgtgagccaccacgcggggccagaaccccctttttatggactatctcatgggaaatatgcccaataagacccactctgggaaaccgttatggcctacacttggattttttttttttttgagacggagtctcactctgttgtccaggctggagtgcagtggtgtgatcttggctcattgcaacctccacctcatgtgttcaagtgattctcctgcctcagcctcctgagtagctgggattacaggcacccaccaccacttctggctaatttttgtatttttattagagacagggtttcgccatgttggccaggttggtctcgaactcctgacatcaggtgattcacccacctaggcctcccaaacacttggatttttgacggcccatttggttacgcactgggttggagctagagctattttcagaggaaaaatactgtcttctctatggacaggagtaactgtccatttgggttcaagtcctggtttaccatgctccataagctgggcattactgatttccttagtatttccttagggtttatttgtccattctcagccacagtagaaagctgagtccacatcctctgattatagttaaggagctgaaacaggacttttagtaggagtgaatggggtaacccacagaccacccttagcacagtgcttggctcttgggaaggattaaacaaatgctggctgctgtgagctccacctgcactgctccagaccctcgatatatcctcactcaggttaaaaaacaggctaaaaccttgggaggttgaggtgggcggatcataaggtcaggagatcgagactgtcctggctaacacggtgaaaccccgactctactaaaaatgcaaacaattagttgggcatggtggcatgtgcctgtagtcctagctgttcaggaggctgaggcaggagaatcacttgaacccaggaggcagaggttgcagtcagccgagattgcaccactgcactccagcctgggtgacagagcgagactccaactcaaaacaaacaaacaaaaaacaggctaaaacctgcctctagactcggtaaatttcacggctacctcccatagattctgagatcttgctaaagtctcagggatctaggttgcatgggagacccagagcctcttgcatacgttagagcccatgacaacccttgtcccctgcaaagcttatttaggccctgcctggactcttggggattggcagtggggtgtgtctgagccactctccagttctgtcttctggaggtaccctctctgctgtgtcctcaagtagttagctctgctctgcctggcccagcccatgcagcctggaaatcctagtgatctgagccccaaacaatcccccaccccagatacctgttcccccatcatccagcagaagtaaggaaatggagagaagttgctacaggagcatttggaaatgggaaccaatgtcaactcttgcaccagggaccaaaagctcagactggtgcaaacaaaagtgtttttgtccccaggggctggtgaccatggtcacctcccagccaagaagcagtgagcttcacagaaaactccttactccagcttgcaccaggacagggccctccttgaagcctggggagctgacatttccaagaaaggggtggtgggggaggtgggaccgcagctgggcccccgaccccctgccgtcctcagcttggagccagggccggaaggaccacttctaatagtgactcagcctttgtctttggccagcccggctgcatggggccaggcggggtctctgcagctggctgagtttgcttccgcagttctcaatcctgggttttttccactgacccccaactttttattttggaagttttcaaatttacagacaagctgaaagaatggtctaattattacccatgaactctccatctagattcagcatttgttaacagtttgccatctttcctatctctctttttttggtatagtattcgaaaacgggttgtaggcatcatgattcttatccctaaataattctcacgcttctcctaagaataaagacaatcttcttcatatccacaatgccattattgcatgtgagaaaattaacagtaattccataatatcagttaatttccagtttatatccatatttcccaattgtcctaaaatgcattttataggttttttttatagttcaatttaaaaaaaacctaattatggcatatgtttttatgctttgcattttgtcttttaaaatctagaatcccagcactttgggaggctgaggtgggaggattgcttgaggccagaagtcggagaccagcctgggcaacatagtgagacccccatctctaaagtcaggtgtggtggcacacacctgtagtcccagctactcaggagattgaggcaggaggattgcttgagcctaggagttaggggctgcaatgaactctgattgtgccactgcactgcaggctgggcaaccgagtaagaaactgtgtatctaggaggaaaaaaagtaaataaaatctagaatagcccttttaacttttttttttctcctatcaattagctttttgaagagtctaggccagttttcttgtacagtagaagtttctacacactggatttgtctgattgtttctatgtgatgtcatttaccttgtttttccatcttcatttttttcctgtaagctggatgttcatcctagatgcttaattagattcaaattaaactgtttataagaatatgtccctagtactgtgcacatcacattgtaacacatcaggaacgtattctagttcgaacttttcttggtgttcaacttgaaagcatgaaataaggtttgatgatcacctatcatatgccaagggctttgcagagcttcttatctggacttacaaaacaatttggaggagaggagattggcctccttagtttatagatgaagagctgaggcacggaggtggcaggggcagagaagaaaatgaacacttgtcaaggaaccattggtgtccagggatggggcaggtgtgaaagccgtgatgctttcattatacagggagctctgggaagttagatggctcacttaagttcccaaggtcagttgaggggtagagctagcttcatattcagatcatcttcctcccagtcctgacctctccctggatgtcctttttgggttctgcatgtccaatggatgcactagtctggagtccaggctccatcgtgctgggtcagcctggcatgctcatgtcctcagtaggccctgagtggtgactctgaaggcctggaatctgagaagatgctttaggtcagcggctgtttattttagtccctcatgacactaccaggaccagaatagggtgggtaagtgggtatttcttctacctctcccaagaattcaagtgtaggtggaaggaggtgtggcagtgagacccgaggaggcctcctaatctggggaagctaaagggccagaccacaagcccagtgtctaagcagaaggcatctggggaaactggggcctgatgaggggcagaggcttgcctcaagtcacaggtggaggcagagctgggagtggaacacaggtgagagtctggactccttaggcagtgaaaactgtgtgaaaggtaatcttttttcagagtggaacgggagctggaagaggagtgctcagtggagggctgcaggggtgagctgatggaggtggaggtgggcagagagagaacaacacaggcaggaggccactggctttcaaagtgtggggtcccccaaggtaacacagggcgtgggttgtagggtgcatgtgtgtctgtaggagttccccaaagactttctttcttttttctttttttttaaattgagacagagtctcactgtatcgcccaggctggagtgtagtggccacagtctctgcaatttctacctcctgggttcaagcgattctcctgcctcagtcactgaagtagctgggattacaggcatgcaccaacacacctgcctaatttttgtatttttggtagagatggagttttgccatgttggccacactggtcttgagctcctaggctcaagtgatccaccacgcttggcccaaagacttgcttcagtgacatcatagtgcctccctggcagacactgggaggaccttcacttcatccattcccatcgccttgatttcaccttcatcttctcactcgggactctgatatcagcctccttgagggtctccagctgccagtttcaccatttctaatctatcttccaccccgtggccagagcactctttctaaaacacctctggtcaggccactcctctttaaacctttgtatcacttagccgttgcgatataacaaacgactccaaaattgaatgccttaaaagaggtcagtgggccaactccactgatctctgctgggctccatcatgtgtctgctggcaggtcatctgggaaccactggtggctggatgacccgggatggactcgctgacatgttgggttgttggcaggttgccagtaatttgggctgggctcctctgggacacctcatttctcctccgtgtggcctcttaggcttgtttccatggtggtctcagacttcaagaacacttttcaaacctttgtgctgcatttgctaatgtccccttctgcaaagcaagtcacatggccgacatgctcatgtccagatgtagtggggagactggggtgggcaaacagattccacctctttatgggaaggggaaatttgtaaccattttgcagtctaccacaatctttccagactccacagtgctctcaggatacagtcgtaccctctatactctctgtcacctgttcccaaactatcttcccattgtgcaccccacacagagcttgtgctgcagtttacccggaatctcaccattttcaaagcacctttcttctccaatgcctttgtgtgtgctgttctctttgactggggtgccctccccacctctgcatcctgtgcttatttattcttccaggtccagctccaatgctaccttattctagaagccttttccgctttatctccatctgcatgcatcctcacttctggatctcagagccttttgcttgcgtgtgtgttgctgcacttctttcccattgtctgggagcacaagctttgctcgtggctagtggagcaagagctctgagtaaggctctccgtgttagaatcccagttccttcatgtacctcatgaccttgtgcacagcactttacttctaagcttctgttttcttatttcctttttttttttttttgagacagggtctcactctatcacccaggctggagttcagtggggccatcttggctcactgtaacttctgcctcacgggtgcaagcgatcttccctcctcagcctcctgagtagctgggactataggtgcatgccaccatgcctggctaatttttgtattttttgtagacatagggttttgccacgttgcccaggctggtcttgaactcctgagctcaagcgatccctccacctcggcctcccaaagtgcttgtgttacaggtgtgagccaccacacctggcctcagttttcttatttctaagaaaagagggacaagaaaagcccttactttgtaaggttgttttgtgaaactaatgatgtgcctgtgaggtgcttggcagggtgaatgtgagctcccatgaggctgtaagcactttgtgaacaggagctatgttggctaaatctcctccccagaggggaagatttagaacactcctcatgtgatctatgtccacatggcttgacatggaacaggtccagggtagagatcctcagtgatcatttttgtgaattgacaactcccccagataacaatgcgtccctgcagatgcagcagacatagggcttgcctggtttaggcttttcctcagcacccctcagtgtgggacaagacttggctgggcccacagccagcaataaagtggatgctaataacatcattatatgctgaataattaactgtcatttaaatattcatatgttgttgggggcaaggccttttatcagcatctggggacgtgtcggcagaggaaggcgatagatgtcggcaaggctgactttgcctgtgaagggcgatctagggtccagagagagccgtggagtggccaccagacagtaagctaatatataaccgcaatattctcacgtgataaactgcaatttcataaatgcttgatgcatatgtgcaagcctgaaacaatattggaagcattaatttcatttgactaatgcttatctatattttattctgttccatttttaaagaaccctctctttctttcatgcaaagggaggtggggccggagacctgcagaagggctagagtagaagggcctggaggttcttaccatctgtctgctgtgctgcaggtgcaggttgggaccaggctggtggactgtccctgagcctaggagccctgccttggggagttctgactctggttccttgggagaagaactcaggctcttggtggcatcaggggagagcagcatggcacctagttcctggccagctgggttgaagctgctgtcaattcctcaattgtttctgcaggggtgagcctggaagggatgccctagtgaccctgcagggagaggtttgggaaggtagggactgttacaaagcaactaccccatggtggtgaagtgggcgtgggaggaggaggagggggaggggagaaagaaagttaagggagaaggacaaggggctggaggaggatggaaagaagagggaagaagagaaaggcaagaaagggatgaaggagcctgaaggggcttgtgccgaaggagatggctaccttggagggagcagggcagattggtgtggtaattaagagcaagggtcctggaactggacagtcctggacttgagttttagctgtgcctctaactagctctgtgaccttgggcaaggaacctaccttttccaaatgccagtttcccatttgtcaaatgggaaaaattgtagtacttaactgatgtattcattgtacatttttgcataaatttgaacaaattaccacaaacgtagtggctttaaacaacacacgtctcatagtttctgtgttaggggttttggcaaggcttgattagatcctcttctgacaatctcacagagctacagaaaaggtgtcaaccaagaggcattctcatctggaggactgactggggaaggatctgcttccaagctcactcagattgttggcaggattcacttccctgcagttgtaggactgaaggctctggctcctgctggttgcaggaggtagcctgcaactcctagttccacagttccttgccatgtgggctcctccaacattgctgcttatgtcatccagccagcagggagagcctctatctccagcctgctaagatggtcctgggaatgggatgtaataatgggacagaccgcccattacctttgccatatcctattagttagaagcatgaacaccaggaggctggagtcatagcatttaccttcaggcttgtctgccatatctgaagatgacagcctgtaactactcagcattggacaatgttctaggtgctgtatcctacctcatttaatcttccgaacaaccccatgatgtgccataattattgccactgtactgatgaagaaatggcagcccaagagcttaagtaacagccatatacttagtagcaggtagagtttggacttgaatcaggtactctggtaccaggacccagactgatagccaccatacaatccagcctcccagggctgcttgtgaagataaaccacttaggatgctgaggacaggtcttggtacaaagtctaataaataccactccaaagtaacccatttgtgacttggcctcctttggtagcctctgtgtgctccctgtacccttgttgtgaccacatctgcaaaatcttcacatccccaggatcaccaaagccaagcccagagcattggagagcaaaaagggagcatggaggaatgaagtcgtgtgttcttcccctcatctgaaacacctccagcccaaatctattcacctctctggccttcacttaaatgtcacttgtttcttcttgctactgtaacaaatcaccacaaatttagtggcttaagacaatacaaatttattatcttacagtcccaggaggcagaagtctgagatgggtctcaatgggctaaaatcaaggtgtcagcagggctgtgtttccttctagaagatctaggggatggctgggcaaaatggctcatgcctgtaatcccaacactttgggaggctgaggcgagaggatcacctgaggtcaggagttcgagatcagcctgtccagcatggtgaaaccccgtcttttctgaaaatacgacaattagcttggtgtggtggtgcacacctgtaatccctgctacttgggaggctgaggcaggagaattgattgaacctgggaggcggaggttgcagtgagctgagatcgcaccatggcacttcagcctgggtgacaaagagagactctgtctcaataataataataataaaatctaggggagaatgtgcctgttttgcctctctactttatggaggctgtctgcattcctcggcttgtggcaccttcctgcatctgcatagtcagcaatggccagtcgagtctttctcacatcacgtcactttgaccctggcccttcttctgccctctgattctcttttaaggacccatgtgattacattgggaccactcagatcatccaggataatctccctattttaaagtcagctgattagtacccttaattctgtctgcaacattaattcctcatttgccgcataacataacatggtctcggttttgggatttaggatgtggacctcttcaggggccattcttctacccagcacacttccacagggggtctggggctctgtgacatcctttacttatcccatcactaccttaggcttcttccaggggtttcaaactcacattggggccaggagcaaatgcaaatgaatcctctgagtgtagggtagtaaggagtggtagcatggtgacaaaggaaaagtccttccacattcaaaaattttaaggcatgatgttggccaaattcagcctgcagactgccagtttgtgccttgggatcctgttagactatgaccaccttgtgagctgaagctggggctgcagagaggctagcaccttagggcagggtagtcagaggcacgttcctgggcagccaggtcaggaaaggctctcctgcctccaggctaaagttgcttgtactggaccatatgccaaatgccctcttagttgggtaccctgtgcagggcacaacccatgcactgtccatggctctgtccctagtgtcccatacggtgtgtggcacatagcatgcatgtggactcaatacttgttggatgtgtaattgaatgaaatccactgccttctcactcactctttaccctgctcagggatgtgtgacctccttcacaagagctcagcttctcttgacaggcactgtggatgtgtgcatgtgtgtgcatgtgtatcagtcacaggcttcagtgacttggaacccaaggtctttgagcctttgctaggaaatcaccgtggcctgtgaccaaaaggctggggccagggactgactgacggagggggttccagcccgctgttgccactgccccagccacttccttcccattttctccccaccaccccccttgaattcaagattccccagaggtcgagcctggtgtaattacaaggtatctgctgcctccccataaatctaatagactttttggccttgtcagattaaaacttacctatcaacccgccgcagtcctctagatctccctaaatctgtacttgggagagaatttatggccaggaattgcattttgcaaaatgattaaagttgccaaacagccataaaaagttgcaggaggagatatggtttttttgaaagtctgcttaatttataaggggtggaaggtttattgtcatttagagtccacagcgaggcagcgatggagcgttcggcggcagctgtgcacagctgctctcgctttatgccttttacatgtttttaaattgccctgtttgaatctggccttctgcagcagcagaaacgccctggtttgcaggagagaggctgttcctcctgtcctctgttgttcagccctggtggccccagatccctgcctcatccccaggctcaccttccagaagcttttctggctgatctctctgcatgctgactgccccatcccattctatgatcctctgctcgtctctctgaaacattaacaagcactcacatgcggaaaggcttttaagtttataggcgatttcacgtgtcgtatcttagtacttatcaccctggattaaatgattaaatgagataaaacatgtaaagctctaaatacaaggctgctacctagtgagctaataaatagaattagggctcccatttattgaccacttacgaggtgccaggacctctgctctgagcgtcacatgcattaattcatataatcttgcctgccactctctgaggtagctgttaattgtgtttgtgttttaggaagcctaaagaactgaaccatgcagtcaatgttcaatgaatattagctgcttctattcatattattagggcaggagtcttttctgttcttcttccacattggcacctagtaggcactcaatgggaattgctgaatgcaagcaggcctgcatacctgaacaacactgctgtcactgcctaatgaccctcatcctctgtgggtacaaggatcagacctcaatcacctgaagtctaaattagtactagacacatattagtctatatatatttgaaaaatgactggacccagggatgatggtgtgcacctgtagtcccagctactcaggaggctgaggtgggaggatcgcttgagcgcaggagtttgaggctgcagtgaactgtgattgtgccactgcactccagtctgggtgagagagcgagatcccatttctgaaaaaaaaaaaaaaggaaagaaaagaaagatgattaaataaatcaaatcctcacagcaatcctatgaggatggttttgggaattccatcttacagaggaggaataggaagctgagagggagtataacgtctgctaaaatcacagctataatggctgagccatgatttggattccaagtccagtgggttttttcccacctcagcccagctgaccacctgttaggcatttggaggtagattcagaaatttttcttcttcattattaccatatctaatattgattaaatacctagtactcaccagctgtacatactgtcccgaatcatgctcacaacatacttgcatgatgtttattattttctccattgtatagatgcggaaattgagactcaaagaggttgagcagcaattccgtgagctgaaacttaagcccagatgcatgtgattccagaggcaggtaattatgataaaggatggtgattgctataatgagggaagaactctaaacccagcctggcaaaggcagcgaggagaggagaactgtcagggcaggcttcctagagaaagtggcttctaagctgacatttgaaggatgagtagggatttgtcagataaatgataggggatcatgttctaggcagagggaacagcaggaaggcaaaaaagaacaaggctgattgaaggatgtgactgttgagcctggccagaggcagtcttggattccctctggcctcagtctcaatctccacctccctggggtgcagagatgctcaaggtgggagaggaacccatcggctgtgggctgggctgcttcctaagttttcatcagctctgccctcactctcggctcttttttccaggcccaggcccactcgcctcctgtgagtatcagggaagtccagtgctgtctgctgctggcctgtgatggatgaattggccctcttggacttggtccagtgctttcaaactcgactttgtccctccatccatatgttcaggcttttttccctcctccccacagcctgggcatggcaggtgaaggagcctcctcctctactttctctgcttctcaaatgttctaagacttgggagaagcccaaagacctccaggctcttcactcattcattcaacagataccttctgagcatctggtatgttctggattttgtcgtaggggttgtgaacacagcaggccaggttgttgtccgcatggaggttatcatgaacaaatgcatcaacgagaagattgtagggaatggcatgagctttgatgttactaaaacaagttggtgtcattggaagtgactgggggatgcgagaggggctgttttgctagcatgtagggaaatccactccatagaggggatgttcgaaccgagatttaaatgaaaagaagccactcagaggaagatctagaagaagaatattccacaccaagagagcgacaagtgcaaagttctcaaggttggaatggactttaccaactcaaggaagagaaacgaggctggagcttggagagcaggggcagaggtgggtagggatcagatcctgcaggggcttagagcccattgtcagactttagattttaccctaagtgcaactatagctcttggaggcttggatcggggagaaatgtgatctggtttacacggtaaaggatcactctgctttccatgttgagaacaggttatcgagaattctgacagccacaaatcctaacccacaccaaactctcctccagatgcacctcaccctgctgtacttctaggtccttgcgcctgcaaaaccctctgccaggtatgcctttctgcttactttctagaacattcctattcatcttcaggacccagcccccaggcactttcctgatgggccctccccctcgcccacagtaagggttaagttcatgttctcattgccattacccaattccagccataagcagactcagcctgtttctgggtccctcccccgactggaccaggagctcctcagacatcaggattgcagttgacttggctgtgagagcccaggacctgcacacagccgggcccagcctgggtgcctgccagctaaacaaatgctttctgggtggacacgaactcattgagtgcccaagtcattaacagaagcacgaggttagcaagcaccctctgtttaaacaaataataagattagaagtatggtaacatactacttaccacagcatttaatttgaatccatacttactagaaatcgtggcatctggacactgagtttccaagtgtttactaaaagcggcaatagcctgtgatcgtcaaaatttgaatagttctttctcaaggactgttcccttgctaccttgagactaggaatgtctgtaaaaaaaaaaaagaacacatttgttataatacttcttgtaaatacttgtgttggaaagaatacacttattaaaatacttcctatattcctgtaaatcctggtgtttgttcatgtgcagttgtaaacctgtgtttgtcacaggatgctgtgtacactctctgatatttttctaattcagctactgatacagaagaactgtgcagcttcttagtaagctaggaatatttaaaggctgtcttccttgttcatga

SEQ ID NO: 576 - DNA, 20001 bp, Homo sapiens
tgtttcctacctaccaagggaaaaaaagggaattggcagatagagtttatatcttgggatgagatgtgtaaagggccaggacctgaaattacgtgaaggttgatattctgggattggtagttttgaagttccataaagaagttcagtccagccatgttccaaatgctctgagtataggcactggctggtaagcttagtggagtgttatacaacatggaagtctaactggcagttcaatgtcccaaaagttggacagaaccaagaaatagagaacataagcagatgacagtaatccaggcagaaggttagtgtcagagaagtctgtcagtgggtcatagggctccacgtgctagcctgggtttccgtgccagaattttgttcttgggaggcaggtagggaaaagcaagtcaacatctccagttccagatgagctagggcacttgaccaaatacaggtacagaagttagtccttgaggtagagcttacctgttggagaacatggcagaaatcattgtaccaaaattggagcacaggtcagaggctaaagcatggcttactgctgtggctcatggtgaacttgagcttctcatggcccctcctatctcctgaggatggctgagctcacagatggggactgttatgtaatcagaggtcaagtggtttagctggggtggcagagagccaggtgaagactgaaagtgttcaaataaggaagagaacagaattgctttatgtctgccttcatgaagacaaaccctaatagccaaaggactgaaagtttgcccaaagagacctcaatttttgaaaggaaaatgcatcttctccttatgttagaatgaccacgtctaaataaaataaactcttttgccttttgttgttacttgtcttggtatctaccattgtttgacactaaaaaaaaataaagcagtgactaattattggctaatttaatctgtcatgatggcatttgtaattcaggtacatccttcattaaagcaagtataggcattattatttttaaaactttttttttctatttggatttcttctattttgtttgattatttattttgttgttactggtggtggtggtgttttacagtgagacatactggttagctcagctaaggtgtttgagtaagacttcataaacataaagtactttgtgtgggtttgttttgtgtgttccatcttacgtcatttgtggcactgaaaatgagattgcaattcccagagtactgggatagttcattcagaggttagcccacctaagtttatagcagttgtctgtaatagaattgtaactaatttccactgttgtttttggagaaaactgtagactataattatgtgttagcactttttaaacagctccctgcattgtcatatcattttaaatgggctctgttttaaaatgacctttcatgttttgattgcaaaaatatagcttacacaggtctgtagttagcaaaatacaaggatccagtaaatgatagagcattgacacaactctagaagcatgtgttaaacatcactggcactgccctaggtttaaaggggaagaaatagggaagtagaaattcactgttcttcaacactccttctgttggataggcaagattagtacatagaacagttatggagccatgtgaaaaaaaatagtagttatacaaatgtaaaatgctacacatgaagtatattgcattacctttttgtggcctatggaaagaagtctcagagcacagtaagattcaagtaccatctcccagaattggggtcagcaacaccattttatattttggcaaatgctacccactgtctcccaaacggcagatatctgcatatagttagtcatgtggacacacccttcctctgctacattgcattgccatattagtagtagaattttagtgttgatttaaaagacagtctgccttaaagcagattgcatagtttgcacactgtgaattgtaattaaagtgtaaggggggcttattatgtcaacaactggcatgagaacccccgagcagcaggtgaccctgaccatgtgacgtttgtgacagctaggatccccttttcactggcttagcgatctgaaagtccaaattgaaagaagcccagaggctgtatatttcattagatcccaggggaagtacaggatacagcttccttctgttttcctgggaggtcgccagaaagtttgtagagctctgtttctgtcagagactcaaaagagaaaagaaaaagcacacacaaaacaaaacaaaacaccatacacaccacaaaaccatccaccaatcacccccaggaccataaatttgacatttcccacagtctgagaccacagtgttgctgtgtcagcaatacgctccttgtttgaattgtctgaaaggaaggctcagtgttctagcttttaaaaaatgtgtaatcttcaatatgcagtgattctcttggtgtaaaaccatgagaaattatcaagtacagatatcatatgatttgcttgaaatacttttgcattatgcgttactttctcctgaccttctaaaatggggcataagtccgaatttagaaagaggaaaccacatgtgtaataagggaaacagactaaggagacatgccatgtgtatttcagatcttattgtgatgggtaaactgtttgaaatgtggtcacattaaaagtatgttactttgtgggagactcaaaatcttttacgagtagatttttattgtgttccatagtggaaatagaactagggtttggttttggtgggaagttttggtcttcaagtcaccttggcacctgactggcagttgtgaaactaagtagaaaagatacctcttttttcttggcacctcacacgggatcataggattcttactatcatacaatttatatatcacagaaatgaaaacttcggtactttgttgtataatacagatcttgtgcttgttgatttttaatttggggctcaagcttcccatgtcaactaatgtggccgctgctaggctgccctcgggtagaccaaatgtaagctcactaggaagtatttctagctctgtaaatacctagcatatcgtttagtccaggcatgtccaatcttttggcttccctcgaccacattggaagaagaagaattgccttgggtcacacataaagtacactaacattaacgatagctgatgagcttaaaacaaaaatcgcaaaaaaatcttagcatgttggccaggcatggtggctcacgcctgtaatcccagcacttggggaggccaaggcgggtggatcatttgaggtgaggtcaggagttcaagaccagcctggccaacatggtgaaaccccatctctactaaaaatacaaaaaaaattatctgggtgtggtggtgcgtgcctgtaatcccagctactcaggaggctgaggcaggagaatcgcttgaaccgaggagacagaggttgcagtgagccaagatcgcacctctgcactccagcctgggtgagaaagtgagactccatctaaaaaaaaaaaaaaaaaaaaaaaatctcataatgttgtaagaaagtttacgaatttgtgttgggccgtgttcaaagctgtcctgggctgcatgtggcccctgggccgtgggttggacgagcttggtttagtccctaagtgttgttcattttaaaccagaaagtgagaattttctgagcccagattctacctttatactgctatttgttatgttttggtcaaaagggaaatacagaaagaggaaagttaacagtcatggtttgtgtgcttgtatgttgtatactttcatgttttgattgcaagaatatggtttacacaggtctgtagttagcaaaatacaaggatccagtaaatgatccttgtatcatttatttaggaccctctgttgtaagggcccaaaaagactcactcacagtgccatacacatggcactgcatgtgtgtgtgcttgtgccagcctgggacgagaacttcaaggcttgagagaaagatgtaccattttcataaatttggtaaataaattaaaacctttcaacttagagctgcatttaagtgttataattaaaggactaccagttgggttttttgttttgttttgttttgttgttttacagtccatctattttagcaaattcgcaaataattagtttcttttatttatgtttttcaagatcggttcctctattcagccagaggaaaacccaatatccttagctgcgttttacctcaggtacccagagaattgaggcaagaataggttgtgggaatgtgagagaagtgtgtctgtgctgtctcagctcagttaactagtcctctgtagcaggataagcatgtttgtgcagaggtagagaattgtctccagtcatgattttgttttttatattttttactgcgttgttttttttttttttttttttttttttgagacagagtctccctctgtcacccaggctggagtgcagtggcatgatcttggctcattgcaacctctgcctcccggattcaagcaattctcctgactcaggctcccgagtagctgggattacaggcacacatcaccatgtccagctaatttttgtatttttttagtagagacggggtttcaccatgttagccaggatggtctcgaactcctgacctcatgatctgcctactttggcctcccaaagtgctgggattataggcgtgagccaccacacccagctctactgagttcgtaagtgaagctttttcccctctcatgttatttgaatattgtttccttcatctttgtttatttattatttatttttcaaaccagggtctcactctgttgccagaactggagtgcagtggcacacaatcatagctcagcatagcctcaaactcctggacttaggtgatcctctcatctcagcctcctgagtaactaggactacatgcttagctgtttttttttttttttctttttttcttttttttttttcctgagacagggttttgctaagtttcccaggctggtcttaaatgatgctctcatcttggcctcctaaagtgctgggattacagggatgtaatcctggacccttaatctttattattagttcatcatcttttatcatgtatactatgtgccttgaaagtgtgtattattttattatctgcacaattccacatcactttattgatattctgaatatacctgtagtatgttaataaatagcatctaataaaatgtagatacataaaaataagccattttcataacttttggctaattttggaaacagcattctcaactgcaggtcagatttttaaaagaatttaattttatctgtgattgtgtatacatcatgccaaagataaaagcaattcagttgagtgagatagggtgtggaaacaggctacatgttggagtttgttgccagcctgacattttcaacacagtttctagacccatctttttaaatgcgtgctacaatgaaaaccaaaaggactttttcatattgtatttgcagtcatctatagatgtaacttctgatgtctttatttttgttgctcttctcttctcattaacagcagacctgtagacacactagtcccaacatggttgttttacttcctcatatgtgtactgaagtgttctttgctgtctgatgtatattaaggggtcttcagcaattatgaaaccattgctgcagaagcccagagtcacatactatagaaatattctatagtaaggacctaacaggattcacattaaacagaacttgactataaactaatggattcctactacagataataggaaatgtggttttttttttatttttttgaaacagggtctcactttgccacccaggctggagtggggtgacatgatcatggctcactgcagtctcgactcctgggctgaagtgatcttcccacctcagccttctaagtagctgggattacaggcacacatcaccacacccagctaatttttttgtagagacggggttttgccacattgcccaggctggtctcgaactcctgagctcaagcgatccacctgccttggcctcccaaagtgctgggattacaggcataagccaccatgcctggccaggaaatgtttttaaagactctggttcctacaaaatttgcaaagaattgtgaaaactgtctatccacttctttaaattttaatttttgttggtttatatttcaaatattacattgtcaattaggattattatgaccatagatgacacattttgcccatccctgataaagagaagaaatttgctccctaatgtgtagccagtttaggaattttagccttaattgaaaaatgtatacttttttgtaactggactttgtttctgctaggagatagaaaagtctataagccatctctgagatagatttctactcttcctttaaaatcttgcccggactggcccttcccctctctgttcttccattcaaggctcacttattgaacatatattatgtgcaagcacttcatttaggcaagtacgagctgtgtgccctcaagggcttataacttgttgggaaggcacgtgggagttatatacacagagaaatgaattaggatctgagtcccattctcagtaaccagggtgtagggagccagaggaaggaatgatgagttctgccaagaggaagggaaaggattctgacgttatcttctacactggttagaatagaaggatggaatcctaaatttaagacggagatctgtgctgtatacatgtgactaacagagattgggaaagagtgtaattacctcctgtgcctaagaaggttgttggcgtaaacaaggtagaagcaaagccaatttttgggacagtttaaccgaaatcttttcaaatatttggtagaaagcattggatgaagtgttacaattttaattaatgtttttaaatgacaattgagggttaataaagccattgttgccgtgcagttgagaagagtagaatgggtttgtttttgcaatcccagtggggtaattaaacttgcagtgcctgtcactcattccttaggctgagggacttttgagattgcaatagctcatcttgtgttgcagctttgtttttaaatttagctaagttaaagcctatggaaaaaaaatcaagggaatggaagagatgagttttgaactagtgaatgtgttcactcaaggcacagggcctctttgaggaatttaggtcgcagacgtctttcacagaaaagctgtgtccaaactgtcacagttactgcctcagtgtcctgttttgttctgaaggacatgacacctattttccatgcactttttcagaaaatagtatttgtacccatttgttttgtcttcttaaggaacgttcatgcagacttttcgagcagtgagcaggcgccagagactatgtcactgttctgttctgcacagtgtagcgatttgcagttggcgaatgaattcatcagcggatgaatgtcagctcactaggtgacaagcttcctgtgatatagactgggtgaggacagagcttggtgagccttttttgttcacgacttcatctctagcactcacagtagtgcttggcacatagtacatgctcaataaatatttgtagttttatttgtggaatgatatgctgagtaaatgattagagtatattatcaagaaattactatttttttttgagacggagtctcgctctgtcgcccaggctggagtgcagtggcctgatctcggctcactgcaagctccgcctcccgggttcatgccattctcctgcctcaacctctggagtaactgggactacaggcgcccaccaccaggcccggctaattttttgtatttttagtagagacggggtttcaccgtgttagccaggatggtctcgatctcctgacctcatgatctgcccacctcggcctcccgaggtgctgggattacaggcgtgagcccctgcgcccggccaagaaattttcatagagtttccacttccttggttgctgaatgatttgtaatattgtaatcagtatatctatgacacaatttctaaagttatttagtgtttgtcagtgatgtctgaagctccatttgctcttttgaagtcatttgtttcttaggacctacaattcttaggaaaaaatgacttacagtcaaataatttaggaattttaggggaaatctggagcccattttatttagtggccttaaagatgaggtacataagacccaggctaacccagcttctaacagttgattctgaatcccaggtttcctgattctgaacttgatgtccattttgaggggttgttaagccaaataccttcaagcttttcccctctgttgcactcacatttatgaatacagatggtctctaacttaggatggttcaacttaagaatccacattccataaaaatgggactttgattacccatacaatactggttttcactttcagtacagtattcaataaattacatgagatatttaacactttaatataaaagaggctgtgtgttagatgattttgcccaactgcaggataacgttaagtgttctgagcacatttaaggtagactagcctaagctgtaatgtttggtagtttaggtgtatcaaatgcattttcaactgatgatactttcaacttccaatggatttatcaggatgcaacccccatcataagtcgaagtgcatctgtacttactttagactaaacaggaataataaagtactctaggagaagagaactcagtaagaggttaactttacgtggaaatgttacaggcctaatgtaaggtacagccaacaacaacaaaaaaagcaagctggcgatctgccttccatgcaaaggttatttttcttattacaacaaaactaattagtggattttctaatgtaagaaaatgttgctgttagtaaaagtttcctcagtgtgccagaaagcagatggtggcagtgaatagtgttttcttttgccaggttttgtatatgctttctaaacctgcaagagattttgcttttccagattcagatttctgatcttttttattttaaaacagaaatagaaacttatatttaaatgtacttgcatcatgtggtctgtttgacatattatggttacttgaaaatgttgagtaacatttgatgttctgcatgaatttcttctctaagagtcttgggacttttaatgttgttctatactctctctctttatggaaataaagagtttctgccttgagagtgctacaatggggagttttgagtgatttatgaaaagcaatgggtaagatttttttatgtgaaaatttgtattttgtttcactcccaattactgtgcaagtaccagcttttcacagtgaggtttcttacagcatgactttgttcattatgacttcagtgtttgtatacagttttgaataatttatttctgtctactactggtgagatgttactttctgctaatttaaaatgttttgcctaacgtttttaatgaaagtccttataaatatgtttgtttaaagtctgaaatctaaacatgtccttaacagtaccaacgaggcagcattaaaacaaaaggcatgttgattttaaggccaactggaagaatgtatatctacaatggtgtagacgtgaggctgtaatgagcatgagtgtagtcaagacttatggctttgttgactaaaacttaagagatgctttcctttctataggacctccatttagaggagaaaaggaaatcattaagtcaatagatgagttattaaagtataaagtaaaaatggaaaatgaaaacacactcagtgatttttttggaaatcatttgggcaaaagtatcaagaaagaattgtctcaaagttactaaatggaatagtctccttatggaattatgtgctattttgggaggtgatagccagaatcaaaggaaatgaaagaaggactttcatcccttctttcacctcattcccatgtagctctgctgtgttgttccatccatccccaacactaacctgataattcggagacaccttgccgcatattgtttcacctttaattcttgaataaactctgattcttacttataacttttcccatgtttgttgccaataaaatttcccatctcatttgaagagttgctatttctgtcacctgttcaaaggatagcacttcttttattactacctctttctttttccttttccaactatttctcctttgactttgtttttcccaataatgatttgtttttatcttctttcctagtaaccaaaaattaaaacaggacagagtttccaaaggaaatgtctgtagatgttaaccaaactgattgaatcactggttattctttgcttactttaaggctgtaaatctgcaaaaagacagaggtgatactggtatcactcacagccacaggttagtgccttggctgtgctgatgctgccagggtttaaacattgctgtgaggagcccagcacaggcaggagtgtggggtgaggatgtgtgataacagggcatgacgggcaggtagaactgctcgcttgtgttttacacacaggcgccccagccttcctataggctctttcttgtgaataggcttccaccatgaccaaaatgtttgaaaaaccgtaaagccaagagataagtaatttttgttgaatataaaatagataagccattacctattcataggaatatttacctcctgatagactttggcaagggttctaacacagagacactccatgttctcaccaccagtgaagacgagggaagtagctactctcaaaaaacaaatagcattggctgggcacggtggctcacgcctgtaatcccagcactttgggaggctgaggcagctggatcacttgaggccaggaagtcaagacaagcctggccaacgtagccctgtctctactaaaaatacaaaaattagctgggcatggcaacatgcacctggagtcccagctactcacgaggctgaggcaggagaatcgcttgaacccgggaggcagaggttgcagtgagcagagatcacaccactgcactccagcctgggtggcagagtgagactctgacttaaaaaaaaaaaagtgtaaacttttataaatgatacagagttgaatgaatggaattcttggtgaacatgatgagctatctcaagactgaataatgctttgcacacagtaggtgataacaaatgtttgaggccctgacataaacaagcttcctcctcctaagaaaggttaatcaatagtcattctttagagtgagggatccatgctgatttttgaaaagtgaatcagagtaaaagttccaatcgccctcttggactttttgatgatcagctattgaaatagcacgtatgttagagacagtcctcccagcaaacatgattttctattaaaatacatccaggtgacaaaaaagaagcttttagaaaaaaagaatttgactgagcgtggtgactcacgcctataatcccagcgcttcaggaggctgaggcgggtggattgcttgagctcaggagttcaggaccagcctagccaacatggtgaaaccctgtctctactaaaaaatacaaaaaagaaaaagagctgggcatggaggtgggcgcctgtaatcccagctactcaggaggctgagacgggagaattgccagaacccggaaggcgaaggttgcagtgagccgagatcgcaccattgcactccagcctgggcgataagagcaaaactccaccttacaaaaaaaaaaaaaaaaaaaaaaaaaaaggatttcccgaaggtagtttatttggcaaatcccacacaaactattagtagtccttatacgaagacaatttaattttgggattattactaagcaaattactcacaaatactgagttactgaaatggaaaatatttttatctccccccagtgtaactacagacaagaatgtagatagtgtacttaggtgtaaatgacagatggaatgaactttgggtgaaggcgagagcacagaagctcagtggtactgagctgggtttgagtgggtgggaccccatgactggttactgatctttgaaagcgtttcaggatttcaaagctacataagcgaattcacgtgttttagttatctaggtttgttttttccttgttatataggatgtttgcagttttcccatttgtatcaactcatacatctttgaagttttgtaattcagtatagctttggttatagattaaagttcactggaaaatcactgactaatccttttagcatgttccactgttccatagtataaagatacacagaacttgatggcttccaagtgtggttcaaacatccaaagcactcgagattagcaccatgtgaagaaattttaaaatattgtactgcaattaattttaaataacttagcactgcatatgtcagggagaaagccatggtagaattcaaacagaagctcctataagtgaaatgattcacttacatcatttaaataattttatctctcataaagacatagaagcaaaatatatgcctatttccacttaggaaaggcttgggtgaatttctgaagaatcagatattacctgaggtttattataatatgggaagtctgtggagcatttattggttaccaaatgattaactccctatattcatgtgtatttgttataggttcaaaaaccaagttattacagaaaagttattgtcaatgtggaaattgaaaacacattattttaataatataacgtagagaaggtatatctaaaatacatatttttaagtattatcctaaattctaggatctagattaaattctttgaggatatctttttagtagctcctgaaacacaaagttttctggaagacccgatgggtcaagatataaaggaaaaaacttagtttatggccttctgtggtcaggggttagccaagtcactgaaaataaacatttgcaactgttagtgggctatttgcggtcatttataaagtataataagacacagtttatgacttgtagtgattattgcactcatgttatttctaattgcacttatgatcagcagcaaataagcaaatatcactcagtgccttttgatgaaatgagagtcttagccttgaatgcagccgaagaccaacagctcaattgctagtgatgtgtttcaaatgtagaaaggctggaaagaacctttgctgaacacctaaccctcaccttcatctatagatattctggcctggagaggtaagaatttacatatccaagggaaaatgggtgatttacgaccagaaagtagacctcctgactcccatagagacccttcttaccacatgaaacataccatcttccagtcatagagtctcctccaaaccagaaagaacaccccaaacacctattgacctttcccaagagagaccctattgtattttatggctctgaaagagctaattttttttctttctttctttattttttattttattttatttttatttttgagacggagtttcactctgtgtcccaggctggagtgcagtggcacgatctcagctcactgcaacctctgtctcctgggtttaagccatcctcccggttcaagcaattctcctgcctcagcctcccaagtagctgggattacaggcatgctccaccacgcccagctaatttttgtatttttagtagagacggggtttctccatattggccaggctggtctcaaactctcctgacctcaggtgatctgcccacctcggcctcccaaagtgctgggattacaggcatgagccactgtacctggcctgaaagagctattttttcatctttgtatttaaattccatttcaacaaacatgtgttagtatctgtatgttccaggcatggtgctatctgccagtaaaaatgagacagaaaattaaatagcatgatgctttaaccagtctatatgctttagaaaacctgcttccaagcagtgaacagttagagaattatagccactcataatttacaaggcactgtaaatcatgccattcagtcctggtactctctagagtcaggtatttggaatgagtcagttgaggttcagggaggtaaaggggcttgcccaattcctcaaagctaatataaatagccaagaagggactcaaacccaggttttcttttatcatgccttttgccttttttcactataccatagctacttctggtagaactgtcatttctattaaagggaggataccaggcctaattcagaataacattctgtactatgtatgcaattgtttctaaggagaaaagtctgatttaaaaaaaaatatttttatacttttaggctgggtgccgtggctcatgcctgtaatcccagcactttgggaagctgaggtgggtggatcacctgaggtcagtagttcgagagcagcctggccaacatggtgaaaccctgtctctaccaaaaaacacaaaaattagctgggcgtggtggcagcacctgtaatcccagctacttgggaggctgaggcaggagaatcacttgaactcaggaggcggaggttgcagtgagccgagattgcaccattgcactccagcctgggcaacaaagggagacttcgtctcaagaaaaaaaaaaattggatactttacaccatttccagcaatgctagttatgcagtaatagcttaatatttcacttaaaaaaagattctgcctaaacctctctttatctcactagaagagctaaccctaaccactaccaccgccagttagtatcagggctgctgtaaattgttccaagggtacatttagtggtattgattgctgctaatagtaaaagaataaaagcaattatgaatgtacacaacaacttgttgctctaccccagtttcaccaggagataggatttagtcaagaggggatgtcacagaatctttatcctgattaggagctttttgaggggagggaccttgccttttttcattttgtatctccaggtatacagggtgaaaggcaccatagtagatgccaagcgaatgaatgaatgaacgagatggataggcccaaagacaactaaatcaaaaaacctgtgttgtttcagaggagaatgatccagtatcatttcccctttgggtaggagtagtggtatgaatattgctatgactgcagaatcccagacttgtctagaatctctagttatagctttcctcagcagtgggattcaccaacacactgaaataacctgtctgtggcaaaactccatacacaatcctgttttctcaaatgcttcaaggggaaaagaaattcctgatttacccaaccacagaatcttcaaccttctcattaaggcttctgcattttttaggcaaattgttactgtgccattcttactcctatcctttcacagaattattttctgattatggatatgacaagacccagttgattttttcagagtttagtcatttattctgtggtttcaaatctcttctaccatgttatcttcctgcccctctactcccctgcccccaccccccgacaccaattcttaattccctttcttccttttattctcaccaggaagggatatgtcacagtaaaccctaccaccttgtcatccaaaatttctagggagccttagttctgagggtcttcttcttgaggccttaaccttacttttagacagttgtcattatctttgtctaaaggtcatagctaaattgaataaaaggaaagctgtgttttcctgttgatgcacaaaggcagtattgacttccctaatccagtttgctgaggggtgagagaattaaattagatatctaagcacagaaattgagagcctttgaaaacaaagataaggagacaagactgtattttcccttttcctgggagctctgggctcaagattttgcaggtgtgtcatctgatccatggcttgcatcgatcaaaactgtgccaatgcatatttaattagcaaggggaccctggatgcattatagccatcatccctatattgaatggactgtcagactctccgcacacttctccacccccaccgtcccctgaacccgtgctccctcccttgcctcgttgtttgggaagcttctgcattttgtctgagcagctaaaaagtttctttgtttttagctgctgatgcatacagcgccactgaggagaatacaaacaagtagagtcctaaagtgtttattttgtctaggaagacaagctaaaccaatttgattccttcggtaagattttcaaaccctgtagaaaaccgacaagaaaagcaaaaagaaaatgaatacactgttcaactcttcacgtatagaatttaaaaaaaaaaaaaagaattggttatattaggaataaagaagacttcggacaaatattttaataatagaattaaagaatactttctattatgatagaaggtattttattttaaaagctctgttttgatacttaaataagacatttgttgttggcaaatattttattgatcagtctaatttgcttgatgcaattcaccattctgacatgaatctgtcattaccattaggaaatccaatgcctgtacaaaagttatttatgatagaaggtgacaaagagttagagctggatgtatttttttttaaagtttctaaggttttgtgggtgtttctgttggtgagaattcttaaagtgcaggaggtttggagttttgccacagacaggttatttcatgggattatggtcactgttcattttcacacaggttccaaagcttgaatatccagacagtgttgtctgataaacagatgtaatgcaccaagtctgcttagaataaagagcaacagactgtgagcacatgtttaggactcatttaaactcatcagcatagtctagctcatagttctctgtctctagtctacttttgaggtagcttcttgctggtaaagtaacaaggaattattttttctctgctacaatttgctgcagagactcatgggaaattcatttgcatacatcttgttacaaagactgactacttcctggcttagacaaagtgttgcctgataaacagacttaacacacaaatgtctgtctggaataaacaacggcaagctgagatttacatttcattatcaaagataatctctttcccagtatatgagaattaagaacctgttctttaaaaccaggtctgtgctcctgatgttttatactagaatcacatcatgtgtcggttggggttgattttcacaaagaaacgaaaaacttgttgggatgtgaagatctgtagggcagaggtaaatgtacattttggggggcctttatgagtttcaaaaccaggttttcttgctttattttatttgaaccacacaacatcctgttaagttaggcaaaatcatcagtagtgtctccattttacagatgaagaaactgagatccagcacagttaaattatatagctgaggtttctaggacaccatctttttaccatttcatactcttttcaatggtggaatatgaatgcaagaaaattagtactttaaggtgctacctggacttaaatagcatgtttacacttgatagagggcattttattatttcaataaaagtttgtgcagacatccaggtacatgaaaataatgcatgtagattataactcaattatccttcattttcatttgaagcatgtattttatagtaggaaagaatacagggacattttctacattaagtagtatagatggctgtatgagtaatcttcaagtatatatcatcctgttgaagaactccaagaacctagtgttaagattaattttgattgtgaaaaaagtgactaaatggggaaattaagcacaattctgctatgcaataatgttgcagggatggctttttaagcaggtctttgtttacatgggagtgggtaggtgatcgggtagactcaataacttgagttctgaattaatcagcaggcaccgctgtgaacacagcgcctcttatggggaaaacaaaattcaaaatgattacctagacattttagtttagtttagtcaaagcgtcttctcaaagaaaatgtgagaagttacaaacttagtcaaagtatcatgtttgcctgtcttttataatcaccagcttcttaccattgacttcatttataacatcactgaaaaagctgatcattacttgaaattcagcctcatgcgaagattgaaggtttaatgattgagtcattttgtcattactttcagagtgactgaatttgtcatttttaaagcttagaaatgatcctcccctcactgtcataacacaacaatagttatgccatttcatttttttctcaacgtgttagaactgtgtatcattctgcaacctccttgtgcatgtagaaaaataacacattgatgagtaggtgataaggcagttgactcactcttcaacttaaacagtcttatcatcgtacacagtaccgactaaacagatgggccctggaataccaacattaatgaaataccagaaaagttgaatttctgtaaatttaatatttcacaaacttgtggccagaaaggcattacaaaaagaaaagttttgagaaagaaaatggtagtaacctagattatgtaacagtcttaagtaggccttgacaatgcggtacaggggagtgactaaggggtggatctccagagcagctggcagcccccagggtggtctggtggagggagcccttccaagtggctgctgcaggaacacagaccttgctccctgtctgaatcaggagtagaggagatgaggaccaatgcgtgcaaactagcctggtccttttggagctaggagttcccctgcaccccgccacagctccccatctcccttcgataaaggacttactctgcatacattaattactgcagttaccgtgtacatatatctagacaaacactcaattctagcttgctgggaaagttataaagatgaaattttgtatttaaaatccagtaatgataagatttcccatttaaagaaccacagagtgtttccatttttaaagcttaagaaaacttttatggtatgactcacctcatcttttatctgttttaggaactcggttattgtacgttaattttcattaagcgggccacagttgtgtacattaattgaccttaaatattagtttggttattcactgagcttaaaagattttattcattctctgtaaatgctaatcataattgcatattttcggtggtccggatttagtaatggtgttacagatttctgtttgttcttaaccagaccatgatggataatattatatttagctgatggtgttgtattcatcaatgtttacccttaagctacaaattgtatatacatgtgtacacctgtacgctgacattctacattctcaaataaggtttttccaatattttcttcacacgtcagtctttaaggtcacggtcatactggaaaaaatagataattttcctaaatattacaaagtattacaataataatttcttttataactgcagctgtgagactaataagcaaaatgtgactattatagttatttgattttctggatttcgttaatgtaataaacttatggtactggctgatcaaaacagagtaattttaaaaattatgttactcataagaacagaattatttctctattacaaccttatagatgtagaaaaatgaattccttggcctcttctgcagagtacttatcttcccaaaccctcagaaactaaaacttatctaaattttgaacatctttaaggtctacagttgtagagggtaactgcttattacactcagagtgtaatcacccttactccttactttcttttacctcagaaatgttcctaactcttcatttatttgcaggaaagtattcactcctgtctttgccttttagtttttatactacaaacaactctagctcatgagagtggaattttcgctttatttctttcactaatatttttgggtttggatgccttctggtttcttcataccgtcttttaatttgggagatttaaaactggaca

SEQ ID NO: 577 - DNA, 20001 bp, Homo sapiens
ttcctgtctgaaactcaaaagccaagtgcagggaaactggagaagtttgtgctaaaatatgaaaaatataaggaatattagtctctttcatgtggaagtcatcctggaaagatatttttcttgcagcttcagtcactcctctgttttttccccattaagtatcaactatttctatttctatggaaaattggatttttaaataaaatacccacaatatcttgaaaatgcacacacggcaaaggcagtcactatgggagtgggaactaaagagagagcaaatgcctctgatgaagatagaagagtctcagataagttatattactcagacttatggggttttggggaggagggattaaacctgaggactgtgatagtgtatcatcttgttctcagactgaagtgcaaagtgtgaggaagcacccagatttttctatcaatggacaatgggatgttgttgtggagactgaagagaaacaagagactttggtctttgatggggtcttagtttgcagtggacaccacacagatccctacttaccacttcagtccttcccaggtatgtcgctaagaatctgtttggtagaaaagtactttccagataacccacagagcaaaatgattgagcatgaactttattactagtctctggtcacattgaataacaaacaactaaatgcccaatatttctgttaacaggacaaaactaaacaacaaaaataggcaaacacataacatttgtttattactttctatagttttaaatagattctaattaatgataacaattagccctggcccactttcaactggttttagttttgtgtccattcatcttatctcacttcctttcagagaaagtgaaattactaaaaataagggacaaatggtaagcaaatcaagcaaaaagctggcaaatccacaaacttagaaattttagagtatgagacaaaattttaaataacattcatcactggtttgcagtggttgataaaaacacactggcaacttactgtttcctttgaattctgtttgataaaatggtgcccatctcaaatgagattattacttgaaaaaacaaaacaaaacaaaacaaaacaaaaaagcttccctatcccctctaactaaagcctctccctttacttctgatccctttcccctccctttacatcaattgctatcagaagtcaatcaagaaatacttgatatctcagtgcctttccatgatgtctaacaagccatcataagaaattctttggaggttgaggcaaactgaaaacagaagagtcctagatgaaaatcaagggacttaaacttgaattttggttgtccaactgactagctcagtcatgtatgacaaatacctgacctttctgtgtctgcacaccaacacaaacatttacaaaataaaaatacctgattttctaaatgttaaaatgcaatatattctggaaattattatataattataacaaaatatataggttatattaataactgtagtatatgtatcagcttctttttgacttgcttcctggctgagagacataccctacagagacacttgtgggacatatatattttaataggtttcaggggacagagatacaaacacgcctagagtgagacaatgtccgagaatgccagacacagattagggctgttctgaagctctcagcagagccagggacaacatgagggtattaggcacttggaagtcagaggagatgtcaagttgatgaagaaaggccctatacttcctcatagaataatgaaacaaaaccaaacaacaaccagtttccagcttcatcattttgcctaagactgcagaggacaatgtaatcatgaataaattagatcatagtgaaattgttgtgaaactttcaatttggaataggtccaagacagatagatctactatttactaaatactttatatggtcactagtctatatttagcatctattggtactaagtctgagtttactccctgctttcctgagctctgtgaaatataaaattacatttttaggacatagggtaatgttccatatagctaacccagactcaaagtcttgctcttccagatgaaccagaatataactttctatgtgttgagttagcaatgtgaaaaatactcctaataataagaaatgttcttccaccacaggcattgagaaatttgaaggctgttatttccatagtcgggaatacaaaagtcccgaggacttttcagggaaaagaatcatagtgatcggcattggaaattctggagtggatattgcggtggagctcagtcgtgtagcaaaacaggtttgtttgttttgaacaacttcactaatggaaacacaactttcactagtggaaatctccgcatttataggtgccatccagaatgtaggtttagtctgtgaaggaccagaaaagaaagtgaaatctatggaccctggcctcaaggtgtttaaattcatggggagcagaggataaatgcaaaataaatccttcatattcacagtggaaaaatacatgtaaacaaattactattaattgagccagttcagtaaaatattagcatagattaaagaaaatgttagataattaatctgacttttttttactgccatagcagtgccttagtcctgaaatagaattcaaatagtggtaaagatgagaaattgcaaatccatctgggatcagcgggttttggtggtagaattaaagaacagaaaacagaggagaattaatgatgatgataaatatgtaattctcttgagctaaagtattatgttgtatctacaatgatgagggaagataaaatactaaattttgctttagacatagtttatttcctgcaaaaccaagttatctaagacttccatttatgcttgattattcaatattctttcttctcttaaaaaattaataatactcagagtttattaaaaaaatgagatactttcacattcaggattgctggccacatttaataaagccttaattaataaagcgccctacctatgaggatgttcagatatcctgattatcgttacttatttgtctttatttgtcatcatttattgttagtttttagaagaaattactaagtgaattactgaagtttagtttattttttaaaaaattaataagcatttaaaaaggtaaatgtttggtcactagcacccatctaatctatcttgtactttacagatttgaccagtaggaactgagattcaacgtccccaagactgcaaaagtacctacaatcaaacaaattaatatatttcctaattggatcagcatgcagacaagtttacaaatatattacagaaagatttgaagagggattctggttacgttcagttaagcaggacactaatcctgaacaatctgatgtattaaagtttctaatgtttgtatctttggtttgatgcatacaatagagtggaagtctgtagtagttaatatgatgataattcgcttctaaatttaaatccttatttatatatgaagcatagctatgtcaatgtccagggaagcatttttaaatagtaaatcagaaacatgtaaactagtgaatacaattttctatttttcattcagaaatttgttgtcatagatgcagcctttatctggaaatcagtgggcagctctggtcaagcacagcatggcgaccactgtgtagtattttaccacctaatccttagtagccaacactgttaaatctgcataatgggtagcatatgaataaaataatatcttgtaaaatgttctctttctctctccttcactggtttgctctatctctgcctccctcatatattccttagtactagacgtggatcatggattttacaccgtgtttgggataatgggtatcccatggatagttcatttttcactcggttcaatagttttctccagaaaatactaactacaccacaaataaataaccagctagagaaaataatgaactcaagatttaatcatgcgcactgtggcctgcagcctcagcacagatgatcaccaaggggccttactttatgcaattatgtgtatgtgtaaaagggaagttaccctaaagacagttcagcttctggcaattaacatgtatttcggtcaagtaatctcatacactcgctaatataaatcacttatattatgacgtatataatatatatcattgcacctaaatgggtcagacaagtgtctggagaacagcttcaggaacctccaagatgagaatgggagagtggcagatcttggaaagaacttggtgtggactttggtaaatgtcaaagtcagcccttcatgaagaatgcctggcactagcactgcacaggttaagaaaaatatgaaggagtaggctgagtccttcctgaggccaggaaaggactaaaaatgaggagacaggaaggccttctctatgtacatcagcaagagaatgcattactggtttctatatcttggacagaaagaagtagtcctcttcaccttttaccgcctgtagaacagcgaccacaaggagcattctgataaccagacatcagccccaatgagctatcaaaaatgtaccatcccatgtaaatgaatcggtatccagagaaatgattcagaacatcagagcacatgcctagctaggcaaattgaggaggaaaaagaagtcaacttgcattggaataggaagagatcttaaggggaattcaagtgaaacatgaaatattattcagagcttaagaatatcatttggcaactaaagacaggagtagataaattgagggaaaaatggttactggatagattaagagaaattggaataggtggagaagacttggtgcttaaataaataatagaataatttttttcagattgaaaagagaccactgaattccaggatggattgtggacacacatgcacacaaatatacccgttcacatacatgtaccatcatgtaggattcctccattgcccctacttttttctctttcctgatcaagagatatcagccagctgcatgttttcccttgcaggcctaaacccaggcctgggccttgaacattttcagccactgataaaggtatttaggttattgccccaaacaccaaaggatactaaccctggacctaagccagattccttaagctctcagataaatatcataacctgaccctctcactgtggatatacctaagcagaacatcccttgtcttattgtccatcaccaggatacacagcagcctcctctgtacataagttcccctagtaaacactttgcaatgatcactctggcatttagtgcttctttcttcagaatcctagtcagtttcatctcagaacaatttgaaaccctcccctgcagaaactcccaagccaccgctaaaaaatacaaaagatagatgatagatagatagatgatagagatagatagatagattagatagatagatgatagatagatagatagatagatagatagatagatagatagatagatagatgatagatatattccatctgggattgtgtaatgtaagtgctaaaaaaagactttaaacaaaggatgtatagcataaggaaaattctaataaatgtgttaaattgcctcaacaaactcaaggagtgaagaagaaagaaaagagaacaatgagtgacttgactagagctacaatttagaaaattaatctacctggtggaataaaaaaccaagagtcagagattccttttaattttgagtttttgtgtttgtaagaatactttgcatattacagaaatcaatactttttagaatcatctgttacatttttttctgatcatatcattttcccattgatttagctttttaaatacagagaaatcttaactttcaatactgatatatttccatctcttctgtcataacttctgagtttttaaactagatgaagaaggtctacccagccccaagattgtaaaaatagtctccaaaatttaccggcaagattctcactttttaaaaattttgatacttacgtctttaatcaatcaagaatttattttcaacctggtaactataagggtcgaattttatttacgtatgtctagtaatgctcacattaccctcagattaagtagaaaacagtggccttgcatttttactctctactccttcccttaaagtttcttaaatcaaacttagctccacacgtttctatatatgcttggcttgtctagacctatatctctgttcacttctttccctctacctcattttcagtctaggtcttacgtacctataacagatcctcccactggttgttactgagtagctcctcctttcttaaaacagaagactgtctggacaaggcagtaatgtgacaccgttttctctaataagagtgagtgaaaatccactgcatggcgtttctgagaaggcaaatgttttcaacataaatctttgcctctcctctttctcattgtccctctttggaatgttgtttcaatgcttggaggtacagttctttaagacaacaatttgccatttagcaaatatttgaatgggtacttatatcaggcaactttatagctaattctgctacagacatatttattatatatctaacttgagtactgattttgcctacaaatgataagaatttggtagaaaataaggtggagagaaggctaataataatttatgacatcttttcaaactgggatccatagtcatatatcatttttccctcaattctaagtagtttaaaatattttagcactaaaacaaataagcattatggcacagaatcaaaatatacacaagttttcaagacaatgtaagactagaaaaaatgtagagctgaggtagccactaaagcacttaggtgtaaaattacccacttctgccattagaggcaaaaagtaggataggtacagagtcagaggaaaaatagaagttgttggcttcaatcccttctcatatgcattattttctttttgtatatttgcttactcaggacttttatttttacatacagggctttaagtcagcatccaactgtcagtgatgacctgccaaatcacataatttctggaaaagtccaagtaaagcccagcgtgaaggagttcacagaaacagatgccatttttgaagacagcactgtagaggagaatattgatgttgtcatctttgctacaggatacagtttttctttttctttccttgatggtctgatcaaggttactaacaatgaagtatctctgtataagcttatgttccctcctgacctggagaagccaaccttggctgtcatcggtcttatccaaccactgggcatcatcttacctattgcagagctccaatctcgttgggctacacgagtgttcaaaggtatgtgaataaatgttggataaaggcctaatatttcacctaaagttaatactctgttttttcttaacactagttctctcttttcagcaaaatgcacccctcttattcctaggaatcctgacaaactctgaattttctcttctagggctgatcaaattaccctcagcggagaacatgatggcagatattgcccagaggaaaagggctatggaaaaacggtaaattaataattagtagcaactagttggagaccttcatagggatcacaaaattttaaatcttaaattctaaatatatgcttcatctcattgaattatgcaggcatttttctccatttcctacactatattgttatacaacaccaaaacaagtatgaatcttagttccctaactcagttttgcaacaaatagtcatatatttattctctttaagtcatactaaatttgaatttaagccctctatatcaatttcagtcattatgaatatttctcccaggatctcattatgaatatttcttcccaggaactcaagaagcttatgtgatttcccaaaatgtgagaatagtttctgattttcaccacatcgtgttctttactgacatccttgttgcctaagtttaaagtatacccttcatgtctggaggcttttggcttccctatcacaagtagagtgcaggaatccttactgagaatgggggctccagctaagatgggcttggagctcagcctccctaggaacccacacagctactctctctgacatcttgccctagattcctagactttttcagaccagttttcaatttcctgctgtgtgaaatctctccctttcctctcttgttaacttaaaatacatttatattattcttttccatgagcccagaatttaagaaataacaaactagaaggggagttgtcttgcaaataaggtacttctttggtcatgtaacaaaaaatatctctgaaacaaggcaacaggaaaggcttggccacttttgcagagagcagaagaaaggaatatagatagaaaagatacaaattcatatcttaataaataaccttgccacattatttcagcattctaaagactttatgtgtgtgtgtgtccatacaaagatatgaaattcattcccattaactgcccccacacacagacactttacagttttacaaactttgcaacacagagaaaaccattcgttgaaaaggccttcaagtgttgcactcatcaatacttggaagaagaagtgaattcattaaaatgtattttgtgcctattgtattagtcatattgctaagcatttccaataggattatgtacaatgtaaatggagagcaatttaaatggcaacactgctgcttcttcttatgtaacagtacctgaaaaattgtgagggctacaaactccatgttatggggaaggtcctacaacatgaacaaaagttcaatacatgcagtagaggtgccagctcccacacatctctaagatgacactttgtgcattcctgcatcagaaagacatgctacccttgccctgtgttgtacagcaggtgtgcacagggctgctgctatctcataaaataagtttttgcaaattagaaaaagggcagcccttcctcaggacactttacttccaaatgctggaagtcaaattctcattataaacatcaaatctacaatatctacaatgcaaatggggcctctaaggttacgcagccccattgcatcatgcaatgtatgctcagagttgaagcatctggggcaagggagagctacccaagaagctgccattctcagcagtgctgcagagtcaccttgctctgcaaaggagactacgttccccacattcttattcccattgtggtcatcaaactcctggagccaggttatcaatgactgctgatcatctatcccctggttaactacaaagacacacggagggtaaaagttaaaaattttccatcctgccaacatagtatacacagaagtattttactggatgacaattcttcattttaaaaaatggacatcttaaaggatagggatcccttcaaacatcatcagttcagtcaccatgaagggacagtgagcatggaaacttggattgtgagtctgccctgccattcaatgattgagtgatgctgggtttgtcaattcagctttctggttctcagtttcttcacctctaaagtgagtagaaggagtttaaactttttgtgattcttggatgatataaatctctgtccagggactgtgagtcttctacattcttcccttttgtttcagatatgtaaagacaccccgccacacaatccaagtggatcacattgagtacatggatgagattgccatgccagcaggggtgaaacccaacctgctcttcctctttctctcagatccaaagctggccatggaggttttctttggcccctgcaccccataccagtaccacctccatgggcccgagaaatgggatggggcccggagagctaacctgacccagagagagaggatcatcaagcccctgaggactcgcattactagtgaggacagccacccatcctaacagctctcttggataaagatggccccagtgagcctggcatttctggctgctggcttggcatactttcgatatactccttacggtaaatggaaataaatgaaagaacactgagggggaaaagcatggaatagtttctactcatcctgatcgttatatcttttaaagtcaatagcatatgtccaatattatttagtactactataactgccataaggaaatgtttagatagactttacaagtagatttattatttttaaaatgggtataattatatatattcataatgttatgaatgcacaagaaaatcttattttaaaaaaatcctgtttaagccttaaaaatgatgctgcaacacagagtatacttaaattgttttcattaagctgaattcttcttgtagaaatttacccatggtgaaaccctgtctctactaaaactacaaaaaattatctgggtgtggtgctggacacgtgtaattccagctacttgggaggctgaggcaggagaacggcttgaacttgggaggcagaggttgcagtgagctgaggtagtgccagtgcactccagcctgggcgacacagtgagaccctgttatcaataataataataataataaaataaataaaaataaatttacacataaagttttgctttttcactgattttatttttaaccttaaccttcctttcgggagattctataaagttctcactcagaaacgaaagttcattttacagcatagaagttgagaaacacacatttaaatgttttaggttttaatttactagaaacaaataaaaatgcttttcttttcttttcaattcattcacaaattattcttttgaagaaacaactaaagaaaaaagtgcaatatatttcagaagttttaatgatttaattattctaaacttttaatatttagcacaaagcagtcactatattctattaagctaaagctatgtggatatctaagtaacaaactcaacggcatgctggctgacatggtaactttgcctggcttttgaggtgatcctgtccctatgtagaagaggtgacttccacactgttgtgatttcgaggatgccagaagaattctctgccccaaatgccttctcccccgactgactatgtgaaatcctccaaagactcagcctattattcaagaaaggggtgttcttcctgtcccccagttaaaatcaaaaccaccatggaatgagagtgtgaaaactgagtagggtgagggatgggaattgagcagcctgcacagctgtagcattaagaagaaacattggtaaaatatactaaaaacatcataaagagatttagatatttactaatgtctcataatgataaactggacatttattacacacagcaaaactttattacacacagtaaaaaaaaaaagtctctccacatctctctcagtaactcaagtagaatggtggctgccttatcccacaatacatgcatgagcacctcagaatgataagaacaacattactacgaacaatataattactcacaactgtttaaacaactaatgctcagaacctgtgattatgttaccacccatgggaaaaaaaagagtgactttgaagacgtgattaagatcaggatcttgagatggtgacattatcctgtatgaccaaggtgggcccagtgtaatcacaggggttcttaaatgggaaagagggaggcaagagagtcaaaggagatgtggcaaaagaagcagaggtccggggaggccattgctgcctttcaggaggcagaggaccatgagtcggggaatgcaggcagcctctagaaaatagaaaaggaaaggatcaaattattccctacagcttgaacacagccttgctgacaccttggttttagcctagtgagactactgacctccagaacaagagaatacatttgtattgtctaagtcactaaatttgtgataatttgttatagcatcaatcagaaattgatatacttcctaagtgtagaaagacagttaaaaactggaacaaaaatgttaagaccattggtttaaaaaacaatgcttatgtttataattgttgtactttagtgaccataaagaatgtgacttaatctgaaaaataaaaagccttcaaatgccttcgttttatagttttttccttcatgctttgttagcatgtttttttacactggattctataagcatcatcccactggtcagtaaagctcaaattaatatgggtaaattaatatgtgttaaacttttttccagactaaaagtagactaaatttggtatagcaaataatgaagcatttcaacatatattatctagtttaatcatattgtaggaggatgagcaatggtttttttcccactttaatctactttttaatacgtgaatgaacaaccaccttgtgggaaaaaagcagaggcttagagatggttagaaaatatggctaaaggtggaatcttggacttttttttttttttttttgagacgaagttttgtgttttgctcttgttgcccatgctggagtgcaatggcgcaatcttggctcactgcaacctctgcctcctgggttcaagagattctcctgcttcagcctcccaagtagctgggattacaggcgcctgccaccacgcccagctaatttttgtatatttagtagaaacgggatttcaccatgttgaccatgctggtcttgaacttctgacctcagatgatccacccacctcagcctcccaaagtgctgagattacaggcgtgagccactgcatttggccctttctacatacagtctatcacacagtaccagctgcttcactttacatgggtatgttttggtactctgcagaaattcatctgcccgctctcccctaatcttctaaacagatctgcaactttcaaccaaattacagagtgctttttttaatttagaattttttcatggtagcttacttttttattattgctttctttgctgtacaatgtgggtttatgtaatacatagttcacatatttaaaaacgaggtatactgaaacaatgtatcaatgctgactactttgatacatagtacatgttccaagagcaaggtgtagtcaaatgcatcctaattcatgaataccaatttattttgtaataatacatgtgtttcaagaacaagatgctttcggatgaaccctaactcatgaatgttaattgctttttaatattacaagccccacaagaacagagtatgcctggattagcctcctctgtgagtgagcctcattctcacacccacttatttcctaaatattgatgatccaagcgtctatcattccctccttccaagggttatttcattcaggtacaatcttgcgctgcaacctaatttccatatcttcatctttcagtgtagacttctctcctgagctacaatctcatgtttattcctgtcttctacaaaagcatctcagactctcatttttaaaactgaactcattttatttccaaagaaactgctcttctcccacactccttatcttagctcatatcaaaaatctaaaagtcctattatactcctttgtctcttgtaatgggctgtaagtttctgatgcctgctgatgctaccttctgcacatctctaaagtctgtcccatccttttcaagctcactgccattgtttgagttcagcttatgatttcccatctcgactattgaaatagactccttatccaagcccatgccatctgtctagcctccctccaattcatcctccacaacaacaccgtggttagatctagagggaaaatctgatcctcttcctccttacatccccttcagccaggacagacagtacccttcgagaatttccctgcaccgacacttccagccttgctcccagacacctgggataagcctacactccaggcataccagctgcttctaagtccctgaataggtcacgttcatgttgactccacatctttgtacagactattctgtttggaaaatcttctttctcctttttctcacttgtaagctgctattcagtcctttaaacttggctaaaattacaactcctttaagaactgttttctggcctttacttcccttgccccattagacaattgatatgaaattaagaaaaagtagaaagatagaaaagattaaaaacctagacactactgtgttttgggataatgataatgggctcaaaacagtgattcgttgctctaccaggagaacaaatagacattgcattacttaaaccatctgcaaatgcccccaaatctctcattctgttaatgtgtctctgttaggtttccatcactgttgtaataaattatcacaaacctagtggcctaaggcaacatgaatttattatcttttatttctggaggtcagaagtctgaaatcagtttcactgggataaaattaagatgtcagcaggactacattttttctgggaggttctaggggagaatctcttccttaccttttccagtttctggagactgcttgcattctttggctcataaccctttctccatgggcaaagccagcagcatctttttttctctctgacttttgcattatctttacgtcttctttcgctaactctgatcctcctgcttccttcttataaggacccatgtaattagattagacccacctagataatccaagatagtctccccatctcaagatttttaacctaatcacatcctcagtcacttttgccatataaggtggtatattcataggttctgaagattaggacatggatatcttttggaggtcattattcaatggtatgaattatatatatgtatatataattcacaatataatatataatgatgaaagaattatatattgttataaaaatatatcactatattctatatgaatcataatttatatgtagaatacatgaattcatatacattatatgtgaattatatataaatatatacttatgaatggattatatatacatataattcttactgttgaataatggcctctaaatatatacatatatacatatgagcaattcatttttcctggtaattaacaatttaaaaactgaaacagaatggcaacaaagaggaaaatatggtaatggctttgcttaaaaatgtctccataaatcacaagccaaattcaggaaaaagattgtacatattttctgacataggaaaagcaaaggaaagaaatggatactgccataagctacactaaacatcatttcttaaatgctagcaaaacatatctccacaggaaccttgcctccagaataactaagcccggaaaaacaaagagaagttgagggagcctcgactgctagctatagttgctaaatgagggtagaaaacagggttagtaatggagaattggaaataccatgaggatttcctttagaggctatgatgagaatttgtagatgcaaagaaaaaaaaaacactttaggtggtgaaggagaattttaagtaacaaaagggtggcttaactttattaatacttaattatattactccaattcccctgcttctttccagtaacagtgttgaccccagccccagaatatggtctccagctgttttccctattcctcttagattttgtcaagttaatatgcatatgcaaaatcaaaacaactcccccagtttcctccttcccatagcccctctgcctattccccaactcgccttcctatgagaacaccaatgctgagaccttcctgtcctcatttagaggtatcagctccagtttacactcatggaatcatatcagaaaaattgatgggtcactttttcacaaagaattctgaagctttattcaggtatccacatatagaacattaaactctgaccttctggaggacaaggactttgttttattcattgttttacatccagcttctaaaacaatgactagtatatagttctttaatgctcactatcaaaattaagaagactagatctcagctggcctccatccccgatttgaacctatcattatcaaatcatcaggaaaataaatgacctttagaacagcacttgttaccctcagtttcaaggggtgaactcccaagaaagcagcatcaacaagtgacatgccattgggcagtggcatcaggaaattcaccagggagaaaaccaggcagtctgagaagatgttaacaatacaaaagctgagatctaatacaggaggattaaaataattgaatactggtttttattctagttaggaattatttaaaatttgaataaaatgcattaaattatataaaattcatgtatttaccatgagagttagagttagaaaatggaaatggtattctggagccaagatggctgacttgaagcagatagtgtgtgctgctcttactgagagaagaaggagtggtgagtaaagactgactctttgactggaaagtccaggtggaagcattgggattcatcaagaaatcaactcgactcacagagaacggagaggaatgagacaggacaactgcctacctgggactagcacagagtcagaggagtccccccaccactactaaagagaaatgataagtgagtgggagttccgggggacccatacttctgccatggacctgtgcaaacctgggctcaggagatccccccataagtccactccactggggccttcagactgacatggagagctatatggagtctgggcagagccaccactcaggtacatgcagagtcccagcagccttggattcccaggcatccaggcattagtggctgtagctccagcaacagaggaggtcagtctccctcacatgccctcaggaaaagggccaaattcagggcctgagcaacaatggactgcaggctttgcttccactgcttctcacagtataagacccactgtcctggggttccagccaccccgctacctgggatcctgggccagtagcaactctgtacttccccggggtggagcttccagagggagatgcgggccgccatatttgctgccccatagccctggctgctgttgccctcaggctctggatagcatgtggtgattagggactggtgcagatccccagcataatacagccacctgacagaaaagtggctggactgttttccacacgagtcccccatctttcttctcttcactaagtgagactttccaacctgggactacagcacaactaccctgccccaactggaacacttcagtcagaggtggctctgcagttatctgtggaggaaattccagagacaactcacaacccctctgccacagcagctgcagtggtactgtcttaactgcccttgggctggggaaggaacaaagggacttgttactactggttctccaagctcactcaatcagacaaaaataaagagaaaacaataaagaagaatgaacaatggctctgagacatagagattatgtaaagagaccaaatctatgattcattggcatccctcaaagaaagggagagaaaacaagcaacttggaaaacatattttaggatgttggaaaacatccccaacctccatagagaggccaacattcaaattgaggaaatgcagagaatctttgcaagataccgcacaggaagaccatctccaagacacataatcatcaggttttccaaggatgaaatgaaagaaaaaatgttgaaggaaactagagagaagggataggtcatctacgaaggaaaccccatcaagctaacagtggacatttcagcggaaacccaacaaaccagaagagattgggggcctatattcagcaaatttaaagaaaagaatttccaacggagaatttccaaccaagaatttcctatttagtcaaactaggcttcataagtgaagaagaaataagatccttctaagacaagcaaatggtaagagatttcattaccaccagacctgcctcacaagaggctctgaacatggaaggagagactgttactggtactaaaaaaaaacacacttaagtatgtacaccagtgacacaataaagcaaccacacaaaaaagtctgcataataaccagctaacaacatgatgacaaaaacaaatctgcacatatcaatactaaacctcaatgtaaatggtctaagtgcaccagttaaaaggcacagagtgacaagttggataaagaatcaagacccaacggtatgctatctttaacagacccatctcaaaggctgggtccggtggctcacacctgtaatcccagcatttttggaggctaaggcgggtggattacctgaggtcaggagttcaggaccagcctggccaatgtggtgaaacccatctctactaaaaaatacaaaaattagccaggcctgggggtgggcacctgaaatcccacctgcttgggaggctgagacaggagaattgcttgaacctgggaggcagaggttgcactgagctgagatggtgccattgcactccagcctgggtgacaagagcgaaatttcatctcagaaataaaagagacccatctcatatgcaatgacacccataggctcaaagtaaagggatagagaaaaatctaccaagcaaatggaaaacagaaaaaagcagaggttgttatttcaattttagacaaaacagactttaaaacaacaaagatcaaaagagacaaagaagggcattatataatggtaaagggttcaattcaacaagaagacctgactattctaaatatatatgcacccaacataggagcaaccagattcataaagcaagttcttagagacctatgaagagacttagataaccacacaacaatagtgggagtcttcaacatctcactgacaatattaggcagatcatcaaagcagaaaactatcaaagatattcaggactgaactagacacttgaccaaatgaacctgatagatatctactgaactctgcacccaaagacaacagaatatacatcgttctcatctgcacatggcacacactctaaaattgaccacaaaatcagatataaaacaatgctcagcaaattaaaagaaactgaaatcacatcaaccacactcttggaatatagcacaataaaaatagaaattgaatttaaaaaatcactcatagaattacatagaaattaaacaacctgctactgaatgacttttgggtaaataatgaaattaaagcagaactcaaaaaattctttaaaactaatgacagcaaagatacaacatagactccctaggacacagctaaggcactgttaagaggaaagtttatagtactaaacaccaacatcaaaaagtcagaaacatcttaaattaacaatctaacattacaactagaggaactagaagaggaaactaaccccaaagctagcagaagacaggaaataaccaaaatcaattctaaattgatggaaattaagatgcaaaaaaaaaaaaccataaaaaaggtcagtgaatccaggagttggtttttgaaaaaattaataagacagacagaccattatctagatgaatgaagaaaaaaagataagatccaaataaacacaatcagaaatgacaaaggagacattacccctgaccacaaagaaatataatagtaaaaaaaactaaagagactgctacaaacaactctgtgcacgcaagctagacaacctggaagaaatggacaaattcctatacacatgcaacctctcaagactgaaccaggaataaattcaatctctaaacagacctataataacaagttacaaaattgaatcagtaataaaaagtctgccaaaaaaaaaaaaaaaaaaaaagacacaggaccaggcagattcatagctgaatcctaccagatgtataaagaagagatggtaccatttctactgaaactattgaagaaactgtggaggagggactcctccataactcattctatgaagccagcatcatcctgataccaaatgctggcagagacgagggaaaaaaaaaactaatttaagcaaactaatttaaacttcatgtggaaccacaaaagagcctgaatagccaaagcaatcataagcaaaaagaacaaagataaaggcatcaccaaaatagatggtactggtaaaaaaaaaaaaaaaaaaa

SEQ ID NO: 578 - DNA, 20001 bp, Homo sapiens
ttgcgccattgcactccagcctggcaacagagcaagattccatctcaagaaaaaaaaaaaaaaaaaggaaatagttaaaggaatctcttctgaggtcaactgccccatgtctcatccacttggcctgcctctgatttcagccacaactatagtaaatagacagtgcctgcaaagctcagactcaccctgtgacagtgccccatctcaaggccagccctacaagtctatctgctttctgtcttcgtttctggctcagcctcactgcctcacaatctcaaatgcaacaaaaacattttacttcttcgtccttcaaagtcattaacttgcgcatgatctcagagtgtgcaaagattttctaaacagaacaaattaaaagcattaaaagattttctaaatagaacaaattaaaagcattaaccataggaaagactagcgatttgaactaatattcctaaaaagacatcgttaggagagtcaaaacgcaactatgagctaagaaaatatatttgcaatatatgtatttagcaaaggactcatatccaaaataaagaactgctgcaagtcagtaacagaaagatcaacagccagccaccaaagattacatattattccattcatatagaatttaaaaatgggtaaaatttccattaatggtaacagaagtcggaatagtgattatctttgagtggagtattacagagaaggactacaaggggaggtgctgggctgatggaaatgatcagtatctcaatctcagtaatgattccacagatgtatacaacggattttatgtaaaattcatcaagttgtatactttgtacactttgcaacagataagtttgagttcaataaaaaagggggtgggaatcgaggctgtttaggtcacatactcactcctgcatccaagggaatagtgtgttgattggcttgggacggggtcctatggcccatcctgagggctgaggatggagcccacccagaccaaaaatggacagaggagggaatctccaagggggattgaaaagtatttgcagaagatgaggaaaaagatgttctaagggagacaactaatttctaatggtcaggacagaggtgggccttacctttagcaagtggagctggaaaatataggagagagagaaagacagagacacagagacagagagacaggggcagagagatgcagagtaaccagccgtcggctttccaattctttgttctcactcctgtgagtgaagctgcacttcctatgtgggggttctgaaaggtttccctgtatctgtgggggaacttgttattctttttgaccatctggcattttgagcctgcttttaattgtttggggaagttccccaccttatgaatcttgacaggaggcagagttgcctcccactctcagtgctgaaaatgccagtgttcatgatctaagctcagccaaggagacagcagcgctccagaatcacagagaccacagggcacatcggtgtggaggacttggtcatagaagagtctagtccagcagtgtcacagcaggccagtgttcacagggtcagaggagcgagcagcagcagccggcgcccagcagcatagccctgcagtcctcacgccccattctaaggtgtgacgtttggcccttttgccagctggcaggccccacatctgatcctccatccttcctgccaatcctgtaccccagtctatatcctttcaatagttcctttttggcctaaaccagccaatccatgtacactgcttgaaaccaggaatcctaactgataataacatgctttcagaaaattcccccttttagtttatacagagaagcaaagcctgaatccaaaagaatgcttctactgtgtgaattttccacaccatcatatggtcacaaggaaggtgtctgctggcaaaagacccttaacaccctacaaatcacatgacaggaggaaagggggacaagccaacgtgtgaattgcagttaggtcctcaactcaccttatgttcagttctcatcgtaaacccacaggataggtattgtactagtgtgctcaggctgccatcacaaagtaccacagactggagggcttaaaccacagacatttttattttctcacagttctggaagtaagaagtctaaggtcaagatgccagaaaattctgtttctggtaaaacctcccttcctagcttgcagacggccaccttctcactgtgtctttgcatggcctttcctctgtgtgtgcacagaggaaaagatctctggtatctcttcctcttcttacaaggacaccagattagggccccaccttctatgacctcatttaaccgttaccttcttggaggccctgtttccaaatacagtcatactgcaggttaagtcaataaatgaattattgggggacgcaattcaatctgtaacaagtattgtctcaatattgcaaacaagaaacatgaggttaaagttcttgtccaagatctagataaagccttggcacttttcagtctgcttatggttttcagtctttcttatcaaatcttggaaattcaagcttcaaagtatgaagtagaagaaaagtatggtgtatcatagagcagtgagaaatgaatgaacctgagatgaagccagtgtgactgtctgccagtcagccctggagcgaggggatggaataacccagatatatccactggctcctctccaagcttcagccatgccatggctggcacatcactgcctcgtagcagcttgggtcctgtgtttgggtcctgactctcatatgactttgtgagtgctggcaaagactccctccttgaccaaactttagtcgggttccctgaagccttcttctcaactaggccttgcccttgacctgatgagccaagttttagcaatgaatcttgttaagtccatttactgagattctctcaccctcaacatccaatcaagctcctcttcctccacctaatcaagttcctgttagtaattttccatccactcccccagcgtgctgattggctgtaaatccccccttatccctgatgtatttgggtttcaatcctctcacctattgcaataatcttgacccttactgcaatagccttgaataaagtgttcgttgctgtttttcacagatatcaggataatttttctttaacagtttattaggggcaagaccacgtctcacatttctccttacatatctccccaacacatagttgtgcctcagctggtgcactgtcaagaggcaagtgagtgggtgggaggatgggtgacacctgaaagtcccatggcctagctacagagaaaagtcaaagagcaccttgaagcctatgaagaatggacagtgggatgagccttaggaaaaggaagatagaagagaataaagggaagaaaacagagggttcctagcagcatgtcagactcaatcggaaccacccttacactatcaatttgggacactccaggagcaaagggccccagtcttgatggcctgagggccccaagtccaaggggcagcacttggcagagggacaaacactggataattatcctggccctgactttggtgttctcagctctgcgacgttaggcaaatcagctaacctctgtgaccctcagcctttccatgcatgaaatgacagtaacaatggctccctcacaggtgcaagtaagaatgtaagtgaaacaatttgttttcttttttagtatgcttgatatttactgagaagaatgcaaatgctctttctaactggtattcaggagctgggttgagggcctgtttttgtttgtctgttttgttcatagtatttttgcctaaatgtgcgtatctgtgggactgatgaaattatgaaagaaaaatgacagctgtgcaaaactggtgcatggaagaaaaggaatgtcatgatgtgggactgccaggtccaccgggcctctgcagcaaaccgatggggcagggagtaggttgggagccaaccaggccagaagattggctcctttgggagttggtgagctgtccaaatcaatgcccagggaggtagagccaacccaggctctcctaggttggtccttgtctctaaaggcagggtctgtcggtgagatgtggtgggtggtgatagtgtagctctctgggcacatgtaggctaagcagtggcagcagctgggctgtgggtggtctgcccaatatgtcacagatctctggcctacagctggggctcagaacatggtccaaatttgcaaaggagacatcctgggctggcctgagtaggcagcagcgtggcttaaagcaagtcccctgcccagaggcaggcaaatggagcatcttcctgaacaaagacaagcactacagagggatgacggagagaaccagagggcagaggagagggaaggggaccaaaggggcacctgtggagggtgggcagtggcagcttacagggccctccccaacagggcccaagggtctcccagcccagtaacaatatcttcattatcatcctggccaaaacattgcttcctttcactgaggacattataaatgttatttttttatttttatttatttatttatttatttattttttgagagagagagagaagatctcactctgttgcccaggctggagtgcagtgatgtcattttggctcactgcaacctcagcctcctgaattgctgggaccacagatgtgcgccagcatgcccggctaatttttgtatttttagtagagacagggtttcgccatgttgcctaggctgatctcaaactcctggactcaagcgatccacccgcctcggcctcccaaagtgctgggattacagttgtgagccattgtggccggccacaaatgttatttttaaagcacacacacattcctggtggaaggtaagtatcctcagcacccatttcctgaaacgtcttttaatcatcacaatatggagattgtattattatctctattttaaagacagggcagtattttcctggggcagtatttcccaaattgtgtcccacggaatgctaataacagtactaagaggtaagtggtgctcacttttgaaaatgctcctatagccaaatatttttgagaaataatgcagaggaatggtgcatttgtgagcatagacccaggagtcagagacacctcggtttggggccgagccccactgattatcagctttgcgggtgcagcaataataatcctagcttccttatctgggatgtgggaataatgaaatacccgcttcataaggttcgtgtgagggttgatgttatgaggtaacaaatgtaaagctcttagcacatagctggtgcaaaaaaagtcttcaataaacaagaactcttattggcattgtagcaggttaaatattgttaacatcttacagctagacctataatttttttagggagagatcaattttgtttaggaaaacatcttaataaaccacgtggaagcgtggccagcaatgagactctgaagttacaagccatcaataaccaagaccaaaacctagaaaaccaagtttgaaaaagccagagtcccatagagggtgagtactgatttctctcattgcctgacattataacaaagaggttcagggcacaaagatgagatctcacctccgtcttcacctccctctttttagtactactccatcctttacagattcacctacacacactcacacatgcacacacaccactcccttttcaggaagaaagctacaggctccagttaattagaaattctactatttcagctttattacttcctctttactctctgaactttaaaggaacacatttctgtaaagtttaaattatttcaatgaggtgtattacctttttaactgggggtgggagggaagcactttttttttcttttttttttttttaatgttgaagactccactcagtcatttgagctccaggaagccttccctggccacccataagttaagagaagagcccctcttctgagctcccagagcacccacttcatacctatgctatagaacacaccgccaaggacggaaattatccaaaggtttgtgtccattgattgccatgccaggcatccagctctgctgaagcacgcaggggccctgacttcctcattaggtattctcaacacctccaccagcagctggtaggcagcagagctattgttactgagctgcccacggcaccaatggatctatgaatgaacctgaacgtcttccctggagaaaagcacttgcttgtcaagggaggaacaggggtctgaaatgctaacccctgccctatagtatgggtgtgcatacggtgcaccttccaaagcccagagtggcattcttattacatcccggaaaccccctggtcaggggcttttggggtgacatccaatatgtaaataccagggtcgggtcctgctgagtggcataacagtgccatatgtgaaagttccaccagcagcagagggctctttcattagtcatttcactgcacacagctgtaaggaatctggcgaagcttgatttggctgggaggagtgcattttccacttgtaggcgtcttgaaaactttcatactaaaaaaaaaaaaaaaattaacaacaagaaaatcatcatagtccaaaatgagaagccagaaattgaaggtggagagccagggtagcaaacataatggagggactccaagaccgggcttccaccaggaccctacactgactcacagatgtgtaatggtcatggcgagccttacatgtaaacagagatcccaacatgtcccagaggtagtggctgtggaagcctgggcagatgccaggcagtattctaaggttaagcattgctatggtttgaatgtgacccccaaatttcatgtgctggaaacttaattcccaaattcacatatcgatgacatttggaggtagggcctttgagaggtaattaagattaaataaggccatgagtgtgtggcccccacggtggggctggtggctttataagaagagttagagtaacctggccgggtgctgtggctcacgcctgtaatcccagcactttgggaggccaaggcgggcagatcacgaggtcaggagatcgagaccatcctggctaacacggtgaaaccccatctctaccaaaaaaatacaaaaaaattagccgggtgtggtggcgggcacctgtagtcccagctacttgggaggctgaggcaggagagtggcctgaacctgggaggcggagcttgcagggagctgagatcacaccactgcactccagcctgggtgacagagcaagactccgtctcagaaaaaaaaaaaaaaaagaagagttagagtaacccaagcggacaagcctgctcttgcccacttgccatgtgatgccctctgccacgtgaggatgcagcaagaaggccttcaccaaatgccagcaccatgtgcttggacttcccagcctccagaactataagcaataaatttcttgtctttataaatgatccagtctgtagaattctgttacagcaatggactaagacaggcatgatttggggtacagagaaggaaaactgagaggtcacagaagagagaggagggtggaagctgggggagaggcactgatggaaccagcttccacccttccctgcagggcttggaaagacccatgaggacacaagggagaataaaaggaagcagccctgattgccatggctgggtcagggtcaggaggctaggactgctttatgtccctgctataatggacttatgggttttttaagattttttaaaatagattaactatagctcctagagctgactctactgataactttaccctggactccctccctgattttgaccttagtttgtgtggcggggggggggatgagaggctgcggtccaaatggaatgcagtttgcctgtcctctatcagcatcaatgcatcacctttcccccgatttttacctcatgatatatttatgcatttaacgcatgtttattgagtgagctgcatgcagcaaaatgcacgtaaaaagcaattttttttcttttttctttgtcctttcaactcctctctctggatttgccttgtccctgcacttgagatgaaagctaaccaataccacggattttctagccactctgagccattaaataaagaggctctttaaaacaaacaaacaaaaaaaaaagtaaaaaacagtctactcaacctgaagcttctcccctctcagactccttcacttcaggtttggaaactcggtaccaaggaggaaggcatggacttcaccattttctctcctccacctctcgtagccagctgctaattctcaagcctcaagctgtgagagattgagaactgagggaaaggacacagtacttgacggctcttactgtcatgacgcggccttggtgccctctgggtttagcatgttttccaacgctttcctttccagcctcacttaggcacattgcagttaaagaatatggccaccaggtggcagtaaaggcctttttttttcctggccagtagaccctaccctccggttttatatggctacataatttctttaagatgatgtcaaatatgctttccctacatttcaaaagaaaagaaagtaaacacttaaaaccacaaactggtcaacttagcaaaaactaaatataatttaaagatgatgccctagggaataaacgtgtaaagaaaacctcccaagttgttaattatgtaattacataactaatttactaagtctttctcttcctcaaattattactgtgtaagtctaaatcttattcccagatcttgatcataatttaccttcccttaatttagagtcagaaacttttccccaaaggctcctgtatggccaattgtcatttaaagacctttattaataacaactattatactaataatatccatttgttttttactatgcaccagttacagttatgttacagtcactacttatagttatgtgttgactacacacagactacacactgcgataaaacctaactgtggtattattttatcctcacaccatccctacatgtcaccaccactgcccctgcccgcatttagggttgccagaaaaaatataggccgcacagttaaatttgaatttcagataaacaacaaataatgttttagcatatgtcccacgcaccattagggacatagttattgcatgggacataaatattttatgggacatatttacactaaaaaataattatttatctgaaattcagctttaactggacatcctagattcttatttgataaatttggcaacctgacccccattttatggataaggaaactgaacctccaggaaggtaagcaatgtaatgaaggctaagagctggtaagcagcactgtggagctgtgaaccccagaccctccgaaccgggttccctccctaccatactgcccctccttgttgtctagggaattattctcatctgccagctgctggtaaaataatctgccatcctcaagtaaaataatccttgtcactgttctcaactaaatagaagaaaagcttttcttcccagccaagaaagagtcactgaaagacaaattctcatgactgattttcccgtatctgtcttccttgccaatttatcgtttctggaaaaaaaaaaatgaaaatcccccttatttttttccccactgatattcatatttttgtaactatttcaaggctacctctagtaaactgaaatgtaaatacaacagtccatcccaatttgttcttctggcttaattacctgaaacataatacagtaatttagaactacgcataaagaaaaaaacaaaacaaaataaaactgtaatgtcattgcactatgaggatatcaaaactttttgttgttggttttttcccagccatatcttccagtatttgagtgatgacagacctagtcaacttgtattcctctgcaggatttactgtcctgcacataataggaaaataaagccatgttacagtcccacagctatacgagaacacctctcccccacaatgtcaaggttagtccctagcagaaaaaaaagcggcaacaaaggaacgtttaaaggagtttaaacatgcaaagtgcttagaacagtgccagccaaatagtaagtgctcagtagatgtgagctagtgttattattaacacctagagacattaccaatggccattaccaatgggtctagagacccagaaatggctttgcattaataactaacaagccataaacaatgcagaatgagagagaaggaatggtggtgcccagagtgaaaaaaaaaaaaaaaaaaaggactgggagagaatggaggaaggccattcattcattcaacaaccatgtcatgagtgagtgctatgtgccagccttaaagggatggagagcccagtgagagaggcaggtctttgtagtatggtgtgataactgtgcactggagagagcaatacccagtacggcatgggagtacagaaaaggggaaccttggccagtctaggaggtcaaaatgaggtcagggaaacttcacagagtgagacctcagctgactcttactgacccagtaactgctgaccaggctgaggctgagaagatggcgcattccaagcagtggaggcaacagcaagcaaaggtgcagacttaaaacaacaaagtgtgtgcagaggagggggagacaattcagttcccttctctttggaaaaccagtcaattaccaagcaatgtaaagttactggaatgacggaacacccatatgtgggcccctgcacaaggaagtacaaatgcaagacttcttccatcttcaaccaacaggagtaagacggtggacaccaccagatgagagagttgatgtcgtggagaaaggaggtttgtcagcttcatgttaaccactgaagagatgttacatgttacatacatatatatatgtacatttttttttttttagacagagtctcgctctgttgcccacactggagtgcagcggtgagatctcggcttactgcaacctccgcctcccaggttcaagcgattctcctgcctcagcctccttacatgttatatcttaattaagttattaatatcacttgcaaataaattcattctcaccaatacatggggctttcacattgatcctcataagcaccctccctaaatctaaaataatagattttattactcccaccttacatatgagaaaatggatttccacagggattaaaagatttttctcaaaattatatagccaataacaagaagagtagaagttgatcttcaatgttgtccattattttattccccttcttttccacctctttaattaaaacacagccttcaagaccctgcttgaatcccacttcctctgcaaagctctccctccctcccccacagcacatgacatagagcctttcatataccaagtatgcaataacagcttgatgactggtgatgatgatcaggtagcaactgtcagcctgtgtggatgccttgtgaccactggataaaggggcaactgcagtggtctggactcaggaaagaagtcccctaggaaggactaggctttgagccaggtcttgaagaaactggtagctgtgaactggtggaagcatatggggtaggaaggagaacatcccaccggtgatggagaagtaacaatttgtacaaagacacggaagcaaagtgaaccaaaactatgcctatcttctatgtctgcctttaatattatccttggcaattcctttataattagagagtgtcttcatctgtttatgccactgtaacaaaatacctgagactgggtaatttgtaaacaataaaaaatttatttctcacagttctggaggctgggaaatccaagatcaaggtgccagcaggtttggtggctggaaacggcctggtctctgcttccaaggaggtaccttacgcactgtgtcctgacatggtgggagggacagaagggcaaaaaggggggtgaatgctgtatcctcatggcagaagaacagaaaagaacaaacactccctcaagctcttttgtaaggaccctaattccatccaggaaggctctgctctcaggacttaggcctgtcgtcttaatactatcacattggtgattaagttttaacatatgaacttgggggaacacattcagaccacaccagaaagaaataggcaattctagacaaagtatttcttctctttacttgcttctttagtccacacgtattttgagtgcttctcatgggcaagactctatgggaagcataaagatgaatcaaacacagctcttccctcgtgaacaatgtgttcactaaaagaggaagacctatgcatgactatctataacgaaaggcacaaactggaaacagccataaacaagctatgagctgctactagtgcttatcacttcaaagtagggatctttgtgggccggtgggcccaatgtgattctatgagttcttatgaaaggggtgcattaaagccagagagaaactgtctgttcccttcctggaagcaatgctgttgatgctggattttcaagggtacaattttcacggcttaagataggttctgggccattctaggcagagggaaccacatgagaaaagatataaaggtggaaaagttccaggtcccacaaaaaagagtgaggaatttggttttactgcaacattaagataaaaagaaaagaatggaaaatgaagttgcaaatgtggatgaaaccaggtcatacagtggaaagaatatgaaactttgaattcctaaaacagaattccaattctgccacttactgtctacatgacctcaggcaaattacttaaatcctctgagcctcagttgcttcatctgaagaatgcgaccagacaggtggattttcaggcatgcaataaggtggcacaccttcaatcagagattctttaaatatttcttattctttaaatattcaagtttttcaaaggagaggttgagcattgagtcatgcaatgactcctagcctttcctccactgtcccaggaattgtcaatattccacccagccacatatgaccctgcagctaatctgagtcctttcctttcttttaattgggtacaaaagttccctgtggatttgattttcgatgatgtcttggtatttttttataggttgtgaatttgaacttctgccttctggcttacacttggctcagtgcagctcagggagtggtttgaaggttaagggtattactgacttagagtgctccataagaatagctgtttctgtgtgaccattgacagaaaaggaaaaacaagctatggagactggctagggggtcatttagaaagactatttcataatccacaaatagcaacttgaggcctgaaataagagaatagcactgggaatagggaagaaaggatagattgaaaagctcctgtggaaatggaatccccaggatttagcaaataattgcatgttagatgaggtaaataatgaggttgaaatctggctctaggaagatggcaaagccattaacataactagtgatatggggaagaagagcagatttagaagcaaagtcaatgaatctgtttgggacacagctggaggagccagcaatcataaaaacagacagaaaaggacatcaggcagttaaaaatgcagccctgttcaagaaagaaacatgatagagtaaatggttaatgcacacacagcctttgtgtgttccaggtggttctatgaactagagcgaggaggctgagcctggacactgtgaccaaaccatggactgttcccacattctacaacctgcattcattccttgtaaatctcttgatgaatttttcacacattctggcctcagttatgtggatatggtccccaaaagatgtgaaagtccttactgggacaaaagaactctttctctcccctgttgaggtttgagtcttcaaaatgaactgataatagactgattaactggagaaaaggcatatagacttatcaagtgcatggagcatcacaggaaagtgagtacccaataatccaacatgctgtatcaatagaagtttatatactcagataataacctgaaacaaagttcgtctgggctctgggtgtggcgtcaactctaacgttccttcctgcgagtcagtcttccctgtttgatgagattatagggagtggggctcaagtcagttgcttccttctggaggagcttcccttagtcagatatggaaacttcagaaaaagtgcttccctttgtcagatatgggaacttcagaaaaattttctccctgtgcttcaggagaggcagataggcaagagacagcggacaggaggtggtcagagataccttgtttccatggctgcttctttagttcaaaatactcagcatgtcaaaatgccatacttaggagtgttgttttctgagctttaacattctaatccccagaacctgtaaatgtgctgctttacatggtcaaagggactttgcaactatgattaaataaaggacttttaaatacagaggttattctggactattcagtgggcccaatgtaatcccatgggttcattttttaaatttttattttactttgagacagggtcttgctctgtcacccaggctagagtgcagtgacacaacacagctcacggcagcctcaacctcccgggctcaagcaattctcccacctcggccccgagtagctgggactacaggtacgcaccaccacacccagcagattttttcatttttttgtagagacaaggtctcgctatgttgccagggctgctgtcaaactcttgggctcaaatgatcctcctgcatcagcctcccaaagtgttaggattacaggcgtgagccactgcgcacagctcccatgggttcttataagggggatgcaagacagtcagagagagagagagactggaagatgctatactgtaggctctgaagacaaagaaaaacgccatgcaggaggaacacagccctcctgatgccttgattttagccctgtgaaacccaatctggactcgtcaccttcagaactgtatgataataaatttgtattgtttaagccactacatttgtagtaatttgtcacagcaccaacaaaaaatcaatacaataatcatagtgaatggcctaggtctcatggtcaatggattagcacttgaaacgttaaaggctgtggacagataacctttcagaataactaatggttagtctacagctgtggttctcaaccagggatgatttttccctaccctcccaaaggatatttggcaatgtctggagatacttttgattgtcacaactggggagtggctgctactggtatctagtgggtagagaccaggatgctgctaaacattccacaatgcacgggagagcccgcccccccactgaccccacaacaaagaattagctggtacaaaacttcaatagtgatgaagtcaagaaaccctctcttacagattgcaactaagttcagaaactacactgacagtgtaaagaatgtcatcgggaaaaaagagagacatgagatttttctaccatgtatgaagtcgttttgacagaaaaatgaaacctgactctgataagtctctagagtcaactataatcatgcatcccttaacgacagcaatacattctgagaaatgtgttattaggtgatttcattgtgtaaatatcacagagtgtacttacacaacctggatggtataatctactacacacttaggctatatggtacagcctattgctcccagactacaaacctgtacagcatgttactgtactgaaaactgtaggcgactgtaacacaatagtgtgtattgcaacatatctaaacatagaaaaggtaatgtgttgtgctaccatgttacaatggctacataactaagcaatgggaatctttcaactccattataatctttttttttttttttttgagatagaatcttgctttgttgcccaagctgaagtggtgcgatcttggctcactgcaaccttcacctcccaggttcaagcgattcctgcctcagcctcccaagcagctgggattacaggcacccgccaccacacccggctactttttttattttagtaaagacaatgttttgccatgttagccaggctggtctccaactcctggcctcaagtgatccacccgcctcagcctcccaaagtgctgggattacaggcgtgagccaccacgcccgacctctattataatcttatgggactaccatccataatggttcatcgttgacagaatattttgttatgaggggcatgactgtactaatttacaagaaacagaaaatggaggatactgttacagaggaccacaggcatccaatccataaaaatctacaggacaaagtactcagtttttcaactgattgccaggataacaaaacagagagggacatggaaggggaatctatggaataaaagatttaagagaaaaaggaaccaactataatatgtgcagctgatttttatcttaattcaaacaagctgtaaaaattgtgcatatgcatttatgagataattataaatttaaatactgactagtttatgatattaatgaattattgctaatgttagttgaatttattgttttgtggttactttttaaaaaggaattattatctatagaactacatattgaaatatttgcagatgaaataacatattggctgggagcagtggctcatgcctgtaattccagcaatttgggaggccaaggcaggaggatcacctgaggtcaggaattcgagaccagcctggccaacatggtgaaaccccgtatctactaaaaatacaaaacttgtggccaggcatggtggcaggtgcctgtaatcccagctattcgggagtctgaggcaggagaatttattgaatctgggaggcggaggttgcagtgagccgagattgtgccactgcactccagcctgggtgacagagcaagactctgtctaaggaaaaaaaaaaagaaagaaagaaagaaataacatatcaaatttgctccaaaataatacaggagagaggatatgtgtaaaacaaaatcaggccacatgctgctaattgttaaagctggacaaaaagtacatggggacttattacactattatctctacttgtatgtatctttgaaatttttttcatgttaaaacatttctttaaaaaaaaagagtattatgaaagtatctggtttctacgaaaaatgattatttttccaaaagagagaaaagactggcccccctctttcttgtatttcctcacctctccaaataatctgctcacatttgtcacacttagacatgtgctcccgacccaaacagaaaagaaaaagtaaccagaattcttgtagcatctgttaggtgctaaataagtagaaagagttctagtttaaaatgtgtgacattcacttgtgaagacagagaagctgagaggggaccccgtcctttgttagatgctgctctgctcattctccatggctcttggaaacaagagcccaaagagaaactggtcctcaagagacagatccaagactgagcacaggctacgccacaacctccaccagctgtgggaaaagaccatgtggggtgtgaatggcagcacccagcactgtgcctgccgcgtggtggcgctttataaatgtttgagaagggagagaggaagttgatttagtgggtttagtttttaattgggtctgaataaaaggtgagcttttgcaatatcctctaatccccctcatatatccttgttgcagaaggaaaagttgagtgagaatgtaattgccaagaccccttaaagtgacattggtcatagcaaatgtagcagcttcctgccttactaagaacttttaggacgtgctgggctgacgctgtcagctgctgctttgtaaaaataagccctataattagattgctactccttatgaagcccactcaagtgctatcctttatttttaacctttatcacagtcctcaagacagagtgtgtagggcctcgcccacagctgctgagtcaaaccccagcaggctccacccttcctgctcccagctgcattccgctaaaaaaaggcctgccagcagcctacgcaatggaacgcggggtctaagcacacagacggttgcagggaatctaatatccaggcagcactgagaaagaacagctgcgccaaatttgaatcttctttatttactcagccaggcagctaacacacacaaataacattgtttcatcttgaatgcacagaattcacaactgccttcttagctcactcctgttgctcaacaatccttttttacacttgcatgtttaatgtaaataactttcacagagtcttccactttctctgtatcgatattacgaacctgttggcatagttagttgagacaataaacatttaataatcttgtgggtcaggagtgggaatgccagaggaatgcttatagcaaagtcaagggaaagtattatagggcaaagggatgtaatggggatttcattatattttgttgctttcttttttgttgcttataacttggtattcacattctctaacagattctttgaaaaagtgtgtgcatagcaaatagggctccatttaaatggacacattagggtgaagggtctatagagttgttcactgcaggaattaatgtcatactctgtctgcacaaataattgtattaggtgacaggcaataccaacgtttatataatttgtgctatatatagcagatgtaactcagaggctgtgtacttaatcctataaaaatctcaacataagacactcttcctccagtgcccacagatcccacaaaccctttgcattctaattaaagctctgctggggttaaggctaattggtaataaaacccaggcctgtgagaaagcctttctgtaaaacaaagaatccatttgtcatgcaaataagcagcctccaaagtggtaaatttgaattttgaatgttcacctgttatcttaacatttcttagaatgtggttcagccagtaattgctagatcattattttccagttttcctcattgccatccttcaaagagctaaagggcatgttatttgtattgttaaattaatattttgttgttgtagacctaaagtaaatgaatcactgtagttgtctttggttttctttggagaatgtgtttgcattctaaatattttccaatacaataatttctttgagaaaatttgtcggtttccttaaataataatcttcaggttaggcttgaaattcaaaagtatggtggttccttcctgatgaaggtccttaaaggtctttacactccattcttgaggaagtttctgggcactagagggcgctctcagcacactgggacgggatttgttagttgcacagaattaagagccatgcgctgattgttgggccttgggccctgctgggggcccaaaatcagcctgcagaaagaagccacctccgtgagcctgcattggctctcaactgcaaagtgccaattcatctgccttcagtgaaccaactgaccaaaccaactgctgagctttctcccccaggggaaaggctggctgctacaaagattcttttttactcatttctgaataaaatatttcatggtcaacaattgttttcacatgcactaccttgcctgctgtccttcactgacaacatttcagggtctcgcaaggcatggaatacaatgcatgttcaggactgcaacctgatggtgatgtgtaatgaagtttagtgttggatttcgatcttggccaaatggtgactccttggtgacaggtcatgtgcttacttcctcagcagatgagttctcctccagcctcacttgtgaccaatgatgtatcatgaacacaggctggtgctgaagctcagtatgtagcccccttggctagaatacacacttgataatagtagcaaagtgaaatcagcagagtgtagcaatgccctgagaggacctaaaagaactgggtgaaggaggccttaaggattgacaactaatacctaatggctaagacctaagagggt

SEQ ID NO: 579 - DNA, 20001 bp, Homo sapiens
tgcctagcagagccagggtgaaaagtagcatggtcggctaaaatcccaatagaaattctgtttttctagttaaacaaacagaaaagggctcctgtggtccagagagtactggagtaagtcagtaggtaaattttctctctcttttttccatctccacatagcacccaaaatggtcctggtcacaggacctggtagcaacacaggcagccaaaactccaaaagaaccccggtctattgagccagaggatgaggaatagaaaacatataggtaggtgactatggggagtcccggagataagagattagagaaatggatctcctaactctgtgtatgacctagcacaggcccaggcttaaccctgagctgtgcatgcatggaacatactcaaagctgccaagtagaggttccgaaaactgagataacattggaagtatcactcataaagtacagatagtctgaacaaaaccagtgtgattacctactcaaataagcaaacaatcttccaaatctcttgaggattttaatgaaaaacatccaaattaaatactcagaatgtccaggatacaatctaaaatcactcagcgtacaaagaaccaataaaagtttactaatttgcatgaaaagtacagtcaataaatgctaccactgagaagaccaagatggtagaataatcaggcacagattttaaggcaactatcgtaactatgctccacaaagtaaagataaacactcttgaacaaagggaaaaaaacagaaattattggcagaataatagaaactataaaaaaaaagaaccatcttacaaaattaagcatatttttaacatacaatccagcaatcacatcccttggcatttattcaaatgagttaaaaacatatgtccacacaaaaacctgcacatggatgtacatagtgactttattcataactgccaaaaccttgaagcagccaagactgtccttcagtaagtgaatgaataaataaactgtgtgtaatggttaatactgagtgtcaacttgattgaattgaaggatgcaaagtattgttcctgggtgtgtctgtgagggtgttgccaaagaagattaacattcgagtcagtggactgggagaggcagaccccccctcaatctgggtgggcaccatctaatcagctgccagtacagctataaaggcatgcaggagaagatggaaaagtagacttgctcggtcttctggccttcatctttctcccctgctggatgcttcatgccctcaaacaataaattccaagttcttcagcttttggactcttggacttacaccagtgttttgccaagggctctcagaccttcagctgcagacaaggctgcactgttggcttccctacttttgaggttttgggacttggactggcttccttgctcctcagcttgtagatagcttattgagtgactttgccttgtgataatgtgagtcaatactccctaataaactccccttcatatatacatctatcctattagttctgtccctccacggagccctgactaatacactgtggtatatccatacaatggaacattattcagttctaaaaggaatgagctatcaaggcatgaaaatacaaggaagaaacttaaatacatgttattaagttaaagaagccaatctgaaaggattatatattgtatgattcctactatgcgatattctggaaaaggcaaaagtatagaaacagtaaaaaagtcagtgattgccagagtttagcagggaaggagagatgaatatgcagaatatagacaatttttacagcagtgaaactattctgtatgatactataatggtggctatatgtcattatagatttgttcaaacccacagaatctgcaacaccaagaataaaccccttatgtaaattatggactttgggtgatagtgaggtttcagtataggttcatcacccgtaacaaaggtaccactctggtaccagatgttgacagtgtgggaggttgtgcatgtgtaggggtagagggcatatgggaactctctgtacttttcactcaatttgtctgtgaacccacaactgctctaaaaatagtctttttaaagatttttttaaagaatgaaatggaaattttagaagtgaaaaaaatacactgtgtgaagttaagaaatcaattgatgggttcgacagcaaaatacagaaaaaagaaaaaaagagtcagcaaacatagtgagacatcaatagaaagggaaaacagaggaattaaagacagaggagacaactagaaaatcaataataaaataaattcaaacatatcaataattacattaaatataaattatctaagcacaccaattaaaacatcgagtttgtcaaatttgattaaaaataaataagacctaactatctacaagaaacctactttaaaaataaagacatagatgggaatagaagtaataagatgaaagaagagataccatacaaacactaatcgaaagaaaaaatgtagtggctatattaatatcaaagtagatttcaaagcaagaaatactactaaagataaacagagatattgcataatgggataaggttcaattaatcaagaaaacataacaatcttaaatgtacacacctattaagagaagttccaaaaacttaaaacagaaacagaaatgagaactagataaatccacaaccatagttggagactttgactttcctctcacagtaattgatagaagtagacagaaaatcagtaccaacagatgagacccaaacaacgttatgtccagttgacataatttacctttataaaacactctacccaacaaaggtagaaaactttttttttcaaacacacatggaatattcaccatgctaaaccatattctggaccataaaacaaactttcacaaatttggaataactgaagtcatacaaagaatctttttcatgcgcgtccatgtgaagagaccaccaaataggctttgtgtgagcaataaagcttttaaccacctgggtgcaggtgggctgagtccgaaaagagagtcagagaagggagataggggtggggccattttataagatttgggtaggtaaaggaaaattacagtcaaaggaggtttgttctctagcggatgggagtgggggtcacaaggtgctcagtgggggagctttttgagccaggatgagccaggaaaaggactttcacaaggtaatgtcatcacttaaggcaaggactggccatttacacttcttttgtggtggaatgtcatcagttaaggcggggcagggcattttcacttcttttgtgattcttcagttacttcaggccatctgggcgtataagtgcaagtcacaggggatgcgatggcttggcttgggctcagaggcctgacaatcttcttgaaccataatggaactaagttaaaaattaataaaagaaacatatctagtaaatctccaaatatttggaaaccaaccgataaagtttggatgtgtgtctccaccaaaatctcatattcaaatgtaatccccaatgttagaagtggggcctggtgggaggtgattggctcatgggggtggatttttcatgaatcgcttagcatcatcctcttggtactgtcctcacaatagtgagtgagttcttgtgagatctgctcatttaaaagtgtgtggcacctccccctactcctgctcctgctctcaccatgtggtgttcccactcctggcttcacctgccatgattgtaagcttcctgaggcctcttctgaagctgatgccagagctgtttcctgaacagcctacagaaccataagtcaattaaacctcttttctttacaaattaccctgtctcaggtatttctcttttcttctttctttctttttttttttttcttgtgtgtgacagacagtcttgctctattacccaggctggagtgcagtggcacaatctcagctcattgcaacctccatcttcctggctcaaagaatcctcccaccttagtctccagagtatctgggactacaagcatgcaccaccacacccagctaattttttaattttttgtagagacggggttttgccatgttgctgaggctagtctcaagcatctgcctacttcagtctctcaaagtgctaggattacagacatgagccaccgtgcctggcctcaggcatttctttataacaatgcaagcacggactaatacaccaacatacttctggattacccatgggccaaaaggaaagccacaaaggaatttagaaaagtaaatgaaagagaaaatgcaacatatcaaaatttgcagaaggcatttaaaacggtgatttagagaaatttataaatgcttatattggaaaagaacaacatctcaaatcaaggatctaagcttgcaagtgacaaaactagaaaaagaacagaataaacccaaagtaagtagaaggaaggaaagtattattagaagaccagaactcaaataaattggaaacagaaaaacaatagagaaaattaatgaaactaaaagttgattattttaaaagttcagcacaattgataaacctctagcctggatgaccaagaaaaataagatgcaaattagaaacatcagaaatgagagaagaaacatcactattaaccccacagaccttaagaggataacaagggaacagtactatgaaaagctgtttgtaaatttgacaaaatgcactaatttttaaaattaaaaaaaattaccaaattcattcaggaagaaaaaagtttatgttaaagcaatgatttatttcatatatatgtatgtataacttttaaattgaatttgtagtttaaaccttccaaaaagaattctctaggccccagtggtttcactgatgaagtttaccaaacattgtggaagaaataataattttacataatctcttccagataaagaagaggaaggaacacttctcaattgattttatgagattggcattacccaataaaaccaaagacattacaattaagaaaatgtcaacccaatatcctttaagagcacagacacaaaaatcttataaaatattatcaaattgaatccaaaaatatatttaaaagatattaataatatggcatgatcaagtggggcttatccccagaatgcaaggctcactcaacatttgaaaagccatcaatgtaattcaccacgtcaacagtctaaaaaagaataatcacatgaatatcttattggatgaagaaaaagtttagaataaattcagtaatcacttcatgataaaaaaaaaaaaaaaaaaaaaaaactccagcaaacaagaaagagtagggaacttccttaaactaataaaaggcatctatgaaaaacctacatctaactttatacttcatgatgaaagactaatgctttccccctaagactgggaagaaaaagttgtcctctcttgacacattcgacagtgtactgaaagtgctagccagtgtaataaggcaataaaaagaagtaaaggatataaatattggaagggaaaaagcaaaaatatatttattcatacatagataacatgttcatgtagaacatttcattgaatctacaaaaagcttttaaactagtaagtgaattagcaaggtgccagcatatgtacaagtcaatataaaaaagttaattatattccgatataccagcaatgaataattgaaatctgaatttttttcaaaaataccacttataatagcaccaaaaataaggaaaatatttagttataaacaataaaatatgtgcacaatcaatttgctgaatacaaaagattgatgaaaaagtcaaagaagatataaataaatgtggagatacagtattcatggataaggaaaattcaatattgttaaaatgtaaattctcctaatctacagagttaatgcaattccaattgaaaatccaaaggatttttgtaggtttttttgtagatttagacaattaaaattttatatggaaaaccaaaataaccagattagccaaaagaaagaaaacaaaacataacattagaggtgtcatactacctgatttcaagactttatagtagtcaagatcatgtgggattggcaaaggaaaagataaatcaatgaaatagaattgacagtccagaaataaacctttgtatttatggtcaattgatttctttaaagatgtaaaaggaattcagtggagaaattatggtatttttaacaaatgatactggaacatttggacattcagatgcacataaattcatacatacatatacacacaatacatgcatacatacacacatacatacatatgaagaataagcctaaactatatgtcacaccttatacaaaatgaactcaaaatggatcatagactataaagtctaaagctaataaacttgtagaaaaagaaactatcttgcccttccgtgtcttttaagaagtcttttctttttttacccccttgaaaaccctgtaattgcctcacctggagctgatgcctcacaaaagagaggatgcccactctcctcaaaatctaccccaaacacttcttattgccactagacccataactagagtccaatttcaacatgttccagcagcctggaagtggcagcaggtctctgagtataactgtggcactgagcccaggttcccagatttgtctcgttccacttgctctgcagagtatgagccaatataaactaaaagtgatgtctttactaaacacctgttacgaaacagcctgaggtgtagatatctctcatctctggccttgttttcagcatttttcctccttggatcaacagtttctgataccaggttaggttacaaggctggaataaaaaaacaaaccccagcttggaaaggaaggtgaataaggtagtcactcttacttgtttgttctcacagaatttgtccacctgactattgaaatacccagtctagcttcttagtttttattcatggctgttggtatttattaagtaagcattaacagacttattgggcaagtaaaacataatgtgctaggcagccacaagaaaatacaaagccagagtccccaaccctcaagagttcattctagactaatcgtaaatacatggctttatgttttcagattatgcttaatggagccactccgaaccattttcttctgggtggcacacctctgcgtaacgaaattttccagacttcatatgggcaaggtagctaggcagagagaatgacctaaaactaaaattgtttcagagagaagtaggaattgtactaattaatgctggagcaagacaaagatagacttcgaaggggcagatggctacagcttagtgtctaacattatggaattgatctcggtagggcacctagcattgcttctactactcccatgcctctaactgtcccataagcaggtgctgttagtggcaaaggcaaaatgcaggagtgcagcccaccatggctataagaagtactcaaaatccatatcttcctgctttgggatagctgaatctcaatagacaacaattatttttgtaacacacttaaataatgtaagagaaaaaatagtaaagaagaaatgtttagagaaaatggaatgacaaatgagcaaatataggaaaagaagtcagggaaaagaacatcacactataaactcatcaatgctttataccagcaccttgcacaaagtttaactttgtaaattgtcttaaatattaaatacctaactttatataaaaaggcaacaccaatatcatctcttctcagcgcctccaaacaaaattatgtactttgttttttctaattaaattttttttttttgagacagagtctcactcttgtcacccaggctggagtgcaatggcacaatctcggctcactacaacctccacctccagggttcaagcgattctcccgcctcagcctctcaagtagctgggattacaggtgcccaccaccatgcccagctactttttgtatttttttttaatagggatgaggtttcaccatgttggccaggctggtctcaaactcctgacctcaggtgatccacccacctcagccgcccgaagtgctgagatgacaggcataagccactgtgcctggccagaattatgtactttcaattgtttatcctccactagagatgcttctctgtgaattagttacacatctttatgagtaactacctttatcacctacctttatgatcaggttgttgatctgagagatgggactatggaacagaggaaaattaacaggtgcccattaggcctcaagccacagttgagttttcagtgggattgtactctcagctaatgagatggaaatgaaagctgagtgcttactgacaagaactgacttcatacctaagtgggcacacaaaaaccccagaggtgtaagagtaaattctgggcttctaatctgccaatcaaaacttcacaaagggttgtgattgttaattgtaaaataaacctatctgcccatggggactcttgggaaacagcgttactgactatataacacatgtaaatactctgtttatatactttaattgtctagccctctgtaaaatgaaacaatttagtttagggacacttgagctcagtatctaaagactaggacaagcccacattccttctccttggaagagagatcttctttttcaacagctaaaatgcagccatttgctaaaaatgactcagcactcagaaagctcaggagaacaaatctcagagaaaggggctgtccctgccagacaccccatttctcccacccaagatttctatgccatgtatcacccatacagccagaaagctagaagtatatttattttataagtgacaaagcaaggaaacaatgctgagaggtccagaattgaacaataatcaccatagatatgtttctttggggagaattcttctatgtaagagccttaaaattacctctcaaatttactttttgaaaccatggtgttgaaagggactgcttgagaatctggaacccggtgtttggtgaggttatcttggcccatacttcctctgcatagcaaacagtgactctttggaataaggggcaaacttgggactcagggccagagttatattcacagactggctgccacttccacaccactggaatatgatgacaattgaccctagttatgggtctagcagcagtaacgggtgtttcaggtaggctccgaggagagtgagcatcctcttgtttgtgaagtatttgctccaggagaggcaattacagggtttttgaggggagaaaaaaattctgcagatacacaagagcaagatactcccactggcaagggagactcagagcaactcaggggttcaagattctcactctcacttgagaccaaccatatgtgcccatttcaagttttggggtctccttcccaatcaatgacctaactttcacatgagaaacttggcattaatttcccaagaaaattactgatgttgtagttctgcaacctgtaaaattaaattttgtgtttaatttttaacaataccaaccctgtggctacaagacataaaagatcctgttagggctgccatggaagtcctctagttctcagaccgagaactaaaccaagagcttaaggacctgagcttttcatcttctgtctgtaagcactccactacactcagaaatatccatcctatgctacagtccttgcagtgatcactactgccgttaagagtccagtgtccggtcaagagacagaaaccacacagtaattcaaataaagaaagtataatcatgaagaactgttaacttggtaaaaaggtggttaaccactaaaaaggataaaagagaattgtatggtgtaatagaggtggcaacctcagactacagctatcactcttaagatgaaaggaaaggtaaacaaggaggaaacttagaaagagagaaaggactccagcagactaacatttgggcctctaaggagatggttcagctggtgcagaaacatgtcacccactgctggggtgaagaagaaacctccgggggacattcacttgctggaaccacaggaacaattcaccaccacaaggaatactgccggggccaggtatgtgctgacccattcactgtcatgtggagaaggcaaaaataacaggagaagataaatctctttttccttctccaactttgagaatcccttcagcactcccttagcccctaattggctgaacctaatataaagccagatatctgagaaaaaaatgtagtttgcagtgtacatctccagtatcgtgaagtaggacaaagaaaggtagtttggaactaagaggaaataaattaataataagcatacttgaatatagaggctaggagtaaagatggggaaaggcgaacagttacaatatatgctttggagatagaatcgcttggacttagtgttaaggctcctgtgggaggggagtaaaaggaggaatcaggatgatccttctaaagagaaagggaaaatagtatattcatttgtggatggaatgagtttgttgtggttagaaagaaagagaattaagaattaaattttgaatatatatcaaatgtctgtgacatattcagatcaaggtgtcaaattggcagatagatggctatacaaatgttgagcttgtctgaagataaaaattagcatcaacagcatatatatgttatttaagggcgctggactagatatcatctccagagaaactacagatagagaaaagagccagagaacttcctgagacacaccaacattcagaagtaagagaagaggtgaaacagagagagtagccagtgagaggcaaacaaacaaacaaaaaaaaaaaataggagagtttggtgtaacggaagcagagaaagaagtgtttccaaaaaagtaatcaactctgtcaaatgcattgaaattgaagaaaagcttccattggattttcttttttttttttttttcccagtcaggttctcactccgttgcccaggctggagtgcagtgatgtgatctcagctcactgcagcctcaacctcccaggctcaagtaatcctcccacctcagcctccccagtagctgtgtctacaggtgcacaccaccacgcctggctaattttttgtatttttttttttttgtagagatgggattttgccatgctgcccaggtgctggtcccaaactcctgggctgaagtgatccacctaccttggcctcccaaagtgttggcattacaggcatgagccaccacacccagcctggatttaacaagatgtatttcaatgtatgaaggaagagaaagaaagaaacatgaacagagaaataagtggtaggagaaggaaacgttgggtcaaactagaagttttaaacctgaaaaaatatgaaaactaagttgtctaatataacagccactagccacaggtggctgctgaggacttgaaatgtggccagtataccatatgtagaaagctgaaactggatcccttccttacaccttatacaaaaattaactcaagatggattaaagacttaaatgtaagacctaacaccataaaaatcctagaagaaaacctaggcaataccattcaggacatgggcatggacaaagacttcatgactaaaataccaaaagcaatggcaacaaaagccaaaatggacaaatgggatctaattaaactaaacagcttctccatagcaaaagaaactatcatcagagtgaacaggcaatctacagaatgggagaaaatttttgcaatctacccatctgacaaagggctaatatccagaatctacaataaacttaaacaaatttacaagaaaaaaacaaccccatcaaaaagtgggcaaaggatatgaacagacacttctcaaaagaagacgtttatgcagccaacagacagatgaaaaaatgctcatcatcactggtcatcagagaaatgcaaatcaaaaccacaatgagataccatctcatgccagttagaatggcgatcattaaaaagtcaggaaacaacagatgctggagaggatgtggagaaataggaatgcttttacactgttggtgggagtgtaaattagttcaaccattgtggaagacagtgtggtgattcctcaaggatctagaactagaaataccatttgacccagcaatcccattactggacatatacccaaaggattataaatcattctacgataaagacacatgcacatgtatgtttattgtggcactattcacaatagcaaagacttggaaccaacccaaatgcccatcaatgatagactggattaagaaaatgtggcacatatacaccaaggaatattatggagccaaaaaaaaaaaaaggatgagttaatgtttctttgcagggacatggatgaagctggaaaccatcactctaagcaaactatcacgaggacagaaaaccaaacactgcatgttcttactcataagtgggagttgaacaatgagaacacatggacacagggcagggaacatcacacacctgggcctgccggggggtggggggctggtggagggatagcattaggaaaaatacctaatgtaaatgacgagttgatgggtgcagcaaactaacacggcacatgtatacctatgtaacaaacctgcacgttgtgcacatgtaccctagaacttaaagtataataataaaaaatatgtatatataaaagaaatgtggctagcataaatttagatatgctataagtataaattacacaccacatttcgaagactcagtatgagaaaatatatacaatatctcatcaataatttttacatcaattatagggtgaaataatatttcacatacattgggttaaatgaaatatatgacaattaaatttacttttttttctttttacttttttaatatggctaccataaaatcttaaattacatatgtggctcacatcatatttatactggagagagttgtactagagcatgtttgtatgctaatataatgatctagtagagaatcaggaattgatgatgtagaaagagaaagagtagggaaaagagaaaagacctttagagcttaagcagataaggggtgatggacatcatacatagatcaacaaacaagtagagaaaggcatgtacatagataatatttgttgtatcctttatacagaaagaactcactctttttaaacagccatgaagcagtaataaacatttatcaaggactaagtcacaaataaaatctcaaatatctaaaggtacagatcacatggtaatcaaacaagaaatcagtatgaaaaagacagcaaactcaatctaattacatggacattataaaacagttttctaaacaactcttggattaaagtggaaatcagtactagaacacagactgtttgaaattaccaatgaaacaacactccatttcaaagcttatgggatacaaccaaagtcttaactcaaaggaaaattcagagctttcagtgatcttcttaatatatacggaagattgaaagtaaatgatctaagcacccagttcaagaaagtttaaaaaaattaaaaaaaaaaaaataagccaacagagaataggagaaactaataaaaataaaattcaaaattaatgaactagaaagcatggcaaaacaaaattgcatagacctggtaaataaagcaattgttttattttgtttttgtttttagaatacaacatacaaaccattaataagtgtgaacaagaaaaaaagagaaagaaaatgcaaatatctacaacaaggaaagaaaaataattcagcattaagagatttttaaaattctaaaattccaaatacccaccagtaaattagaaaatctacatgaaatagacaaatttttagcaaaatgcagattactaatattagctcatgaagagaggaaattatcccaataatcaaagaaaaacttgaaaatgcagcaaaagctctaacttcaaaaaaagcaccagttccagtttgttttatcagtaagttctaatacatcataaagaacagataattcctggattatttaaacattcggccagtacaaactatgaaaaacttcccaatacacttcactgacaaatttaattctgatactaaagtatactaaatactaaacaatagtaaaaataaaatacatattgggttattcttaaaatccaaagtcaaatattagcaagtctaattaagaatgcttttgacagcaagtaacagaaaccctgactccaattatctttaaaaatgagggtatttctgaactcaacagaaatctagaagtaggataagttttaggatgggttgtggtttaattacgttattaagaacccaggggaggggggccaagttggccaattagaagcagcagctgtctgtggcactcagggagaggaagaaaggagcaagtgaatatagcaccttcaactgaaatatccaggcactcacactgggactgatcacagaaacaactcgacccatggagaagagagaaaagcaaggtggggcaatagcccacctgggagcaacatgaagccaagagaactcccacccccagccaagggaagcagtgagtgagtgtgcaaccccaggaaaccacgcttctcccacggatctttgcaacccacagatcaggagatcagtgcacccacaccaccttgtgcacccacatcaccagggtcttgggtcccacacacagaggtgtgttgagtctcagcagagcagctgctcaggcatgcatagagatccaggaactttacatattccggccccaggatccccaacagaggtgtctgtaactcaggcaaggtgggaggtctgtacatacccctaggaagggggctgaatccagggagccaagcagcatcaatctgtgggtcccacttccacaacacctcacaaaataagacctactggcttggaatatagcctacctgtgatgggacagagtccccagtgggaggggtgggctgccatctctactgtttggttgactcagccatttcagtctatgggcttcggagaatccatatggttcaaacaaggaagggtcttcccagaacactacagcggcattgcctgaacgtggccaggttgcttctttaagtggggccccaatccattcctcttcactgggagggacctcccaaccggggcctccagccatctctgcctgtattccacaaacggatcctgatctctttctggaatagcatgcccgaggggaggcgaggagggaaggaggaggggaggggaggaggggaggaaaggagggccaccaagctggctgtttgaatgactcagccattccaaccagtgggctttagagagtccaagccaacaagggcagaagcagtttcccagcacaacaaggctgttctattgaggcatggccagatggcttctttaagtgggaccctgatccacttttccttgacgggtagatcatgccagctggggtatccagccacccccgcccatgttctgtggccaacagacttctaatttttccctgggacagagtgcccagaggggaaggcgggccaccaacttggctgttgggcacctcagccagttcagcctgtgggcctcggagagcccaaaccaacaaggggctgatgggatccccaacacagcacaactgctctatcaaaaacagcccaactgcttctttaagtggatccctgatcccgttcctcctgactaggtgagatgtcccaactggggtctccagccaccccctacatactgtgtgctcatgctggcaacaggacagtaccgccctgggatggagcttccaggggaaggggcaggctgccatctttgctgtttcatagcattcactgctgatacctccaagtacaggaaaaactgaggcaaccagggtgtagagtggacccccagctaactgcagcatctgtaaggaagagtaaacagactgctaaaagaaaaagatgaaaaaacaaaacaatccatgaaagcgccatccaaaggtcagcaacctcaaagatcgaagatagataagcccacaaaaatgagaaagaatcaacgcaaaaatcttgaaaattcaaaaacccagagagccccttttcctccaaatgatcacaacacctctccagcaagggctcagaactaggctgagcccaagatgacagaagtaagcttcagaatgtggacaaaagccaattttgctgagctaaaggtgtatgtcctaaccaaaggcaaagaagctaagaatcatgataaaacaatgcaggagctgacagccaaaacagccagtatagaaaggaccataaccgacctcacagagctgaaaaacatactacaagtactcgcaatgtaatcccaagtattaatagcagaatagaccaagcagagcaaagaatcccagagcttgcagactatctctctgaaataggacaggtagacaggaatagagaaaaaagaatgaaaatgaatgaataaaacctctgagaaatatgggtttatgtaaaaggaccaaacctacaactgattggggtacctgaaagagacaggaagaatagaaccaagttggaaaacatacttcaggatatcatccaggagaatgaccccaacctagcaagataggccaacattcaaattcaggaacaagagaaccccagtaagataactattcaagaaaatcatccctaagatatgtatcagcagattctccaaagtcaaaatgaaagaaaaaatgttggctgggcacagtggctcatgcctgtaatcccagcactttgggaggccaaggtgggtggattacttgaggtcaggagttcaagaccagcctggccaacgtggtgaaaccctgtctctactaaaaatacaaaaattagccaggtgtggtggcacatacctttagtcccagctactcaggctactcaagaggctgaggcaggagatttgcttgaacccaggagacagaggttgcattgagctgagatcgtgccactgcactccagcctgggtgacacagtgaaactccatctgaaaaaaaaaagaaaaaagaaaaaaatgttaaggacagccagaaagaaagaccaggtcacctacaaagggaaggccatcggacaagcattgggcctctgagtggaaaccctacaagccagaaaagattgggggccagtattcaatattcctaaagaaaagaatttccaacccagaatttcatatgcaaactaagtttcataagcaaaggagaaataagatccttttcagacaaacaaatgctgaggaaattcatcactaccagacctgccttacaagagctcctgaaggaagcactaaatatagaaaggaaaaaccattaccactacaaaaacacactgacataccaatgatacaatgaagtatccacataaacctgcaaaataaccagccagcatcatgatgacaggatcaaatccacacataaaaatgctaatcttaaatgaaaatgtgctaaatgcctcccaaaaaaagatacagaataacaagctagataaagagccaagacccattagtatgctatcttcaagagacgcatctcacgtgcaaagacacacataggctcaaaataaagggatagaggaaaatttaccaagcaaatggaaaacagaaaaaaacaggtgcaatcctagtttataacaaaacagactttaaatcaacaaaaatcaaaaaagataaagaaggccactacataacagtaaagggttcatttcaacaagaagagctaactaacctaagtatatatacacccaatacaggagcacccagaaaaagaaagtacttagagaccttcaaagagacttagactcacacacaataatggtgggagactttatcaccccactgacaatattaggcagatcattgagacagaaaattatcaaagacattcaagacctcaactcagctctggatcaagtgggcctgatagctatatacagaactctccactccaaaacaacagaatatacattcttctcatcgccacagcacttactctaaaattgatcacataattggaagtaaaacactccttggcaaatgcaaaagaactgaaaacataccaaagagtctctcagaccaaggtgtaatcaaattagaacacaagattaagaaattcactcaaaaccatataactacatggaaaatgaacaatctgctcccgaatgacttttggttaaataatgaaattaaggcagaaatcaagaagttctttgaaaccaatgagaacaaaactacaatgtccagaatctccagaatgcagctaaagcactgttaagagggaaatttatagcactaaatgtccacatcaaaaagctaaaaagatctcaagttaacaacctaacatcacaactaaacaaactagagaaaaaagagcaaaccaacccaaagttagcaggagacaaaaaataaccaaaatcagagtagaactgaagaagacagagacatgaaaaacccttcaaagaatcaatgaatccaggagctggttttttgaaaaaaattaataaaatagatagactgctagctagactaataaagaataaaagagaaaagattcaaataaacacaatcagaagtgataagggtgatatcaccactgaccccacagaaatacaaacaactatcagagaatactacaaacaccactatgtacataaactagaaaaatctagaagaaaaggataaattcctggacacatacaccctcccaacactgaaccaggaagaaactgaatccctgaatagacaataatgagtttggaaattgaagcagtaataaatagcctaccaactgttgggaaaaagctgagtgttgggaagaaagctgaggcagggctcgcatgtctgccacaatgtcctctggaatgtgtctagacttgctggctccttgcttctagccctcctaggctcctagttcgattgtatcttcattatctcaagtagcagaacatgttccttataaatgccaaaccatcacagctgtagatcatgcacctgctcttctgacctccacattctcaccacctgtttctctgttggattaccaataaatagcatgggctcccagagctcagagccttcacagcctccatacactaacaatggcctcctggttccacctttctccctcaaactgtctttttctcaatcctttgactctgctggactttgtcacccccatgacctggtgttgggtctgatcaccccaacaccaacaaaaaaaaaaagcccaggaccagacagattcacaggtgagttctaccagaggtacaaagaacagctaataccactcctactgaaacaatttaatattcaaaaagatcgaaaaggagggactcctcctaactcattgtatgaggccagcatcatcctgatatcaaaacctggcagagatacaacaaaaaagagaaatttcaggccaatatctttgatgaacatcagtgcaaaaatcctcaacaaaatacaggcaaactgattccagcagcacatcaaaaagtttatccaccatgatcaagttggcttcatctttgggatgcaaggctgttcaacatacaaaaatcaataaatgttaagttatcacataaacagaactaaagacaaaaatcacatgattatctcaatagatacagaaaaagtctttgataaaattcaacatccctcatgttaaaaactctcaataaactaagtattgaaggaacatgtctccaaataataagagccatctatgacaaatgcacagccaatatcatactgaatgggcaaaaactggaagcattctctttgaaaagtggcacaaaacaaggctgccctctctcaccactcccagtcaacactggaagttgtggccaaggcaatctggcaagagaaagaaataaagcatattcaaataggaagagaggaagtcaaactatctttatttgcaggtgacatgatcctatatctagaaaaccccaatgtctcagtccaaaagcttcttaagctgataagcaacttcagcagtctcaagatacaaaatctatgtgcaaaaa

SEQ ID NO: 580 - DNA, 40001 bp, Homo sapiens
gtactagagtcccatggagggcttggtaaaacacaggtggctggatcccattgaggcaggagaatagggtctggaggcagggaacgtaaggctgtttcactctgacttcctagaactaaattgaaaggaaaaccctaactttgcacacctaagtaacaaaaagagcagaggctactcccttggatcttttctgcgtggcagatgggaaatttgctgtctacaacaaatcatgctgagtgcgggtggagtctttgtttgcaactttgtaacttcactccagcgtctgaatggttgctttctgcaaccagtcagactgagcgggggataccacttcatttacatgaggttagcatgaagtggccaatgggaagcttctagggggcccaggaagattctgtatctgggcccttgagccactgcttgggtctgctcccacaccgtggagtgtactttctttttcaataaatccttgctttagttcttttgttgcttcgttctttctttgccttgctgggtgtttcttccaattctttgttcaaaacaccaagaacctggacaacttgcagtcatgactctctaccggtgacaccatctctagagtttctcattcaggaggtcaggggtgaagcatgagaatttgtatttgtaattttctattgctgctggtacagagacatcactttgagactactgattgacagcctatgtgggttgaaagaaggcatctacaaatgaccttccctccttatagttcaaccagttcttctattttcaataccatacttacccctcctctggagatacctgtgccttcaatttaagaaccattccagggtgctgcaacaaaattaagcttactactttctggattcacactcccacctccaacgtacacacacacacacacacacacacacacacaactgtaggcttaaattttggctttttcagttctctgaagtcagttctctctagtcgatccacttttcagcttctaaaattttactgacacatcttagccactatagtctcctctcctgggcttttagtgcttttgagcttatgcctttttttaaaaaaaattgtgacattttggtataagcaatgaaatgaacacttgcttcaaagtggcatgtttaataggaagtcaatgcaggaagctataaaggagaaactaatagttaccttcaaatttcaccgttcagaaataatcatcattgacattaggtaaacatctttccctgaatatatacatgtaaaaaacagaaggctgagagtagtggctcacgctggcaatcccagcactttgggaggccaaggcaggcggatcacgaggtcaagagatcgagaccatcctggccaacagggtgaaacaccgtccctactaaaaatacaaaaattagctgggagtggtggcatgcctgtagtctcagctactcaggaggctgaggcagaagaatcacttgaacctgtgaggcggagcttgcagtgagccaatattgtgccactgcattccagcctggtgacagagcaagactcagtctcaaaaaaaaaaaaaaaaaaaaaaaagaaaaactctttatttttatatgtgattatattatatgtgtttgttaaaatttatttaatttacttaaaaggaaaattttaaaagtgaaaaaaattactgaattacaaataaatattttttctccaaagtgatattagtcctcactgggggcatcgcatcatctgactttaaaatctgctacaaagctatagtaagcaaaacagcatggtagtggcataaaaacagacacatagaccaatggaacagaatagagaactcagaaataaatccatacatttatagccaattcattttcgacaaaggcaccagaaacatacattagggaaaagacagtctcttcaataaatagtactgggaaaactagataaccatatgcagaatagtgaaactagacccctatctcttttgaccatatacaaaaatctaatcaaaatgaatcaaagacttcaatgtaagacctgaaactatgaaactactagaagaaaacattggggaaatactccaggtcattggtctgggcaaagattttttgagtaagatttcaaaaacacaggcaaccaaagcaaaaatacacaaacgagattacatcaagctaaaaaacaaacaaacaaaaaacccttctaaacagcaaaggaaataacagagtgaagagacaacctacagaatgggagaaaatttgcaaactatctatctgatgacacattaataaccagaatatgtaaggaactcaaacaactcaatagcaaaaacaacaacaatgaaaccaaatatctgatttgaaaatgggcaaataagctgaatagacatttcacaaaagaagacatacaaatagccaacaggtaaatggaaaaatgctcaacatcactagtcatcagagaaatgcaaatcaaaaccacaatgaaatatcatctcactccagttaaaataggtattgtcaaaaagaccatttgttggcaagaatgtggagaaaggggaatgttcacatactgttggtggaaatgtaaattaatatggctactattacagtggctgtacactattacactacgtaaaggaaaacagtatggagattcctcaaaaactaaaaatagatcttccatatgatctagcaatcccactgctgggtatacatccaaaagaaaggaaatcaatatcaaagagatatctgcactctcatgtctactgcagcagtattcacaatagccaagattgtaaacaacctgtccaccaacagatgtaagggtacttctctgtacagtttaagaaaaagaaaaagaaaaaacaaaaacaaacaaaaaacaaaaaccaaaaaaattcacagaccctttgaaagaagcaacttgctgctctaaactccatgagacggtaaaaaaactgtgagtggccaatatgtgagaggggaaagtctgcctctgaacacacatcctcagtggggaacctgaaaatccagatcacgggagaaggatttgacctaacctagagctgaaacaaatttagagagttgagtgaaatatgaaggtagaagaagcagtgggaaaagccctataggcactcctggtccccaggaaggccaggaaagccatttctgactttttctcacaggggtctttgttggggggctgccagtggaactgggaaaggaccacagggggaaagaaacttcaagctgaactttgtaataattttgatggagtgtgaattttcctgggcaaaatggagaagggggtgaacaaggagtgcagataagagcatggaagacacagcaggcagggaggggcagggcctgaaagccctgcttgctttctcagcagggaagcttgtagcctggggcaagatctcagtcctgctcacctggatataaactccatgctgttggtggggcatggtgggagtgagactggctttgctggctgcatgggagctggatgagacctgtcactgccatcaggtgttcctgaggaagaagagaaatctgaaagtctggaaaacttatttgagggaataatcgaggaaaacttctctggccttcctagagatctagacatccaaatacaagaagctcaaagaacacccagtacattcatcacaaaaagataatcacctagatacacagtcatcaggttatctaaagtcgaggcaaaagaaagaatcttaaggatggtgagggcaaaagcatctggtaacctataaaggaaaacctatcagaataacagtagatttctcagcagaaaccctacaagctagaagggattggggtcctatctttagcatccttaaacaaaacaattattagccaagaatcttgtatccagcaaacctaaacttcattaagtgaagaaaagataaagtctttttcagacaaacaaatgctgagagaattcgccgctaccatgccagcgctacaagaaatgctaaaaggagttctaaatcttgaatcaaaacctcgaaatacaccaaaatagaaccactttaaaggataaatcccacagggcttctaaaacaataacaacaacaacaacaaacataaggtattcaggcaacaactagcaggatgaacagaatagtatctcacatctcaatattgacgttgaatgtaaatggcctaaatgatccacttaaaagacatagaatggcagaatggataagaattcaccaatcaagtgtctgctgtcttcaagaaactcagctaacacataaggactcacataaacttaaggtaaaggggtggaaaaagatattccatgcaaatgaacatcaaaagcatgcaggaatatctatttttatgtcagacaaaaaaaaaaaaagaccttaaagtaacaacaggtaaaaaagacaaagagggacattatgtaatgattaaaggagtagtccaacaggaaaatatcacaatcttaaacatatatgcacctaattctagagctcccaaattcacaaaacaattactactagacctaagaaatgagatagacggcaacacaataatagtgggggacctcaatactccactgacagcactagacagatcatcaagacagaaagcctaaaaaggaacaatggacttatactataccctagaacaaatgaacttaacagatatttacagaacattctacccaacaactgcagaatatacattctattcatctgtaaattcaatgcaattcccatcaaaataccactgtcattcttcacagaactagaaaaagcaatcctaaaattcatatggaacaaaaaaaagagcccgcatagccaaaacaatactaagcaaaaagaactaatctggctgggcgtggtggctcacacctgtaatcccagcactttgggaggccaaggtgggtggatcacctgagggcaggagttcgagaccattctggccaacatagtgaaactccatctctactaaaaatacaaaaaattagctgggtgtggtggcacgcggctctaatcccagctactagggaggctgaggcaggagaattgctggaaccaggaggtggaggttgcagtaatcgcatcactgcacctccagcctgggcaacaagagcaaaactccatctcaaaaaaaaaaaaaaaagaacaaatccagaggcatcacattacctgatttcaaactatactacaaggggatagtcaccaaaacatcatagtactggcataaaaataggcacatagaccaatggaacaaaatagagaacccagaaataaagccaactacttatagccaactgatcttcaacaaagcaaacaaaaacataagtggggaaaggacaccctattcaacaaatgatgctgggataattggcaagccacatacggaagaatgaatctggagcaaaactccatctcaaaaaataaataaataaaaataaataaaaaagctgccaggtgtggtgcctcacgcctataatcccagcatttgggaggtgaaggtgggaggatcacttcagcccaggagttcgagaccatcctaggcaacatggcgaaactccatctctacaaaaaattgcaaaattagcagggcatggtggcatgcgtctgtagtcccacctactggagtgcagtggcatgatctgggctcactgcaacctccacctcccgggctcaagcaattctgtctcagcctcccgagtagttgggaatacaggcgcatgccaccatgcctggctaatttttgtatttttagtagagatggggtttcaccatgatggtcaggctggtctcaaactcttgacctcaggtgatccacccgccttggcctcccaaagtgcggggattacaggtgtgagccaccgcgcccagccagtctttcatgtcttttagtgctattgtgaatgttgggccttacaattttcaattctgacttttttttcctagtatttagaaatacaattaatttttgaaattgatcttgtaacattcaactgtgctgaactcatttattagttccagcagcttttttgtacattctgtagaattttctacttaaaattatgtcatctgcaagtaaaggcaatttaatgtctccttttccaatctggatatattttatttatttttcttgccttaatatactggctttctttagtacaatgttgaatacaagtggtgagaacttacatgcttcccttactccttatgttagggagcaacattcagtctttcaccattaagtatcaaattagcttcagattttgaggggtaacttttataaagttgaggaaatgttattccttttagttagataacattctatttatttatttggttgtttgtttgtttacttatttgaggcagtcttgctctgttacccaggctggagtacagtgatgcaatcatggctcacttcagcctcaacttccctggctcaaacaatcctctcacctcagtcttctgagtagctgggactacagatgcatgccacgacgccctgctaattttggaattttttgtagagatggagttttgccatgttgcctaggatgctctcgaactcccgggctcaagtgatcctctcaccttgacctcccaaattttgggattataggcatgagccaccacacctggcagattttttatttatttttatttacttatttattttttaagatggagttttgctcttgttgcccaggctggagtgcaatggtgcaatcttggctccctgcaacctccctctcccaggttcaagtgattctcctgcctcagcctcccaagtagctgggattacaggcatgtgccaccattcgtggctaattttgaatttttagtagagatggggcttcacgatgttggccaggctggtttcaaactcctgacctcaggtgatccacccgcctgtgcctcccaaagtgctgggattacaggtgtaagccaccacacctggccctggcagatttaaaaaaaaaaatcaggaacagatattggatttttgtgaaatcttttttctgcatctactgagatgaacatatagtaggttcgttttttgtttggtttggttttggttttcttctatggtaaattccattgattttcaaatgttaaaccaaacttgcatttctgaggggaaattccagttaggcataatgtattaccatttttggacattgattcaactcagtaaaattttgttaaggctctttttgcatttatgttcatgaggtatgttggtccttagtttttgtttgtttgtatgtttgtttgagtcttgtaattgttgtattttggtgtgagagtaatgctagcctctagtctcataggatgagttggtattttattcttctcaaatttttggaagaatttgcatagcattggtcttatttcctaaatggtagaattcaccaaataacttaattgttaaaatttgtttaatttttatgttttaacttttattttaagttcagggttatatatgcaggtttgttatataggtaaacttatgtcatgggggtttgttatacagattacttcattacccaggtattaagcctagtatccattagttattattcctgatcctctccctccttccaaccttcaccctctgatagaccccagtgcctcttgttcccctgtatgtgtccatgtgttatcatttagctcccacttataagtgagaacatgcagtatttggttttctgttcctttgctagtttgctaaggataatggcctccagctccatccatgttcctccgaaggacatgatctcattctttgttatggctgcatagtattccatggtgtatatttaccacattttctttatccagtctaccattcctgggcatttaggttgattccatgtctttactattgtgaatagtgctgcaataaacatatgcatgcatgtatctttataacagaacaattcatattcctctgggcgtataccaggtaatggaattgctaaatcaaatggtatttctgtttttaggtctcaccaaataatttatatgagcccggagtagttttattttaataggaagattttaactacaggtgcaagttctttaatagaaatggtgctatttgggattctctttcttttgtgtatgcttaggtagcttgtatctctcaatgaatttgtccatttcatctaaattgttgaatttattggcattacattgctcctaatttcctttgttttgcttttaatacctgtggattctgtattgatatcacgtccttattcctgacataggcaatttgtatcctctctatttttcttttaattccttccttccttccttttttccttttctttttccttctcttcctcctccttttacatccagaatacacactgcagttcctttcttccttttactgatcagcctggctagaagattatcaatttagttgatcacaaagtaacagcttttggtctcattaatttcccccattacttttctgcttctgtttatgctctttattcttcttatttatttttgcttactttgggtttcatttactcttttcatttctagtttattaaggaggaagctgatgacactgattcagttctttttttctaatataggcatttagtgcaataaatttccctctgagtactgctttagctacatttcacaaatatcaatatgttgtcattttgttttgactcaactgaaattgttttctgatttccctttctgatttcttctttgaccctatgggttgtttagaagtgtgttatttcatttacaactattttgaaggtttttttcagatatttctatttttgatttttaatttgattccactttggtcagaaaacatactttatatgatttgaatcctttaaatttattgagattttgggggggctcacaatatcatctgtcttagtaaatgttccatgtgcacttaaaaaatatgtattctgttgtcattgaatggagtgttttataaatttcaattttgtcaaattattcgatagtgttgttcaactctgtgtctttgctaattttctgttcacttgttctatcacatatggagagatggatatcaaaatctctgactataattgaggattacatctatttattctcagttctatcagttttgctccttgtattgtgaaaatgtgttattaggtccataatttagggttattatttcctcttcatgaattgactactgtatcattaaaaatcatcttctttatctctggtagtactttctaagtactgaaatatttgcctataactactccagttttcttttgattagtgtaagcatattatatattattctattcttttacttttaatgtatttgtatttttatatttaatgtgggcttcttgcaggtaggatataattgaaatcttactctttgccttttttttttttttttttttttgagatggagtctcgctctgtcacccaggctggagtgcagtggcacaatctcggctcactgcaagctccacctcccgggttcacgccattctcctgcctcagcctcctgggtagctgggaccacaggcacccaccaccacgcccagctaattttttgtatttttagtagagatgaggtttcactgttagccaggatggtctcaatctcctgacctcgtgatccgcccaccttggcctcccaaagtgctgggattagaagcctgagccaccacacccggcctactctgccttttaatggagtatgtttagaccatttatatttaatgtaattatcattattatttttattagagatagtctttcactttcacccagactggagtgtagtggtgttatcgttgccattgcagtcttaaactgttggactcaagcagttctcctgccctggcctcccacagtgttgggattacaggagtgagccaccatgcctggtctacatttcatgtaattttttttttttatgttttgcatttctgtgtttcttttctatgtctttttttttaagttcaggggtacatgtgcaagatgtacaggtttgttacataggtaaaaatgtgccatgatgatttgctgcacagatcataccatcacctaggtattaagcccagcatccatcagctattctttctgatgctctccttcctcccttctcctcccaccctcaacaggcctcagtgtgtgttgttccccgccatgtgtccatgtgttctcatcattcagctcccacttataagtgagaaaatgcagtatttggttttctgttcctgcattagtttgttgaggataatggcctccagctccatccatgtccctgcaaaggacatgatctcattccttttttatgactgcatagtattccatggtgtatatgtaccacattttctttatccagtctatcattgctgggcatctctatgtctctgctattgtaaatagtggtgcaatgaacatacacatacatgtatctataatagaatgagggctgggcacagtggctcatgcctgtaatcccagcactttgggaggccaaggcaggtggatcacctgaggtcaggagtttgagaccagccgggctgacatagtgaaaccctgtctctactaaaaatacaaaaattagccaggcatggtggcatgcacctgtagtcccagctacttgggaggctgaggtacaagaattgcttaacctgggaggcggaggttgcagtaagcccagttcacaccactgcactccagcctgggtgacagagtgagactccatctcaaaaaaaaaaaaaaaaaaagaatgacttatattcctttgggtatatacccagtaattggattgctgggtcaaacggtatttctgctgcttctaggtctttgaggaattgccacaccgtctgtcacaatggttgaactaatttacactcccaccaacagtgtaaaagtgttcctttttctccataaccttgccaacatcagttttttttttttactttaacaatagccattctgactggtgtgagatggtatctcattgtggttttgttttgcatttctctaatgatcagtaatgttgaacccttttttatatgttttttggccacatgtatgtattcttttgagaagtgtctgttcttgtccttttcccactttttaatggggttgttttcttttcttgtaaatttgtttacattccttgtaaatgctggatattagacctttgtcagatggatagattataaaaattttctcccattctgtaggttgtctgttcattctgatcttttcttttgctgtgcagaagtgctttagtttaattagatcctatttgtcaatttttgattttgttgcaattgcttttggcatcttcatcataaaatctttgcctgtgcctgtgccttaatggtattgcctagattttcttcttgggtatttatgattttgggttttacattgaagtctttaatccacctcaagttgatttttttatatgatataaggaaagggtccagtttcaattttctgcatatgactagccagttctcccagcaccaccatttattaaatagggaatccttttcccattgcttgtttctgtcaggcttgtcaaagatcagatggttgtaggtgtgtggttttatttctgggttgtctattctgttccattggcttatgtgtctgttcttgtaccagcaccgtgttctttttgttactgtaggcttgtagtatagtttgaagtcaggtagcatgatgcctccagctttgttctttttgcttaggattgtcttggctatttgggctcttttttggttccatattaattttaaaatagttctttttaaattctgtgaagaatgtcaatgatagtttattgggaataacattgaagctataaattgctttgggtggtatggccattttcatgatattgattcgtactatccatgagcatgaaatgtttttccatttgtttttgtgtcatcttcctttctttttgagtttttattgtttttgcactgattctttcttttctttgtgggcttatccaccttcaatcttcaaggttgctgacctttggtgggatttttgtgttgttttctttgttgttgttgttttctgtttatttgtttgtttttcttttaaccatctggccactcttccacagggctgctgcggttttctgggggtctgctccagaccctagtcacctttgtttttcctgtacctgaaggtatcactgatgaaggctgtgaaacatcaaaaatggcagcctgccccttcctctggaagctgcatcgcagggagggtactaatctattgtcagcctgaatgcacctgtaggagatggctggagtccctggttgggaggtctcacccagttaggaggaacgggatcacagacccacttaaagaagcagtctggctgctttttggtagagcagctgtgctgtgttggagaacctttcagcccctgatcagtttgggctctccaaggcccacaggctggactggctgagaagcctgaatggtcaaggtggtggcctgtctgttctggcacgcttctaacgatatcagaatcgtctggatcaatgatagacaacatgcatactctgcagtatttaccacatgctatgcccaattcaaaattattgtcactgtagtgatggacaccagttttggtcaacatggtatagtactctattttggatttcctcaaagctggacagttttcagtgtggatagccaattttgctttgccttgcctgatcatctttggagtctgcttgtacgccagtatgtactttccactttttataacaagtagaagcctagagttgatccattccactgactttttaatcttctttgcaagcaccatcttcctgcattaggtgtgggatggcccccaaacaaaagcagctgccaaggtaactgggaggcaagaagggaagacctagaatttttctaaagcaaaactttgatgggctgcccacctgtttcattcccaggaaccttgtaattaattattgccacaaatctcttgggttaaagtacttgattaacatttcctctctgcagcttaatgtggtaattgcatctatcctgtctctgatgattaaatgctgccacctggccttctacacaccaggattctattattccattgcaatcagggattcctaatttcatggcaacatttccgaccgtcatcactgacctacggaatacagccaacacagagctttaaaaggatactgaagctcccaacccaggcatttattaaatgattaatttttcatatttattaatttattaatggcttggtgaagagaataccctctaggcctccaggaggtatggttggtatgtggatgatcatatctgctctaacatactcatttccctaagcctgaggtttaattcctagagcataccaaagaagtactggcatctcaatttctttctttttttttttttgagacggagtctcactctgtcacccatgctggagtgcagtggcgcgatctcggctcactgcaagctccaccgcccgggttcaagcgattcttctgcctcagcctcctgagtagctgggattaggctactcggtggtgtgcctgacgtgcaccaccacatccagctaatttttgtatttttggtggagacggggtttcagcatcttggccaggctggtcttgaactcctcatctcatgatccacccgcctcggcctcccaaagtgctgggatggcatctcaatttcattcactataggccactattgaagtcagtcctgctaaccaaccaagcaaattgttagttacacccaggcagttaaacatattaaatctccatatttatattaataaatttagccagatccaaccttatatttttttctctgtggactaatacctttagaatatactgtcaatatgctccccaaatttctgacaatacaagttatccttcaactgctgcattttctgtgtatatagtattttctctcactcagtagagcttgtaattttccctctgagctatactgggaattaattattattgtgagtttggggttgatgcaggtcttgaggagagaattgttttttttttaattggatattgtcagaatatagattgtatttaagccacaagattggatgtgaccatcaagacagtgagcatagataggaaagaaaagagttgcaagggccaaacccaatatttagggatcgggttgagggaaatggatcagcaaaggaagaatggccagtgaggtaagaggaaaacaaaccctgaagcaagtgtagaatgtatttagcggagaaaagaaagatcaatggtctgagagttaaccatttgatttggccacaaaaaggttattggtgaccttggcaggcagtttgagttgtgacgagggcaaaaccctaactggagtaggtttaagagaagacacggaaggaacttgtagacagaaaatacaggcaacacttatgaagaattttgttgtatcaaaagtagagaaatggaatgtaagctgcaggaggatgtcaggtcaaaggaggacatctctctctttttagaatgggggatttttcagcatgtttctgtgctcatgtgaatgatccagtagagacagaaaaactgatgcaggagggtgaagggagaattaccagagtaatgtcatcaatgaggtgagatgagaaggaatgggatatagtgttgcaatggaagagtggctttaggagaaaagacagttcatttttataaacaggaggaaaggcagtacctgggcacagatataggatgggtagatatgatgatggtaggaacctgtggaaattctctcctgggtgctttttatttatttttcactaattaattttactgagatataatttgcatacagtaacatgcacagatcttttgtatataatctgatgagttaagacaaatatacccttctgtgtaaaaaacaccccagtcaagacaaacccagaacatttctgtcaacacagcaagttccctccagcccttttccagttaatcccctcatcctcctccttgccaccaacaccccctcctactgcccaaaaactccaggcaacaactattttgatttttatcactatagactagttttactagtcttaatcttcacacaaatagaataataaaatatgtagtgttttctggctttttttccttaatatgatgttgttttgaagtcacctattgtattatatatatatatcaatagtttattattttattacagagtagtattccataatacaaatgtaccacagtatgtatattcattctcccattgaacatttggattgtttccagtttttggtttttgtgaataaagcttctatgaacattcttaggctaatctttttgacaattgtttttaactccaagacctgtatactgagaaagatattgtcccttagcttcagattcatataactagttgtctacttgaatgattcctagcttcctcaaactcaaaatattccaaacttagcccttcccttaaacctggtcctcctgcaagatatcccttctcagtaacagcaccattatccacctcacagcccctgctagaaacttagaagttgctcttaacttctcctctcccttacctgctgtttccagtcactcaccatatcctgttgatttgatttcctatctttttttgcaaacatcttatgaatccacccacttatctactacagtctaatccatttcctatatagaaaaaatatggttgggcatgatggctcatgcttgtaatcccagcactttgggaggcccaggcagctggctcacttgagcccaggagtttgagaccagcctaggcaacatggcgaaactcttgtctctacaaaaaacaaacaaacaaacaaacaaacaaacaaaaactagctgggcatggtggtgcaagtctgtggtcccagatactcaggaggctgaggtgggaggattgcttgagcctggggggggttcgaggctgcagtgagccgtgatggtgccactgcactccagcctgggtgaccaaaaggagaccctgtctcaaaaaaaaaaaaaaaaaagtattttctgaagctcagatctgatcatctttttcctgatcaactcttccataatatctatcccttgccttacctttatgataaaaaccaaagcccttagtatggcttacagtcatgatccagcccctgacgaccttggtagcctgatctcaaagctccaggcccactgaacacatttccatttttcaaatgctctctcttttgaggctcctcactttgtctagaatattctcttccctgctcttgtttgcctggctaatttctagcctcgttttaacattgcacttcctctgggtggccctcgacctccactatatgcttcatagcacacacttgatcataattacttttttttttttttttttttgagagacagagtctcattctgtcacccaggctggagtgcagtggcaccatctcggctcactgcaaccttcacctcccaggttcaagtgattttcctgcctcagcttcccgagtagctgggattacaggcacttgccaccacgcctggctaatttttgtatttttagtagagatggggtttcaccatgttggacaggctgatctcaaactcctgacctcaggtgatccgcttgcctcagcctcccgaagtactggaattacaggagtgagccaccgcacccgacccataattacttattgaattgtctttatttccctcgagtggaataaacagtcttgttcactgttgcatttccattgcttagtacatagtaaaaatacttaataagtatctgttaattgaataaataacacttaataggctttaatgtccattgtgcatattttatagcacaacttactcatttggaattccttttttttttttttgaaatggagtctcgttctgtctcccaggttggagtgcaatagcgtgatctcagcttactgcatcctctgcctcccaggttcaagtgattctcctgcctcagcctcctaagtagctgggattacaggtgcctgccaccacgcctggctaatttttgtatttttagtacagacagggttttgccaagttggccaggctggtctcgaactcctgacctcaggtgatctgcctgcctcagcctcccaaagtgctgggtttacaggcatgagcactgcacctggccttcatttggaattcttattctgatttcttagttgaagatactcaagatttatttatttatttatttagagatggggtctcactccagttgcctgggttggagtgcagtggcataatcttggctcactgcatcctcgacctctctgccccaagcgatccttccacctcagcaccctgagtagctgggatgacaggtgtgggccaccacgcccagttaggttttttttttttgtacttttattagagacgaggtttcaccatgttgcctagactggtcttgaactcgtgagctcaagtgatcctcccaccttggtcttccaaagtgctgggattacaggcatgagccaccgctcccagccaagatttatttcttaaaatttatttttcttacaaaaattttttttcattgtcggggactttctggtaaagaccagaaaacctgctagacaaattttaaaagagctttaatgtgatttattttttattaaaaaaaagtttttagacatgggtttctcaatgttgccaagactgaccttgaactcctgggctcaagcaatcctcccacctcagcctccagagtcctgagtagttgggactacaggtaaaagccactgtgctcggctatgctcaagacttttttaaagaagaaaatatgggtattattttattctgaaacttctcatgttttatcttgccatcgtacataaacacattagtttgcacttaaacagtagcttaaattgtaaattttatccatccaaattttgttacaaactttgttataatggaagctctaaatgagggttatctgatttttagttatttataagtaatctgttttagtctactggaatgcttgcaaactccttgttatcttctctgccccctaggatatgtctagatatggatctttgaccattaatctcatgtcacctttttctttacttttaggtcttcttttaagtctagatatttttattcaatttgcctttgagttactattacttctgtttaaattagtccagattactcctcaaacatacttgtaattctcagattgggttttatctcatctcttttgtctttctgcttctgtttcatacaagcctcatcttcttgctttcttcttgagaatgcaaattttctaaaagaggtatctatttccttagaaaatcactttcagagataagcgaatcttctgaatcttctgtattatgatcctttcccttttgtatattattttttatgcttctcttgggacaagaagagggcttgggagtgtgatatggaccaaggttccaaggatttgggacaggtcatgtgcaagtaagcagagctgaccactagctgtggatagggaacaaaggagagttgaagtctaagagccttgccaagcagccttgagaagcaaacaataatctgaaacttgaaatctgtgagggaagatgaactcaagaactggatctttttcaaaggttgtcaggcaagatggaccttaactagtagaatctggagacagccaggaatgttaacttgaggaaataaaatacacaagaatgtgatagcttttcatactgctaaatctggagagaattaagatcttaggtcagtttggacaggtttttcccttctttattttctcatctatgtccagtatatcagtcatctattcagataggaagtgtggatttcctttggctccactcttagatctctaagtagagtccagatcgatatgcctacgtgagagtaattcccagggccttttgttattccactgtcttaaaccaatggaatccatgatcagctatcatttcagcaagcactgcagccagcactctccccgtacactgtattcatagggacaaatgtgacagggcaaatggacaattacctgtctctccatccaccccatctttcgccactgaattccggaagttgcagtccccagttacatgcataaagatgatagtctctaacagtattataatcacgtctcaaagcaggattttagattcgagaggctgatattgtttggatctgtgtctctgcccaaatctcatgtcgaattataatcctcagtgttggaggtggggcctggtgggaggtgattgaatcacaggggtggatttctcaggaacggttaccaccatccccttcacgctatgcctcatgatagtgagttctcgtgagagctggttgtttaaaagtgtgtatcacctcctcccttactttctctcttgctcctgctcctgccatgtaagatgcctgctccccctttgccttttgccatgattggaagcttctcgaggcctccccaaaagcagaagccacaatgcttcctgtatagccttcagaactatgagccaattaaacctcttttctttataaattacccagtgtcaggtaattttttttttacagcaattcaagaacaggctaatacagaggccgaagagggccagctgcttagtttgcagctctgatggacactggctctctaattcagtgagcagacagtgggaaagggatgctcagatgccaaactttctttcagatgggtggatctgttctgtaccatgaagtagagtatggataagccaacaactgtttttctgaatccacctccattagcctcataaattagggcaattcctcctggtaatgagcaagcagcttgtcattctttatgctctgtgttaggattaattttgtcatttttctttacctttttatgggttttaggcagcagttgagagaccctgaggcagggctgctagccaaatactatttaaagctagaaatgcctcactgatttttatcgtagattgtttcaacctgtgttcatttcttcagcctctgactataggatttcccaggttgcagtctttggctggctgctcagtctgcactctccttcagaggactaatttactcttacaccttcacatcggacacctgaagactctcaaactgttacctctagtcttgtcttctcatttaaattgtgaccctgtattttctgactaaaagacatttctacttgtctatcccacaaaattattgtatccctggtgtgtgtactcttaattattaaaactgctaaattatcaaagaccaaagtcatgaggacaggaaacaaacattttatgcaagggctactgataaaacttttggaggcacaaccccatttatactcctttggttcctggagaagagaaactgcactatgtattattcaaaggttctgagcatttacctcatcctgcaggatcacatcccagcttcacaccccaatatagcatggcctgagagctggcaatgtaactgggttttcaatagccatgtcactattctataagatcaacatcaactgcttctggctgatggggtgcaagataagacctgtaaatctaatgggtatcagaatattgactcacagagttcatttgttgaagcaatgaagcaatgttgcatggaaaattcacatcacataggatgttttcatttgcaaggagcagactacccagtgagttacagttcttgaagtttctcccacagggaagatatccctttcccaccatccttcagggtctacctagatggaactgaatgttacagaaatccatttagggcaagagctatcataccatgcagagatttctataaatttggttaggttttttttttccttcccaggcaagtgatcataaggaagtatccgtgattccacaggagtggaatatggaaagtgtggcagtgtaatcagaaaaggcatgctgcagtgtgagccatctgcatgtgcaactttcttgtgactttggacctgttgggtctagtcctgtttacattgtttccacttgatgatggtggaaaccatcctcagatataacgtggttttggttctagaccactacaataaagtggatatggcaataaaccaagtcacacaattttttttgtttcttaatgcatataaaagttattatttacaatacaccatagtccattgctagtgtgcaatagcattatgttaaaaaaacacgtatataccttaattaaaaatactttatggctaaaagttgctaacaatcatctgagccttcagcaagtcctaatatttttgctgatagagagtcttgcttccatgttgacagctgctgactgatcagggtggtggttgctgaaagttggagtggctgcagcaatttcttaaaataagacaacaatgaagtttggcacattgactgactcttcctttcatgaaagatttctctgtaatgctgtttgataacattttacccacagtagaacttctttcaaaattggagataatcatctcaaaacctcccaccattgctttattaactaagcttatgtaatatttttgatcctttgttgccgtttcaacaatgttcacagcatcttcaccagaagtagattctatctcaagaaactactttctttgttcatccataaaaagcaacttttcatctgttcaagttttattgtgagattgcagcattgcagttaatcttcaggctccatcaatcacaaatgtttttaatgccattagaatggtgaatcctttccataaggttttccattgactttgcccagatctaccagaggaatcactatctatggcagctacagccttacgaaatgtgcttcttaggtaataagacttgaaagttgaaattaccccttaatccatgggctacagaatagatggatgttgtgttagcaggcatgaaaaaaacattaatctccttgtacacctccatcagagctcttgattgactaggtccattgtcaatgagcagtaacatttttttcaggaatttttttttttttttccctgagcaggaggtctcaatactgggcttaaaatatccactaaaccatgctgtaaacaaatgtgctgtcattcaggctttgttgttccatttgtagagcacgggtagagtaaatttagcataattcttcagggccctaggaatttgggggtgggaaatgagcaatggcttcaacttaaagtcaacagttgcctcagcccctaacaagagagtctgcctgtccttggaagctttgaagccaggcactgatttcttctttctagctatgaaagtcccagatggcttcttcttccaagagacagctatttcatctacaccgaaaatatgttgtttagtgtagccacattcattaattgtcttagctaaatcttcttgctaacttgctgcagcttttgtatcaacacttgcggtttctctttgcacttttatgttatggaaatggcttcttttctttgacctcatgaacgaatctctgctagattcaaacttttcttctgcagcttccttacccctcttagccttcatagaattgaagagatagggcctcgctctggattagcctttggtttaagatgtttggctgatttggtcttccatccagtccactaaaactttctccatatcagcaataaagctgttttactttttatctatcatttgtgtgttccctggagtagcacttttaattcccttcaagtacatttcctttgcattcacaacttggctaactatttggttcaagaggcctggcttttggcttatctcagcttttgatgtgcatttcttagtaagtctaatcatttctagcttttgatttaaattgagagatgtgtgactcttcctttctcttgaacacttagcaggccattgtagggctattaattggtctaatgtcaatattgttgtgtcttagggaacagggacatgtgaggagagggagaaagatgggagaatgagttgtctatggagtaatcagaacacacacaacatttatccatgaagttcaccatcttacatagtcatggtttgtggtgccccaaaacaattacaatagtaacattaaagatcactaattacagatcacaataacagatataataataatgaaaatgtttgaaatattatgagaattacctaaatgtaatacagaaacatgaagtgagcacatgctgttggaaaaacggtgccaatagacttgctccatgcagggttgtcaccagtcttcaatttgtaaaaaaaaaaacgcagtatctatgaacacaataaagtgaatcacaataaaatgaagtatacctgtactgatgcttgattttatgtctggttagataatatcaggttaatgattggtaccaggtatttcatgggcattcactcagtgtctatcagggattatagcaagcaagccacaggctgtttcttgtttgtttgtttgttttgagacagtctcactctgttgccaggctggaggtgcagtggcgcaatcttggctcactgcaacctctgcctcctggcttaagcaattcttctgcctcagcctcctgagtagctggaactacaggtgtgcgccaccatgcccagctaatttttgtatttttagtagagacagggtttcaccatgttggctaggatgggctcattctcttgacctcatgatctgcccacctcagcctccgaaagtgctgggattacaggcatgagccaccatgcccagctcttgtttgtttgttttttgttttgttcttgttgttgttgggataggatctcacctctgttgcacaggctggagtgcagtgtcatgatcacgactgactgcatttttaccctccccaggctcaggcgatcctcccacctcagcctcccatgtagctgggactacaggcacaagccaccacacctggctaatttttgtattttttgtagagacagcgtttcaccatgttgcccacactggtctcaaactcctgggctcaagtaacccactcgcctcagcctcccaaaatgctgggattacagatgtgagccaccacacccgaccctacagggtgtttttaaaaaatatatatataattcttcattatagattgtattttattgtatattatgttatatatttttttctttcatttttatatgtttaattttttttttttgagatgaggcctcactctgtcatccaagttggagtgcagtggcatcatcttggctcattgcaatggctgtctcccatgctcaagcgatcctcccacctcagcctccctcgtagctgggaccccaggggcatcaccatgcctggctaattttttgtatttttggtagcgaccgggtttcgccatgttgcctaggctggtctcgaactcctgagctcaggtgatccatctgcctcagcctcccaaagtgctgggattacaggcatgagtcactgtgccaaacctgtaatttttttttttaagacagtgtctcacttcgttgcttatgctggaatataatgatgcaatcataactcactgtacccttgccttagcctttcaagtagccgggactacaggcatgtgccaccagaactagctaaatttttttatgttttatttttgtacagacgaggtctcgctttgttgcccaggctgatcttgaactcctggcctcaagagatcttccctggccaggcacagtggctcacgcatataatcccagcactttgggaggcagaggcaggagggtagcttgagtctaggagtttgagaccagcctgggcaacatagtgagaccttgtctctacaaataataaaaaataaacaaaattagccagccatggtggtgcatgacagtagtcctaggtacttgggaggttgaggtgggaggatcgcttgagcctaggaggtcaaggctgcagtgagccaagatcatgccaatgtactccagcctgagaaacagagtgagagcctgtctcaaaaaggaaaaaaacaaaagaggggtcttccccgcttggcctcccaaagtgctaggattacagacatgagccaccacacttggcctaaattatataaatttttataagtgagtatagagccctgctgtgattctcctaacaaatgcaagtgatctgcatttgtgatggtcatctgtgctcagtgatctttggtgttactattgtaattgttttggggcaccaccaaccacgctcatataagatggtgaactttagccgggcgcggtggttcacgcctgtaatcccagcactttgagagactgaggcgggcagatcacctgaggttaggaggtcaagaccagcctgatcaacatggagaaacaccgtctctactaaaaatacaaaaattagccaggcatggtggtgagcgcctgtaatcccagctactccagaggctgaggccggagaattgcttgaacctcggaggcggaggttgcaatgagctgagtgcgccattgcactccagcctgggcaacaagagcgaaactccatctcaaaaaaaaaaaaaaaaaaaaaagatggtgaacttcatgtaaaaaatgtgtgttctgagtacttcataggcaactcgttctctcatctttcttcctttcctcatactcttctatttcctaagatacaacaaaattgaaattaggtcagttaataaccctacaatggcctctaagtgttcaagtgcctctaagtgcttcaaagccctgctgtgattcgcctaacaaaacttgtcacattctctataaggcataattgatcagtctttgagcaccactcgcacttcagcctggatgagttaggatattccctctaaaatgatgatcatgtttttctactctccctaccattcaggaagagacacaatggtttgtgagcttccttggattttggaggcagcatacaccacatttgagtatgttgctctgatccattttcaggttaacacaaaagatctcagctttgagagggccgcagagcaaaaaaagtttctctagctgataaaggtggatcagggagctgcatggagatgatggcaagttctagtaagggagtcaaaatggaggtacctgatagtttgggagagaactatgccctttttggcaagtgactattctatttttgataagcaactcttgttttgatactggtttctgatagaaactgagcacctgaccataaggtaccaaggagccatggattttgaggaacgttccatgaaacaagtgttgtatgatctacctagccatacagtctgatgttgccagcagcattccatcaagtgaaagcagtgtatacgtaggaccagaaacaagcaagatacaagtaagtgtcatgtgaagatgtctcatatttacagcattttttctgttgcttcttcctcagcccatacctaagggctttgtgtagaattctctatgatcatggggaggaaaaaaaaatccagcttggttacagagaattaggtttcattggtaccaaatgaaaagcttacagtttcattcagctggaaaagcaggccaggggcttaattttgaatgaagtttaagatatgtattattaatccaagtggagatgtctttagctgaatatatgaatgtgaatttcaaggaagaggacttgatgatagcttaattcagatgtgatcctgaaaagtagtggaaaaaagaaatcccccagttaatcacactttaatgaagacttctcattgtccactttatctaaaaggagaaatgacattagataaataagtacaatgattcctggaaaataacgaaaggtttcactgaatggtcagggtcttgggagtaaatggactgaagagctgctgacaaggagtttttgaaatgtggtataaggctagatctctcagaatgggtccagaatgttagaatatttgagtcccatgagagtgaccacaaaagatgcccactttagaggaccatctcaataatgaagtggataaaatgattgatactatagatgtcactcaacatctttctgcatcccagtgcttgctcagtgagctcataaaatggccattgtagcagatgatggctatgagtcgggtcaacgacatgcatgtcctctcactaaggccactatggcggctgcctctgctgagtgccccattttctagcagcaacaacaagccctaagcccctgacgtgatactgcatgaaaaaaatctcaatgcacatcttatttgacctatcaggagcatttggcacagttcatctctctttcctccttgaaacacattcttcaatggcttctaaggcacccctcctttttttttaagttgaaaaagcagaggaaactccagacgttgcatggtttaggctttggccttacactcttgcaagtctcctgtccaggagaaccactagtgcctcagatctactcggtgcggaccctaaggtcccttccacccccatgagccacctgtcagggtgagctaagaaatcggccgtggggagcagggtcacctatggccaagaggcattgttctgggggttcgctagtaagcaggagagagaaaggggagaagaaaatcgtgcacaggggtcaaatgcctccagccgaagaaggcgaggcgtagagatctcttatcactagggaatgtgtctgagttacacggcaccaaaatatgtttgcagtggtgaatatgagttactggtggtgaatctgtatgggtctgcagcaacctcaattattgcctcctcagaagaaagaattcaactgaggggcataaggcagaaaaagagactgaggcaagtttcagagcaggagttgaggttgattaaaaaagctttagaggccaggcgcagtggctcacgcctgtaatcccagccctttgggaggctgaggtgggcggattacctgaggttaggaggtcaagaccagcctggccaacatggtgaaaccccgtctctaccaaaaataaaaaaaattagccgggcgtggtggcacacgcctgtaatcccagatactcggggggacgaggcaggagaattgcttgagcctgggagacagaggttgcagtgagccgagattgtgccattgcactccagcctgggtgacagaacaaaactctgtctcaaaaaaacaaacaaacaaaaaaacaaaaacagaacaaaaaacaaacaaactttagagcaggaaagaaaggaaagtacacttggaagagagccaagcagacaccttggaggccaagtgccactcctccttgattttccttctttaatcatttcttctcagaatatctttgctagttccttctcatttccctgacctcttatgttggggtgtcccagagctctatttttttttttttttttttgagatggagtcttgctctgttgcccaggctggagtgcaatggtgtgatcttggctccctacaacctccgcctcccaggttcaagcgattcttctgcttcagcctcccaagtagttgggattacaggtgcccaccaccacgcctggctaatttttgcatttttagtagagacggagttccgccatgttggtcaggctggtctcaaactcctgacctcaggtaatccatcctccttggcctcccaaagtgctgggattacaggtgtgagccactgtgctcagccaaagctcaatctttagacttcttttcttctctacgtactttcctttcctaggtgatcccttcaagtcttatgtctttaagtaacataaatttgctaacaagtcacatttaaattttcagcctggttctaaaatctagtcccaagtatccaacggaatacatttccacctgcgtgtacattttacatttaattggtcagaaactgagccccagatctgtcctctaaggctgttcttcctgcagtcttccctttctgaattgattgcaacttcaactttccaattgtttagatcaaaaatcttggagccagtattgactctcctctttgtttctttattttttatttcttatttttttgagacagagtcttactcagtcgcccaggctggagtgcagtggcacaatctcggctcactgtaacctccacttcctgggttcaagtgattctcctgcctcaccctcctgagtagctgggattgcaagcatgcaccaccacttctggggtttcaccatgttggccaggctggtctcaaactcctgacctcaagtgatccgcccacctcggcctcccaaattgctgggattacaggtgtgagccactgtgcctggcctgactctcttctttcaaactacacatctaatccatcagcaaatccttttgacatagctccaaaattaaccccaaatttgatcacttgccactgccactaccaccttggatcgaaacaccatagtctctggattactgcaatagccttttagtggattttcctgctttggctcttgctcaccaatagtctattctccatactcaggtcaagtcactctgtacttaaagctttccagtgactctcatctcattcaaagtaaaagccaaagtcttcactttgtttcagccccattgatctccttagggttcctagcatgtgccaagcttgtccccacagaagggtatttgcacatcctattccctggacttggaacatttcccctcatcccaaccatacctccaaatatcactatattttgttattttatttgcttaaagtctttgtacagatgtcactttctaagtgagggcttacacaaaaaccctatttaaaactgcaaccatcattccctctgtatttcttatttcctttgtctgttttttcttcatgacacttataattgtactatgtgttttattttgtttattgtctgctccctctacctaccaagaaagcagccatttattgtcttttcaatgcggtgcctaaaacacactcaacagatatttttctttctctctatcctccaatttttcttttttttttctttgtttttttttttttgagacagagtctcactctatcacccaggctggagcgcagtggcgcaatctcggcccactgcaatctccgcctcccgggttcaagtgatttgcatgtctcagcgttccacgtagctgggattacaggtgtgcgtcaccatgctgggccaatttttgtattttttagtagagacgggattttgccatgttggccaggctggtcttgaactcttgatctcgggtgatccgtccaccttggccccccaaagtgctgggattacaggcgggagccactgtgcctggcctcttccaacttttttgttttgaaaatgttcaaacctaaagagaccaggtgtggtggctcatgcctgcaattgcagcactttgggaagccaaggtgggaggactgcttgagcccaggagtttgagaccagcctgggcaatatagggaggctctatctctacaaaaaaattttgaaaattagccaggtgtggtggcacacacctataatttcagctactttggaggctgaggtgggaggatcacataagcccaggagttggaggttgcagggagctatgatctcaccactgcactccaccctgggtgacagagcgagaccctgtctcaaaaaacaaacaaaaaacctacagaaaatgtaacaacaaatacaatggatatccatatccccttcacctagattcactcattgttaacattttgtcacatttgctttatttctctttcagttgcactacacacacacacacacacacacactttttttgctgacttcatttgaaagtaagttttagacatggtgacccttcacttccaaataatttagcatgcattagctatgatatataacatacataaccacaatgcaaatatcattcaggataattaacaattatatatatatacatgcacatacatatttacacacacacagcctgtattcaaatttcctcagttgttccaataatgtattttatagctgttttttaaaaattaataaaggactcaatcaggaattacgcatttcacttaaatgccatgtctcttaaggttttgaaatttagaacagtgccccagcttctttgtttttattttataacactgatagttttaagggtacatgctatttgtcaataaatattttataaattaatacataatgatttcctcaaatgttttttcttcctgtccctgcagctctgagctctcattatttggtggtctgagaaagcaagagaagaatacttctaccagggaatacaacagcaattctattgaagttgaaattcaatggtcacttcaggttcttcttaaccaccaatacaactggtaagaaagaggattgtgggattggctgtggtaatatatttcaggtatcaggggaaataggactgctgctataagatagggggaggagtagtgtagctgaactccaggtgattattaggagccccttctgttattggtatattcagaggtaaaaggtaatggaagactacagcaacctatataggcagcatcaccaaaggtacaactttttcaggaatgaaggacagtaacacactagataagaaatagatggctaaaggtagagagaatacaggatcagtagcaaagaaagctccaagacactggcagccaagcctagacctgttgggcaggaagtttgacgaaacttttctagggatcagatccacccaaaaggaaagttatagataaaacttcagggattcctcagcaaatgatccaggcatatcatctgatatggtttggctgtgtccccccagaaatctcatcttgaattcccacatgttgtgggagggacccggtgggaggtaataggatcatgggtgcaagtctttcccctgctgttcttgtgatagtgaataagtctcatgagatctgatggttttaaaaagaggagttcccctacacaagctctctctctttgcctgctggcattccacataaaatgtgacttgctcctcctttccttccaccatgattctgaggcatccccagccatgtggaactgtaagtccaattaaacttctttctttggtaaattgcctagtctcaggtatatctttatcagcagtgtgaaaacagactaatacatcatctcacagtgaaactgagagataacatattgctgtagtctcaatgtttgtgtcctcccaaaaatttatatgttgaaagctaatcaccaatgtgatagtactaagatgtggggcctttaaatggtgattaagtcatgagggcagaggcttcatgattgagattagtggccttgtaaaagagatgctagagagctgtgttgccccttttagcaggtgaggacacagcaaaaaggtaccacctatgaaacagaaagcagccctcaccagacttggaatctgctggcatcttgatcttggactttccagcctccagaactgtaagaaatcaatttctgttgtttgtaagttatccagtctgtggcatagcttatataccagactaagacaaggagaaatggcctcaaaattctgaagcagaattatttccaactttgaattctacaccaagtacgtatgttttttaaaaagaggaaggagacattttcagacatgcaagtatgcaaaaaatttatttcccatacattctctctgaggaagttaccaaaggtgtgcatcatcaaaacaggagccctgtcctaggagagaagtgaaaggattttccaagatgtttatcaagggagaccctaggatgacagctatgtgacaagtcaaggttaaggcacttcataaaccctgggacagaaatatttaggaagatgaaataaataaattgatagaatatgtgaatttaaacaactgtaagagagtttgattgaattagaaattaggaagttaaacacacacaaaaattattagctgtagggaaagcaaaatattttctaggaaaggaaaatgattatagttgactatattgctccattctgaaagcatatatagtcataataatagaaacactatatatttatctaaccaaaattatatcactatattgtgataagaatgataactgctttgtatgtctgtgtttaattgtggtgtggagaggaaagaccatagggaatgcctacaactaaaagaatatgacatagcaagacaaacatgttatctagagtatggaggtacatatgaagagaatcatttagaggtaaatgtagttgtctttggacacagggaaatgatgggtggaagaacaattgagagctgttctttattttaacatatctcataaaatttgttgacttttaaaaataaagacacaaagttaatttataatcacaatatttcagaggcattacttaggacaccgaaatagttattttgtttaccatgccttgtacatggtaaagacacttaattgttttttgaatggaatccttttaaatgtgtcagaagttataagccattaccactctgtaaaattgagatcagggattatttcttatacttctttcttatacttcaggacacaatgtggcattatttgcattgtatttttattaatatgtaggatattgtgtgtataagacttaagaagaaccaaatcaaattgctttttagtctcagttaatgtataaacaatcctgagtggaatatttcactttacaaatgagatctgctttttcccttgctatgagtcaaaacattacctcccaatcaagaaatcaacaatgtagtggtttgaatatatgccctccaaaattcaggtattgtcaatgtggtgcctttaagaagtgattgggccatgagggcttctcccctgtgattggatgctcttgtaaaaaggcttgatggaggcagttgtccctttgcccttctgctttccaccatgtgaggacacagtgttcctcccctccagaggatgcagcaacaaggcaccatcttggaagtagagactggaccctcaccagacaacaaatctgccattgccttgatcttagatttcccagcctccagaactgtgagaaataaatttctattgttcataaattacctagtctggccgggcgctgtggctcacgcctgtaatcccagtactttgagaggccggggcaggtgggtcttctgaggtcaggagtttgagaccagcatggccaacatggtgaaaccccgtctctactaaaaatacaaaaattagccgggcatgaaggcttgcacctgtaatcccagctacttgggaggctaaggcaggagaatcacttgaacccgggaagtagaggttgcagtgagccgagatcaccccactgcactccagcctgggagacagagcaagactctgtcttgaaaaaataaataaataaataaataaataacctagtctgtggtatctgtaatagtagcataaatggatgaagataaatcaacagtttttttggagtacttatcttggacaagacagataacatagttttaaaaatcaattatagtacataatagttgtttttgtttttttcgagacagggtctcactctgtcatccaggctggagtggtgacacaatctcggatcactgcaacctctgcttaccaggttcaagcaatcctccagcctcagcccaccaagtagctgagattacaggagtacgccaccatgcctggctaatttttgtattttttgtggagacagggtttcaccatgttgcccaggctgatctcgaactcctaagctcaagcgatccacccgccttggccttccaaagtactgggattataggcatgaaccactgcacccagcagtacatatagttctttaataactggattactctatctattaactatattacattctctaggaaaagaatctgagagattgccaaggtcacccggagaatcaggcataccacctcttcagattatttaccctaaactaaacttttgtgaaaaatacacactgagtaggtgtgagaaaaaagtcagaaaggtttatcccacttgagattaacgagcagtgtagtttgtcttcaactaaagtgttgatggataaaagacaaaaactggtgtgtaaattcagctttcgctttgttgaaaggggattaaaaatagaaaggaattctatttaggtttagacagtgaaagttgagaaacagaacttttttaaaggagtaggcttgagatattttttcctactgaagagtccaaattgtggagctggcagaataagcatcttgtctgcctgcttgtatttttggtgtctcgattaattgcatagctgtcctgcatcagtagttttaaatctataaattcacagctctcaggagttaatatgagattatccagacactatttaaagggccagagatcaaagaaacaaagaagcctctttataggggctatttgagtactttactagtccttaggcacttggtaatttcacaaagtagatacgatgtatttgtcaaggaaatctctttcaacacattcttctcctcttcatttgttccctcttataaatagagtcatattctatgcctctaagagggtgtaattattttacatagaacaattctactttctatttgctgtgttaattgttgtctcctgtatggaagcttatttttgatatcttaggtttaaaaaaatctcagtagagagtagaatagtgattaccagagactggggagggaaggaagggaggttggttaatgggtacaaaaatatagctagatggaagaaataagtcttagtatctgatagtactgtagggaaattatagttaataataattcactgcatatgtcaaaataactagaagagaagaattttaatgttcccaacacaaagacaaatgttggaagtgatggatatcccaattactctgattttatcattactcattatatacatgtatcaaaatatcacaagaactcctaaaatatgtacaactatgacatatcaattaaacaaaccccaaaagctcagaagagcatccctaagacttaagggatgataagcataactcagaaaactttggaaagaatggagtcttggaaacagtaagtataggaaaacttcattaataattaccatttaaaaatctgccatgcagaagataaccacacacttaaaatgacttacctgttagcttctataattttaaattgatttttctgagacatatttcctacatataaccaaaggacgcatttggcatttttagcattaaatgctggaaggtgtaataatttaataataatgctttgtatttattgttttgtacctttaagatgctttcacatatgcaatttgagacagatagtgcaggtattatgatcatttatagattgagaaaacagatatgagaatttaagtgacatggccaaggcctcaaaaccacattgtgaaaggcaggacaggaattcttgttccagtgttttgttctttactatctatcagtaaaaattatatctttgattaaatataggcattcccattttgtatttcagtatatgaagataaaacacaaatcttaagaggtttgttcaaggttactctgtaagagaatgaacagctatgaaaaatatacacaaactctgacttgttattctttgctgaaaatacttgaccacaatgaatgtgagactgaaggctgaagagttgcacagaacacattgtccattactgctcttcttaaagtttgtcttagataaaaggttcccattaaaatcaatttcttcttggcaaacactctagcctacgtgtaactactcttctcctaatgacatattaaaaacaaaaagagagaaacttttttcctcgataaataatagaaatggagcaattctttatgatgaacaaaggtcaggataattaaacttttacaaacaaagtacagcattatttccatcatacaattacatagtatataatgggcataaactattatgtggtcaaataattacaataatattataagtaacatcctattaatctgactttaagaatttattttgatggtcttcagacatatattacataaaaaaagatttttgaaatcaaagaaaccattatatatccaacgaatggttgcctcactgtatctaagtaatattagataattaaaagtaatttggatattagtacaaattagtagaaattggtcattatttgggccacttcaacagcttccctatatttaggatatgtctcaccatgtaaatcttcgtgacaagcaaaggctgtttcccataatggaagcagaagatgtcacatactttctctggggtgcaggcatgtgacctaggcttttcagccagacatctgtgttagacctttgactcacagctaaggagacaagcaacagtttttttcctctctctcccttctcccttcctccttctgtgtttctctctcctagtggcaatagaggttactgcaagcgtgagttcccattgtataagtggccaaagggcaaattgtgttgtctagtgcttgatgtctctagtgctagctgtaagattaccacattgtcagtcatactttgcccagcatttttcagattttggcatggaaggatctgaatccttggaaactacagtcaccaaaaaaaccaggacagttggtaacatttgccaacttcttcatcatgtccgttctgtgggtggtttatcgttgctgtttaagttcaagcctggttttacagccctctcaacaattctatgagctacctgatatctttttaaatttttgttttttgagataaagtcttgctctatcgtccaggctggagtgcagaggcatgatcacggctcactgcagccttgacctctgggataatgcgattctctacatcagcctcttgagtagctgggactacaggagtgcaccaccatgcctggctaatttttatttatttttttgtagagaaggagtcttgctacattgtgcaggctggtcttggactcctggcctcaatggatccttgtgccttgaccttccaaagtactgggattataggcatgagtcactgcatctggcaaaaaaaaaaaaaaaaaaaaaaattaatggaagtataactcagtatctgctatggtctgaaagtctgtatcctcccaaattcttacgttgaaacctaatcaccaatgtgatggtgttaggaggtggggcctttaggaggtgatcaggtcataagaacagagccactatgaatgaaattagtgcccttataaaagaggccccaagaaagctgagtctctttgtaaagaatgcctcttacaccatgtgaggatacaagaaggtgccatccacgactgaagtaaggggccttccttagacaccaaatatgctagtcccttgattttggacttctcagcctccagaactgtgagaaataaatttttgtgtttgtaaggtactcagtcaatggtattttgtaatagaaacccaaataactaagacaatacccttttaatcaactactgctctgcttaaatcaaagagaattggtctcaattattcttaccaagaactttgactgaaacagacacctttgtgtataagcagtttggtaaccttctatatttcacaatgaccctatgagtcatattggcttaattcagcttgtatagttattacagaccctctttgatgttagtgaactttttagcatgtcgaaagttctgaaaaagcatcagtaatgagtgttcttattgtatttttgaaatcctgagatatttctgatggttgagactaccatgaaccattttttccctggtgatgagacaaacattgacagaatgtaaaatcacttaaaaataaagttgctgacagaaaatcttagattttctccatcccattccataacctccaaatttatgaatgcttaattatcaagatgaagaatttttaaggtcaagggaatagaagaaagtggtaacctaaaaacccatttaactattcatctttggaccatatataaaagttctttgttgtttttgctgacaggcatctctcctgaacacacccatctctcaccagcttcaccttcctaacatcctcatattcctgcactttgattttccatcctttggaggggaaaccttcaataaaaatactcctgctcattaaaatggttattacaatgctattgcataagcaatacatctttattaaataaaataaaaatactggaagagaaatagaaacaagcatccataattctgccactactaacatttcgatattcttttctgtaaacactcatatctttaattatacaattttttaaaatgtgggggatcaaatgatgcatactatttcagaacctgctttattggtagaattgtggatttctttctggatagatataatttcaaatgattgcacacttttacaatgtatagaagtatcataacatgtcatcatttagttttttttttcttttttttttgagatggaatcttgctctgtcacccaggctggagtgcaatggcgggatctccgctaaccacaacctccgcctcctgggttcaagcaatcctcctgcctcagcctcctgagtagctgggattacaggcacgtgccaccatgcccagctaattttttgtatttttagtagagatggggtttcaccatgttggccaggctggtctcgaacttctgacctcatgatctgcccgcctcgacctcccaaagtgctgggattacaggcgtgagctaccacacctagcacatcattgagttttttaggctggagtgtagtggtgtaatcatatctcactgcagcctcaatctcctgggctaagcgatcctccagcctcagcctcctgagtagctgggactacaggcacaccaccaggcccagctaatgtttgtgatttttagtaaaaaggaagtcttgttatgttgcccaggatggtcttgaactcctgaactcaaacaatcctcctgccttggcttcccaaagtgctgggattacatgcgtgagccaccactcccaggctatca

SEQ ID NO: 581 - DNA, 20001 bp, Homo sapiens
acgcgcgcgccgccaggccccgggcgtctcctccagtccgccgcggccccttggggagatgggcccggcgcgagggctcgcacctggaagcccacgaagtgggcggtgcccaatgaggtagggaccggagagcgcggagcagtccagaagccgaccccaccccctgcacctcggggaagagggaacccgggtcagcccgtagcaagaatcattcctgactatcccaggagaccacggcagaccaaaaacacctctctgaacagccttccgcaccgctcgctgcaagcattcgtccacacacggtacacagattgcgggcggatcgtaattcactcttgaaatcacaccctttttagggatattcgttttcaatgactttgggaaagccacgaggtactacatttactacgaagagaccgtttctttattttgaagtcagtgactcctgagactgcattggggacaacttttttgcacaatgaccatattttaccatgcagcgcacttcagaaaattataaaagtttacaagttttatcgcttctggaaacacctgggcagcatccctattatcccgccacgtggctctagccttgttgatgtacctgttactttctcccactgcaacatttttgttaatgtctgtggcttctttctgcagaagagttcctcctcctgacatgcacttcattctctgcttttctatgtcttgacaactctcttatggtagtcattttcttatactgtagccccctggtatttatgtactgtgtggtattaatatttatacttccaggttcacatcttttatgaactgtgcatctgttgggattgtggacaggagtaggaaaccaaataaaagggttttttaaaaaagtcagttttctccgtttgtaagggaaacttgtctccctgaccaccctggagcaaaatttgccattttaagataacacagtccgtctgagagaaagtcctgcaccatgcctttccccttttcccatatttcccagcatgctatgagctgatgaataaacagactttgtcctattttcgttgtatctataaaatatacataatgtattcccataattatcagacctctcacagtcactattggtaaaattattgggttacaggtttcttgctgtaaaacacaaaaataggtcatatttttattccatagtaccccaacttgctttttatttttaagaaaatagtcccttatgacaccagcactaaaaagagtgtctgaaactttaaatacttaacttttgagagtcagagtatccggaattactgaattactagatatctcttatcagtgagatgttcatttgttcccaaatttaacatcaatatatttacaagaactgaatgtgtcttatgagccatactacctcaaaatatttctcccagtctggtcagattgcattaaatcttaggtggattaaaccctaaaattcagtatgtgagaatggattatatactctcggcttcatgtatttgaagaattataagtttttatttctgttcaatttttgcttgtggactatagtagtttcataagtttccataataaaagcatgtttgattttgttattgaattactattgattagggatattatttatttaaataacgttgttctttctcttagactatgccggtatgaatttggtagaatctgccgattgtggtatgtcggtactccatacagagtgtgtggcagatttcttctctattttgttatcacatccagtaatatggagtgcagccagcatgttcatccctgggaatgtccctcctaaattttgcaaagaaagccttcattctttattacaccaaatattcttaagattaacatttctcagtattagttatttattcattttaagaaaaatgttcattcttctttactaccaatgactaagtttgatactgagctatttcttggtacttcccccatttcttgggagtaactaaaactggaaggatatttagaatttcagagcatctaatgtcttagtccattcaggctgctataacaaaataccatcaactaggtagcttataaagaacagaaatttatttctaacagttctggaggctgggaagtccaagatcatggcaccagcagatttggtgtctaaagagggttccgtttcctggtttgtaggtggtgacttcttgctgtgtcttcacattttagaaagagtgagggaactctcttggacctctttttctttttctttgtttttttttttttttttttttttttttttttttttttttttagagacagtgtctcattctgtcacccagactggagtgcagtggcatgatcatagctcactgtagcctggaactcctaggctcaggcaaccctcctgcctcagcctcctgagtagctgagactaccagcatgagttaatgttcccagccatcttgagcctcttttataagggcactaatcccattcttgagggctcaaaccctcatgacttaatcacctcccaaaggccccatctactaacacactttggaagttaggatttcaatctatgaatttggggaaacacaaaaattcagaccagggcatcacataacaaaaattaagttactgctcttctgtcttaatagaaagggtgtgtcatcctaggagagggcatggaacaaagcagacacagaatacctgtttgtggaagaaatacatgttctaatgttctaatgacggctctaataaatctgtgtactatgtacagtttatatagtattttcctcttgggatgtaacgtgatttattggaaagaacataaaagtgctttggagacttgcagaccagagttcaaatcctctctctgcagagtttgtctcatctcaggcaagttacttaatttttctaagccttatatttccttatttgtgaaatggcagttacaactacttcaacaacttatgtgaattaaattttatgaaatattagtatctaaaacacagtgagtggtcagcaagctaagattcctttaccataaatgtgaatatatttatgttaaactaacaatagctgctacaaacaaatacaaaaatctatattggcactctctgccacagttggttctgaaataaccacgttaagtctacagctgtaattagtgaatatattctagatgattaatagaacaatttctaaaggagtatagcttaaatttctgttggttaagcctcccaatctgtgatatttttcttacagcatcccaaactgactaaggcacacagttcattacaatagttatcagtactaattgtctttttctccctttccctgatgtctgtctgtctgtctgtctgtttttctgtttttttttttttttttagacagagtctggctctgtcaccaggctggagtgcagtggcatgatctcggctcactgcaactccacctctcgggttcaagtgattctcctgcttcagcctcccgagtagctgggattacaggcgcctgccaccacgcccagctaatttttgtatttttagtagagatggggtttccccatgttggccaggatggtctcgatctcctgacctcgtgatccgcccacctcagcctcccaaagtcctgatgtctttcttaaggcacaggccaggtgcctgtacaagaacatatgagcatagccaagggccagatatatcactaatctggtgctgtgtgaatctgggttacttaaagccctgtggaaacctccctcttattttgttctcaggttttatttttttgctatgttattagagtatgaatgaattttttttgttcatattctcattgtcagacggctaaatctgttagcaacttaagcaatctctggacattacatttaatatttcaggacacttgggtcacaaaaagttactgaccactaataaataactgcttgtggagcatcgagctagaattcatgttctaattccaaagcaacaagcatacacaattattattcctggctgtgcaggagaatcgtggtatgtgataaattaatacatattataatcctacagcctcattttagtatgtaatgttaacttcctgaggtggtgtgcatttctagttgtttctgaatcagctctgtggggattggactttcccatgcaacagctagcagtgaaataacaacagtaaatttccaaccttcacctggataattacctcaacttcttcctcggttatctcatgtaaatactgtcctgttccagaaagtttccccatccattttaaaacacagtttcttctgccaatcaaaacactttcacaattaactgaaaagtttcaaatctacatctcactattttaaccctctatgaagtccttcaattgttgattctgtgctattttgttaaataatactggctttttatagtaggagaaaatcagtctcagaatttttctgttgactagacagaactatgaccattttaaattgcaaacactatctcgattcagtaattggatttgaatcaaagctctgaatttgatttagaattcaaactttgtagtggggaaagcaggcaggctcagcttctctatttctctatcttattttcctcttccactccacaagtcagtctctgggtgaaggacaaaacagttcttacccagctggtaccgctgtcagccagctttgcactctctcagcctagcacacagaaccagctacatgatttgcaaggcccagtgcataatgaaaatgctgggccccttgctggagaagagttaagaatttaaaactttttgagagcagagcgttaagccaagtacacaagcctgtattccgtacaggtagcatgcccatgaggctgccggcatgtgcttcatgctagctgtccaggggcttttcggagagttgcttctgggctaccctaactgcaatctctgcgatgtgggtaatgcacccttaccttcagctggcgctcctgatggcccctcagctttagtttcttcagtcctattggagtcttctcacccctctgggagaaagtctcataggcgcaactccagatggctccaggcaagttctctccctcccataggactctgggctacagaaaacattgaaacattctttgcccagcaggccattctcttccaagcagttgggcagcctgtttcccagttttctgaatgggagtcagatcccagtccacaaaatgcccctgccctgcatccaacccccattgcaggaaacacattccaagctctccacacaatcaatggaaacccgtggaagtccccggcatgagccgaagaaacatcctccattttctctgcacaggaggtgatgagtgcaagtctcccttccacaaacctatcttgaattttctccactattgtatatgttttaagtggatgagagtatttgagtcatagatttggttttgaattctttccttcataatagtgaccaagcttgaaatttcatacttttgtatcttgagatctcagttgaaacttcaatttaaaattcctattaaaaagcatattctcttgcctcattcaaaatgcagtggctcatgcctgtaatcccagcattttgggaggccaaggcaggagaatcacttgagctcaggagttcaagactagcctgggcaacatagcaaaaccttatctctactaaagttattttttttaattatccaggcatggtggttcacgcctgtagtcccagctattggtggttgaaggggttaaggtgagaggataacttgagcccgggtggttgaggctgcagtgagctatgattgcaccactgcactgcagcctgggtgacagagcacgtctctatctcaaaaaaagacaaaaaaatcttctctatgctgtaactattttctctgttgcttatttagatgtgtgctcacatgtattaaaaaattatcagctattactgaataagatatttaacaggtgttcaaggcacaaaattaattaaaatagtgtcttctctacatatttgtatttctgtttgataaatatgttccaacaaattgcctttttcatacattattacctacgttactattaaatatttttagagactcttgcccttagctaatttctcaaattttttattaagcaatttaaagttgaaccctttgaaattttatctcagaagatgctatgatatagatgccacaaaatcaagtataaaaaaggataaatgtacaatttgtatgagagtcggtcacttgcacaaaggtcatgctgagctatgaaaacctctagatgcaggcatgaatcataaatgatggatttttgcatactttttttttgagatggagtcttgctctgttgcctaggctggagtggagtggcacattcttggctcactgcaccctccgcctcccaggttcaagtgattctcctgcctcagcctcccgagtagctgggactacaggtgtgtgccaccatgcctggctaattttttttgtacttttagtagagggaggttttgccatgttggccaggctggtctcgaactcctgacctcaggtgatccgcccgccttggcctcccaaagtgctgggattacaggcatgagccatcacacctggccagatttttaaaaataatgtaagactgccttgatttccctttaatgtctatgattaccaaagagagggtttgccttcctttgttctttatcaaggtattaaaaattgagaaaatattggactttggggcgtagtttaaactccttaactttttcttgcttcattcaaagtgctattgggatctttgagtatacaatgttcagagaataacaatttgataaatacgcatgtcatgtttgcctaccttgtctctttctacccctcatcttctgaaaagttacttccttatagctgtcttcttcttccaaatatctgagaaagtctttgagttatgtgacatctagaaatcgtatttatgagcagaagcttcttcaaataatccataagggaaaacttatgaagagtgaggaaaaagactccaattttcattactcttcatgcactctctccttaatggtggttatgataaccctgtttttcttaaatctccactcagggtatcataaaacttatttgcatatttacctagtcccattgtcttccctgataaaatgctttaagccttagatcatacagtttgtattttggcattcacttcaacttaattccataaacatttcttgactctctctatagataaaggtctagagatcgatttaagttcaacacagagtctccttccaagaagctccagctaccagggagaccaacatgaataagtgactataaaacaaataagtgctatgagagaaatatgtataaaagggtatgagaacacaccattgggagcaattaatagtgaaatgagagggagtaagtcaggtcaacctaaagacaggttattgatattttagctgagcattaaaatgaggtccaaagttgatcaggcagagggaggaggacattcctgcagtgaaaagagcaccccaaaaaacacaagagaataacactggggactccaagaaaataaaataggtgggggaaggtctcagtgacataagtgatacgataattcaagtccagtttgagctgtctatatgaatgcaggagcagtggagagggagaaggaagactcttaaataacttatgatatagaatcaacaggaatgagtgatcagttggcgggcagaggggtagtaaatagaagaaggagtgaaggatgatgcccagaattctcccctccctggcactgggaggaggaatggactgtgtgtgtatggacaaacatgcacacactatggttattgttgctaattttggagaataaggttggcaagaggccgggttatgaagagaaaagaagatgagtcgttttggacatgttaaaatgcaaatgcacctgtgagacttccaggtagatagagcaatccacactatagctaacacggttgagttcttactttgtgcaaagtgctccactgagcgctctactgatttaatatcagaagcacttttgaatatggaaatggagggatctgactaaaagacttggtctggatgtaggcttgcatcagagcgtggggtaagtggctccgaatagcaatgtgatataagaaccaaaccttaggaagcactaacactggagggcaaaaggagatggaggaaaaaaagtcaaataggtgggaagagaaaacgagttatgaaagccaaggtgggacagaatgtcaagaaaaggcagcgtttggcagtgggaatgttgcacagaggtgaaataaaagatcaagtctgataattgcctacagaattttacaattgggaagtcattgcttaccttggttgaagtaatttcatggtgtaatgggattgaaagcttcgttgaactgcctttaaattgaggaagagggaaacaaggagagatgaggggagaaactgatatttattgaaacctgctgggagccaagttctgtgccggcactttgcttacatctagctgcacgttacagtagtccgggatattaactgttgttccctagtttctgactccccatggtccttactggctgtcgagtgaactagaagatccttgcctcaggaagcagatgacagagcagagaaatgacgaaaggacctttcctggctttgtagtttcagaagcctagccctcagtgggaaatagaaatgactctggggcttaaaacagtagatgagggagaagatgtgatgctgtaagaacaaggtttcatgcacatcaccaccaccaccaccactagaaagaatgtcagtctagcaggaggaagagaggttggttctattacctgccccatggggacagcacaagaaagaggatgagtgaacaacctgacaggcttcaggattcccaaagaagagggaagttgtgcttcctttccttaagggagcctagatggaaggaaggaccagatgtagatatgtcctgatggtgaatgaaggcaggcccctcggggcatcctggggcccagtgtaacctgggcagcaacacagtaatcccagtgtgatcaggatttctgagtttgcacaggatttaggacgatttctgcgattccatgccctacaatggtgcaggatcagcatcatggttccagcacaccagcaaatggaaatgaggggagagaggaacagatcagaagtaactttgaggacaaacaatcaaggggcaatcaagatgaccaatatctcagaggacaacagtatgaacagacaaccaagacaagtagcccttctctgtccagacaaattgctcccatgcaagtcactctccccactgccttccctccagagcatcatcacaatcccaggcagataggaactttccaaccacgcagcaaaatggaggcccaaaatagaaatggagttgagttctagaaataatgttacatttcctacacacctgaatttgggaaatgaatgatagccagaaagggatccaaggtgatgaaacttctttttttaaaaaaaattaagaatgaagagccgggcatggtgttgcagctactcgggaggctgaggtgagaggatcctttgagaccataagtttgaggccagcctgggcaatacagtgagaccccatctctttaaaaattttttaaacaatttttaaaaaagaatgagagaaactagataatataaatgggggaaaagaaagaactagttgagagggagagcttgaaaatgaaggaaaaataggtcacatactaaggaatgattctgaaggatatgggaggaaaatcaacagaaagggatacaccttgaagggagggtgtacacctctggaacacgagtgaatgtgaaaaggatgtgcgtagatagagttctgtagagggctgggagaaatgtgacaggtttcatgcttcatggcatggaggaggaagggccacgtggtaatgcttgttggatgcctgttggaaataatgtaggatgaagacagaaccataacacagtttacttccttgagcgttaggtggtatatgtattgcattcgacttccttcattgaagttgtggatgctgcagtcactgccgggatccgcagccccctcctttcaggatggaagcagccacttcaccagctgctggaactgttggccactgacacttaagccccttttctaggaattgccatctactgagagagccactctaccgcaaattacacccccttctcagtgaccatacggtctgaaggtggaaagtccagcccccttgcctcagttcaggaggagtccgctggcctataaagatgggcacactgggcgtgtctctcccatccccacagcccctaccaggagatcagctggggtctttgttgtgactgcacagcactttccccctgcccaatcctgcctccttcaccccggacagtcattgattgtgagagcacaccccacaaacttcctgcagtgctgtctccatcccagagtctgtctcactgggaatccaacttgagaaaacacatcaaccttatgacagcacaggtccctcggaatcaccgtcagtactgtaggaaggaactccagcatgccttgggaaaatccaagtttaaagaacgaatagctgtgtggtgggacaacctcctttctttctgccctcttgtttccatgtggatgaaagttacattcctagcctgtgtcatccctgactcccgcctcaccagagacttatctgatggaggagtccgggggaaagtactgggcacttagcccattctggggtcccctgtttggaagacgggttggcccaaatgctccctcataccaaaagaggcctgtcctgtgggtgtggcatgtactgttctggttctaggggaaagtgtttgcaagcccatttgtctgtgggcctaatacacatcctccaatccagcttttactaatgtcaagctgctattttctttgccagtgtccattcttttttgtattgtatttctcaattgggatccagatttacaagggggagaaagggttagctatttaattctccgaaacctttactatatagtacttttggaagggagggaaaactgtttagtgtttgggtgtctctttaggataagaaatagcaagtcaagagtgacaaggaatgcaaaaagaaacatcacacggacagaagataaagaaaaatacagtcgttccaacatttagaaaatatctctgaactctagtcctgtatgcaggtaattcctgcctgagaaggagtggatcacaaatctacccagacccccagccattggatttaaatcattgttcctttattctccaaatgtttggctttgttcgaaagattcataaaaaaaaccaagcgtattggctctgttacacagaaaaactgcatcagctttttgctaaaatcagttttatcatgaagttaattacattttattaccaaaagataagtatgctaaatgaatccatatatcacaacatctcttataggtttgtagaagtgatggtagggatggcactatttttattatgtctatttttaaattaccttaatttgacctcattttaccccaaattactccttgagatgattttgcaggctgagctgagtcccaagttaaggatggcactgaaatttttctgtagcaagaagttaggtatgatttggtttgttttgagaataaacaagattaagaaaaatttacattttagaccagtcgagtactttaggtgtcatcttttacagatttcacatttaatataattctactcctgacattaaattttattactctacaaactagccagaagtaataaggttctaagagctataaaacacgtatttggcttttctcagctgtttgaggcaatggtagaatttctgaggtacccttaagtgttaatgaaatgaattcgtaaatcatttgttgcttgtcagtcatattgcttatcaataatgctattatcaatttcctctaaagcatgtagatttcatacaaaaatggaagctacgtaactacaatttttcaccttttataataacattgtggggtgcaggaagtggaggcacagaggggccttcaacttctccaacctactgtaacattctctggcatgtctgggatgagggatgtatgagataacaggagggctctgctctcagaggtgatgatgggtttgtgctgagctatcgacactcatacctgggcctcttgtgatcaatgacactcaatttggagacggctgactggggttaatggtgcaatctgtggctttggaacagagttcttctctatgtgaaactaattggcccatatggggattaaactggtaacagtgtcctcatttgtcaacccatctattcagcttttgaatctagtcgtgtttgaggaccgccccaaattcaatcaatgtgttttcaaattgtaacatcatgactttagaaagaggaagaggtaaatttttaaatatatcaacccaaatcactgtaagaaaaacttacaatggtctccattgtaagttaaataacaattattcgattgccaattattcttaaatgattatccctgtgccatgggaaacaacaggaagcaagtctgtttcccattagataccttattccagaattacttttaaaattttcaaaacatgccttcagactcccacccctgactgcccaatgactgtttcaagggttgccacctgcagctacccccaactcttttccaaaacatcagattttaagatggaactcggttttccctcacttgatcttcctttgtttctacattcaccagaagcctttcttaaatcctgatgccggagcgctttttaaatccatttaccaattacatgattcatgtcctgactttgaaataaaaaaaacacaccactatttgccacatccttcaattcagacttaaaggacatatctcgacaatacaacatactcaaattcaaaaattctttttagatccatttacattttctccccatttatttcataattaacctgatgcttttctccaattcacccgatacttaatatctaactaatgcatgtaaaaacaagccccaaattgtgagttaagtgtgctgtggtagagactacaacatggtggaaatgaaataggaaccctagaaaggctggataatgatgcaccaggtgacaacatttatatccaatagaaaagcatcttcattacctaactctccagttagaagctatttttccttccaaaaagactttcaaaagaagtaatctttgagcagtcacagaaacacggagcatttctcacaaataataataaagaaccaaacatgaggaagtggcagagaagcatagaccaataaaaaagtgtgagatactagaagagcatcagcagaactttgacaaaaagagaagagttacacagactggactccaaacagagattatatttcagccctattggctaagagttttctttttttttaattttcaattttttttagagacagcgtctggctctgttgcccaggctggagtgccgtggcatgatcatagttcactgcagcctcaaactcctgagctcaggtgatcctcccacctcagcctcctgagtagcttggactacaggtgtgcaccaccaccctcagctaattatgtttaagaggacgcccagacatctagtgagcattctttctggatgtgtctgtaaaggggtttctggaagagattagcatgtcaatcagtagactgagtaaagcacataccctccccgggtgtggctgatcatagtccctaccatagagggcctgaataaaacaagaagtggaggaagggaggaatctctcactctgcctgatgagctggaactgcccttggtgctccaggttcccaggccttcagactaggactagaatctacaggggtgtccaatcttctgacttccctgggccacactggaagaagaattgtcttgggtcacacagacataaaatacgctaacactaatcatagctgatgagctagaaaaaaaaaagaaaagaaaaaaatctcataatgctttaagaaagtttacgaatttgtgttcagatgccttcaaagccatcctgggccgcattccaccctcaggccgcgggttggacaaggttgatctacaccattggctctctgttctcaggtcttcaaactgtaccgctggcattcctccgtcttcagcttgcagaaggcaaatcatggggtatctcagcctccataatcatgtgttagtaacttagaaaagaatgcttttgttagagtgtgcaacatattgtgtttgaatgagagagaactaatgagtgaaataatgtacccacatgactttctttttagttctgtattattttttaaaaattatgggatgtaatatttatgtagaaagtatataaaatgtgtatgtagattggcaatcatctttttgttgttgttgttttttgtttgtttttgtttttgagatggagtctcgctctttcgccaggctggagtgcagtggcgcgatctcggctcactgcaagctccgcccccccaggttcaagtgattcccctggattcccctgcctcggcctcccaagtaactgggactacaagtgcgcaccagcaagcccggctagtttttttgttttgttttgttttgttttttctgagacagagtcttgctctgtctcccaggctggagtgcagtggtgtgatctcagctcactgcaagctccgcctcccgggttcacgccattctcctgcctcagcctcccgagtagctggaactacaggcgcccgccaccatgcccggctaattttttgtattttggtagagacggggtttcaccgtgttagccttgatggtctcgatttcctgaccgcttgatctgcccgcctgggcctcccaacgtgctgggattacaggcatgaaccaccgcgcccggccagttttttttttttttttttttttttttttttttttttagtagagacagggtttcaccatgttggccaggatggtctcgatctcctgacctcgtgatctgcccaatccaatcattttaaagcaaacgcctatgtaactattaataccacccaggtccagaaagcagcgtaagcagaactccaggatgcactgtgctcttccccaatcatagcccctctcccctcaagagtaaccactacccactcccccatctttgggataatcatttctttggttctcatcatggtgtttcctctgatgtatcagttaatatgtaagtttattttttatttcctccttgttctcaataatatgtatttaagtttcatctatgttgtgagtggctgtattttttcattttactgctatgtgatattttgttgaatgaatatatcgtgattattttaggaatttatttcatttaaactcaaatttattgacaaagattttataatacttccttattttctttttaatgtctaagaatctgtaatatcctctttttcattcctgatattggttattaatgcactctctttctccttctctttctcctggttgattctcaccagaggtttgtcaattttaccagtgttttaaaaaatgcaaatgtggggttagttgactatctttattttatacttgttttgtaattcattaattgctgctgtctttattattgtcttctactttcttttattttgctgttctttttctaacttcttgagatagatgaatagcttattcactttcagcctttcttctcaaacaatcctccagccttggcctcccaaagtgctgggattacaagtgtaagctaccgtgcctgccttctttttcaatatatggatgtacatctatacatttttctctaataacgtatttagtgatgtcttatatgtttgagatgtcatattttaattaccttttagttcaaaaaaatttttgtgttatgatttctccttagaattttatttctcaattctccaaaatatgagaatatactttgcacaatttcaatcctaaaatttattgaggcttgctttgtgtcccagtcccagctttttgtaaatttttgtaaatattctacgtgtgtgcttgaaaagaatatgtattctgcagctgttgggtgttgtgttctatatatgttcattataaaatttttaaaaaattataagcatattgttaaaattttttatatctttactgatcttttttggtctccataatctatcaattactgagagaggaatgttaaaatctctctactctgatgtgaatttgtctatttttcttgacattttgtcagttttttatttatgtattttaaggcaatgttattagaaacatacaaatttagaattcttatggcttcctgatgaattgaaccttttattattatgaagcgaccctctttaataatgcttttgaccatagtatctatttcatctcatgttgaaaactatacacacacatatacacacacgcgcacacacacacacacacagtcatgtgccacataataacattttggtcaataatggaccacagatatgacagtcatcccataagagtataatactgtatttttactataccttttctatgtttagatacacaaacacttaccattatgttatacctaccagtaagcctatggtattcagcacagtaacatgctgtacaggtttgcagcatagcagcaataggtgtgtagtaggcctaggtatatagtaggccataccatctaggtttgtgtaagtacattctgtgatgtttgcacaatgacaaaattgcctaatgaaagatttctcaaaatacatccctgtcattaaacaatgcatgagtgtatgtgttcctgtgtgtttgtgtgtgcacacgtgtgtgtgtgtgcataaaaagagacaacagacagagcacaacagagctatacacacatatggttataagtatatatatatatacacacatatatacatatatgtatatacatgtaatacacatatatacatataggtatatacatgtaatacacatatatacatataggtatatacatgtaatacacatatatacatataggtatatacatgtaatatacatatatatctgagtgtgtgtgtatgtatgtgtgactatgtcagcttttatttggttagtatttacatagagcacccttttttgtccttttattttaaacctttttatatacttatgctttgtatggatttttaaagtgaagtctgaaatttttgtcttttaaccagaggatttagttcatttacatttaatataacaattgacaaaactgtgtttttaaaaaatcactatcctatttgagattttctgttaattctgcctccttttcctctccttttaaaagagttggtcctaattttcaccttcactttctgtagcttaacaagcagctcatttggaagaaactagctcaataaaagcacataaagtttctggaaaatactattagctgagttccagaaccccctaacctaagatcattttcttgaccaggaaatcttgactgttagagggcctcattggtgacccctgcctccttccatgtcccttatgaatacatagaatcgcagaggacaggatccttccgctggagctctgctcctcaggcgtgcctccctgtgtgatactgacaagtgagagcctgggtggtatttgcagctgctctctgccttcaagtttccctaatacacctgacttcgcatttgtgtcctggcctgttagtggtacatgtgtatgacccttagcctgacactgttcttacctttcttttgactgatttcttcttgtcattttctttcctctatgaatttggcaactaatctcattgtctattattttagtaatgactttagaaatcacaacacacacaattacacttttgaagcctaaaggtaatcagtacctttaccctcttcctagagtgatggaagggataaaaaccaacaacaaaaaaattcttttttggtctccataattgtaatgcttgaaccctattatctccacacctaccaattgaatatatttttgcaatagtgtatctttaaatatcattttttaaaatccccacaagatattattattaatgttgatacagtgactaattgttttgtttatacaaatagttaccattttctttcctctccattatttcatgcatcttggatcatccttccagaagtacctcctttaatagagtgcttcttaaactatctgtggtgaaagacttgtcttttttttcttttaatcatcacagcctagtattttttaaaagtacaataacatgaattactagaggaaaaaattaaatgaaaaaaacaaagacatgcaaaatacaaaccccacatgtttatttttggattcgacagacataaaagtactctgtcaaattgttgtaaagttttcagaatgcttcctttcagttcctggacttctgtcttctggactgggagcgaacactcacaggctgacattaatccatggacctgactttgaggagcactgcttaatatttttccttagtgaaaagtttccctgagttctgtgaactgctccagcaaattaagaatgcaaggagggggctgtgagaatcccaatttatagccagtcagaagagtaagtgacaacctactacttatgattagcatctgaatttgggggaagtcttgtaggactgagccctcaacctataggatgtaatgctatctccaggtagatagagtcagaattgaattgaattagaggacacccagctggtatccacaggagaagctatgaagattgcttggtagggagaaatctccgcagatttcggtgaccgaggtcacagaaatattccatgttgattgttgagtgaaagactaggaaaaacactttgtgtttttttgtatcacaacaactggaaacaggaattcctgttactactttgtatttcgtaggagggtctcttgttccaggttgattaagaattcctacttagaaatacattcagaatgttaatatacattttattaagttccaaatttgttttgagtacaggaactctgaggcacatgtgtgtatacgtatttataagcataacaatttatagatacattgttatatttgtcttattattaaatattattttgccatttgataaccccttttccagtagcccaccttacattggtataatgtggaagaacagtgttttttactaaagatgttaattacataatattttatgtttctctattctttagttagatcatggagtttaggacttgggctgccatgttacccttgttaacagtatgcgatataaaagagatctaatcctgtgagtacaaaatgagggaagtcataagagattcctaagaagagaaacttgaactggggagagacttactgcattaaaaatgtattaaataagttaaggactcaagggatctatgctgatgctaagtacaagactattcctgttgaacaataggaaaaaaggaaattagatgtagcttgagatcacttgctcattaatttcatcattgtgttaaggaagaagagacttaggattcttaatttttttttttagaaaaacctgttaataactgtaaaatggaatggatcagacaaaggatttgaaaagttgagattctggtttgtgtcccagctttgctatataagagttatgtgtgaaattgggaaaaatatgtaatgagacttcgttgtaaaattgagataataatagtatttaaatcaatagttgttgtaaagttaacataagagacttgtcagaaaacttggtgtgattgttaattttctgggtcacaactgggctgaggaaggcccagagagctggtaacacattgtttctgggtgtgtctgtgaggatgtttctggaagactgagtaaagaaaattgccctcaccaatgtgggagagcatcatttaatctgttgaaaacccgatagaacaaaaagctggaggaa

SEQ ID NO: 582 - DNA, 48462 bp, Homo sapiens
aaaaacccattttccaaggagaaagtcaaatcagctgcagaaatttgtaaagtaacaaggagcctaatgttaatcaccaagacaatggggaaaatgtctccaggtcatgtcagagatctttgtggcagtccttcccatcacaggcccagaggcctaggaagaaaaatggtttcatgggccaggcccagggccccctgctgtgtgcagcctagggacttggtgccctgtgccccagctgctccagctatggctaaaaggggccaagatacagtttgggccatggcttcagagggtgcaagccccaatccttgccagcttccacaaggtgttgagcctgcaggtgcacaaaagttaagaactgaggtttgggaacctctacctagatttcagaggatgtatgaaaacacctagatgtccaggcagaaatctgctgcaggggcggggccctcctgaaaacctctgccagggcagtgcagaaggaaaatgtggggttgaagcccccacacagagcccccactgggcactgcctagtggagctgtgagaagaggaccaccgtcctccagaccccagaatggcagatccaccaactgcttgcactgtgagcctggaaaagctgcagacactcaatgccagcctgtgaaagcagccaggagggaggttgtaccctgcaaagctaaaggggcagagctgcccaagaccatgggaaccgacctcttgcatcagtgtgacctgggtgtgagacatggtgtcaaaggagatcattttggagctttaagatttgactgccccactggattttggacttacatgggccctgtagcccctttggtttggccaatttttcccatttggaacagctgtatttacccaatgcctgtaccccccattgtatctaggaggtaactaaccttcttttgattttacaggttcataggcagaagggacttgcctcatctcaaatgagactctggactgtggacttttgagttaatgatgaaatgagttaagacattgggggacatgactggtttgaaatgtaaggatacaagatgtgggaggggccagggacagaatgatatggtttggctgtgtccccacccaaatctcatcttgtattgtaactcccatagttcccacacgttgtgggagggacccagtgggtgataactgaatcatgggggtggttcccccatacttttctcatggtagtaagtaagtctcaaaagatctgatggttttacaaggggaaaccactttcacttggttctcattctttctcttgtctgctcccacataagacatgcctttcatcttccaccaagattgtgaggcctcccgagccacatagaactgtgagtccattaaacctctttttctttataaattacccagtctcgggtatgtctttatcagcagcatgaaaatggactaatacaacaagcaacttaaattgagtctcagtttcgtaatctctaaaatagaaaaaataatacctttatgatgttaatgtataaaatagaaacaatgcatataatgaaactatagtagtatacagtacaaagtcctcaataaattatagccattgtcatcattatcatccctgaaccataaaatgttttcattactgtgattatagaaaaattgaaaaaaaatcttaatctgtaaatctctggcttttaaaaaatataatcactctgtaatttttattattatttaaaagagagtgctaatctaaaaaataagaaaaaagtccctattaagccagtaagttattttctaattatctgaattatttccatgaatgtgaagtatggaaaattaacaactacaacagaaacccatattcttccttcatcacattaatacaaggattacaaagaacatataaaatcagatcataagacaattcaacatgtcatttccagtgttaataagggatattaagtggaaatttcataaccgtatgaataagaactctcaaaattcaactgacatggtcttctgtttttgagtcctgtatctttcactgtaataagcaaagattataagtatactttctggtattcaagtttgaaaagtatgtaatgtttatcgatgtagaaaactgctttcaacaaatacataatctcagcctatggtttcactggatcactaacttttcattattatacattctataatcatcatctcatgtaaatattgtagaaaaatactataacggtatacctaactagatcccctccagacaatttttaaccactgttctagagcctgatatcagtaaccaaaaaaataatcagaaaaccctacagagtgtgattctactatttatatctacggataaatcaaaactactgtatataattgttaaataaaatctgaggccagtgatgatttttctagtaaaagtaaacagccactaaaatacaacatttacatgtagtggttacatgaaaacaaaaaaaacaaaaacacagccaggtgcagtggctcacacctgtaattccagtactttgggaggccaaggcaggaagatcccttgaggccaggagttgaaaaccaaccagagcaacagagcaagactccatctctataaaaaaactttaaaaattagccaagcattgtgatgcacatctgtagacccagctactcaggaagctgaagtgggaggatcgcttgagcacaggagttcgaggctacagtgagctacaatcatgccactgcactccagcctgggcaacagagcaagagcctgtctctgtctgtctgtctgtctgtctgtgtctctatttatttatatatatatgtgtgtgtatatatacacacatatacatatatatatacaagtacatatacatatacatatacacacatatatatactggtaataaaaatagtatttttaatacacacatgcaaagaagaaagtttggaaaactaaataacaaagataatgcagatgatttttacttccttaaacttatttacatatttttaactttctaacataaagatgtattcactgtttaactttttagttttaaagaagttaacagcatgagttaaaagatccactctacagtttcttctcttgagtaggtggatgctgtttttctaccctgtataccacagaagtcaatgaaaatgtttactgaataaatacataggattgaacgactgaaaaatctaggtcccaggaataggaaatataagttcaaaaataaatgaaggcaatgtgcataaagaaggcaatattcttatactgaccaagataaatcaaaaatagaatatgaaaaaaagcaaagacaagaagtaaaatcatgtatgcgatataaataagaaaacttaaacagattcttttcatatcaagatctcagaatcatgaaataaatttatatatcaggaattaagtcaatttcccttctaaatgtttcccatcctaacctatgaagaaccaaaatcaatggtatttaaaccacattaataaaaagatacaataaccacaatatctacaagtacaaggattgcaccaacccaatatttactgttgaattcacacgccacatcactttgtctcattgcttcctttctcaaaaaggtcacaaaagccaactcagaaatactttgttctaacactaaagagctcaaagtgctcttgtgcaagggggggaaaataaaaaaaagaaaagaaaagaaaaacacgctaccagcgtagcagattctactgaatgaaatcaaagcagtgcttgcttcagcagtacatatactaaaattggaacaatacagagattagcaccgcccctgcgcaaggatgaaattcaagtagtcagaggctagagagaacaattcatacacctacctagctatgggcacacggaacaagcaagttgtatcaacttcagaattccactggcagactcaacaaataacaaaaacacttgctttatcagatacattcgaatctagtgatcttaggaaatccctctcactggctaagcaaccatcttatcagtctaagtgacgacccgtttttgccttcaatctacagataaagtaaatcaaaactattacatatattggctaaataaaatctgaggcaagtgataatttttctagcaacttattcaacatgtgcaagtagtaaacaataacaaaaaacaccagtaaagtaacacatgaataaaacatatcagaatcagtcatctttttaaatgaacactggatattaaaaaagtatctctatctgaaaaggaatctataggactgaaagaagaaaacaggctacagttaattaaggtaaaagtatagtgttgaaaattagggactgatttagtaaaagatcttgtaaaaataatgaaggttgagaattcttaaacataatgttgagccaggtgtggtggtttaccctgcaatcccagcactttgagaggctgaggcaggaggatcccttaaggccaggagtttaagaccaggttgaacaaagtcttgtctctacaaaaaaaaaaaaaaaaagaaagaaaaaagaaaaattagctgggcatggtggtgcacgcctgtaatctcagctactcgggaggctgaggtgagaggcttgagcccaggagttctaggctgtggtgagctgtgattgtgccactacacaccagcccagtcgacagagtgagacccccatctaaaaaaattgcatatatatataattgcatacataattatatataattttatacatatataaattatacatataaaagtacatatatacatatgtatgtataatatatatttatactatataaaatatataattacataatttataaaaataaaatatatataagattgaattaaaggaagtaatatttcctgagttaaaaatttgattgaatatgctatagtccatgagatacagaaggcatcagctatattacacattttaggaccttagaaaattgtggtcttatcatacatataaattgtatacatataaaaactatacatatataaccatattcctgctcaccgctgtaactggacttcctcctaatgttaatgatactgcaaataaaaactctaaatataaattgaatgcataatcaggggagaaagcaaatggtctaagtagactcgccctcagtgacaagtctggggagaggtcaggaagagactaggatgaaatcaataggggtaaggctatgcaaaaagaaaagaaaaaaaagttgtactaagttttcatgcttgaaaagctcaaggtattgcacacattcagtagagtttctcccacgaaactagttgaagaaatagaaataaatccaatgttttcaatctgccgtttacttactggtatccttacctgtatagttcactctgctttgaagttggtttgagactgaagtaattttagcaacttgctacttatcttattctgactgctcctctgctatttctcagagagggttgtaagagtaaaaatgagaatcaacaatgactagtttacttaaagtactagagaccattcaactacttacaaaattacaggcatttttctcaaatcacaaacatcttatcctcaagtaacagaagctaaatgctgtacttttaaactttaatttggggtatcttattttgatttaaagtaagtgtactactattctggtatcagtaattcttcaattttattttcctaggaaggagaatttaagttcctgcctgctcatttatttctggaaacagagaagcatttttcccattatcctttcttattgaaatttgttctgctaagttttatccactgcaaaaataaagttaatcatttgaagaataaaatataacagggaagtaaaaagaagtttaatatatgcagctctttaaaagatacacagatttatgtttaaatttgaatgatgcataaattaggaatttaatatctgtctacttcttctgattttgctagaaccagatatcaatattatcatctctggggctttttatgttatattttcaaaatgaacaatgaatacaaagtacattttctgatgcctcaaacattacttgaaaaataataaggctgtttttaagtgtcaactgagaattttcaagttacatcactgttctgactttgcttactgatatacaattcattaagttactttttcactattacaggtactattcaagttacaagatacacagcaattggaaacaacagtattatccttgagtatccatggtttccatttagaaataatgctggatttttaaatttaagaaatttgggctcagacaattcaaattccttctgtgccacttattacctatgtgaacttgcacaagtcaccaaaaatctctgaagatcaatttcctcttctgaacagaataatcatacccagtcatattgttgaagtaattacatgaaacaggataaagtcctatatagatgttcaaaaaatggaaggtataatataacaataaaagaaaagtacttggtgaatctaggtttggatctactaaaatgtttaactcttctggaaaaggaaacaaaattctcatttatttaacttactactttagtttttcaatatatatgctagatactatgatgctatccttcaaagcaattaccacactcctaaacacttagtatgtactcaaatatcatttaatttaaatattttaacttttttattatgggaaatttcaaccatatacaaaagtatatataatagaataatgaaccaataggtatctattactcagctttaacaattaacaagggcaaatctcatctctactccccacccccatctgactggattatatgtaagcaaatcctagatatcatatcatttcattcgtaaataattcagcatgtatctctaaaatatagtatttttaaataaaaatattatcttaccttaggaatccactaatcactcaattaccacaaatatccactcaaggtaaacttttccaactgccttgaaccttctttttaattaatttatttactgaaacatggtctcactctgtcacccaggctggagtgcagcaacacggtcataactcactgcagcatcaacctcgtgggcttaagggatccttctgcctcagcctaccaagtagctaggactacaggaatgtgccaccatgcctggctagtttttaaatattttgtagacataaagtcttgctatgttgtcccggctggtctcaaactcctggtctcaagggatcctccttgcctgggtctcctaatctgctaggattacagacgagggctgccacacccagccattgattttttctttttttaaatagctcattcatttgaatcagaaagtccacacatgatattttggtaaataagtctcttaagtctctttaaagtttccccttcctccattttttattatcatatatggttgaagaaaacaggttcggtatattctctgacagtctttatcttgctgattatgtctcagtagtgttgttctatgggttcctctagctcttatatttcctgtaagccattcttttttttttttatgaatatactttaagttctggggtacatgtgcagaacgtgtaggtttgttacataggtatacatgtgccatggtggtttgctgcacccaccaacccatcatctacattaggtatatctcctaatgctatccctcccatagcccctcaccccccaacaggccccggtgtgtgatgttcccctctctgtgtccatgtgttctcaccgcacaactcccacttatgagtgagaacatgtagtgtttggttttctgttcctgtgctagtttgctgagaatgatggtttccagcatcatccatgtccctgcaaaggacatgaactcattcttttttatggctgcatagtattccatggtgtatatgtgccacattttctttatccagtctatcattgatgggcatttgggatggttccaagtctttgctattgtgaacagtgttgcaataaacatacgtgtgcgtgtgatttataatcctttgggtatatacccaataatgggatcgttgagtcaaatggcatttctggttctagatccttgaggaatcgtcacactgtcttccacaatggttgaactaaattatactcccaccaacagtgtaaaaacgttcctatttctccacatcctctccagcatctgttgtttcctgactttttaatgatcgccattctaactagcatgagatggtatctcactgtggttttgatttgcatttctctaatgaacagtgatgataagctttttttcatatgtttgttggctgcataaatgtcttcttttgaaaagtgtctgttcatatcctttggccacttttttatgggtttttttttatataaatttgtttaatttctttgtagattctggatgttagtagccctttgtcagatggataggttgcaaaaaattttctcccattctgtaggttgcctcttcactctagctttactgaatggcttaccctgatgttttctgccatttctacaagccttctaaaataaatattaatcaaaagaataacaaaaatgataaaataatagaaagtacaaagaaaaaaacaaccaatgggccagaaataatctgttcttgcaacatattaagaatgtatacatggggcagctatccaaggcatggcacatttagaggttttgaatgtttctcttgtaaccaaaatgggctcttttgtcctctcccaccatctacaacatttctacgtcctcccacacaatccactaagaagaagggcattacctgcacacaactgaacaatctatgactattactaagattccacctagtatgtttgccactctgattcattcctaccgttttaaaagaataatataaaagctatgtgaacttcgaaatatccttaaagtagaggacagaaacattacaagcactcctatttggtcaggaaagaggaaacaacttatcttagaatgaattcatcagtttcataaaatgcaggaacatcccattctagtctattaaacttcattctccaactctagagatcaagaaaagatttaactgtaacaggctgcacacctcagaaaacacagattcatgagatgatattaatgcagagaaacagacattaataaaccttgctgagcctgggcgtccagcatgttagttccaagtaatgtagttttgtcaaggagaactagatctcctcccaccgactacccaacaagaaaacatactatttggccagtgtaccagaaccttcagatcaaacaacagttaagacaataagagattctgaaaggatcaaatatatccacaaattaaggaggagttcttaagtaaacaaatggaaaagacaattaatcatgcattgcttgtttggccaccttcaaacaaccggacagtggatgaccatccattctgtcattttcttttcttttttttttttttgagacagagtcttgctcttgttgcccaggctggaatgcagtggaacataaattacaaaatacataccagcataataaaaataccaccttaaactaatatcgcagtttactattttcaaagcaatttgacatactgcaaagaaaacaagtgacaaaaaagagtggaaattttccatctaaaatagaaactttagagttctaaactttccaaagaacagaaagtattcagaattgaattcactataatccttcaataactatatagtctaacattcaagagcttaataacaaaaacagttgtaacacattccaagatatgagtatgccacaagaaagaatggtaatttaaacagcattgttttccaaggaaaaactcttaagactgtttcttcaaaagcatggctttagaagagagattctcaacattttttctctgccccaaaacagttcgaggatacacacaatctcattaataacaatgactcataacctatttagagatttattttgataaacaattttaaaagcaaattatctttgaaagtgtcaagctggttgagcattcaaaccttaaggtgaaaattattttaattagaacttaatttagttgaaatctgcagcacaaaagaagttagagagaggcaagagaggaaaggggctggatggcacggagtctctggtcagctaagggcaataacaagaagacggacaaagaagaaaaaaagtaggattctaaatacaaaaaaaaagtaagatatataaaaaaaagtaaatataaaaaaaagtaggattctaaatacaaatagacagcactaaggatttgtctaggcacctggaagggtacctttactgcacatgccttgacaggagctgaattcttatgtcagaaatggcttggaagactgcaaacggaaaacacccactaggcaaagccatcatttttctcaaaactgaaacactggttctattcctggtttacaaattttgcaaaaaaaaaaaaattgtaaaaagttctgaaaaatgtaatacatgatggcaaagaaagtaaagatttttcttctctaactcttaaaagcacaaaactgaagatcataaaatcaattcagtgtatgaatgttttatcaaatataataaacttagaacacgaaggataccacttaaaagctgaaaagttttgtatgtaactctaaaacttcacagatgaaatcgacataaatcataaccagaatgtcgggggatatcagtaagggtaccaatatgcttcctcaaaatattcttgaaataacaccaaggtgacagaatgctcaagtgcacgaactctggttgtgaatcaatgtgggggtaattcttatgctgttattcacaattttgtgaggctaccatctctgaaattaggaacatttgcctaacagctgatgcagatgtctatgacaataaagaagaattaagtcaatggctacgactgctgaaaagaatgagaagccagagaagcattcatgtcagaagacaaacactttaaactactattagcatttaccgggatttcatacatttgactatttccaaagggagaagaaaccttgaaaacagtctattctgaagtcagctaggaaactaaactctagaaattcatatttgtttcttctaccttacaactgtatgggaaattttcacactgtatttcactttaattctgataaccagaagaacctagtgatgtgataaaataaacaacactgtccctgtattacagctgagaaaactgaagcatgcccaaggtcacacaatttacaagtggtagttgccttttagtttatctttgaacaaacattttaaatgtctcctcctctgagaaattttcaaattattacccagtccaaagcattctcctttctgctttcccacaatacttgcaaaaataccactctcaaatacttccaaaaacacaaaacagacaatgagacattaagcgatctgcacaaggacgtactggtggagctttgagtctgacttcagagattatgcaattaaccactcaactatttcccgaaatgatcactaaccaagtatgatcttttctgctataactcctttgcataaagtgaattagttcatataagcttagtaaatggggtatgatgttaatataactcagattatatataactatttttcccacactttttggccgtgtatgtccagcttaacacgaagttcactgacacaagccaatgcagtgaactgcacgggactgctgcactgttcatggcgctcattcatgccactctgttgctacttcaatttggtcacttactatgtcctggtagggctttttgcatagcacttcctcattttttgtgtactttgtcctaatcttcggcagtctatcagcctcaaaccttcaatgcatccctttccatcagcaaccaccacctttaaagataaaatcctatatttactgtaatatttctttacttattaggactctgacatgttttttaactaactgtttttaactaactgttttactagactgctattgcttttattagtgatctggatataatgctgtatagattttgagtgatttgtgcaactccatttttcccagacctttaatttctagtatatgatggttacaaccacaagatttctcagaaatgtatcacaattatagcaaaaacaattgtataaaaatgtttttgaaccaatatcaatatttactatatattcctttagagccagtcagatctttcaagtttttctgcagaataaaattgcttccatcaaaaacgctgggcatctaacacaatagaacagttattcattccctactcttttcagtgccttctatgcaagccgaaagtcaggagttcctcagaaggttagaagagaaatgcataaacatgctatgactggctcctaaacttgaccaggcatcacccacccacttgtgtaacttaaagaaaatacaggttcccctgccctcacacagacctcctggatttccagagactgattccagaatctacatttgaaaacttccacagttgattgtgtttaatgatcaggcatttacataagaaagaaaaatgcataaaaattaagccccaaaaatatgcttttactttctgcaatgacaaataattcaagtgaaagaaatatcattcctaaatgtaaagtactaaaattggccaggtgtggtggctcacacctgtaatcccagcactttgggaggatgaggtgggaagatcacttgagtccaggagtttaagaccagcctaggcaacatagtgagacttggtctccacaaaaaatataaaattaggcaggcatgcctggtgcatgcctgcagtcccagctacttgggggactgaggtggaaggattgcttgtgcctggaaggtcaaagctgaagtgagctatgatcacaccactgcactccagcctgggtgacagagcaagaccctgtctcaaaatatgaaaaaagaaaataaaagtactgaaatcgtataaatgcccatttttaatcatgtatctcagaatgatcaattcaaatatggaaggtctgttcattagccatatatgattaataagaggcttgaatgagtggaaataaaaatgtaactatcaactgtattttccaactagttgcctaatatgaaaataaggctctcactgtgggaaacaagcaaaaatattggtgtttgtgatatatgcacatacagaaagttttatttcagctctgtcaatctgaaagatggcaagtcacaatcatcttttgacttttttattctggaattcttcagtctgctggagcaaattattcttatttaagccgtaccaatatcactatactaactatactgcttaatttacctcaacataatttatgtttttcccagtaatatttcctaaatacttatatgaatctaccacagttggcagaatgttattgctccaatagtacatagtctagtacaattgtaatgttttagatggcaattagagcaagttacactacataaatgaaatggtctgcaaaacttcatagcataacttgttgtgtacttaaatatttgtgatccaatttgatcattaaacattgtatgcatgtatcaaaatatcacatgtaccccataaacatgtacaactattatgtatccaaaataagtttttttttaaattgtgatccagaattcttacaagacaacaaaattttaatgtaggtgcaaaaaaaaaaaagctcaattttcatataaataaacaaaccttatttgggctaccaaacatgattaatttgagtctcaaattatatgtgtatctggcctttgccttgttgtcccaagaatatatatactttattattctccaaaccacaaaaacttatctttcataatattatatttcaaataaaatatagtataagacatatgcatttccatttgtctagcctcatacttttgtattcacttcgtagttccgctatctgaaatttaaatgatataaactaagatacagcgtaatcaagagatgtccccaagtcactaacaggctgcaatgttcaatgaaactcacctttcaccgaaaatggacaaaatcactgcttcctgagttaaaccagaaaaatactcaggaggtattttaactgacacaaggaacatagcttgccacctatagtagttacattttaatcttccatttgtcagaactacttgccaaaggcaactgacagccggtaataatatgagattccctgcaactggcagcaggtgcgtaacagtaatggagaaaagtcactgatacatgagtccaagatgtcatcacagtacccttataaggtactgcaggacatgttaaaaatagtgtggccaatctcaattacagtaaatgaatgctatcttattaatattatatgataatattaaatgatgttagtaacatttaatgtaatataaatagacaaaactgaaaatgtcagcttcccttatcttgaattttgatgtagataacatttttaatagtgcaacattttcataatgctacataagccattttaaaacacttcaaatagacacagtgctctgtgacagccaaaatgacaaatcatacgaagacactacagggataataaattgaggcattaaatgaggtcaggaagagacaggaaaggagaataaatagttttgtagggcgaaaagtcagtgttttaaataatttttaataaaaattataaaaaatcctgcaggtaagaatgtttgttttgttttcttatacctcaagtagtaatttttaaaagagaattgcagacccctccggaaaacccgtaactccagtctaaccatgagaaaaaaaaaatcagacaaaccaagactgggggacattctacacaataactgaccagtactagtcaaaatcgtaaagttcatcaaaatcaaggaaagtctgagaaactgtcacaacaaaaagaagcctatggagaaatgatgattcaaggtaatggcatcccagatgaaatcctggaatagaagaaaaaagtatgaagaaactaaagaaattcaaatgaagtatagacttcagttaacaataatatatccatattggttctttacgtaagatgaacgtaccacactaatgtaagatgttaacagtaggggaaattggatatgaggtcaacgagaagtctctgttctatatctgcaacttttccataaatctaaaattattctaaaataaaaatgttttttaattgctattttaagtgacagaaaacataactagaactggcttgaatgaaaataaatttattgattcatataatggaaactatctaaggggtggtctcactttcagcacagagagattgaggggattcaaagggcttccaggaaggtgtctctcctttgttgccttcactctgctctccagaggtggactacagtcttaagttccatgtagagacaatattgccacaacatttgctttgaagatgcaaatttgtttcaaattgatacatgagggaacaatgtgaacacagcatgaattcagcatttgcttacgcgtgacttcatctgacaagagcactaggtacggtcagcaaactttttctgtaaagggccagataataaatagtttaggctttgtggaccacatggtctctatcacagctgctcaactccatcttcgtagaaggacagcagccacagacaatagcaaatgcatgggcatggctgtttttcaataaaactttattgaccaaaacaagcaggacagtttgtccatcactaaaccaagtgaattaagaaaactgcatgcagctgaccccagccgcttaggaacactcaaaatggatatacctcacaagacaatgagccacatcctctactcaggtgttaacaactttctctcctctttctgagcagcctccttccatcacttcacagtaactcacgtgctgctattcttacaaccacagggtgaccacaacccccagccctcatctctctttaattttaccctttcttaaacctagggttaaggtttccttatgatttggttaggattagggttttggtgcctcagtttagcaataacagttcctttcctcataaggtaattgtcagaactaaatgagttcatgtatgtgctagaacacatcctagcactcagggcattctatatgtattaatttctgctttgatcatggtattagtttccaattgctgttgtaacaagtcactccaaattcaatgacttaaaacaacagaaatgtattctcttacaattctgaaggtcagaagtccaaaatcagtctcagtgggctaacatcaaggtttcagcagggctggttccttctggagaggggagaatctatttccttgcctttttcagtttctaaaggccatttacattccttggctcatgacccctccctcacatcactccaacttcttgcttctgttattacatctactactcagcctgactctcctgtctctctgagaatccgtgtgattaccttgggctcacccagataatccaggataatctccctatctcaaaatcattagcttaatcacatctgcaaagtcccttttgccatgtgtggcaaaccgatatggctcccaaaaatacctccatgtcctaatccctataagttataaatgctaccttatttgaaaaaagagtctttgcagacttgaataaatgaagaattttgagatgagaagataatcctggattatgcaggcagtctctaaatgctcgttagagagaggcagagggggtctggacacagaggagaaaagagcgatgtgaaaacagaggcagaaattggaacgacaggaatgtcagcagctaccagaaacaagaaaaggcaaggaaagaattctcacctagagcctctggagcgagcacaaccctgcccacaccttatttcagacttctggtctccaaaaccagaagagtaagtttctactcttatagccgccaagtctgtggtaatttgttgcagcagcaacaaacacaccatgcagagtaacatacaggttccagggattcggatgcggacatatttgacaggccactattcagactaccagtctttattcaaatcctcctctgttctctttgaaaaatatattttgatattctttttctctctccttgagttacatgggtaattcatttattctaattctttattaatatgtatatttaaggccggtggcagtggctcactcctgtaatcccagcactttgggaggcccaggcaggtgtattacttgaggttaggagttcgagatcagcctggtgaaatcctgaccttcctaaaaatacaaaaattagcccagcatggtggctggtgcctgtaatcccagctacttgggagtaaggcaggaaaatcgcttgaacccaggaggcagaggctgcagtgagccaagattgcgccactgcactccagcctgggcgacagagtgagactgtctttaaaaaaaaaaaaaaaaaaaaaaaagacaatctttcagattttagctgagtccccataggttctaatacattttatcatcattttctacaatttttaaattcttcaactcaaaaatttatttaaagattcttaattgcccagtgatagtgatttgtttttataagtttttttctaaaattattaatttctacttttattccacctcaactatttctattttgggaaatttactgaagtttttttttctaaatggcccaatatataatcagtttttgtaatgttccaagagaacttgaaaataaggtgtgctctgtttattgagcataaagttaaatatattttaactaaatatacctcacattaatcaggttgttctaaatctttacttaatttttggctactgctttgtccaataatttatttttccttattttttatagttttgactttatgtttgttaatgctatgttatttggagcatgaataatcagtgtgcactctttattactgtaaacctccttctttgcctctttaaatcttttctgctctaaattcaccctgtctgatatcaaaacctgtatgtccccctttcttgttagctattgttataagtaatccagaaacctgtggtctatgctctgaaaactaagctgccaccacagtaacacaaaccatatataaggttaatgaagaaactgatacacaacagtagtgcaagataggtcaccctggggccatgtcatgccaaggggtatgccttgccaaaatctaacactgcctaagtggtaggaagatgttaaatcccaggcagtatttattttttaaaagttcagtataaaagatatctctcttctatgagcattttctagagctaacttttataaccatgtatatatatactctgtaatttatatatcatgaatcacagaactgcctgagatgtctttatacctcctctagaaaaatatactcaaagtaaaaagctcagtactgtctattctccatttctgatttctgaagatttttatttaagaaatgactaagaaaacaagttttgaaatactcctcaaggattattctaatttttgaaataaatacaccagtcaaagaaatagacatatacacgtcactgaagtcagctttgcaaaatagttaaaagcactagcttggtagtgagtttaaacctaagttcaaatcccaaacgtggtgattactgtgggaccctgggcaggctacttaacataggcctcaattttcttacctgcaaaattggactaataggaacaaactgagaaggacactgggagaattaagcgtgacaatgtacacaatggacttaacacagtaccaactacacagtgcttgtaagttgctcttgtcactgtgcagactcaggtaaaacatcaaaaccaactgtgatatctacttttaaaatctgttgacacttaagtcattagctttatgcaaattcaaaaccttttaaatatcatttcatgactttaaatatactgtgaaatattaaatacgttaaataatatctgtttattataaagctgatcctgagaacataagacaaacttatcgatagtagcccactgctaatgaagtgcaaacttcctcaaatgataaacatgccctggtccttctatacttaacattgtttcttctgtcagtcataggaactgtttataactctccacgtttatcaagctgtttcaagttctttagagagatggttccctacaccttcaatgcattccatctcccactgcagctaatctcacacacacacacacacaaagccccctacacaaaatcctacttgtcctaaattagctcaagtgtcatctcctttaagaacccttccctgatctcctcagatataaattgatattaatataaatggcaatgtcagaactataaaaggaggcaggagagatgagacagaaaagggacagaatacataccaaaggaagacagaacgggggaaaggagcctgagtaaaatattttccaaatgaaagcgtctgacgcactggagaacttccacccagtgctgaatgtaaaaaacaacaacaacaacaaaactattcaggatgacaatgcctagccaatgaaaaagtaaaaccttatagtaacacaaggtggatactgcaggttagattctccaggaagcagactctgacacatttgtcaagtagaatgttaatgagggagtgcgggtgagaagaacatctgttgtaaggaggagaagaaacaggaattgagcaaagaaagaagttgaacagatgaacttcactgcagacccaatgagagccacggccaacccttcagggagcactaaagtcagcatggcccttcagaattgagaaagggcaagagagacagccaccctacatcaaccagccattgggccacattgggatgaggtgctgcattcaattagatttcaacctcagattatgatcttgagaacctgatcgctgactttttagaattcttctcccatttggggcattatttcaaatagaaatacctttattttgaaaggtgtgcttttttcctatcaggaaataaatacaaatttcagttgcaagtacctaggactatatatacaaaaatcattctctcattctttatccatgctattgagatagttgtaattatcaatgataaaaatggttatgaatttacaaagcatatcttttccttccattctgttttactgagttcaagctgagacacctttttggtaacttttctagtattcctatcctcacaaatgataaacgagaaaatttaaactaatgttttggctgtttctgagatctgtcatgcaatttatgcttcacataagcagcacacaagagtagagaactaaagtcttgcaaaccagcaaaaatcacactgtctggcaatctctcagactagctggtcatagtctctatttttctggcccagaaatatttctacagtaatttttcaaacttttctcattttttataatttcagtaacattagcatactatgcataaagataagcacttaagacttcttgcctgacgctttcacaagagcactttttctgccacacaattgtctcccagagtgaaaaaagtagagacatgctcctacttacaaacaaaaataacatctggaggttattaatattcacattaactacacacatacacacacacacacacaatgttcattctcaatcccacataattagtctgccaggcttcaagcagaataatccataaccatcttgacatgaaaaaataaaacctggccatacagttttcaaacacatttctctaccctaaagctcaaggacaaaaagtgagaagaaattctactttgggcaaatgaggttcctgaaactatagcacttgcataaattactttagaaaactagatcagacagaccagatcacttaacaatgaatatgttttccctatatctgaaacattctccagaatggatcaactttttttaaaccagaatatcattaactgagataatgtagcttaaatcccttcagtatgtttattcaccatttggagtgtccaggagcacagagaatgtgggaggaaaaaaagataaatcaacacagttaaattttaaggcaaaaggaagggtctgtatacggcacagaactaagaatttttctaagtgtgactgatactaacaatgaaaatccgtgaataaactttggaagcaagggggaatggaaaaatacatatattttagctttaatgcatcagtacaacagaaaacaaaaggtcactcaaaaactgtccaaaacctaagtagagtacatattccccaagtacaggagaatacataaatttttacttgccatggtcaagttttctcaacatgagaagatacagattcctcaataaacacataccctctgattagaatccagtttggtttgatgcagtggattgtgaaccatctgcatcacaatgacctgcaaagcaattaaaaatgcaggtttctaggctccactctagaactagtaaactagttaagactcagaaagccgcactgtttaagaacttgtaggtgattctcttacattaaagcctagtaactgtttttgtgtagactctgtaatggtaacatatttgctccaagttatattttattcatttttacaactattttacaggttaaactcaattcaatggcacaacagttctgaagtctaactacacattacaattccctaaggagcctttaaaacataccaaaacctgaatctcaccaactacaccagattctctagggataaagagagggtatcattatttattaaaagctcccttggtgattctaatgtgaagcgatgtttcaaatacagctcagaagatgctatatattctaactaggaaaaaaaaaagtctacagaaaaaaatgaaagaaataatgtctggaagctgaggacaccgatattttcagacacataattttcccagtatgatataaagaaaactggaaaatgatactgcccgcaaaaataaaatctatgcgaagccatgaagtcttattttaaggaggcaaagtttctagcaaagacaataataagataaccaccatatccattttaattgaatagaacttttaatgtcaattaaacatcacaaacttctatttattaatgaataagaacaaatttaaaagaaatcagacaatgaactagacttctaaaggaaggggtgggctgaaatatgcattttaattttgctccctcctaaaaccccattacaatcgaaacaagctttgtaattgtcattactgtgtgtgtgtgtgtgtgtgtgtgtgtgtgtgtgtgtgtgtgtgtgtgtgtgtgtttatggtaaaaattcataggcagcagagatgagtggaaccaatcccagtcctgagctgcgccccagaaactccagggctctctgcacccatcctgcaatggtgaatactgaagaaatgaggaagagtacaagcagtagaggacaaacaggctttccggaggagagcctcaacctaaagctgaggccaatagtgggcaagggcaggaggtccaggctgctgtgggctatgatcacacccctgcaccctagtctggatgacagaagaagatcttgcctctaaaaaaaatttttttaaatagtaggcaatgggaccctatgctccaaccctcttctttctttctgctcctcctggacgtacccacagtatgttacttgtggacactcgaatcttctctttccttccaagacctcactgagtcactggccctctttactcagggacattgtgaatatgcaggacccaaagaatcctgcagataggcactgtgggaccaattacttctgaaatattgacaactatagctactattggagtttactgagcaacaggatgaagaaacagcagcatctgaagcattcatttaccttcagcattgatcaaatattttaagcagtactggtctcttttgctactctaaagcatattccctcatcaagaagaaacgtgacaagtgaacctaagagttacagaaccctcaaagagaccaagtgataattaacttggtccagttttaccagcaagtatatgaaagctggtatcttagtgttttttcttcagtgtccaagttcagacaggttaagcaataggttcagacaggttaagcaactttcccaaggacacaacgctactaagtaaaaaagccggagaacttcaaccttgatgttttaattgccaaaagctatgccctgctacactacaagacacaggaagttttctcaaattttaagtagaattacaccctaattaagtgtaaaaataattcacaggaaataaatttctgcatggtccagaaaggttatatccagggaataaactgatatagcaaaagggagaagagaaagatagttaccctcgtttccaagagtttaaacagaaatacacctgggaaaacctgttgtcactgttctcattcacaacctactttttagtactctttaagtgcaacctctctggtaactgattttatgcaaaatttttcctgtaaatctgttcatcctgcagcaatctaatagtgcaatacttcttgtttgcaaacttttaatgtaaaaagatatcacatggggatcttactaaaatgcagattctgactgagtatggctggagtcgggagatgctgtattctgggggtagaaaaaggatattgcagtatccccttgactagcaaggatctagtgcagtgctgtgtcatactatagaaataatgcaagtggtatatattgttttaaatttcttagtagctactttaataaaacttttttaaaaggtaaacttaattgttgtaatatattttgtctaactcaatacatccaaatcattatcagttcaatgtgtaatcaatattctaaaattaatgagattttacattctttcttcatactaagtctttgaacacagcttgaattttccacttacagtacacattttaattcagaatagcaacatcccaagggctcaataaccacatatggctagtggcttccttactgaacaaatataagtagactgaattttagctactctgtacctctagcttgcttggaatgtttaaacagttcaaaatttatcattagccaactacataaagcttagctgtggtaccagtggaattgaagagtgcttttatttgtttcttacattttccttttgtcctgacaattcatgactgagtgctgcagcacaggacggatataataggcagtgaaatagactctagggaggggtggcagaaggctgggtgatggcaggaatggtagtgggaaaacagaaagttagtgtattttcaagatataatcttggcatagtttaggagaaaaatgtggaaaagatgtttgcttacttttatgaatacagatgttttcactaaccttttaaaaatctaaaataaagatctggtttagataccaatttaaataccaaatattcatttttaaaaaacagctaaagaagtaaaagacagctgatccacagcaaaacaaaaagtaaattcaatactcctgtcagagagagccaaagagatttctacatgccaggatttcccaaagaacattaagcaattaagatgaataatgtctatgatactcaccagaaacaaagtttcagccaaagaaagaatccactagacatctgcccagataagatacttaaatcacattttgggactacttgaagtaaatatgaagaagcagtaccagaaacgtcagggtggaaataaaaagataccaactcaattcacttgttggctttcttcttgagtacaagtgaagagctgataggctccatggtgatgacgaaataatgaaataaaaaccaagaaacagctgatctaagtgcactgttgtccattaactgaggttttgcattcagacaggaaagcagtaaagacaacagatgtcagcaccaatgtcctatgcactacaccatccacattctgtcatggttgcagaattctcagaattgggctggaatatatggcaagagattcaaatttcagaaggcttgtaggatctaaatccagattgtaaaatatctaaaacagaatggtcatgtattaaaatcttggtagttcaaaccaatgacagtgaaggaaaggaacctacatttattgaggtttaagtaacagccataagaattacatcagtgaaaacagtagagtgagtacctctgaaaattctctccttaactttttcaaaattctggaaattaactaaaagcttgcagcaatccatggaacattttttcaagaaaaacagctgaatctccgtaagaacagcaaatttaatggtatttcaacttaccctattccttccctctgatctgcagctccacagtcaccatgaaaaccagcaacacataataccactgaaagccaggagcctggcagccaccaacggattttaagtgccttcaaagcctcattcccagagaactgtcattatatcaacctatccggtgacatcctcaaacacgctacttggactgtctttatttgacctgactcacagcttggctagagcaaaaaaaaaaaaaaaaaaaaaaaatctcttccccacaagcatttgcctaaaatatttagagggccaggtggggtggctcatgcctgttatcccaacactctaggaggctgaaccaggagaatcatttaaggtcaggggtttgagaccagcctggacaacatagcaagactctatctctataaaaaattaaatattagccaggtatgatggtgcatacgtgtagtcccagctacttgagaggctgacacaggaggataccttcaaagagtttaaggctgcagtgagctatgatcatgccactgcactccaacctgagtgaagggtgagagcctgttttgcaaagaaaaaaagtattttgaggcaattatttaatgttgtggctgcctgaaatggtagaaagcagtaggacaaagataaatacactaatgaaaaagcttaaaagaaaaaactgagaagtaagatgcccatggagactttgaaaagtttagacatattcctgaaaatctcaaagtctattcacatgtacagggctgtgtgtatgctcagaactgtgtacatgctcaaagaagtccggacaagactgactcagaggctctgtgcaagaaggaagtgatggctaagcaaagttatcaaatgtctggatgactgttaaaggagtgtaccaacacacacaaagagcctctcagcaaaaactgggaaaatgactggtcccaggagtttaaggaaatctgtacaatcactagctgaccacaaagccatttgaacagacttctgtggccatgcacagagaatacaaactttacagattacagaaaagtcacctaacaaataaaaaacaacaaacagcaacaataaggatcctggagccaaatatgattttcaaagttgccaccccactatattatataaaatgtccagtcttcaacaacaacaacaaaattacaagacacgccaagaaataaaatagtatggcctatacatagagggaaaaacaatcaatagaaactgaccttaaggaaacccagatgttggctgtattagacaaatattttaaatcaattatcttaaatacgttcaaagaactaaaggaaactgtgcaaagaaagtatgagaatgatgcttcaccaaatagagaatatttttaaaaagctataagaaccaaacggaaattcaggattgaaaagtacaattactgaaatgaaaaattcactagaagggctcaacagcaaatctgagaaaatggaagaaaaattcttcaaatatgaagataggtcaattgagattatctaattcttcaaatatgaagataggtcaattgagattatctaatccaaaaacagaaagaaaacaaaatgaagataaaggaccaatgcctagagaactgtaggacaccatcaagcacacttgcatacatacagtgagaggggaggagagaaaggaacagaaggactatttaaagaaatcatggccaaaacctttacaactttgatgaaaagcattaaaatctgtatatccaaaacaaactccaagtaggataaactcaaaaagatccacacctacataccataatcaaactatccaaagacaaagcagcaagaaaaaagtgacacatcacatacaagggatcctccataagattaacagctggtttctgatcagaaatcatggaggccagaaggcagtagaattacgtattcaaagtgctgaaagaaaaatgactgtcaatcaagacttgtgaaacaatgtcattttccccctttcttccctccattatggcattcttttctgttaaatattttccagtacaaaaaagggaaaaaagaaattgttaacaagacacataaaaaactaacagcaaaatggaagaagtaaatcctatcttatcagtcattacgttaaatgtacatggataaatattccaattaaacattccattgacagaatggttaaaaaagaaaaaaacatgatccaagtatatgtttctacaagagacacacaacacactatatccaccaaatatgatgaaattaagacattctcagataaacagagactaagagaatttgtagttagaaaatctgccccacaagaaataataaagggagtccttcagactgaaataaaagaacactagattaactcaaatgcagatgaagaaataaaaagcacaggtaaagctaactacataggtaagtatgaatgacagtataaatgtatttttgcttatattttatttttcttttcttcttctacctaatttaaaagactgttgcacagagcaaatcataaatttggttaacgggtacatgatgtataaagaataatttgtatgaaataacagtacaaaggaaggggaagggaaggcactatatgggaacaaagtttttatatactattgaaattaagtgagtattaattcaaactagagtgttataaattaaattttcaattgttaattataatccccagggcaaccactaacaaaataactcaaaaaatatactaaaatacaagataaggaaattaaaattatgcactggaaaatatctaacaaaaaagaatgccataacggaggaaaaatgggaaaaaattacgtaagacatagaaaacaaatggcaaaatggcagaaataaatcctatcttatcagtaaccacattaaatgtacaaagactaaatattccaattaaacattacattgacagtttaaaaaaaaaaaaactgaactaaacatgatccaaatatatgctttctacaagaaacacactttaaatataaagacatgaataggttgaaagtgaaaggatggaaaagctatttcatgaaaacaataccaaaaggagagatgaaaatggctacactaacatctaacaaaataagactttaagaaaaaaactgttactagagacaagggatactttagaatgatagaggtaaatttgtagcagacatccaacaacagacacccaaaatacatgaaacaaaactgacagatttcagaggacaaatagacaatgcaacaataatagagacatgtatcccactttcagtattggataaaataattaaatggtcaacaaggaatagagacctgaacagcactgtaaatcaacctgacctaacagacacctacagggtattttacccaacaacaataatatatacattcttctcaagtgcacatggaacattttaggatagaacatgtggtaggtcataaaaccaatcttgatacatttaaaaggactgaaatcacacaaactacgctctctaaaaacaatggaacaaaattagagattaataacaaggagatctgagagatatacaagtaagtggaaattaaactcactcctaaataataggtcaaaaaagaattcagatgggaaataggaaaatactttgagacaaatgaaaacaaaaacacaatcaccaaaactaatgagatgtaatgaaagccacacttagaggaaatgtatagctgtaaatgcctgtattttaaaaagtagaaagatttcacatcaataacctaaaatttaaaaactggtaaaagaacaaactaaattcaaagcaagcagataaaaatagtaaaggtatcagagcagaaagaaatggagaacagaaaaaaataagagtaaaatcaacaaaaccaaaagttagtccttttaaaaggtaacaaaattgattcttccttttaaaagacaacaaaattaactatttttaacccatttaaaagataacaaaattggaataccatgtagccataaaaaggaaagagatcatgtcctttgcagggacatagatggagctggaggccattatcctcagcaaaccaacacagaaacagaaaatcaaataccacatgttctcactattaagtgggagctgaatgatgacaacacatggacacagggagagaaacatcacacactggggcttgttggggaagtgggggaagggagagcatcaagataagtagctaatgcatgcaggcttaatacctaggtgatgggttgacaggtgcaggataccaccatggcatacgtttacctacataacaaacctgcatgtcctgcacatgtatcccagaacttaaaagtaaaattaaatgtaaaaaaagataacaaaattggcaataaactccattaaataatacacgtaattttattaaatagtcacaaccacctatgaaggtacatttggctatgcccaattcacataaggttgtgagttattacatcacttaccctaggacgcagaacaaggggaaaaaagttaaaatttaagccttatgttttttacagaatgctgtaccacctggacaagtttctggatttacaaaaatctaaactctgtattttaaagaatacaattatcttaactgaacttgcttttgtcaaatataggcttttaattatactattcttttggcttaacttgggcattattgcaaaacattagtcttcattaacttactaacctcacatacttataaagtgtgtactgacagaaaaccaaagggaatttgtataaacagatgcaatttatttataattaaggcagaggtcacatgtaaatatttgaaatatttgaaaaaatatatacaaattatattatttaaataattttctggaagttatgtttatattaattagtgaacctttgaaaaaactttttcccctaattaaactttttactactcgctcaattatcaaatgctaccaattatcaaagagctaattcatatcgtttttacactatgttaagtctataccaccactatcaccactactgtgcaatcccaatgctgccttaactgcaaatttaaggctgaaaagtctatagagctctaagaacacaaaaggtagcgtagtggagaggctatcgactaggctaggggccacaggaaaaccacgatatatctgaatcccttaaaatgaatcaatgtttttaaaaatccaattacttaaggattttcacttgcatcacttttggtagaacagtctgaatattaagatatatatatgcataacattaatatggcccaattccaagcaacaatttttttgggggtgggaggcagggtctcactcacccaagctgcagtagagtggcgcgatcccctcactgcagcctcaaccttctccgactcaagtgatctgcccacctcagtctccctagtagctgggaccacaggcatgccaccacacctggctaatttttgtaatttttatagagacaaggttttgccatgttgcccaggctggtctcaaactcctgggcacaagcgatctgcctgtctcggcctcccaaagtgctgattacaagcacgaaccattgtgcgcagccttaatatatttttaagctgctaaatgaaaaacgaagttatatgctactgaagaattgggacattgggtggcactcttgtaaaagaaataattactgtaacatacaggttgagaaaaacctaaagtttaacattatactgcttggccaatccaaattatttaataaaatctactttaaaagaaattacttgtttcccaaatccaccatccatgtctttgaggaaatgtttcagatgttattgaaaaaagtagttgtttttggacgtggataaaagtcaggaagcatttgtctttcctctccctaatctctctcatttgagtttacagtgagaatacaagcagaaacatacaatgatgcaattatattccataacatatttactgttttattctacttacttttttaaaatttggttataaaatatctcacaatattttgttaaatatggaaaaagcaaacaagtttagtataggcattgtgtcttctccaagctatattagtgacatcaaattaaactagaatatatttttaaaatattatttctcatgtataatatttcacaataagtatgtgcctgagagtaaaactttttaaaatatctttgagctaaattatttcaacaggaaccatatcaaacatcatacatcaaatcaataactggttaacttgtaaaatataaaaatccataaaaaagagcccaaaatttaatatattatccaataccataaagtaatcattttggccaggcacggtggctcacacctgtcatctcatcactttgggaggccaaggtgggcggatcacttgaggtcaggagttcgagaccagcctggccaacatggtgaaaccccatctctactaaaaatacaaaaattagccggccatggtggtgggtgcctgtaatcccagctactcgggaggctgagcaggagaatcgcttgaacctggatagcagaggctgctgtgagcccagaccacaccagtgcactccagcctgggcaacagagtaagacgccatctcaaaaagtagaaaatttaaatttaaaaagtaatttttcatttttacatagcacatactttgtgtttcttgtgcaaatatttactgtttgttattgttacggttttctattgagacatcctgccctatttttgacagctattaaacatgtggctaataattttgttttctgattacagatgaaatctcagtacagacgcacttttttgttaaatacactaacaaggaagttagtgtatttccaaagaaaatgcaaaatgcttggaatatcttcaacattctcaaatgtaagtatgatgtgtgaccggcaaacaaattatatacaactttaaatttttaaaaaacctagggaagtcctggttccagtaacagtggagtagcttgtatttctccaacaaattctagttcttcaatggattctagctctccgacatcttacaaaaactgtcaactgtggacaaaacattacacaaccacttaagaaaatcagaggccaactataaaagtagtacacctaatgggatactgtataaaggtttgtcagtcatcccaactgaagacaactttgaagggccatcccaattcagaattccctagagtcagctaaggcctttcttaagactgcctctcatgccggtaatcctagcactttgggaggcagaagcaggcgaatcacttgagcccaggagttcaagaccagcctgggcaacattgagaagccccatctccataaaaaatacaaaaattagccaggcctgatggtacacacctgtagtcccaacttctaaggaggctgaggtgggaggatcacctgagcccaggaggttaaggctgcagtgaagtcatgattgcaccactgcattccagcctaggtgacaaagtgagacggactcaaaaaaaaaaaaaaaaaaaaaaaaaaagagactgcatcacactcaacttctccctctactcacttctctgttcccatttcttccttcccacaggtgttgataccagtattatcctaataaacatcctttgtattaatcttggtcccatagagtttgagaaccacactcacgggtgacattagtgtagctacagattatctacgtatcagttagacagatattctgggtgatgaactaggaaacaggcataaagcactttacactttatacaacagagggctgtctccaagaaaagcacctgagtgactgaactagaagatgagttcatctagccccacttttcatggcatattatttctatttgaaagaatggtagacaaattagggttactcaaatgatgatatttccttaaaaaatgaagtgagccagtcatttcaaggaaaacaactggcgttattgttgaaaatgataaaatttgaactttcaagtaaaagtcagattctggagaatttgtatttgatactaggaacttgatagcttgatgagatcagtaatgatgttaatgatattaactagtgatcttacaaggccataaaaaaaaaggtgtcagccaagattgactctcatctgaaggctggggggaaaaatttccttccaagttcatgcgggttgttggctaaattcacttccttgcagttgtaggatgaaggtcccttgctggctgtcagaccagggccactctctgcttagacactggcatcacatgtccccttcctatcttggagacagcaatgcatgaccagtccttctcatgcctccaatctctctgacttctctttccgctaccagcctgagaaaacttctcttttacttccctctctcttccacaagggtcaggcctgcatagatctcttccagttgcagatggaattgttctctaacttgattggggtatggattacttaaacatatatatttgtcaaaacttttcacactgtacacttaagacatgaatttcatcatattccaataaagtatttatttttactggagtataatgctatttttattggagtataatattatactccaatgaaaacaagtaatgctaaaaaaaatgtaaccattactttaaaaaaagaatcctgatcttttagagatgtgcactgaaatagcaacagatgatatgatgtcagggattggctttgaaataatcatgggtggtaggagtggctttggataaaacaaaattggtcacatattaaagacttctgaaactaagtggggggtacataggagtttattatattctacatttacttttgtatatgtttgagaatttccataataaaaagatttttgacctaaccaactcacagcaggcgatacaaaatgacaaaaattctaatacacaattggtgtgaatacaaaataataaaacctctttaagaaagggctctgtctaactctaccaatgctgaaatggcacacacctttcaacccagcaactcacttttcggatgccttagagaagtcatgcacacatgcacaactgaacgtgtacaagactgatcaatgtggcatggtctataatattaaaaaaaaaaaaacctgcaacaatctaaatgttttggggataatggaaaaagtaactgcagtatattcatacaatgaaaatatatgtaatagttaaaatgaactgtatccatgtattacacggaataaatgagaaaaaaagcctgcagagtgatatactttttatataaggttttaatatactaaagttttaatattacatgataatatacaatatacagtctaatactatgcaatatacagttttaatatttatcatataatgctatatattttttacggatagacataatagaggtctcaacaaattcaggataactgttacttctaggtaaaaagaaaggaaaataatatcaggggttcaattgtataatatttcattttaaaaaaacctgaagcaagatggtaaagcaaaaggaattaatggagcaagtatgttggttcatgttccttgccgtactttcctgtttgtttttaaatatctcaaaatttttttaaaacaaaaaaacaaaggctattgcaataattcaaagaagagattactgacaaactatctaacattaaagtttttaaataagatttccttttaagaacttcatgctatttcagaactgtaaactattacatttcaaaatacccacagttaaatattgatctgaaagaagtcctcctgacaacaccaataatgtatatactataaaaaatgactaactctcaaaaatgtagtctaagcattgtgccaaatattttgaaactataaaaatatatatgtaaaatagtctactatatatttttccttaaaatatatatcctaaggaaatatgaaaaatgtaaaattttattaagtttaggtgacgagcacatgagtgctaagacctattatcttgtacttttctgtgtatgttgaaaacactgacaaagttaaaatatatcaatataatctatatatctgcaagaagaatggcaaaaatacatatactgttttctaggttatttttcccaaagatctccctactacttactcaaaaagaaaatcatttacttatttttaatctgccacctgaatgaatctggcaatttttagagaaacaaaaccacccctccagagtagggtggggatactcagcacaggaactatttatttaaaggggcgtctctgtcaggacaactaggtttttagcaacaaaaacctagcaacagaaaaaacaaacaaacaaaaaaacacaggtagttgttcttctatttcaatccctatttcaccattcccttagtttaccaggcttttaagtaggacttcactggttttgaccagtggcccccaaaaaatatatatccacatcctaatacctggaccctgtaaagactgcactatttagaaaacaactttacaaatttaagttaaggatcttgagatgaactcatcttgcatttcaggtgggctctaaatccaacaataattatccttataagagacagaagaggcacaaatacaaaagagaaggccacgtgaagggagtgtggccctgctgacatcttgatttcggactttagcccttcggaacttaaataaacttctgtaagctaccaagtttgtggtcacctgttatcttaccttctgaaacatttccctaccaattcaactagctacctaacacagcacctgccacgagctctacctggtctagaatttcaccccacgttgactttacctgctctagaatttcatctcacatttactgggctcctccctacactcttgcctgagctcctacccttaggtactatatgtataaatatgtgtaacctagtctaaaattgtcatcatctgtagcaaaagtaagtttgcaccatttttggtattatctgctcaaatacaagaactggtaaaatgacagggcagcatggacacaattataggtccataaaaacacagcattactgagcttggtcttcatataagagaaaacaggtggcgcttggttacatgaataaattcttcagtggtgatttctgagactctggtacacccaccacccaagcaatgtgcactgtacccaatgtgtagacttttatctctcccccttccccactactccccgagtcctgaaagtccctcaaagtccattatatcattcttatgcctttacatcctcatagcttagttcccactcataagtgagaatataggctatttagttttccattcctgagttactccacagagaataatagtctccaattccatccaggttgctgcaaatgccattatgtcattcataaacacacacacacacacacacacacacacacacacacacactcacacacattttctttatccactcattggctgatgggcatttgggccagttccatatttttgcaatgcgaattgtgctgctataaacatgcatgtgcaagtatctttttcgaataatgacttcttttcctccgggtagatacctagtagtgggattgctggatcaaacagtagatctactttgagttctttaaggaatctccacactgttttccatagtggttgcgctagtttccattcccaataacagtgtaaaactgttcccttttcactgcatccacgtcaacatctattatttttttatttttgattatggccattcttgcaggagtgaggtagtattgcacagtggttttgatttgcatttctctgataatcagtgatgttgagcatttttccataggcttgttagacatttgtataccttcttttgagaactgtctatccatgtccttagcccacttttttgtgggattgtttggtttgttcttgctgatttgtttggcttctttgtagattctgaatattagtcctttgtctgatgtacagattgtgaagacagtctcccattctgtaggttgtctgtttgctgattatttcttttgctgtgcaaaaccttttttgttgcattcacttttgggttctcagtcatgatgtctttgcatcctgaaactctgctgaattcatttaccaattttaagagctttttggatacgtctttagggttttctaggtatacaatcacatatcatcagctaacagggacagtttgacttcctctttaccgatttggatgcgctttctttctttctctgattgctctggctaggacttccagtactatactgaatagaagtggtgaaagtaggcatccctgtcttgttccagttctcagagggaatgctttcaacatttccccattcagtataatgttggctgtggatttgtggtagatagcttttattaccttaaggtatgtcccttctatgccaattttgctgagggttttcatcataaagggatgctggattttgtcaaatccttttcttgcatctattgagatgatcatgtgatttccatttttcattctgcttatgtggtgtaccacaattattggcttaagtatgttaaaccatccctgcattccctggtatgaaacccacttgatcatggtagattatctttttgatatgctgttggactcagttcactagtattttgttgaggattttggcatcaatgttcatcgggggtactggtctgtagtcttctttttttgttcttaatattttcttattttcattttgcctacacagatcaaaataaatgttgatgtgaatagtaaatctcacatttaaagaaatacaaatttccctttgtttataactcattcatcagttaaacaaatatttactggtcatttgttacatcctagctgatgagaaaacttcagaaaacaaaatctttgctcccagggactttacattctagtggggattacaaatgtttttaaaggattatttattgggtagtgataagtgctttagcgtgttaaaggaatgaagaatgctcaggactgctgctttagataaggctttcagagaactccttcctctgtgaggtggggacatgaacagaggcctaaatgaactgagtgcattacgtggatctaggcagatgggtgcacagctgcaaaggcctcggggtaagagcacacttgtgtccagtgtggtgcaacagtacggtgagggcaacaaagtgataggagaaaaggctccagaaatagggccaaaccaggcagggctttccaagctatgcaaagaacccctgaaatgaggagctactgagagcctttttgcaaaagaggaacatgactctccttacactgagaaggataatctggctgctctataaagactagaccaagtagggcaaaaatcacaccaagagaccagtttaaggctactgcattgatccaaagaagtgagagtgatttagactagggtggtagcaatagaagtagtgagaagtggcccaactgaagacgcattttgatggtagggacaagggagtttggtgaggtagtaggtatggggcagagaaaaagtcaagtcaccacagtgccagcggtttttgatgactcaaggaaaaattcaatcttctcaattatagttctgactaaccctaatttctcttctaagcttgagtgaaattaattaatcctgaatctgccatcctagagaccaaatatcatggaatttatttatagtccttgcaaactttgaggatacagagcaccttcatattaaaagatttttccttctaactcttataccctcccaggaataattcctaaccattaacccacataaatggtgcttatgcctttctgtgccctttcttctcccctctcttcacacttctcatgacccagtcagagaaaaatgttgcacagtgaggacatgtaagtgaaaaatctaccaatggccatttacaatcagggatttcatgcactactggatttactagtcatttcagcctccactaccaccacacatctataaatgtcagtaacaggtgctcttatacacttaagattattcttacatgcatgagtaatacatacactgatgggatttaaaataatcaactgcaaattgggtgtggtggcacgcacctgtagtcccagctacttacaaggctcaggtgggaggactgcttgatcccaggagttccagggcagcctggttaagatgctaagacccagtctcaaaaaaataaaccaaccaattgcataatcatagaacttattttaaacacacacacacacacacacacacacctctaaccaaacataattaagacttctgatgatgcaataaagtgttattttcacaataataattttttttgaaacagggtctcactctgttgcccaggctggggtgcagtggtgtaatctcggttcactgcagcctcgacctcccaggctcaagtgatcctcccacctcagcctccccaatagctgggactacaggcacataccaccatgcccgtctaattttgtttattatttatagagtattatttatacagacgacgtttcactatgttgcccagactggtctcaaacccctgggctcaagcaatcctcccacctcaacctaccaaagtgctgggattacaagtgtgaaccactatgccaggccacgataataatttttctaagccctcgcatattgtacagcttattaaatagtacagactttcctatttcctatatagtctttctacttctagtctttgcccttttccagaacattattttatacctaactttttttgtgtgagcacttactctgttagaacatgcagtaagcattctgcagcataatctcatttatgcatcacagcagcgctgtaaggagggtactagcattacccacattttgcagatgagtaattttaggattggtcagatgaccaaaattacccagaatgacagagccaggagctgtcccagaagtgaggcctctagaagctcattttccaaactagcattacactaaccaccttttagttagttcacctagaataaccctcctaaaatagaaattggatgataccaattctgctaaaatacaatacctagaagcactttcgacacccataaaagagcgtccgaattccttagcacattagggttagcatcatctctaatggaccccctcacttcccacattgctgctaatatagattactggccattttccaaatatgctctatactattccacctgtgtctactctcacgctaatccaaagccttccccctccatcctcaatctgtgcaaacagccaactctctaaaatccaactcaaatgccactctcagttaaattttttcccaaaacttacaacacatacacacacacaattacttaaaaaacagactttttgcaccagcagatcccaaatttcttctcctatctctcagactacaaattctaaggcaggaactgttgtttgtaatcttcatttcctacacagcaactgcacagttactatgcgcagtgacaaattaaataatttcccctatactttttcattttttttttctgagacggagtctcactctgctgcccaggctagagtgcagtggcgtgatctcggctcactgcaacctccgcctcctgggttcaagtgattctcctgccaacctcatcatacaatatacccccacagccaagggtgactagacatataaatttcttggtaaagttatagcagtttagcaagatagctattactgcagactttggagtcagactgcctcggattccaattccatttctagcacttactagctatatgaccttggggaaaaaaaaaaatctggtcaaactgaactacttgctgttccacaaacacactcccagtagttttctgcctctgtaaattcttactggaatgacccttccctaattgtgctacccagccttcagtaggcccatctcaagtaatttccttttctacaagctttccctaggtcttcaataaattcacacagtacctagtttacccttctcacaggatatttatattgccttgtggtatacttacttttagttgaattactcttgcgggccaaagctgtcttgtctctgaattcctttagatacacaacacaagaccttaaacaagtattaagtatttgtgaactaagcaaaaagtaagtaatctgatgatatcagtttttcctcttccttctcacaagccctaaatgcttgagagtgagattaatattttcttttatattttttgtcattatatcataagaaaccactgcataaagcttttctatctttaatatggtttgaaaaaaattttgagtctgcaaaagctaattttatgtaaattttaaagactaagtttaaaagtaacatttcaacagaggaaatagaaagaaaggttcctggagaaatctgggaatccaaaagagaggacaatgtacagtttaactccgtggttaagaatatggacttaggaatgagacattcctgaatttgaattcttgctccactatttaccatcactgcagctttgagcaagttatttaatttccttaacacttcattttttcactcataaaatggggatcttggtacctatgagatgtaaggaataaatgagctcacatgtacaaaatgtatatgtcagtacctgatacacagcttacattcaataaatgaagttaaaattttaaaacaaaaaatattttaattaaaggacatagatacatggtaacttacacttcattaaaacttcattaaatttccttttatttggaaaggtaagaaaaaataaaatttgcatcaagtgttataatagccaattttgatactataaaaacagacaagtagtccaggtgcaagagctcatgcctataatccagtgctttgggaggccgaggtgggagaatcactcgagcccaagaagtcaagaccagcctgggcaacagagcaagcccacatctctacaaataattttgtaaaaattagccgggtgtgttggcgcacatctgtagtctcagctactcagagattgaggtgggagagtcacttgagcccagaaggtcaaggctgcagtgagacgtgatgacaccactgcactccagcctgggcaacagggcaagaccccatgcagaaaaacaagaaaccaaaaacaggtaagtagatactctactggatttagtaaaaacaaagtctatgtaacaagttctcacacagaagcccttcgaagtcacaaaacaataattttgactggatcattcagtaataaaaatcccaatgacatactaaatccaagatgctgcctctccagaaaaagacaaaaattttaaaaagtattcagtaatgttcaaataaatttagactgtgtaaatataataaagcaagaatgaccaataaaaacatagtatttacaaatagggtggtaaatcctggtagggaggaagctgaaagagctgaaaaacattgtttctatagagtagaaatgggaggcaagctgggatagggtcaggagactgttgcttttctttgaaagtctcatgggagtattgctttttaaaattatgtttgcaacttagttgatgataatacaaacttattctaaaggaatgtttattattataattgttttacaggcaggaccttggttagggtgagacaagcaaaccacctatggtgcaaaattttaggagtcaccactctcaaggccaagtacttgaacatacttactcaaccccgcaagtgatacctcctcctagccctgttcagagggctagtgttttaggaactcaacacaaatgtcataacctcaaacaactgagggatttgagctgttacactcacttatggtatgcaataaaatatactgttcaatacataacacatttctaaaattactacctacaaatatacataaaaagaaacctaggccaggtgcagtggctcactcctgtaatcccagcactttgggaggccaaggcaggcagatcacaaggtcaggagatcgagaccatcctggctaacacagtgaaaccctgtctctactaaaaatacaaaaaattagccgggcgtggtggcgggcgcctgtagtcccagctacttgggaggctgaggcaggagaatggcatgaacccgggaggtggagcttgcagtgagccgagatcacaccactgcactccagcctgggtgacagagcgagactccacctcaaaaaaaaaaaaagataaagaaaaaagaaatctagaatgatctttctggttattaatgacagttttttctaggtagtaagattttttttttggacacacctctgtaccaaaagattttttaaataatgagcatatgaaattgtaataaagtggttcttttaaaataaacaacgttcagctcccaaaccacctctactaactgcacacacacacctacctgcacattttcccatgacaacttcatccacttcaatggcttcatctaccacctctacgcatgcaacttaagtacaaatccatattcttcaactctctagccacccaactccctcaactttcacttccacattgccaattaccccctacatagcaccaaatgaatgtttcactggcaattcaaagtcagtcaaaaataaaccatcatctgtccacatatactagctcatcctcattattttccaatgtgcattaagactaatgcaataaatccccaagtccctcaggtttaaaacccaagagctagttttaacttccacctctcccttactccatatataaggtttagaaatctgtcatccaacttctgtaatttgacatctagtctacctctcattcccagaaacacattagtttccttttcataatctatgtcctgaaatattactaacaatcataaataagtaaatatgatacagtactatcctcaatacaaagcataaaacatggcaaagaacaggtaagcaacaaatgtttctgaataataagtggaaaaaaatagtcttcccagctcctatctctcctacctccaccaaaccattctgcagatattccatcttcctaaaacatagttctcatcaagtcacaagaaccttcatttaccaatgtcacatgaataaaataaaaattcctcagcttggcattcaaccattccaatatgaggactctttgtctctcctccaagttacatcccaattctaatccactagatacctgctttgttttcccatctctgtctttgttcatgtgccccataaaatgccattatcagaattttacctctcagaattctaccattcaaagcccagcgaaaatgtcatcttctccacccccacaagcccaaagtaacccgcactttcctgtattagagctctcgtagcactgtgacactttcttgtgtcaccatattgtgatctggaattaaaattatttctcaatatgttgcatttactaccaaatgtattttaagttccttgtgaacaagtacagaatttttacttatttatctcctattatacctaatataatgcctggcacaacagaaaataagagacctgtgcatcaataataaaatacaacagcagttgcagtggcaaatttgagttctttataaataccagatactattcaaagcactataacattatttcatttattcttcataacaactccatgaggatggtactattatttccattttgcagataagaaaactgagtcagagtgagaaccctgtctcagaaaaaaagaaagaaaactgagtcagagagataattaactttgtcaacatttaacactattcctcaattgtataaataattctgcaaataatgtatctgcatatatggttagttccatattttgcactatttctttagactctaaaaattataacattcagtcaaatagtatggatgttgtaatggtctttcacatttattttttaaacgttttctaaaaggattaaccattttataaagctatcaataatgtacgaaggtagaagaaaacctaggcattaccattcaggacataggcatgggcaagaacttcatgtctaaaacaccaaaagcaatggcaacaaaagacaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaaacaaacaaccccatcaaaaagtgggcaaaggacataaacagacacttctcaaaagaagacatttatgcagccaaaaaacacatgaaaaaatgctcaccatcactggccatcagagaaatgcaaatcaaaaccacagtgagataccatctcacaccagttagaatggcaatcattaaaaagtcaggaaacaacaggtgctggagaggatgtggacaaataggaacacttttacactgttgctgggactgtaaactagttcaaccattgtggaagtcagtgtggcgattcctcagggatctagaactggaaataccatttgacccagccatcccattactgggtatatacccaaaggattataaatcatgctgctataaagacacatgcacacgtatgtttattgtggcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatctcaagaacaaaaaaccaaacaccgcatattctcactcataggtgggaattgaacaatgagatcacatggacacaggaaggggactatcacactctggggactgttgtggggtggggggacgggggagggatagcattgggagatatacctaatgctagatgacgagttagtgggtgcagcgcaccagcatggcacatgtatacatatgtaactaacctgcacaatgtgcacatgtaccctaaaacttaaagtataataaaaataaataaataaataaataaataaagatcacaacagaattatcaacagattaaaataataataataataataataataataataataataataataatgtatgaaggtaacaattttattgcctcctatcagcttagtatatcaccattattttcccattctcctggttcaagtagccaaagaatgacatgcataattcattgtgttaaataatagtgcctttaaggttacgaccagtgtttaggggtggttgttgctagtgttataaacaatatcttaagagctactatgcctaaataatttattggaagttatttcacagtattttctcagataaaaggaaatcacttaacctacaaagatattcactaaacctttgataatatttgattcattcatttattcaatggatattattcaatagattagctattcattaaacatttatttatagctcattggaatcagaaaactatactagtccctgggaataaatcaataaaatacaatccctgccttcaaggggaatgagaattttttaagcatcagagtcatcttgagcttggggaaattggttcaaagatcagaaactcatttaaagaggggtccccctcatgtcagttgtaacacagattccaagaaaaagtattctatttcatacagagaaacgtacccaaatgtggcagaactaacgaaaggtcaaaaatttcaaccaaagtatcatcaaataagggactcagttagaaaaagtaatagctgggataacacaatctataaaagcatgaatagtccatagactttgggtcatcaaattcaaaaatataaattagtaaaatgttttgataatgaataagataagtaagaaaaagataaattttacttcccaaagcatgaaataaaattatgaaagccaatacctcgaaatccaataaaatgaaccaaaaaggttctggaaaaaattgacacaaagctataaatcactagtcaaagaaccagggcaatacttaacctttacgcgacaatcagagatgaaaatcatgctctcccatagcagtagactatttttgactataggtcactagtggcaattgaatgctgagattaaatctttggtttgatccattttagcaatttctattcgaccttctatctctgtaggcatttcaaactaattttgcagggtgatcaattataacattggggtgggattttaaaagggcctatcctctgcctgttttcctcctctcaaacgtgtctctaccatgaaccatgctgttaaaataggtcttttaagagaagatgtgtatcataatatcagtgtttcagtttggaacctgatggtagctgatttcaccttcacattcatttcagcttaaaggcagcatttcccacagagtacctcttttttcctcactaggtctaccttccacgctctatagtaaatacactgacatagtagcaagtctcattcatcatctggccacaggcccagccatcctttgcatctagtaaattgttaataatgtatattaaatgattaaaaacaataaaatgcttattccacaattctcaggagtagaaaattattacgcccccatataaacaactcttggttaaagatcaagtctgtttacatgctaaaagtataaatgatgtgcagacccagttttgttcatcattcaaagctggatatgaggcaagttgccagcagtgataagatcttaaactgattaagttcattcctatgtctgtcttctcatgtattcatacttcctgtttcatgacttcaaagtaaccagtaactacttttttaaggattttaaagacacctcacaaacaacatacatcaaaggaggagaaatatacaactattctgacaatacttcctccaaaataaaaatgtaccaaattatattaatctgccttcaaagaaatttatcttaaaaatatgtttatttcatcttccagtttatattaaaggaaaaaaagactttcttttacatcatatgaaaggtatgatacagcaattttccatccatcttttgaagcacatttttaaaacattaaaacactgcagaatt

SEQ ID NO: 583 - DNA, 40001 bp, Homo sapiens
gaaccatgtcccaacaccgatgtcaagagttctgtccaaatgcacctaccactccatccttgtctacctttctgtgcacccaaatgtttacataaatgagtttgtcccactacttaggaatatttagggacaaaacccagaaagcttcttggtctgagtctctgagccccagcctccagtgtccagataggagaagggagactccctcaccttcttgatgaggacaaattcgttctccatctctgtacgcttattgatctcatcctcatacctgtgaggaaaagacttacaattagaggatgaaggcaaaagggaggttgcccttggtcttttgggagacaggggcgttgtgaaaatcaggaaaattcagttcacagagatgcaggatatgagaaggctggtccttctgccttccccagctgccctctccaccctcacccctcccttagcccgtgggaagcaggaaatctctctccaaatccatgaatacacatcggattggacaccttgagagtgttaacagcagggcctgacatgagacctcagacagaactttctagagtttgctagaggtcaagggtcaagactaaagaggggccagaatgttaagtacaaaagtgaggcccacaggctgcctatctctcccgtctcaggtttaccatgtcaacattgacacataatttgttcttcaaatccagacagttgagattgaaagggggtgggtactatcaacaattgtgctaggaacctgggcataaacacagactgttccgagcaaacctcatcaggtggtcaccctaattagataggactgcacttcccacaacagagggccatggggacttagtcccaaggtcccaaggggtggaggagagcacggtgacttcagttgggtggagggtgggagttgctcacttgttcttgaagtcctccaccagcccctgcatgttgccaagctccgcctccagcttcagcttctcctggcccagagtctccagctgccgcctaaggttgttgatgtagctctcgaacatgttgtccatgttgcttcgagccgtcttctgctgctgcaggaggctccacttggtctccagcatcttgttctgctgctccaggaaccgtacctatacgaaggaggagagagcaaaaaggtctacatcaggccagggctcaaagtctggaggaaagcaagcagtcttttctcttaattcactcctcaagcagtaaggtctccagaccccaggcacctggttagctgttctggaaagatcacctatgaccagggggagaaagcatggcatgatggtgaggtggggagcaatgtccctcagcattgggtaggggaaggagacaggtaaggtaattatgttaaagctgcatttgcaaaccaataggcctaacttcatttacataggttgtatattacacatcaataaaaatagccaagctttctttgggagtctccggcgcccaggctggagtgcagtggcaagatctcagctcactgcaagctccgcctcccaagttcatgccattctcctgcccctgcctcagcctcccgagtagctggggctacaggcacctgcctgccaccacgccccactaatttttttgtatttttagtagagacagggtttcaccgtcttaggcaggatggtctcgaactcctgaccttgtgattggcccgccttggcctcccaaagtgctgggattataggcgtaagccaccgcgcccggccaaaaatagccaacctttctaaagatgttaagattgaaaaagaggccgggcgtggaggctcacgcttgtaatcccagcactttgggtggccaaggcaggcggatttcttgaagtcaggagttcgagaccagcctggccaacatattgaaaccctgtccctacaaataatacaaaaattaaccgggcatggtggcacgcacttgtagtcccagctactcgggaggctgaggcaggagaatcgcttgaacccaggaagcggaggttgcagtgagctgagatcacaccactgcactccagcctgggcgacagagtgagactctgtctcaaacaaacaaaaaaacttgtaactccttctaaactggaggggacagaaatcttttaagggtacagcctagttccctccaccactctctgcaaatcgctttcttccccaggtcattctgccccaaaattattttttaaaaaaaagtgattataacatcttatcctaatggaatgtgggccaagcactgctgaactctttacatatgtaagtttgaataggcaaaaacttttgcctatatggatttaggggctctcatattcattttatagatgaggaaataagacttggcaagggagtccataaccaggaaccggcagagcagtgcgaaccaagaattcagattccaaagcctatgcttagctgctctctataaggaccccagggctagcaaaacgcagtcaacaagtcaagtccaggcgcttggagcgccaagggcccccgaccactgggttcctggggctccggttcctcccggcttactctgccccaggatttccctcctcccgttcccacaatgcctcccaggagccagtcagcgtgaagggcccaatcctcggggccgccgggggcccggggcccctcaggcagcggagtcccagggctgcaaaacccggcctggctcctgctgtgtgaaagtggagccaggccgctggggcggagcagggacaggacgcgagaaagggacacgggctgaatgggcgaggggcgttggtgggcgaccgcgttatctgaagccataaacttaacaggacgtaaaccccgggcggggcgtcccacgcccgcagactttgaatcctgcatgggctttccgaggccaggccctggcgcctcctccaccccaccccagcccaccccaccccaccccaccccacccacaccgcccccgacgccgagctccgccaggtggaggagagcgtcccgagactgctgcccgcagcccctcaccccgccctcggccccgcccacgctgccggcgcaggggccggggtatgactcattctgtgacccccgcactcaggcctccgggcgccaaaggcctcaatcaatatttgcccgtttgaaccgagacacccacttccttctcctagaatgctagaatcacaccaaacccctatgtaaaaaaaagaaaagaaagaaaaaaaatcacaaaggcaccactggggagcccttggggtagtgctggcgaagaggcgaacctggaggagggtagtccccgaacagctgggactgccgcagggcgatagcttaaaagacggtcagaactcgggttggggtgagaacaataaccgctattattttttataatttggggacagaatgacctgaggaagaacgggatttgtagagaggggtggtgggaactaggctgtacccttaagttgtctctctcttccaagaccctccagtttaaaagggaagaaggaagccccaggattcatcccggctgtccagaccctctccccaccctcacccagcccaaaccaaggtgcacgggaggggtgagtcggaggatggaagggagagtgtcgccagggcgggtgaggcccagcaggacgccagctgggggctggagatgtgcatagggaccgggactaccaggagaaaggggctgcgggcacagtcagccacgcaggggggaccctcaccttgtctatgaaggaggcaaacttgttgttgagggtcttgatctgctccttctcctgggtgcgcacggcctggatgttggggtccacctccaggacaagggggctcagcaggctctggttgaccgtaactgcggtgatgcctcccatgccgctggccccaccatagccgccgcccaggccaccgcgaaagttgctgctgcccactcgggagaagctcgaggagctgatgcgggaaccgggcccactcgtgtaggagcggctgctgaaggcccgggggccagaggtggacaccttgtaggacttctgggtcaccctgatggacatggtagaggcaggagtggaggcaggcgggccgaaccaggcggagatcctagaaggagcggagaagctgcttcttggtgaggagagctctcaggaatggccttttataaaagagatcccagccccgggggatgggggggaaaggcctcgtacctgagtggctaggcccagagggggctgggcctaacccgtcacctgccacctccgggcaggactcaggtgggggcagcagagagctgccgccacccaagggcccgttccaaccctggagcccactccagcaccacccccagaaacccaggaaaaggcagttcagtgaatatgaaactggaagaaatcctgtcctggcacaagtgcctgtaacaagcagacttgcctgggccgcccagccactacaaccctgactcctgggtcttgtctccctccctcctgggggaaataaactggaggactgggaagcatgggaaaaaggggtctcctagtatttgggtctcctctgagctgccgacaccccagagaaactctcctgtgttctccctgattgaagcgattatgagggcctgcctgagctggatgacagaacagctggagtccaaagccttgaatctgaaatcaaccatttgcctcatctttccaggttactgttctacccctagcacctggtgcagtgccaagagggtctgggtagatatttgtggaatgaatgaatgaataaataaatgagtgaataaacatcacacgcgcacacacacacacacacacacacatacacatacacacacagtggctgtcgtccctctacatctgaaggtgcaagataaaaagagatccaaggccaggcacggtggctcacgcctgtaatcccagcactttgggaggctgaggtaggcggatcacgaggtcaggagttcaagacaagcctgaccaacatggtgaaaccccatctctactaaaaatacaaaaattagctggccatggtgtaatcccagctactcaggaggctgaggcaggagaatcacttgaacccgggaggcagaggttgcagtgagctgagatcgtgccactgcactccagcctgggcgacagagcgagattccatctcaaagaaaaaaaagagcgagatccaacacagcacttttcctgaacataacccaggggcttcctctccttccaagatcctaggatcccctgggccaggtgaacactgtaggcctcactgaagggcctagagaatgatgaacagggctagaaggcagagaacgcaggggttggggggggcaagaggagatgggagctatgtcagggacttcatagttcttgctctttgcgggagtcactcccattgctcccagtgagtgaatcatgggaagtgagacaggacggcagggggtacagtggagtggtgtggcactcgtggtgctacctggaccctcctgctttacccaggctcccaacgggccagaggaaatagaggaagagtccctgcacctgtctcccattatcaaagtgagtcaggagggcaggttgggacgtagcacgcacctgtgggaggttggagattggggagctgagcaaggcaccccaggcctgggtggggccaggcagggcatgctgtgggtggaaggcaggaggtttaggtccccaaggcagagattccacctgcaattacctgatggctggggctgggttctctggaagatactgcagggtgtgatgtggggactggatgaaactgaactcagaggaccaacagatgacagccagatccccttgaggagagggacaggtgacatagccctgacccagggaagggggtgaccacctactgggaggacagatgtacagtttcttccccatccttctctaggagagacacccaggctcacagaaagacaggcacataggacccctacccagaaggacagagagacccagaagccccctccttggaggacagacaaacttaaaaagacagacacacagacaagctctcttcacaatgcacgcgtgcatacacacacacacacacacacaccccacacattgaagtcccttccagaaaaatgcatagatcccaagagcgggcacagtgagtggctccttcacctcccctcccctccccaggccctgcctcctgctatgctgaatggagcaagggaaattcagttagcacctatttacaccaggccttctcccagctcctttaaacaatgcctaattttcccaagagtgattggaaggcatgctaccccctccccaacaaacacccgcacccaccagggctgagaagcttttaacagaagaccaaagggagaaggactgggcccagtgccaaacctgggacagggaaggcggaaggagggagggaggggctggtcagacgggtatggcagccctggaaagggaggacaggcgctctccctatcttccctcccccacgctgctgttagagggagcagggggcactcaggtcctgatctaggcagcacaaggagcaaaaaaacagcaccccaaagcctttcctgaaattccagtcccctccaccccacctttctggttccctggttctaggagtgtcccttgtttaaggtgaggacagagggggttgccagggaccctgcagtatgcaggctggagggctgacccagaccttacccagccaggggaagccctttttttctggggcagcccagaaccgtctagggccagaagtgtttgtgtctcatttgtcatctctctattgcccagagaccccagccaaaccttcccccagatgccccaagcacagcctcggtgcaggagaagaggccagagttggcctctctgatggcccctgcctgggacttcagggttaaaggcagaaggagaaggcccctgggactagggccaagtggtgagggaagagagaaccagactggagcaggcccacaggtacaactccttgtaaggcattgtggtctacacacagctgcctgccggacaaaagggaacaacgtgtttgcggtgcctgccctacccagacaactctgcctcaaaccgcctttcctggagagtgaaccagggaaggaggagacactcactccctgtgggccaagagtgagggccaggccccctacttctgatggtgcaggataattcagagaaggccctgagaccctgagcagtggcattaagtcttggggccagtggggtggggaggtagctgttatcatcactcatgatcatgggaagagatggtctgaacaagtttttttttttcttttttgagacggagtctcgctctgtcacccagactggagtgcagtggcgcaatctcggctcactgcaagctccgcctcccgggatctgaacaagttttgcttagagatcaggactgatgatctcattcgctgcaaccttgttcataatagccaaagagtgggaacaaaacaaatgtccaccaaatgacgaatggatttctttaatgtggcatatccatacgatctaatgttacaattaaaaggaatgaactactgatgcatgttggatgcagatgagccttgaaacccgtatgctcagtgaaaggagacagtcatagaagatcaggtaccctatgattccatttatatgacatgtgcacaacaggcaaagcatagagacaggaagtagattagtggttgcctagggaggggaggaatggagatgaatgctaaagagcacagggtttctttctggggtgatgagaatgttctaaatttgatggtggtgggcaggcacaatggctctacctataatcccagcactttgggaggtcgaggcaggaggattactttagcccaggagtttgagaccagctgagcaacataatgagacccccgtctctacaaaaaatacaaaaattagccaggtatggcggcacacgcctgtagtcccagctgccctggaggctgagttgtgaggatcacctgagccccgaaagttgaggccgcatgcattgagccaagactgtgccactgcactctagcctgcgtgggagacagagtgaaactctgtctcaaaaataaataaataaataaacaaatttgatgatggtgaagctgcacaagtctgtgaacatactaaaaatcactgaactgcaagcttcagattgttgaattatattgtatgtgaattacagctcaacaaagttgtaacaaaaagataaccacaaaagcataaatgagctacatataaaaagcaggggctttgtgcccagcataaggggtcaggggaaagaagcaaagagtttgtttagatgccccaggtaaagaggcttcctgcctctgggttaaggcaatgcccgaaaagcacccgaaatccctttaaatgatggagcattttgaaatgttattattggtatagaaatagctgcatttagcatagagacagcagaacaatttgtttaaataggaagccacaggtggtgggtacacccctcaggaagcagcatcatgaataatagagtcaattcgattgctaattttgtgttatgtgcctcaaggctaaaatttttcattgtcaaagcttagcaaatgctgacttttttgctcttgatcagtgatggatctgatgattaaagccagccaggatggaaatggactgcctagagagggagcaacctcctgtacctggagacatggagagggaccttgctcaccagctgtccactggctcagtgggagggggttctcacatctgctagggtttgaattagaatgtccaagtcccgccaactctgaaagcttttgatccacatccaccaccatagagctttacgcactgaagatgaaaatctgtgaatgttctctggtttgaaattttgcttgtgataagagatatgattagaaattattagaacaagagtgagggaggacagcacagccttgttgtggaggaaggagacacaagcccagcagcctgaagatgttgaggtctcccacacttttttttcttttttttagagacaggatctcactatgttgcccagcctgactcgaactcctggatgcaagcaatccttctgcctcagcctcccaaagtactagggttacagcgtgagccactgcacacagcctttctcacattttcaacattctctcaccctcctctccactgatgccaaaccaagaaggtcatcccactgggtgagcatgaagcctaggcggaaggtcccagctatggctcagtccacagagtccttccccttaactctggttctccatcacatcaagatcgcccgtgggagattataacagtatacgtgctcaggtcgcaccccgtctgcattttcaaagcttcctcggtacagccagagtcaggcaccaggctttagctctggtcccaacaccaagacctttaggaacacactttcttcctcttcccagaggaaataggccagagctcaaatccacagcactgcaggttcctgcttagaaagggtgatatactctgtccctcaggaaggaaaacagagtggttcagtccccagaacctgaaactccaccaccgttggccagggccacagagacagagacagagactgcgagaggacagacacaaatgggtcccactcctgacagtgaagacagcggtactggggacttgagtgacaggaagtggaagttattgagaggatttcaaggaaacttcagaagctgacattgcgataggggaagccctcatggtgttcaggcaaccggacaggagtgcaggaaaagaacaaacaggaaggacctggggctccgctataggcatcctgcccacccccaccccagccctgaggattcccctggcctgagctgcttagcactggagctgatatccagaggcccactgttttgattttcctgctgggcaacctgaggactaaggtgggagttggggacagggactagaggcctttattccttcctgtattcaccttttcatttatccacatatttgcttatcaggcagtagtctaaaaaatttcaggagatgaagtatttgggtcctctcaaaccaaaggaggtaggagtctcctttgaccaaggcaaggtatttcctgaaagtccctgttgagaagtgaccatcaggccagacgtggtggctcacacctgtaatcccagcactttgggaggccgaggcgggctgatcacctgaggtcagcagttcaagaccagcctggccaacatggtgaaaccccatttctactaaaaatacagaaattagccgggcgtggtagtgggcacctgtaatcccagctacttgggagactgaggcagaagaatcgcttgaacccaggaggcggaggttgcagtgagctgagattgcaccattgcactccagcctgggtgacagagtgagactccgtctcaaaaaaaaaagaaaagtggccatcagtaatccttcatcattaaatcagcatattgatggctgactatatactgggcacatgctgggaagacactgagggaatcaagtccctaatggcctttactgtacatcagggggagacagacagacatatagtcacttattccaatactgtaacaataacacatacagtgcaaaaaaaatgccttacaaatattaattcatttaaccttcgtaagaacactataaagtaggtgccataatctctatttttaccagatgaggcacagagatgttaagaaacatacccaaggtcatgcagcagtgtggctctttttccatgctcctaaccactatacacacttccagtataacgatggagaacaagaaaagtggtatgggccgggcgtggtggctcatgcctgtaatcccagcactttgggtgggtggatcacttgaggtcaggagttccagaacagcctggccaacatggtgaaaccccatctctaccaaaaaacaaacaaaaaaattagccaagtatggtggcacatgcctgtagtctcagctactcgggaggctgaggtaggagaattgcttgactctgggaggtggaggttgcagtgagctgagatcgtgccactgcactccagtctgggtgacagagtgagacactgtctcaaaacaaaaaaaggaaagaaaagtatttgtgtttttaaaaagtggtctggcagtttaacaaccaagagactgtcctcagagcagcaaccaggcacctaccacagggcaaggtctgagggaaagggactgagggcgggcacattttgatggaaagaggagcagagtcacagcattgggcccaaaggtcccccaagaaggcaggaggactcctgcagtggggaaggcagcagaggggagattccttactgcagcgttgcttgaaatcagtcttacctctgatgaaaatttctgagtctctgttttgcaacccactcctcccagccccagcctcttggaaaagtcccctttacaaagagagcccttcatggtttagaaaacacccctcagtcatccctttaaaaacccacaactcttggggttggacagaactgttgaatgtcctgacaccctggaacttgacaaagcatcccaggtagaagccacacttgcatgccctagcacagatgcccaccctaggcctggcccctttcttgctttcccaatccacgggaccagtgacacttccatgcctgatacagaagacaaagttgcataggactggtgaaaagacgtgggcaggggatggtcctctgcagtcgcctggcctccatgtctcatcccacctgacacagagaggcagccacagtttaggctattcccagccttttccatggccatggcctccatgaaatgataattcgtgtgtggcaggctggggcaaatgaaagggtctgctgaagagcaggtgtggtcaggccaggggctgtggacactcagagagctgatggcctaatatgtctcacagtcatagccacttagcacaggcagcgtgaccaggtacacaggcagcgtgaccaggtaccctggctgggaagcgcttgcttgcagaaagcaacctggttttgtgaaatgaggagctaagggaggagcaggaaggaatggggagccaaaagatagttaaaggcctgcctgccttgggttgaggcttgggatcaagggcactcatcagacctggaagccataaacatccaggtatcagaggaggctcagccgaggttaatcacccaccataaaagcaaccacagcccatggagagcagagtcaggtggcagggctcctcaaaagtgagccgccccaaggccagccctgcccaccccatccccacctgctggagtggaaggaagcaatgactccaaccttggtgaaatctggccatgccccaacacacctgtcagtttcctcctctgatattgcagggtggccctaacctgattctggtattccccgcttcaccaccaccgtcaacaaaagttttatgattctatgtacctttcaaggactctaaagaatctggcttcagactgaaaacaatgagaattttcaggagggcagaggtgcatgatgataagcaggtgtttttgagcacgtgtctttatatgcatgtatccatataaatacaaagcacacatgtttgatgggttatctcccagaacaaacagcctcacaggcccaccccccaccctgtgggcacacaacctcagcctatagcacacacgccctcttgtccctcacacactctctcaggttcacacacaccccacctgccctctcacttgcatggcctgacgcacacgccaaggtgcagtaccacctcacatcctcatctcaggcacaagcatgtgcgtgtaccacccgtcagagtcccgtgcacaccaccttcctacgaacgtcacacacatacctgtgcacacacagccatatataacacacatccaaactcaaatacacggttacaggtttgtttgttttttcttttatacagacagaggtttcactatattgcccaggctggtctcaaaatcctggcctcaggctgagagaggtggctcatgcctctctaatactagcactttaggaggccaaggccagctgattacctgaagtcaggagatcaagaccagcctgaccaacatggtgaaatcccgtctctactaataatataaaaattagctgggcatggtggcaggcacctgtaatcccagctactcgggaggctgaggcaggagaatcgcttgaacccaggaggcaaagattgcagtgagccaagactgccctattgcactccagcctgggcgacagagcgagactctgtctcaaaaataaaacaaacaaaacaaaaaaaaaatccaccgggtgcagtggctcacgcctgtaatcccagcactttgggaggccgaggcaggcggatcacctgaggttgggagttcgagaccagcctgaccaacatggagaaactgtccttactaaaaataccaaaaaattagcatagtatggtggcgcatgcctgtaaccccagctactcaggaggctgaggcaggagaattgctcgaagccaggaggtggaggttgcagcgagctgtgatcataccattgcactccagcctgggcaacaacagtgaaactccgtctcaaaaacaaacaaaaaatccttgcctcaagcaatcctcccaccttggcctcccaaagtgctgtgactcccaaagttacaggtgtgagccccagctcccagccaaaggatacacattcttgattgcaagtggctgaaacccaactcaaacagacttaagcataaaaagatcatttcttataattgagaagttcaagggtgcatttggctttcagcctagccagataaggggctcagtgatatcatcaggaccaagactctcttcctgtcttttggctattttcctccatgttagcttcgtcctcgggcaggccatctccctgctgcaggaagggcgaccactaagggagcacctctttcccgatgcttcctgctgaagttccagggctgactctccaaggctgatataggtcacatgctcatctctgaaccaatccctgtggccaggggaatagaatactatcatgttgactagactagaccacataacaagaccctgtggaggggtgatcagccccacccaacctatagagaaaggggaaaaaaaatgtgatttgggccaggcgcggtggctcacgcctgtaatcccagctctttgggaggcagaggtgggcggatcatgaggtcaggagatcgagaccatcctggctaacacagtgaaaccccgtctctactaaagatacaaaaaattagccgggcgaggtggcgggcacctgtagtcccagctactcaggaggctgaggcaggagaatggcgtgaaccccaggggacggagcctgcagtgagccgagatctcgccactgcactccagcttgggcaacagagcaagactccatctcaaaaaaaaaaaaaatgtgattcaccaaaagaccaggaagaaatgctggacagggccaggaaccatgcctcacgcctgtaatcctagcacttcaggaggctgaggcgggtggatcacctgaggtcaggaggtcgagaccagcctggtcaacatggtgaaaccccatctgtactaaaaatacaaaaaaatcagccgagcatggtggtgcatgcctgtagtcccagctacttgggaggctgagacaggagaatcgcttgaacccaggaggcagaggctgcagtgagccaagatcccaccactgaactccagcccagcctgggtaacagagcaagactccgtctcaaaaaaaaaagaagagaaaagaaaagataaacaaatgctggacaggcagaaacaacagatgttcactacatatgctaaccaaaatgtacaccaataaagacgtggaaccagagaagccaggtataaagatatccgtgtacacaccgagcccttctataaatacaaatactacctggccaaagtctaccttctgtaccttatcaacggaatattgatttcagataaataaatgattcagatgtatgctataggacttcaggggaaggagagagcccttagatcaagctgagcttaggaaagtaagatatggatggaaagatctggaaatgtgataagccactggacaggagcgggattcctatggaagagtagaaaagctagatattggggaggagggtgggactaggggtttcagaggccagacagagctttttctgcaggctgcaggaagggaggagcaggatgatgagcttaaagcagtgctttaggaaaattaagctggctggggtgttcaggatagatggtaggggcaaaaactaggggcaggagactagaaagggggctactgcagaaagcaggtctggaggcctgcagtgtggtaggagcaggaagatagggatggactcaagctagaaccaacaggaggtggcagttgactgcatgggcgtgagtccaaggtcactcagctgcacttctagcagctccctgctgaaccctagcaccttctgttccagctagactgttccatgcacttgccatgagccactgggcttaccatcgtgtcatccaatcagttttagacacagctccttggagacagagcaggttcctccagcgtctgtgtctggttcctgtctcagtgccagcatctgcccagcagggtactggcccagagtagatgctccagagtaaatgtatagaccctcccctgaacatgcagtttatacttgcctccttagcttggttcatcccacacacaccccttcactctggtaacagcacgatgaggctgtctcaaaacccaccacagtcctcagcagcagaagcaagtgtggacaagcccgccttctcgcatgctgaccatgctggagcagggtatggcttttgtctgactcttaggactgactgatgcaaggaggtgcctgggatagagaggagaatgggcaccatattccagtgagacatagcgcaggagctgggagtgccagccctggagaagaggttcccaatgtgtatagaacctcaggactgcctggaggaataggggacattcatcggtgtgacccaagggatataaccagcaccaataggaaggattcccccagagagagacttctgctccctgtaatcaaggacttcccaaaagttggagctttgtgaaaagagagtctgcggccgggcacactggctcatgcctgtaatcccagcactttgggaggctgaggtgggtggatcacttgaggtcaggctttcaagaccagcctgaccaacatggtgaaatccagtctctggtaaaaaaatatatatatacaaaattagccgggtgtggtggtggtgcacacctgtaatcccagctacttgggaggctgaggcaggagaattgcttgaacccaggaggtggaggttgcagtgagccaagatcacaccatcgcactccaacctggacaagagtgaaactccatctcaaaaaaaaaaaagaaaaaaaagaaaagactgagtgtggtggctcacacctgtaatcccagcactctgggaggccgaggggggcggatcatctgaggtcaggagttcaagaccaccctggccaatatggtgaaaccctgtctctactaaaaatataaaaaagtagctgggcatggtggcacatgcctgtaatcccagctacttgggaggctgaggcaggagaattgcttgaactcgggaggtgaagtttgcagcgagacaagattgtgccattgcactccagcctgggtgatagggcgagactctgtctcaaaaaaaaaaaaaaaaaaaaattcgccaggcgttgtggcaggtgcctgtagtcccagctattcaggaggctgaggcagggagaattgcttgaacctgggaggcataggttgcagtgagctgagattgcgcctctgtactcagcctggatgacaaagcaagacttcatctcaaaagaagaagaagaaggagaaggaggagaaggagaaaaagaagaaggagaaggagaagaggaagaagaggaagaggaagaagaagaagaggaagaggaagaagaagaagaaggagaggaaggagaggaagaagaaggagaagaagaagaggaggaggagaagaagaagaagaggaagaagaaggagaagaagaagaggaggaggaggagaagaagaagaggaagaagaagaagaagaagaggaagaagaaggagggggagagggagagggagaaggggaagaagaagaagaagaggaagaggaagaagaagaagaagaagaagaacaagaagaagaagaagaagaagaagaagaagaagaagaagaagaagaagaagaaacaaaacagagtctgcgtcaactgggaagttcatgaggagggttcaggcagaaggtcaaggggcctctactgtatcagctgggttgttggagcctcagaaacatgcaggcctactgtatgcgctgcatgcatcacctcatttaaattcataaagatcccaccaggccgagatggaaaagtgcctacattcacacagctgtgaagggaagaactggcatctgagccccgccagacagacgccgcgcaggtgcagctgccccgagcctgcccatgcatgttctgctgccccaaagccatgtgtgaccaaaacccaaaggacagagggtgcaaccagaagaatttcgcagccacttcctaatggtgttaagagttacttcaccagctgaaaatgcagatagtaacaactacctcagaagactgacatgatcatcaggtaaggaacagtgcctaaaatagcaggttttcaagacatgttagcttgactctcaccaaccctccctgcttgtcccccagcctttcccaaagcctttctccacacaatttcccccattccctcaccaccttcagaccaccctcccccatggaacttgtgttcacatcactttgatacatttgccttgtgagagtttaagccttgtgtttccctgcatgaaataacctccttgcagaacagaacagtgtctgctgcctcttcccagggtaggtggtcaagtggaagaaagtgctagctcagcagggtggagggtaactaggaggtggcaattgggtctataaggaggagcttataggatagtaataaagaaatagcatgtaaaaatccgccattatgcaaaacagaagcttgcaaatccaattcctagggagctagccatgcaaacagagccctgcctactgacgcccacttgctttccccaactctcaacccagggctcctttccctgccaatgatggtggcagtggtagtgattaggattgggaaccatggtgatcatgatgggtttcttttttgtttttttgtttttgagacagagtctcactctgtcacccagtctggagtgcatgtagtggcactacctcagctcactgcaaccttcgcttcccgggttcaagcaattctcctgtctcagcctcccaagtagctgggactacaggcatgtaccaccactctctgctaagtttttgtatttttagtagagacagggtttcaccatgttgaccaggctggtcccaaactgctggccccaagtgatctgctcgcctcagcctcccaaagtgctgggattacaggtgtgagccaccatgcccagccatggctttcattttcagggttcctaccaagtgtcaaagtgtcagatctcttacatatattatatattattttattttattttagtctattttattttgagatggagtcttgctctgttgcccaggctggagtgcagtggcacgatcttgactcactgcaacctccacctcctgggttctcaagctattctcctgcctcagcctcccaagtagctgggactaaagacctgcaccaccatgcccggataattttagtatttttagtgagacagggtttcaccatgtaggccaggctagtcttgaactcctgacctcaggggatctgcctgccttggcctcccaaggtgctgggattacaggcgtgagccaccgcacctattatttataatcctaaactaatccatgaggaaggtaacattgttctcattttacagacaaggaaactaaagcccaaggtcctttggttagtgtgacagagacaggaattgaacccaagtctggagtaattttagagcttgaacattctcttttcaattatgctgttttatagtcaggatccaattatgtccattaagagatgtaataatgtcaataactcaaaagggaggattcaaaacatgtttattattttatttagcaatccaaaagagctatattacatttatttattgagcatctgtactacctctcctacagtagggattctggcagacttgggggacctctccccatcaaaatggacagccccagcccaggcacggtggctcacgcctgtaatcccagcactttgggaggccaaggcaggcagatcacctgaggtcaagagtttgagaccagcctgaccaacatggagaaaccccatctctactaaaaatacaaaattagccaggcatggtggcacatgcctgtaatcccagctacttaagaggctgaggcaggcgaattgattgaacccagggggcagaggttggggtgagctgagattgtgccattgcactccagcctgggcaacaagagcgaaactccatctgaaaaaaaattaaaaatggacagccccatgagggcagagaccttgactatgttgttgaccgtcacatccacagcattagaaagacatctaacaggcactccaccagtatatgatgaacgaattcacaaatggctgaaccagcctgccaggtaagcctgtgcccagccaggcacagtggctcacacctgtaatcccagtactttggaaggccaagggaagatcacttgaggccaggagttcaagaccagcctggacaaccagcgacatagcaagaccctgcatgtgtgcatatatgtctgtaagacagaaaatgagacagagagactctagagagcacgcagctcagctaaagaaaagacctgctacccaccactctgtaaccaacctgcccccaccccattccctggtctctaaggactaagataaccccaactcagatacaatgacccattcataggcctttaggaaaatctgttgacctggatggtgggaatgggctaagcccaggccagcccaggccagcttagcctcagggacctgttagtcaagttcccatggcaacacaactaattgtgtgtttatgcattccctacagaactccaggcagaggccatctattccccaaggccacattctaccttctctctccttccttgcctccccaagtttcctgggtgaccatccagggaacattaagagaagcttaagtagcaacagcagcctccagaacatggaaggcaaaggagggaaagcctctctgagggagaggaccagtacttcttgctcacaattgtccagctgcaaaagtcaaactccctagtcctcctcctggacccacagttctatggcttcgatggctcccacatgtcaccacactaaacctccacccccaggcccccatggcctgaccctatcctacttgactgccagctcctgcacaaactccctcttcacttatgcagtgcacaggcccagggcccctccttcctctctctttgtgtccctctagcctggctctacccccaaggacttccttcaggaagccctcccagatggactattcctcccaggcttctccctccagccctccagcctggagcctctgattgtgcatccccagctgtggccggatctcccagagctgggcatgggttcagctattcccccatggcctagcagtttccttaaggtggtaaagcttttaattcttacagaaactataaaataagcattatctgcattctagagtggagaacactgagcctcaggattaaaagcaatgtgcactgcttggcacagtggctcacacctgtaatcccagcactttggaaggccaaagtgggaggatggcttgaggctaggaattcaagaccagcctggacaacacagcaagaccctgtctatacccctctcccccacaaaaaaattgttctaattatccaggcagagtggtgcacacctgtatttccagctacttgggaggctaagcaagaggataactggagcccaagagtttgaggctgtagtgtaccataattgcacctgtgagtaacaatggcactgggtgacagagtgagaccctgtctctaaaaaaaaaaaaaaaaaaaaaaaaaaaaaaaaaaaaatgtagcaaatgggagagccagaactggaccccgtctgcctccaaagccatgtctctcctccccaccttatacctccctctctccctgaagacagtaccatatggcaggcactccctgtaccataggtttttataactgcatttattcctcacaattaaatctatgaggaggccaggcacggtggctcacgcctgtaatcctaacactttaggaggctgaggtgggtggattacttgagctcagaagttcaaggccagcctggccaacatggcgaaaccccgtctctactgaaaatacaaaaattagccaggcgtggtggcacatgcctgtaattccagctactcgggaggctgaggcaggagaatcgcttgaacccaggaggcagactttgcagtgagctgaatttgtgtcactgcactccagccttggcgacagagcaagactctgtctcaaaataaataaataaacaaacctataaggaaagtacaaataacctcattttacagatgaggagatgaaagttcagaaactttccatctacttcctaagtcatgtagcatctaagtgctaggatcagaattccacccagctcttctggctccaaaacccaaagtttagcttcccagtcccctggatctaggcagacagtctgggagatgcaggaggcaggaaggcagattctgcagccagcatgagagcttgaactgatcggccaacacctctgataaaggaaggtgccttccagaagacctccaggagcttccccgctgatctggggaagctcaggaagcccaggacagctgagtgagggttccgtagccaggctcccagctctctgccctcccactcgtcctgtgaactgaccctccctcacatcattgcacttctgcaaattcctaccactacctccaaagtgctctaggatgtgtgattaaaatcaaagcgttctaaggtttatgatgaaaattaaatgaaattaagttaaatttttgttttgagaattgttttagactattcctagaagaatgtgcagtagcaggaaaacataagtttggaaatcaaatagcctgtgttctagtctcaactcggtctctaaattgctgtgtgacattggacaagttactgctcctctctgagctacagttgcctcatctatataatgaaggggcaggaccatttattcctaaattgttttgttttgttttgttttgtttttgagatggagtctcgctgtgttgcccaggttggagtacagtggcttaatctcagctcactgcaagctctgcctcctgggttcacgccattctcctgcctcagcctcccgagtagctgggactacaggcgccagccaccacgcctggctaatttttgtatttttagtagagacgggatttcaccttgttagccaggatggtctcaatctcctgacctcgtgatccgcccgcctcggcctcccaaaatactgggattacaggcgtgagccaccacgcccggctctaaattatttttattactaattattaatttttgaaattattaaaattacctgtattattacatttaaattaatatggattttagagctttgaattgcctaaagtgcttgcagtgtagtgagaaaagcattatatattttttttttcgagacggagcctcgctctcgcccaggctggagtgcagtggcatgatcactgctcgctgcaacctccgcctcccgggttcaagcgattctcctgcctcagcctcccgagtagctgggattacaggcgcccgccaccacgcctggctaattttcgtattttttcagtagagacggggttttaccatgttggccaggctggcctcaaactcctgacctcaggtgatccgcctgcctcagcatgagccgagttgtgagccacccaccacacccggccaaaagcattatacttaaaatcatacattaggccaggcgcagtggctcatgcctgtaatcccggcactttgggaggctgaggcagacagatcacaaggtcaggaaatcgagaccatcctggctaacacggtgaaaccctgtctctactaaaaatacaaaaaaattaggcgggcatggtggcgggcgtctgtagtcccagctactagggaggctgaggcaggagaatggcatgaacccgggaggcggagcttgcagtgagctgagattgcgccactgcactccagcctgggcgacagagggagactccgtctcaaaaaaaaaaaaaaaaatcatacttgatttgggctctcagcttttgttctctcatatgtaaaataaattagattgaggctgcagtgaactatgacaggccactgcattccagcttgggcgacagagccagaccctgtctcaaaaaaataaataaaaatttaaaaataaaataaattatatgatgataatgtttgtaaagataattgtaaagataattgtaatttgtaaagataattgcttgtataggacactactgtataggacactactgtgatgggaaaagaccatgcactcttctctaagaattcaccgttccttctgtcttttgccttcctcccctcagctaaagggctcctggagtgaagtggaccctcagctgtactctgtggtctgcggcaacagccaacgcacagaggagcatcctctccttaactaagcaccgaaagggagtgaaagggtagactgaaggaaggacttactaattcaaggagtcattggagcagaaatgagtgaccaggaatggggaggatgcgtctgtggaaaaggaacagggctgggcccccttctcactggtcctagatgggatcaggcctgcccagaagccaagaaaaagatgttgtatagacctcaatggggcaaggccgggatgattgaggggataccttcaggggaggaggtgctaggcagttttctgaaaatggtgcgttcagacagctcactatttcctgtagtaattccaggaaaagactgagtaagacaaggtcaggaccgggaggaatgcagctggaggaggtgtgtatgcacagtctccccagggtgagcctgtccagagccataaaccttatctccttcctctgaatagctgggatagctatctctggctcccaggggctcaggctgagtcagggctggaggctgggagagactgtgggccccgaagcatacctaaaactgtgagaccactcagcacttaggtatgaatggcgccatttagggtctgaaatggtcaccattttcagaaacctgctcaacacctcttcccctgcaggtatccccctccgtcatcctggccttgccccattgatacctgaagtgtggcacattcaggaatgagattggagcaaaagggatctctttggcggaggtggggtcaaagagatagattaggatgattcatctccacaaaggctaaggctttagattcctaccagccagccccaggccagaaatttccccttcaaggaaagttgggctccagggctgggcaatactatcacctcaattatccctctgttcctgagttctagggtttatgcacagttcttaatggggcctaatagtttctttgtctcttccagccctctatcttagaggacaggaggtggagcctaccaacaaagggacccaggttccagttccagggctgcgtttctctccccctcagggcccattactctgagctgggccccaggtaggggaggaaggaggagaaaggaggcagtgttctcatgttctctgtgtccctgagaaattccccacctccctttcaagctccctcctagcaggctggtgagacctgccctggagacaggctggtgcgagaggccccctctgcagagtggaagggggtgacataattgcctgtcctgagacttctagacatgtacacactgtccctctgcctggtgtgtccctgccccccgccccccaccacctctcctgctcgctcaggtatcctctccagtgcccagccagactgatcttctacaaacactgctttgatcctgtcactccctagcccagagcttcccgttgccttcagaataaaggtcaaattcctcatctggtggctgaggcttagccttccccacctggcactagctgccctccccaccccacccccaggactgtgccctcctctcctgaagcacctccttgtcacctgcacctgttgaaaccttacccttcctgcaggtcctggctccagctcaccccattcattccgcaaacatttgctgaatgaaaatcatgcatcaggcacctccccacaaagcctgccccagtcacctctgccggaagtggccactcctatagagaccccaagaatagggctttgttacacccctgggctgggttacacttgctgtgggcatgtctgagctcccctccctgattgtaaacctgatccacagtcatttagcatgcactgaacatccactattaatgaggcattttccatatttgtctcatttgaccctcacaaggaccttgggagttcagtcttcttatccttatttacagatgaggaatccaaggctctaagaagtaatgtgcccagcaagtagtagtcagagctcaaaccggagtcctgtaccctaagtccagggcccgcacatcagcgccaaggcatcttcctcaaaagtaggggcgtgtcttatacatgtttctgcttccctccacacccagcacaggaacttgtttgattcactgaatgaatgaatgaatgaatgaatgaatgaatgaatgattcaattctatcccatgagtcctcttctctactctgaccctatctcctctctcccacattgcttttttcctatcttctgtcccttaccctggaccccaaggattccccccaagggaggaaagaagctgtgattgtttcatggataccagagatgggagctaagcctcagaagggtgtccacagcctggacacaccccagggaggagattcaggacaggaagaccccttcaccttcaccaccactcagtttgatagacccaggagagttccagtccttctctccacccctccccaactccagcaggaaataggtgggcccaagggagcagcaggacaagccagagaacagtgagagggtgaagaggggcccagattcagtgactcaccacccttgggcctcccctggggaaagggtggggagcctggacacttggaattcctgcctgtccctagggagacacttgggtgttaggaggctgaacaggaggaggaagagctctgtttgtcccaaactaaggggtggccatggcaacaaggccagagccatcagggctgggagcaaaggtcctggccaggggtggagtcgcgagggccctgctgcctgcctgccaactgggccactgtccacaccatgccagccaggccttctctgactgagcacccccttgtgggcagagccgagcctgaaatctggggatgggcagtcctgagggggaagccacctgctttacagacacacatgttcttgtcctctcccagtccctccatgtgtcttctcaactgcaaccagagacagacagcctctagaacagggagtgctcagccaggcgcgatggctcactcccgtaatcccagcactttgggaggccaaaacaggtgtatcacctgaggtcaggagttcgaaatcagcctggccaacatggtgaaaccctgtctctactaaaaatacaaaaattagccaggcttggtggcaggcacctgtaatcaaggagaatcgcttgagaggcgggaggcgcaggttgcagtgagccaagattgcaccattgcactccaggctgggcaacaaaagcaagactctgtctcaaaaacaaaaacaaaaacagggagcgctcttggcctttgtgctggggaaaagaaggcatggagaactgagtctgctgctgggaagtgagtagattggaggtgtcagtctgggaaggcttcctgaaggaggatgtctcaggctaaggaaaagacagcaaaggcttcagagcagaagagtgtgtctcctctgagagcccaaagcaatgtggctggagtcacagatgacaccatcactccttctcttctgctagtcacaagaatcttggtgtcccaaggagcccccagtgcaccaccaccatccttaacaatgcccctaccattatgcatgtccattcccacccttacctccccttggaggtggagatggcacttcctctgcccagggccagacctccaccagtgctctgatccacacacccctcccttcacacacagaaccttgtctcatcaaatagtatctctcccttgccatactcctcccacccccatcccaggctgaattttattcccctctacttgtagtcatgctcatgtcacttcttcctttaaaaaaagaaagaaaggggctgggcacagtggctcacgcctgtaatcccagcactttgggagtccgaggtgtgtggatcacctgacgtcaggagttcgagaccagcctggctaacatagtgaaaccccatctctactaaaaatacaaaaaattagctgggcgtggtggcaggtgcctgtaatcctagctacttaggaggctgaagcgagagaatcgcttgaccccgggaggtggaggttgcagtgagacaagatcgtgccattgcactccagcctgggcaacaagagtgaaactccaactcaaaaaacaaaaatagaaagggaatcatccttgacccatgtcccacacccactacagccctctctccttgcctctacagccaagcttcccaagaggggagaccatactcgttgtcaatttttcacctcctcctacatccccaaccctagccaccatccatggaaatggctaaactaatgatcaactcctagccaaatttgatggactcttttcaaatcttttcttccctgcatccctggaatagtggataccactgaccactcctccttccttccttcctttcttttttttttttttttttccagattctcactcattcgcccaggctagagtgcagcggtatgatctcgatctcagctcactgcaatctccacctcccaggctgaagccattctcttgcctcaacctcctgagtagctgggattacaggtgcccaccaccacgcccagctgatttttttgtatttttagtagagacagggtttcaccatgttggccaggctggtcttgaactcctgacctcaggtgatctgcccacctcagcctcccaaagtgctgggattataggcgtgagccacctcgtccaaccgcctttcttaaaagacaattcctttggcttcctgacattgccttctgcatttcttgctatctctctggccactcctttccagtcttcttccttgaatcctttttatctattcaccacttacacctgtaatcattaatcttcttggtggttcatgctcccctttgagactctaatgcacaatcagagattgctagcatctcccatgcagctgaaggggcacatgcatttgtgaaagccacccacagaggccagattaagagccttgctcttgagtgttaggattcccacctccctgcctccacctcttcaggccaattcccatccactctcagggatgatgaatcccagatcaacatctccagactctcctcggagctacagacccaagtttctaattgctgcctggatgtcccacctaagcctcaaactcacagcttccaaactcaagtcattatccaatgccatcctccaggcctcacttcctctcataattcctctctggtggacatcactgcctccaaagcaagaagcctggagtcagcaaaagtgctgaggatggcactagaacctctcacaggattgctatgttaaataatgtgatacatgtaaagcacatagaatggtgcctgatacatcatagatgttcagtgttattattgttactattattgctgcttctttccctttacatccaattagaagccaagtcctgccaattctatcattttttttttttttcttgagacagagcttcgttcttgttgcccaggctggagtgcaatagcacaatctaggctcactgcaacctctgcctcccaggttcaagcgattctgctgcctcaccctcctgagtagctgggaagctgggattataggcatgtgccatcacacctaattttgtatttttagtagagatggggtttctccatgttggtcaggctggtctcgaactctcgacctcaggcgatccacccgcctcagcctcccaaagtgctggcattacaggcatgagccaccacgcccggcccccaattctgtcttccaaactttcctttttttgttgttgttctttttttcctttttttgagacaaagtcttactccgtcacccaggctgaagtgcagtggcacaatcacagctcattgtgccctagacctcctgggttcaagtgatcctcccacctcagcctcctgagtagctgagactacaggcatgcaccaccacacctggctaatatttttattttttgtagagacagggtcttgctctgttgccaggctggtcttgagctcctgggctcaagcaatcctcccaccttggcctcccaaagtgctggcattacaggcatgaacctctgtacccagcccctaaatttcctttgaatctactttcttccgtatatttccactgattctctcttagtttgagtcattattactacttatctagatgattgcagtaatctccactcttgtcttttcaaatctttccaagacatctggctagcatgttcttgtcaaactgcagttttgatcatgatgcttccccacttttagcttcagtgtctcccccagattcttttttttttttttgagacagagtgtcgctctgttgcccaggctgcagtgcagtggcatgatctcggctcactgcaagctccgcctcccgggttcatgccattctcctgcctcagtctcccgagtagctgggactacaggcacccgccatcaagcctggctaattttttgcatttttagtagagacagggtttcactgtgttagccaggatggtctcaatctcctgacctcgtgatcctcccgcctcggcctcccaaagtactgggattataggcgtgagccaccatgcccggccagtgtctccccagattctaaaatagtttcccttggtttttggtaatttcctagggaacttgttgtagagatccagccccaatcccagagagtattattctgcaggtctgggatgatattgggcacctgcattcatgacatgttcccaatcatagctggtacaaaacaaagttgaaaactaaggcagtgcaaactcttcaaggtctaacaaggctcttcttgacctggtcttcactaacctttcccactttatctcccacctcttcctttctccactactcattggctccccatatatatatatatatatatttgagacggagtttcgctcttgttgcccaggctggattgcagtgatgtgatcttggctcactgtaaaccccgccttccagtttcaagcaattctcctgcctcagcctcctgagtagctgggattacaggtgcccgccaccatgtctggctaatttttgtaattttagtaaagatggggtttcaccatgttggccaggctggtctcaaactcctgacctcaagtgatccatctgccttggcctcccaaagtgctgggattacaggcatgcgccactgcgcttggccatatgtttatgttttgtagagacagagatttgccatgttgcccaggctgctcttgaactcctggactcaagtaatctgcccgcctctgcttcccaaattgttgggattataggcacctggtaaatcattctttttttttttttttttttgagatggagtctcactctgtcacccaggctggagtgcagtggcacgatctcagctcactgcaacctccaccctctgggttcaagtgcctgcctcagcctcctgtgtagctgggattacaagcgcctgcaaccacacctggctaatttttgtatttttagtagagacagggtttcaccatcttggctaggctggtcttgaactcctgacctcgtgatccacccacctctgcctgccaaagtgctgggattacaggtgtgagccaccgcgcctggcaaatcattcttaatagtgaaagaatgattactttgtccacaagatcaggaacaaagcaaaaacatttgctctccccacttctttgtgtttgtttttttctttctgacctcttccctgtaggtatgttctcatcacttttattcaacattgtactgaacgtgctagccagtgcaataagtcaggaagaagaaataaaaggcatacagatgggaaaagaagcaataaaactatctttattcacagataaaatgattatctatttagaaaatcccagccatgggcagtatgcacacctgtactcccagctacttgggaggctaaggcaggaggatcacttgtgcccaggagttcaaggcttcagtgagctatgatcaccaatgcactccagtctgggcagcagaatgaggctgtgtctataataaaaaaaaaacaaaaacaaaaaaatcctgaagaacctacctacaaaaaagctactagaactaataagagaatttagcaagattgcaggataaatgataagtgatcaatacacaaaattacattttttgtgtgttttttgtttttgtttttattttagagatgaagtcttgccctgtcacccaggctggagtgcagtggcgcgatctcagctcaccgcaacctctgcctcccaggttcaagggattctcctgcctcagcctcccaagtagctgggattacaggcactcaccaccacgcccagctaatttttttgtattttcagtagagacggggtttcaccatgttggccaggctggtcttgaactcctgacctcaggcaatctgcccacctcagcctcccagagtgctgggattacaggtgtaagccaccatgccggcctcacaaaattacgtttctatatactggcaatgagaaattggaaattcaaactgaaaaagcagtattatttacaatcagatttaaaacataaaatatcttccaatcaaactaacaaaatatgtgcaagatttgtatgctgaaaagtataaaacattaatgagagaaattaaagatgtatatgaatggagagatatattaagttcatggattggaagactcaatgttgttaagatgctaactcacttggaattgatctgcaagtttaatgccatcccaataaaaatctctaagtttttatatagaaactaacaaaccgattctaataatgtagacaaaaaagcaaagggcctagaataaccaaaacaattttttttattttttatttttttatttttttgagacggagttatgctctttttgcccaggctgaagcgcaatgggacagtctcggctcactgcaaactccgcctcccgggttcaagcaattctcttgcctcaacctcctgagtagctgggattacaggtgcccacgaccatgcctggctgatttttgtatttttagtagagacggggtttcaccatgttggccaggctggtctcaaactcatgacctcaggtgatctacccatctcagcctcccaaagtgctaggattttaggcgtgagccacctcgcccaggctcaaaacaatttttaaaaagaatagccgggaacggtggctcacgcctgtaatcccagcactttgggaggccgaggcgggtggatcacaaggtcaggagttcaagaccagcctggccaacatggtgaaacccggtctctaactcaaaatacaaaaattagccgggcatggtggcatgtgcctgtagtcccagctgctcgggaggctgaggcaggagaattgcttgaacccaggaggcggaggttgcagtgagtcgagattgtgccactgcactccagcctgggtgacagagtgaaacttcatctcagaaaaggaaaaaaaataaaagaaaaggaaggagaaggagaaggagaagaagccgggcacagtggtttacgcctctaatcccagcactttgggaggatgaggtgggcggatcacttgaggtctgagttcagaaccagtctggccaacatggtgaaaccctgtctctactaaaaaatacaaaaaatagccaggatggtggcacacacctgtagtcccagctactcggaaggttgaggcaggaaaatcgcttgaacccagtaggcagaggttggagtgagctgagatcaagccattgcactccaatctggtgacagagccagattctgtctcaaaaataataataaaccaaaagaaaaatgaaaagaataaagttggagaactcccattatctggtttcaagacttgccataaagctgcagtaatcaagacagtgaagtatcagcataaagatagatacaggccaggtgcggtggctcacgcctgtaatcccagcactttgggaagccaaggtaggcagatcacctgaggtcaggagttcgagaccagcctgatcaacatggagaaaacccatctctactaaaaatacaaaaattagctgggcatggtggcgtatgcctgtaatcccaggtacttgggaggctgaggcaggagaatcgcttgaacccgggaggcagaggttgcagtgagccgaggtcgcaccattgcaccctagcctgggcaacaagagtgaaactccgtctcaaaaaaaaaaggatagatacatctatggaacataatagagtctggaagaccccatctctactcaaaatacaaatactccagcatgggaaacaagagcaaaacttcatctcaaaagaaaaaaaaaaaataggcctggcgtggtggctcatgcccgtaatcccagcactttgggaggccaaggcagattgatcacctgaggttaggagttcgagaccagcctggccaacacggcaaaaccctgtctctactaaaaatacaaaaaattagctgggggtggcaggtgcctgtaatcccagctactcaggtgactgaggcaggagaatcgcttgaacccaggaggcataggttgcaatgagtcgagatcgtgccattgcactccagcctgggtgacagagcaagactctgtctcaaaaaaaaaaaaaaaaaaaaaaaaaaaaaaaaggccgggcacagtggctcacacctgtaatcccagcactctgggaggccgaggcgggtgtatcacgaggtcaggagatcaagaccatcctggctaacacagtgaaatcctgtctctacttaaaaaaaaaaaaaaaggaaaagaaaaagaaaaaggaaaaccgttcgtgaccttgagttaggcaaagatctctgaaatagaacacaaaaaatacaaaccatacaaaaaatttcataatttttttttttttttagagacacattcttgttctgtcacccaggctggagtacagtggtgtgatcatagctccatataaccttcaactcctggcctcaagcaatcctcctgcctctgcctcccaacagctggaattaacggtgtgaaccaccgtgcccagcccataatggaattttatcaaaattaaaacttcatctcttctaacaacattgttaagaaaatacaaagataagccacatattgggcaaaaatatttgcaaaacacattaactcaaatgaatcataggccaaaatgtgaaacagaaaaccataaaaattctagataaggctgggcgaggtggctaatgcctataatcccagcactttgggaggccgaggcaggtggatcacgaggtcaggagttcaagaccagcctggtgaacatggtgaaaccccgtctgtactcaaaatacaaaaattagccgggcatggtggcacacacctgtaatcccagctactcgggaggccgaggcaggagaatggcttgaacctgggaggcacaggttgcggtgagctgagatcatgccactgcactccagcctgggagatagaggaagattccatctaaaaaaaacaaaaaaaaaattctaaataaaaacagaaaatctttgtgaccttgagataggcaaagatttcttgtgatcatagctcatggcagcctggatcttctgggctcaagtaatccccctgcctcagcctcccatgcctgtaatcccagcacttttgaagctgagactacatgtgcacaccatcacaccagactattattttatgttttgtagaaaagcggtctcactatgttgcggagctagatttcttctgttgtttttgttgttgttgttgttgagatggagtttcactcttgttgcccaggctggagtgcaatggcgcaatctgcactcactgcaacctctgcctcccaggttcaagcgattctcctgcctcagcctcctgggtagctgggattacaagcatgggccactatgcccggctaatttttttgtatttttagtagagatggggtttctccattttggtcaggctggtcttgaactcccaacctcaggtgatccgcccgtcttggcctcccaaagtgctgggattacaggtgtgaggcactgtgcccagctgctagatttcttaaatacagcatcaaagcataatccataaaataaaaacttgataaactgggctttgtcacaattaagaacttctcttcaaaagacattaagagaatgaaaagatagccacagactgggagaaaatagttgcaaatttcatgaagaagaacttgaatccagacatattttcaaaactctcaacattcaataataaaaaagagacaaccaaattttttaaatgggcaaaagatctgaacagatatttcatcaaaaaagagatacaggccgggcatggtggctcacacctgtaatcgtagcactttgggaggctgaggcgggtggactgcctgagctcaggagtttgagaccaacctgggcaacaccgtgaaaccctgtctctactgaaatacaaaaaactagcctggtgtggcagcatgcacctgtaatcccagccacttgggaggctgaggcaggagaattgctagaactcgggaggcagaggttgcagtgagctgagactgtgccactgcacaatccagcctgggcaacagaacaagactcggtctctaaaaaaaaaaaaagagagagagatacagatggggcagggtgcagtggctcaagcgtgtaatcccagcactttgggaggctgaggcgggagtattgcttgagctcaggagtttgagaccagcctgggcaacatggcaaaaccctgtctctacaaaatatacaaaaattagccaggcatggtggcatgtgactataatcccagctactctggaggctgaggctcaagaatcacttgaatccgggaggcaaatgttgcagtgaaccaagatcccgccactgtactccagcctgggtgagggagtgaaactctgtctcaaaaaaaaaaaaaaagaagaagaaaacaggccgggcatggtggttcatgcctgtaatcccagcactttggaggccaaggcaagtggatcacctgaggtcaggagtttgagaccagcctggccaacatggtgaaaccctgtctctactaaaaatacaaaaaaatgtagcctggcatggtggcacacacctgtagtcccagctactcgggagactgaggcaagagaattgcttaagcccaggaggcagaggctgcagtgagccgagatcgtgccattgcactccagcctgggcaaaagaacaaaactccatctcaaaaaaaaaaaaaaaagttgccaaaaataaagagatacagatggtaaataagcacatgaaaagatgcccaatatcattagtcattaggaaaatacacattaaaaccacaagataccattacacacccactagaaagctatatatatatatatatatatatatatatatatatttttttttttttttatatataaggtcttgctctgtcgcccaggctggagtgcagggccatgaccttagctcactgcaacctctgcctcctgggttcaagtgattctcgtgccttggcctcccgagtagctgggattacaagcatggacaatgcccagctaattttttgtatttttagtagagctgggattttgctgtgttgcccagactggtgttgaactcctggcctcaagtgatccgtttgcctcggcctcccaaagtgctgtgattactagtgtgagactccacatccagcctaacttttgtttttcctttttaataacaggccaagcacagtggctcaggcatgtaatcccagcattttggggggccgaggcagaaggatcacctgagcccaatagttcgagacaagcctgggcaacaaaggaagactcccctctctacaaaagaattttttttttttttgagacggagtctcgctctgtcgccgaggctggagtgcagtggtgcgatctcagctcactgcaagctctgcctcccaggttcacgctgttctcttgtgtcagcctcccgaggacctgggactacaggtgcctgccaccagtcccggttaattttttgtgtttttagtagagacggggtttcaccgtgttaaccaggattgtcttgatctcctgacctcatgatcctcccgccttgacctcccaaagtgctgggcttacaggcgtgagccaccgcgcctggcctacaaatgaatttttaaaaccagccaggtttagtggtatgggcctgtagtcctagctcctgaggaggatgaggcaggagtatcacttgggcacaggagttccaggctatagtaagctatgacagaaccactatactccaacctgggtgacagagcaagaccctgtatcttaaaaaaaagtaaaataaaaaataaaaataaaaaaaggacagacagtacagagtgttggtgaggatacagagcatcatgttactgggggcatgcaaaatggtacagctactttggcagtttcttagaagaataaacttggccaggcatggtggttcacgcctgtactcccagcactttgggagactgaggcgggcagatcacttgaggtcaggagttcgacaccagcctggccaacatggtgaaactgtctctagtaaaaatagaaaaattagcctggtgtggtggcacacgcctttagtcccagctacttgggaggctgagacaggagaatcacttgaacctgggaggtggaaggtgcagtgagctgagatcacccctgtaatcccagcactttaaggctgaggcaggcagatgacttgagcccaggagtttgagaccggcctggccaacacggcaaaaccccgtctctactaaaaaatacaaaaattagccaggcatggtggcgtatacccgcgattccagctacttaggaggctgaagtatgagaatcacttgaaccctggaagcagaggttgcagtgagccaaaatcaggccatagaactccagcctgagtgacagacggggagactccctctcaaaaaaaaaaaagaaaaaaaggaagaaaacatatatccacacaaagataaacagctttattcataattgctaaaaactggagctgagcactgtgcctcatgcctgtaatcccagcactttggaagaccaaggtgggaggatcacttggggtcaggagctcaggccaggaatttaagaccagcctgggcaacatattgagaccctcatctctaccaaaaaaagttagaaaaagtaaagaaaaaaactaagaacaaaataaatattcatctactggtgaatggataaacaaattatggtaactctatgcaatggaatattatgctgccattaaaaggaaggataaatactgataccctgcaataacatagatgaatcacagaagcatcatgttaagtgaaagacgccagagacaaaaagctacacaccaggccaggcgtggtggctcatgcctgtaatcccagcactttgggaggccgaggtggatggattaccaagctcaggtgtttgacaccagcctggccaatgtggtgaaactccatctctactaaaaatataaaaaattagccggacgtggtagctcatgcttgtagtcccagctactcgggaggctaaggcaggagaatcgcttgaacctgggaggtggaggttgcagtgaaccaagatcatgccactgcactccagcctgggcgacagagcaagactcagtctcaaaaaaaaaaaaaaaaaagaaaagtaaaaagctacacaaaaaagctacacactttatagtttattttatacaacattatggaaagggaaaagctatgaggacagagaacagatcagtggttaccatagctgggggtgtcggggaggaggtgtgggggtgagcaatgaacttgactataaaagaacacagtggattttttttttttttttttgagacgaagtctccctctgtggcccaggctggagtgcagttgcgccatctcagctcactgcaacctcctcctcccaggttcaagcaattctcttgcctcagcctcctgagtagctgggactacaggcgcccatccccatgccccgctaatttttttgtatttttagtagagatggggtttcaccatcttggccaggttggtcttgaacttctgaactcgtgatccacccgcctcaccctcccaaagtgctgggattacaggtgtgagccaccacacccagcctggagctttttgaagggataaaaa

SEQ ID NO: 584 - DNA, 20001 bp, Homo sapiens
aaactctgttacacccagagttcagaagatcacaccaggttgaggattcaaaggagcccagaaattattcataacatatccaactctctcctgtttaccttgatttttttaaagtatcagttacccataaagaccctaacaaatatgaaaaggaaaggcaattataaaagatccttcattattccacgcacaagagtcaaagattttgccaacagcctcactttataaatgcaaaaataggtccagagagagaaagtaacttgtctaaagtcacacagcaagtgagatggcgggactagaagccacgtctctggccaccctctgtgtggtctccctgaaaattggtggttctcaccagcagcttctcggttcgtcagctccactgccctctgcccatacttcccactgtcagcctccttcccctcccacccccaacatactcttcttctcaatagggacccaggtctgtctcagctacatgctgggaccattaaagtcaagaacattgccactgacactgtgcctggtgccagcacactcctgagacacagcaggtcaaccacagcactcacctcaacagcgcctccctcaccccacctgaggggcacccatgccaatgatgcacaggtatctatcttcttaatcatctctgctgaggggccaggctgcaaattacccatctccccaaccccagagaaagtctaggtgcttaggggagaacagagactatgaaaattataccatgagggattccaggtagatctcagaaaggacttccaggtgggagagatgagtttggagaactggtaggggggaagaggagtgtgcagaatgggacgcctccctccaccccctaccccagtgccccatctagagccagagtagctgaaagccaaaggctgccagggcaaatgggagcaggtgtgaggagggggactcttgaggctgggggtgcagaagcagcaagttgcttcttcctgggcccactgcctctctactgacaccaaataggcaagggaaggtgaccgaatggctgctgccttcccaggcagagacgctgtgtccccaccatccccctggctgctcccacctatccctagcctggatcagctttggggtcgggggtgtggcagagaagaggaaaagaaggcatggctggggcaggggcctccccaggctcccatctcatcagaattcagccttgcctggggtgatcaggggtcctgatgactctcccgctgtcccctttcagagcccatggccacatagagccccctctcctaaggtccctccagtatccttccaggagagaaggagaggtccgggcatcggtgtctccaccgtcactcacacaccctatgtgtttgggaaagtggggtccctatccacctgcccacagcccacagctctcctggcctcctgcggacaatgcccccctcgcggacatcgccaggccgtccacacctgcccatgcccacacctgactgcccgtccctccccgcccccggcccacccgggccggctcccgccagtcctacctgctccgggctgggggctcagcgcccgggcagcctccctgagcaccagcaccaggagccagagctcgcctcgcatggtgggtgcccggacctgcccccggcctgcttgctgccccggtcctgacgagggagggggccctggctcaggctgcggccgcgcggtccccggggctggcggaggggcgggcggcgaggagacggcggagcgcggggccgggcgagccggcaggagcggcgagagcgcgagcggagctggaggctgcggcctccgggagcaggcggggagctgggggggccgctgggtcggtgggggtgggggggagctggggcagggggcggggcggggggcgcggcgtcgttgggggctctcccggcgcctgccctcagccctaacggagcgctcccctagagctctgcagccgctcccaaggcaaggggtgcagagtaggggacagggcgggagcccctcgggctgagagaacccctagaagcatcagccgccccgcgctcctcactgagctcctggctccctttccctcctccgttccgccgggaaagctgcagagagaaggcccgaggactggacccctggaagggacaggcgccccatccctgggtcacgggcccctgactgttccccgcccccagctcctccaagctctgcgacttcctgagctgttcttcggaattctgtgcgtctctgatgctttgtcctccagcccccacccccagaaatctccccctgcagcaaagacccccagcttttctccccaagaggggcctgaatcccaccccccttccatgactccaccttatccctccaccccccatttccagcaccgatttgccccccaagcctagcagacgtgagggtggagggggcctggctaccccttactctgcaacagtctggacccctccccacgagtaggtaacccaggcctcctgcctctctggggcctccaggcctactcagggccagacccaatcaatcttcagagccagccccagacgaggaaatggctcaccccacctgtcaccaccttctgacaggctctggggatagataatctttttattttttcttccaggacagaataaaaatacccgcaatgtaggatatttaatagacggcaaggaatcaggtcaggacacgaagatgcctcttccctcccctgacctacttcgttcttgtgacggcaaggagctggggcgctggagagtgggagacggggtgagggggcatcctggcttctagtgggctggggcctagggactagaaaaccgcggagaggaagggtgcgaacgctgagcgccattggagaaattttccaggaggagggatatgggcggggacaggagaaggtacactgtgggctggaagagacggattccgtggcactgaggttaaaaaaaaaaaaaagaaaagaaaagaaaaaaaaacacctaagaaaggaaacaactaaaggctctctaatctcttagaacgccggttcctccttccgccgggcccagagtcccagagactacctcctccagccctaaacccaatgtccccttaccgtggaacaaggcaaggccggtctgtaaattcttcttgatgtctaatttaaatcccaacttggcggactctcaaacagaatcagataggcagctacctccagctgcagctacttgctgccctcaagtggccacgtgacgagccacaaccctcttgtcctgcgggtttcctctttccccagcctgcccaccccctgtctccgacctcctgccttcctcgaggtcaaggtgagaagtctcgggacggattccagctccagccccggcgtctttgcacattcctccatctggggtacctcgtggtctgtcttacaagaagagctcaggctgaaacataaacttgtaaatagtagaagcaaatgtgtaaattttaacgtaagcctctagaacttgagatcgtaatcacctgcagggtgtgtgtgtgtgtgtgtgtgtgtgtgtgtgtgtgtgtgtgtgtgtattttgtttgttttttgagacaggttctcgcacgttgcctaggctggagtgcagtgctgcgatcatagctcactgcagcttccaactcctggactcaagcgatggggagcgtatatgaaaacacagatttctggactccaccctcaagtttctaattcattaggtctgggatgaggcccgagcgtacccaggtaatgctgctggtcccaggaccacattttgagagccactgctgttgaatccccagttcctttcagtccctcactgctcctcgtctgccagtaggagtaaaagcaaacagcttaggaaaaatcgacacccaggacaaaaacagtatctcgaaaaggccaaagagggggcacccggatttgaaccggggacctcttgatctgcagtcaaatgctctaccactgagctataccccctctgccggcaaaccgaccgcacgtagtcgtttagtggtattgctgcgcaggcgctgtgtggcgttcccgaagggaagtggaagtggggtaagacgtttacaagagatggaaaaaatacaactcccagaagaattactcacttggaagcaggggttgttccctgaagctctgagctgaagatccccactggcagtataagaaaatatattcctggggtgtggaaggagaagtctctcgaaatatttcacttcgggggcgtcccactctcctgccctgcagaagaccccttgccacgtctcggagcttctttctccctcccacatgctcacgcggcttctcccgacctgtcttccccagcccagcccttagaaactcagcctccttcccgccaagaaagagccaggctgacctgggggtgcgctcgcctccgccctgccattgcgaggttgagccacccgtaccgtgttccaagggtcagcccggagctcctcgccctcactcgcattgcattctaccctgggtacacacacaggctgagccactggcaggggccaggactccatcctcactcgcctgcgaaagcaaaaagggtggcagggctcgagactccctcccattccatctgtgcgggaactctttagaggacctccggagaccaacaaaacgaggtaactccggagcacagagggggcacccggatttgaaccggggacctcttgatctgcagtcaaatgctctaccactgagctatacccccgccacgccactacgttgtcattagagttaatttctatggaataggggtgtggtcttcattttcccttaaagttttaatctgagggttgcgtcgggatacctactgaaaaaaacacaaaatacaatgggaatggctagaactcctgagttcttccttcatagccacgctttcggaaaaccaactagattaaggaatcttgggccgagagcggtggctcacgcctgtaatcccagcactttgggaggccgaggcgggtggatcacaaggtcaggacatcgagacctcctggctaacacagtgaaaccccgtctctactaaaaatacaaaaattagccgggtgtggtggcgggcgcctgtagtcccagctactcgggaggctgaggcaggagaatggcgtgaaccctggaggcggagcttgcagtgagccgagatcgcgccactgcactccagcctgggcaacagagcgagactctgtctcaaaaaaaaaggaatattgggtcctctatatccgtgcctagactctcccccaaatgtccactgactggcttgagaaaaggactgtccccaggaccgccccaggtccagggatgtacagatgaacagactggatctccatcttgtctcctgggcttttccaaccccagggtcgctcctccccttctctcaaaccaaaagccagtttgaggaacagacagaggagaaggctgaaataagaggtaagcatttttcaatagcatttactacagccttataaaaatcctaatacagtattttttttaaaatcctggccgggcgcggtggctcgcgcctgtaatcccagcactttgggaggccgaggcgggcggatcacgaggtcaggagatcgagaccatcctggccaacatggtgaaaccccatctctactaaaaatacaaaaaaattagcagggcgtggtggtgcgcgcttatagtcccagctactcgagaggctggggcaggacaatcgcttgaacccgggaagcggaggttgcagtgagccgagatcgcgccactactgctctccagcctgggcggtagagcgagactccaacaataacaacaacaacaaaaatcattacacaaagacaaacaagcagcccctttaggaatctggtatatttgggaggagtgggattcaaattggaaggacactagaagtaaaggggatgctgtggggtggcttaaagtccaagagctgtggtcagagtcagcatctcagagggaatgggaagacgaggagaagtggaatccctgcagtgcaaagggctgtccctatctgggacgtcctgtcctcctccatttccccttccagtttttgcctctgccctcctccccttgagcccaccttcttcaccttgctagaatctcctttgcccaaagggaatgggacaaaaatggctgaggggctaaaaagcctgagggtggaaggaggtttgaggaaatgaagagcaattccagggttttttgtttttgtttttgtttttttttgagtcggagtctctctctgtcgcccaggctggagtacagtgacccgatctcaactcactgcaacctccgcctcccaggttcaaaggattctcctgtctcagcctcccgagtagctaggattacagacgcccgccaccacgtccggctaatttttgtattttgctttgttttgtttgagacggtgtctcgctctgtcacccaagctggagtgcaatggcacaatctcggctcactgcaacctccacctcccgggttcaagcaattcttctgcctcagccacccgagtagctgggactacaggcgtgcaccaccaccaagctaatttttatatttttagtagagacagggtttcaccgtgttagccatgctggtctccaactcctgacctcaagtgatcctcttgcctcagcctcccaaagtgctggattataggcgtaaaccaccgcgcccagcctcaggggtctcttaatctgcccccccaacacacacacacattattcctacggagagactgagggctgaggagagggagagagttccactcactaaatctgcaacatatccaacatttccctgacgtctccaagaaggatgcctgcggccatggagtgaggagcagcttcttctgctgtgctgtctgcaggaatccaaggtatgcagtccagcttctcagcaacgggttgggagaatggtgtcaatctcactgtccatagcagccactgctcccactagagaaccatagaaaagtaataaatagccacttgattttccacccatgttgaccatgcaaaaccccaaagtttctggttgacctcagactggaacatcagttagcagcggcctgagattccatccactgaagtctggcaggcagcctgcagggaggaaggaacaggaggggtcagcctaacccaagagaatgatggccttcaagtctccagcccttgcccagatcggactgggtgcaggaaccaaagttacatccaataattcaattaacagagatgaactggcttgagtatctgctgtgcatcaggtactgtgcaaggctctggagttactggtgaaaatgcagacatgcccctgaggcttactgtctagtagaagagatggatactaaataaatggtcagacacataattctgtaattacatactgtgataaaggaaatatacagaggcctctggatgcctgagagtcagggagggcttctctgaggaaggagcctggagactcaccttgctgggccccttagctgtgtctctgggcaaggattcttcacggtgatctgtgccagaaagaggttccctacgcaagttcccccattagattgtaagcaactccggcgcatgggtggagtcttggtcatctctgtatcatcctcagccttggtctggcaccgcacagggaacatggggggtacttagaaaatgctgattgggccaggcgcagtggctcacgcctttaatcccagcacttagggaggcggaggcgggtggatcacctgaggtcgggaattcgagaccagcctgaccaacatggagaaagcccgtctctactagaaatacaaaaatcaactgggcatgttggcgcatgcctgtaatctcagctacttgggaggctgaggcaggagaatcccttgaacccgggagacggaggttgcagtgagctgagatcatgctattgcactccagcctgggcaacaagagtgaaactccactcaaaaaaaaaaaaagaaaaaagtggccgggcacagtggctcacgcctgtaatcccagcactttgggaggccgaggcgggcggatcatgaggtcaggagatcgagaccatcctggctaacaccatgaaacaccgtctctactaaaaatacaaaaaaaaaaattaaccgggcgtggtggctcacgcctgtaatcccggctactcgggaggctgaggcaggagaatggcgtgaacctgggaggcagagcttgcagtgagccgagatcgcgccactgcgctccagcctgggcaacagagcaagtggccgtcgaagaaagggaaggagggagggagggagggagggaggaaggaaggaaggaaggaagagagggaggaagtgagggagggagggagggaaagaagggagggaaaatgctgattgaactgactgtgggttgtggaagagggttctcctgacccagcgggtggcaaggacactgctagaaacgtgtggtcccttggactgacttgcctaaagtctccccttcttcaaaaaacacatctgcgccaggcgtggtagctcactcatgtaatcccaacacttggggaggccaaggcaggaagatcatttgagctcaggtgtttgacaccagccatgggcaacgtggcaaaaccttgtctctacaaaaatacaaaaattaccagggcatggtggtgtgcgcctgtagtcccagctactagggaggctgaggtgggaggatcgcttgagcccaagaggttgaagctgcagtaagccatgtttgcacaactgtactccagcctggggggtgacagagggagaccctgcctcaaaaaaaaaaaaaaagatacctgtgtgcccagcctgccatgattccacttgacaggtaagacgaaagggaagttttccaggcctgatgtaaggccctttctacgtggcccagctccttaaaatcctccaggtgattactcaatatctacctgcttagtgtcccttgtcagataacttacctaaaattgcaacattccctccacacacttccactctcccttttcttttctttgtttttgcttttggaaatgggggtctggatatgttgcccaggctggactccaactcctggccccaagccatcctcctgcctcagactctccagtagctagaactacaggcatgaaccaccatgctggcccaatctctgtttcttactctttattcaccttatcatttatcacttgtttttttttttttttttttttttttttgagacaggatcttgctatgtcacccagactggagtgcagcaacatggtcagagctcagtgcagcctggaactcctgggctcaagtgattttcctgcctcaacctcatgagcagttaggaatacaggtgtgtgccaccacatccagcggtttttttttttttttttttttgtaaagacagagtctcgctctgttgccaaggcttttctcaaactcctggcctcaagccgtttaccattttctttctttcttttttttttttttttgagatggtgcttcgctcttgttgcccaggctggagtgcaatggtatgatcttgactcaccgcaacctccgcctcctgggttcaagcgcttctcctgcctcaccctcccaagtacctgggattacaggcatctgccaccacacccggctaatttttgtatttttagtagagacggggttcctccatgttggtcaggctggtctcgaactcccgaccttgggtgatctgcccgccttggcctcccaaagtgctgggattacaggcatgagccaccgcgccccgccatcattttctaactgactatatatttttcttgtttatcatctgcctcccctaccggaaagtaagctccgtgagggcagggatttttgtctgttttgctcgctgctgtttctccagtgcctagaacagtacctggcacaaaggaggtgctcaagaaagatttgtgtactgaatggtgtcatttactctacagaaactctaggaggtataatgatcctcttccttacagttaagaaactgaagtcagagtgagtcaatgatttctgcctggaaggcttgttccccaggtctccccatggctgtctcctactcttcactcaggtctcagctcaaaagtcatctcttaagagaggccagccctgaccaccagaactaaatcagacctatccttctcccttccatttctggtaaccagtgggattcttcacatcacttctcagcacctaagattattgcggccaggtgcagtggctcatgcctgtaatcccaacactttggaaggccgaggccggtggaccacctgtggtcaggagttcaagaccagcctggccaaccccatctttactaaaaatataaaaattagccaggcgtggtggcgggtacctgtaatcccagctactccggaggctgaggcaggagaattgcttgaacctgggaggcggaggttacagtgagctgaggtcatgccattgcactccagcctgggcaacaaagagcaaaactctgtctcaaaaaaaaaaaaaaagagagagagattattgcatttaggcggagtgctacctctttctccactagaacaagcccctgagagcagggatgctgtctgcttgtggcttacccaccacatctcacctgtggggagatgccaaattggcttggcccaggagccaactgtgaaccagattctcacaggagagaggcaggagaagggttctgatggtcagtcatccattggttcagccaggccctagagatccaggtagggcagccactaacccttccctggtgagggcacagcagccttgtatatgccacgagtggtctttgatggtgctgagagtaaggaaatgggagatctccaccatcctcatggagtccttcacgtcctgcttattggcaaatatcaggactgaagcatcctgtagagcctgtggacagaggagcccagccccagtcagcctgctagtgcccagccttccttcctactgcctcacaggcgctctctggctccctctccagctgtcccaggaagagaggcccatgcctggatggggcagagatgggggccctgccacaatggtagcaaccgtatcaaataacatcagcagctcaaggaaagcctctttatgacaatcccataggtgggaattgatgatcctcctcattttatacttggggaaactgaggattagagaggtgaagtcacttgtccaaagtcctacagtgaatgaaagatggagttagaacttgaaccagcaactctggcttctatagtcaattgcactgagggtactgatgcccttcatcaggcacaaaccagccctcctcatgctgctggtatagaggctctcagaaactgggacagcaggaacgaatctcagagaagctaagtgaccagcctgagggcacacagctagtaccactgggccctctcccaactgcagggggcttacctcatgggccagcattttatatagctcctcccgagtggtcagcagccgatcccggtccgtgctgtcaatcacaaggatgataaactgggcagcagaggggagccgtgagagacaggctttctctttggtaaatgtgtttcctgccctctttctttccccactggtctctgcactgcccagatgtcagccccagagaaatgaaagcatgcagcctcaagatttcaccaccctgcttccattataattgtctttttttttttttttgaggcggagtctcgctctgtcatccaggctggagtgcagtggcgcaatcttggttcactccaacttctgcctccttagttcaagcgattctcccacctcagcctcccaagtagctgggattacaggcgcgtgccaccacacccggctaatttttgtatttttagtagagacggggtttcgccatgttggccaggatggtctcaaactcctgatctcaggtcatctgcctgcctcagcctcccaaagtgctgggattaccaccaggtgtgctgccacacctggcctgtaattgtcttttctatccagacatgggaatagcacacctctgactgtgtggcagaggctgtgctacataagcattgggtgttcatgactccatttaggccttaccacaacgctgtggacttggtactgttagtatccccattttacaaatgaagagactgaggctcagtgaggctatgtatcttgctcttgaccacacagctggtgagtagcagtgctggaaatggaacccagctctgtctcggtccaggaattataccactgaattctactcctgctggagtaagaaagtaaggcccctagagagaaggggcctacccatccagtgcatcaaacagaaagctgccagcagctgccaggaagtattcaaacacgttaacaggcaggcactgcactgtgttgagtatctgacatatatgcattacatattggtttgttatttaattttcacaacaacttagggagatcattatatatatgtatatataaaactttttttttgagacagagtcttgctctgttgcccaggctggagttgcaatggcgtgatctcggctcactgcaacctctgcctcccaggttcaagcagttctcctgtctcagcctcccgagtagctgggattacaggtgcctgacaccatgcccagctaatttttgtattttcagtagaggtggggttttgccatgttggccaggctggtttcgaactcttgacctcaggtgatccacccgccttggactcccaaagtgctgggattacaggtgtgagccacaggaaccgaccattataatctctatttcacaagttggggaaccaaggctcagaaaggttacatgacagtctgatatcacacgcctgccttggagacccttcagccctggtgccctcctcacctcagtgttggagtagtatgtgttccagataaagctcagagcctcaggtctcactatgtcccacatgaagaagtgggtcttcggcagaatgatctcctccacgttgctgccaatggtgggacacatatggaccacctcattggtcaagctggggaggtaggagtgggcaccaagagctcagtccagcctactcccaactctggcccccaaatgctctactcccaaagcagtctgaatctaactcagaacaagtccacccaggttcaccaaacacctgctcggagccaggccccgtgctgggccctggggaatgaagacaggagtgagactaagccctgccctggcttggaccccagagaagggaaacatcttagaggaggctcctcaaactttatctctttttttctttttatagaaacagggtctcactgtgttgcccaggcttaccttgaactcctgaccttgggctcctgtcaagagatcctcctgccttggcctcccaaagtgctgggattacaggcatgagccacagagcccagcctcctcaaactttaatatgcagttgaatgacctgagagttttgtcaaaatgcagattctgacccagtgagtctgggcaggggtccaggcttttgcctttctttctttctttctttctttctttctttctttctttctttctttctctctttctttccttctctctctctctttctttctttcacagagtctcactctgtcgcccagtctggagtgtaggtacgatcatgtctcccaggttcaagcaattctcccgcctcggcctcctgagtagctgggattacaggagcacacccccacgccaggcttatttttgtatttttgtagaaacggggtttcgccatgttggctgggcgagtctcgaactcctgacctcaagtgatccatccaccttggactcccaaagtgctgggattacaggcatgagccaccgcatccggccacagttttgctttttttttttttttttccttgagatgtagtctctctctgtcgcccaggttggagtgcagtggcacaatctcagctcactgcaacctccgcctccctttgtcgcccaggctggagtacagtggcgcagtctcagctcactgcaacctctgcctcccgggttcaagtgattctccttcctcagcctccagagtaggtgggattacaggcatgtgccaccacgcccagctaatttttatatttttttagtagagatggggtttcgccatgttggccaggctggtctcgaactcctgtcctcaggtagatccacccacttcagcctctcaaagtgctgggattacaggcgtgagccaccttgctcagccctttgttgttgttgttgttgttgttgttgtatttttagtagagacgaggtttcaccatgttggccaggctgctcttgaactcctgatctcaggtgatccgcccgcctcggcctcccaaagtgctgcgattacaggcactttgagagcaacagcgcccggccatggttttgcattcctaataagctttcaggtgatgcctgtgtgactggtctgtagaccacactttgaggagcaagagtttagaaaaatgagacagacacagtgagggacatcagagaggtgctttgtttaaagtgacatagaaaatatacacatgcttttatatgtaaataatgcttctgaaaagttacgcaaagttacaataggaggaaaactaggagccagaggcaagaaggaaacttacttttcaccgtgtattcctccattgtttgaaattttcctttataattttttaaaatcattacatgtattactttttcatggaaaagcttctcctaagtaaagtactttggaggctgtaaaatgggagaggtgccatccagagagcgaatatcggggaaagctgcgatcggtatttactcagcaccacccatatgtgccaggcttgctagaccaggagctacagagcctcagtgagcctttgggtttgaagaaggggaagaaagttaactggcagaggggacaggggtgagaaaggagggacctgccgctagagggagcgaagagcagggaggcagtttgggacacttggcaggcctggagctgggtttggcagggcccccgggaagatggaggaaagcagtgggagctagggttgcctgtacggtgcaggatttgaatgccagaccgaggagccgcagtactaggaaggtccaagcagcgtgcccaatcgctcctccggactacagaggagcccgggaacccagggaagagctccagtgattggtccccctgcctgtcagtctggtgggaggcccagctctctaccctccccgcccgagagtcacttacaaccggtagagaatggtggtctttccttcattgtccagtcccacgatgatgaccgtgtgctctggaagcgtcggaggaagggcagcgtcagggccaaacccgaagaccaagggactgtgtgcccccaccagacctcccaggaaggagatagcgctccccgcaggctggggacctctgcccaccgtaccgcgtctgcttcccacccagctccgacacctgccccactccgggacggtggaaaagacagctgagcccccacctcccttcacattccagaaaagtgtctgaaaggcccggggcgcttcggggcttgccaagagacggtgtttagagaaagagcataacgcgaagtcacaatcgcaggaaactcgcagcagccccccatccccgccgctggctccgtttagcggggagaaaggagggtcgcccagctttgcgtcctggggcgcaccgaagcgccgggacccaagaggagcaggcagggacgggggcaggggaggccgcggggcagtcgaggagcgcccatatacgaccctcggagcccgaggtccccccgtgcgtccgaccacagatcagaggagtcccagaagagggcgagatcaaagcgctcgcttggatgccctgtgcgccccttaccctggttcccgaagatgctcattaacttggcgatcagctgtcccatggcacttcccgggccggacaggtgcaggagggctcagcggcctcaggagcggagtcggccctggtattcggagctccgctcccccgggagggtctggcagattttgcctacgaagttagggaagccccacacgtcaccaacctgacctgggaaccctctgggacgctggcccttcgtgggcactatggacaccccagtgactaagggctgcctgtcccgggcccaagaggtgcaaggaatatgggggttccaggctccagccctccccctcgccctgcgaaaactcctgagttctccgggtggactgctccactaccgcaaatcaggggagactcagcactgcgcgcggaaccggatcccagctctccctcctctgagtgccatgtctagggcactagactgaagcaaaaccccaggcgacccactttctgtacctaccagctgtgtagtacagacagggctcaccgatcctctctgagctgggagaatattccaaccctccacagatgtgcagttggttcactagcgtgggtcttgtgggcccactcaaattgcattcccctggggaagggcagggtctccccttgatgcttggcaacttctaggataaatcagtactcctacaattcacggacaaacctactgcccaggcacagcttcctgatccccaaaagtgggcgcctgaagacaaggatggagcatgaagagagatcctccggctggagaccctgcagagaggccccagatacctggcagaggagtacatgggccaacagagaaccaggaggccaggcctgaggagggaatggaaggtggagtttcctgctgttgcttgtgaatttctttctttgcttaagctggggggaaaaaaacaaaaaatcagataacaaaaggagaagtccaaaaggcaacgtgccctcaggctgcaggaatggttagcaggagatccagccaacacaccagggagccagctccttccacccgactgtactgccttcctgcagcctccactaaggtaacaaccctccattaaggtaacaactttctaactggtctccctgcatcttcctctcctttcccaaggcatcctctccatggcccctattaaccttcctaaagcacagctcagggtctgtaactcccccagctcatagatcttcaatggctccctattgctcactggattcagatcagtctccacttgacattcaagagcttccacgaacagcccccacctgccttcacaggtttatctcccaggctctgtatctactggttcctgcctatacatgcctggctctttctgatggtgcctttgcttctgcatttcctccttgagtgcctttcaccttctcagaaaggagaatgcctgagacccattagctgccctgccataaaagccacctgcttccccagccctgacttggttctccagccacatggggcttctccctacactgggcttatagacgggcaagtctgtttcctcccatcaactgtgagtaccagggtgggattcatatattgttaaccagcatatgacctcccccgccagcccaatcactccctgcctggtccagaaccctgcacacaggaggaatgtgttgctgtcagactgatgtagaatgagttaagctacagcctgagaaatggcacttggagtattaaaaaaggaatgtgaacacaagtttaagaggattgaggaaggctgggaagtttgcgggaagaagaaggaaaatagctgactaaatacagactttcatcccaccctgcttggtgcccagagttagaaggatagagttgactgccagagcccatctgggctgattgcatttcagccttaggagagaaggagccaagtctggggctggggggtggggcaccaagggtgctgagggaagcagcagtgtcttaagcattttaccatctgtttcctggggttagtgggatgcggggaggaacatcttagtgcatgctgccctccccacctcctctttgcagaattgaaagtaacactctgcaagctggaaacacattcagtaaacagacaaggagagggcatctctctgagcatactctggctctggaagctgcctgattaaaaaaaataataattaaaagagaaaagaagaaaaaaaaaagaaaagaaaatagaaaaacagacgagaagatctgcctccactttgaggcccaggacctggatcttaagaagcattcattcgttcattcattcatttgacaaatatgagccaggaaatacatgaagtagacaaaacagacctagtccaggtgtttatgtttttgttttgttttgttttgttttgtttttttgagacagaaccttgctctgtcacccaggctggagtccagtggcaggatcgcggctcactgcagcctcaacctcccaggctcaagtgatcctcccacctcagcttcctgagtagctgggagtagaggtgaaagccaccactcccagctattttttttttttttttttttttgtagagatgggcttcgccattggtctccaactcctggactcaaacaatctcccgcctcagcctcccaaagtgctgggattacaggtatgagccactgctcccattcccagtctgggtctttatggagcttgtggtctagagagagagacagatacacacacacacacccctctgagagacagtaggaaggcctgatttagaaagaaagcaaggcacccttctctgaagaaaatgagaggtgaacctagctggacttcctgggtcgagcggggacttggagaacttttctgtcttacaagaggattgtaaaacgcaccaatcagcgctctgtagctagcaagaggattgtaaaatgcaccaatcagtgctctgtaaaaacgcaccaatcagtgctctgtagctagcaagaggattgtaaaatgcaccaatcagtgctctggaaaatgcaccaatcagcactctgtaaaacgcaccaatcagcaggatcctaaaagtagccaatcacagggaggattgaaaaaaagggcactctggcagggtgcagtggctcgggcctgtaatcccagcactttgggaggccgaggggggcagatcacgaggtcaggagttcgagaccagcctgaccaacatggtgaaaccccatctctactaaaaatgcaaaaattagctgggcgtggtagtgcccacctgtaatcccagctactcaggaggctgaggcaggagaattgcttgaacccgggaggcagaggttgcagtgagccgagatcgcgccattgcactccagcctgggcaacacagtgggactccatctcaaaaaaaaaaaaaaaaaaaaaaaaaagaaagaaaagaaaagaaaggaaaaaaaaagaaaaagaaaaaagcgcactccgataggacagaaacagaacatgggcggggccaataagggaataaaagctggccacctcccagccagtagcagcaatgtgctcgggtcccgttccacgctgtggaagctttagttctattgcattcttttgctctttacaataaatcttgctgttgcttaatctttgtgtccgtgccatctttaagagctgtaacactcaccgcgaaggtccgcggctccattcttgaagtcagcgagaccacgaaccccaccagcaggaaccaactccggacacaaaaagattattggagctaagacaaaatttttctctaagatactgaactgggacagccccttgtccctggaccatggtggcctcagcctagttctctttagtgtagaacagtggaaaccttaagccacatgtaggacctgggcctctcccacatcacctcattctgggacagaacccactgcaaaaacaggagcagctagtcagggaaggaaacaaagggtcccaggtagcagaagtccccagtccctcagttcctgcctggtctcagctgacttcatggttgtcgaaatcctcacacatggacaaccactaacttgctgatggtgtagccagagttaattgagagcttctgattaccaagaaacaagaatctgcccccatctctcgctatctccaagcc

SEQ ID NO: 585 - DNA, 20001 bp, Homo sapiens
ttagctggatgtggtggtgcatgtctgtagtcctagctacttgggggcctaaggcaggaggaatgcttgagcccggacgacaggggctgcagtgagccgtgacagctgccactacattccagcctgggcaacagagtgagaccctgtctcagaaaaacaaaacaaaacaaaaaacaaaaaaaaagaaaaaaagaaaagaaaaatttaaaaaatgctaatgacagaatgatgaaatattcacaatgttatatttccaaaaaaaaatggcccaagccactcctacttctgaggttagttgcttagcaataatatcccctcccctcttgctatcagttgcccactctttgctgtctcctcatgcttttgactttgatctttacaatatgaaaaataaaaataaaaaggccgcgtggctcacgcctgtaaccccagcactttgggcggccaaggcaggagtatcacttatgcccaggaattcgagaccagcctaagcaacagtggggaccctctagaaaaaacatttaggctgagcacagtggctcccacctgtaattccagcactttgggaggctgaggcaggtggatcacctgaggtcaggagttcgagaccagcctagccaacatggtgaaaccccgtctctgctaaaaatacaaaaattagccaggtgtggtggcacatgcctgtaatcccagctacttaggacggtgaggcatgaaaattgcttgaatccaggaggtggaggttacagtgagctgagatcacgctactgcactccggcctgggtgacagagcaagactctgtcaaagaaagaagagagagagagagagagagaaaagaagaaaagaagaaggaaagaaggccggaaggaatttaaaaattagctgggcatggtggcttgtgcctgtagtaccagctacttgggaggctgagatggtgagatgggaggattgcttgagcctaggagtttgaggctgcagtgagctatgataccaccactccagcctgggctgcagagctaagatcctttctcaaaaaaaaaaaaaaaaaaaaaaaaagggagggaggaacccagggatagcatgatttcctttcgtcttgggaatacccctaaaaataccctccctgctttggacccagtgaccaggaaaaacaacccaaactcagtttgggaggaagggatgtactatgcatactctccatggccgctgggttttagggatgaaagggaccaaagccctgggttgagaatatttttggacaaaggtttggggttcttctagagcaaggtagccctaatttgcgttgaatccaggaaagaggtacaggttggattgcgatttggggaggagaagccatcaggctctcgttccagccctggtgccctaccctttaatgcccatgagacacctaatcccttaaatgcttcctggcccttatccccaggcacttggagcaggtctgatgggcctttgctgctggtccatatgtaggtcactgactttgcctcctcaaaactgctccagaacacatttttagtcatgagccgcatagcaacgtttcagtcaacagacggcatacacaaccgtggtcccataagattgtaatggaggctggttgtggtggcttatgcctgtaatcttagcactttgggaggccaaggcaggtggattgcttgaggccaggagttcgagaccagcctggccaacatggtgaaaccctgtctctattaaaaatacaaaaatattagccaggcatggtggctcacacctgtaaatcccagctactcggaaggctgaagaagaacaattgtttgaacctgggaggcagaggggttgcagtgagccaagattgtgccactgcactctagcctgagcaacagagcgagaacttgtctccaaaaaaaaaaaaaaagattgtagtggagataaaaaattcctatcacctaataacattgtagccatcataatgtgttagtgaaatgaattactcaagtgtttatggtgattgctggtgtaaacaagcctgctgcactaccagttgtataaaagtctagcccatacaattatatacagtacataatacttgatattgataagacatgactgtgttactggttatgtatttactatactatactatttttttgagacagtcttgctctcttgtccaggcacaacctccatctcccaggttcaaacgattcccctgcctcagcctcccaagtagctgggattacaggcacccaccaccacacccacctaatttttgtatttttatttagagatggggtttcaccatgttggccaggctagtctctaactcctgacctcaagtgatctacctgcctcggcctcccaaagtgctgggattacaggtgtgagctaccgtgccatggctattgcaccttttctatgtttagacacatttagatacacaaatacttaccattgtgttatagttgcctacagtattcagtacattaacatgctgtataggtttgtagcctaggagcaataggctgtatcatatagcctaggtgtgcagtaggctatactgtttaggtttatgtaaagttactctatgatgttcacacagtgaggaaatggcctaacactgcatttctctgaacatatcccagtcattaagcaatgcgtgactgtatttcctttttttttttttttttttgagaccaagtttcgctcttgttgcccaggctggagtgcaatggtgcgatctcggctcaccgcaacctctgcctcctgggttcaagtgattctcctgcctcagcctcctgagtagctgggattacaggtatgtgcaaccacgcctggctaattttgtatttttagtagagacggggtttctccatgttggtcaggctggtctcgaactccccacctcaggtgatccgcccgcctcagcctcccaaagtgttgggattacaggtgtgagccaccgcgcccagccccgtatttccattttatccccactttctggatctaaaagagccctactctccaaattgttgcctggagggatggttaatgggtacaaaaatacagttagatagaaggaataagatctaacgttcagtagcacaatagggtgatagagttaacagaaattattgcgtatttcaaaataattaaaggagtggaattgggatgttcctaacacaaggaaatgataaatgcttgatatgacggatactctaattaccctgatttgatcattatacattgcatacttgtctcgaaatatcacatgtactccaaaaatatgtacaactattatgtatccatagtaattaaaaataaagccttttaagtttaaaaataaacaaactggatgcacgtggtagctcatgcctgtagtctcagcactttgggaggcccagacaggagaactgtttgaacccaggagtttgagatcagcctgggcaactaagtgagaccccggactctacaaatatgaaaaaaaacaatttgccgggcacggtggtgggcacctgtagtcctagctactcgggaggctgaaccaggaggatcacttgagcccaagagttcgagactgcagtaagatatgactgtgtcactgcactccagcttgagcaacagagtgagaacttgtctgaaaaacaaaaccaaaaaaccccaaaaaacaaattgttgcctggaagaattggttctttaatgatcatagttccactcatctgcatggcattttattttatttattgttgttattattattattattattatttttgagatggagtctcactctgtcgcccaggctggagtgcaataacacgatctcgctcactgcaacctccgcctcccaggttcaagccattcttctgcctcagcctcccgagtaaccaggattagaggtgctcaccaccatgcccggctaatttttgtattttagtagagaggggtttcaccatgttggccaggctggtctcgaactactgacctcaagtgatccacctgcctcagcctcctaaagtgctgggattacaggcacgagccacctagcccggcctctgcatggtattttagagcaactgcctctatattcacaatctggcctgatcgtcctgcaaccctcagtccattaactcctataactagtagaattcacttctctcatttactagctgttgctagccaagtgtcgcctgatagaatgcaatgtcaaactgctaggttttgtttgggagacagggaaggaaatgccagagaagggcagtaatgactcagaagtgagtttaagatgagggctgtgataccttggggtgggaggtgctgaatttcgtgtgtgtgtgtgtgtgtgtgtgtgtgtgtgtgtgttcaaatgcaaacttaaagctgtgaaatcattaagtctagaagttccctgaatttggggtggggccatacaagggattccctccttttctccccaggaatagggtatggaaggccagatgtctccatcccacaacgggggccttcccatcccttggtgttctctgccccgcccccactgccacatcatcacctcccacccctgtagtggggaatacagcatcccttcccctatggcccctccagagaattcacaccatcccaggaaactttctccaaatctctgtctctttgcctggccacccaacatcctcccccttcagccggactttaccataaatgctgctgcccccaatcttccctaataggcctgccaaggcacagagctatttttacctccttcccttctcaggcctgcagacctctgggaggagcaggagcagcctctgctttcctccagcagccgggtccccacctggaacatctgctctgcagctcagggaagttctgctttcccaagcctcaccccatttgctggaatcttttccttacgtctgaagtcttccccaggttgggaccatttcagttcttagttattccctctgtgggtttgggactccatttgagctactcttactacctcaactctctgtcacccactggccttggtttagtgcagattcatttgaagccacctgtgattagaacacattccctcccaccccctaaaatatagacatatccctgcagattgctggagagggcagaacagagggatgccagtggcctctgcagataagtctttctccctccatacctttccctcttctctcagaatctccatctttggcatagggaagtttacctccaggccaagacttttcccaggttctatggtctgggatagttagcgtgagaagggtcacccctcgagctcttcatggtggctctcggccacaccaggctctggaggaaatatagagctggcttgctgtcccagacccctgtcttgttccgctcctctcaatgtccccagtactaagcaggtctcttaaaaaacgtcaaaagcccccctctcatcctgcgtcctccaagcagttagactaagtggaaatagctctgggcaaacattttctatctaaatagtgcttaagtaggggaagtaaagcttttaaaagccacgtatatgcctcctgggaggagtctgtcatccgtgggtaagggtggggagggggacaagtgccacttctgcctctgtcccaccacctcagataggtaccagctgacccacctttctgtctctactcttcccagatacttgtcctgatttgcatctatcttaactcctcctggggaaaccaagccaaggaccccctcgcctcaccccagatggtcactcagaacccggctcgaccaggccccagagcagtcagcagagccacaactcccggaaaggggtcttctaacttggagggtgtgggaaatccagccttccctttctttccattcccttcagcagggagaggaaggggagaggggagcatagactaacccccctgccccacacgatcccgcctccctggggttaggagcatcagcaggcctttgggaggcggggaggagccaggctggaacacttgccgcccagcccaaaatctcatccccgatggcactgcggaagcggcgtggagaggagcagcatagaaacccgagactcccaggtttattgggggttatgatccaaaagctacatttttatccaagtgtgaagaatggggagagctgcaaagaaagcaacaagtggccccgggcggagccggggggtgggggcgccagcctcctcccgccggctgcgctgctgcgcctggcccccgcccccgcaggcatgcggggtgattcacctcgcccagactgcgcccagaccgccggaccccgcaggggctgtccacccactccaccagcccctcttgcactcctgacgcccactcttccccgcccagccccgcccgcttccaggaggcccagggtgccagcgcgccgcgggtgagggtgtcctcaagggcctgaaaatgcctggtggccaggagcagagagcagcgaggggacaggggtgggccgccgaggccgatgtgggggcgcgggggcgcagggtctggggaggaggttggcggtcgcgttccccgcttggcacagcccccgctggtgcgtgcctgagccctgaatcacccgctatatcaggcccgcaggcgcagaggccccaggcccgggccccgcagccagtgtccgcttacagcggaccccaacgatcgcgagggacccctgactttcctagaaacttcccccaagtaggaagaagtttgacagagccaattagggagggagcggtctgcgaggggcagcgtcctcgagtccacccgctaattcggttctgctacaagtttgggacccgagggaaggatctgagtggggaggtgcgaggtgcagagcgcgcccctctacgcgccccaggagtccgccgctccctccaccccatcctaccccacccaaccccaccccagccgcgctcaccggaaggagggtggatctgccgggcgcccgggccaggctgggaggggagcagcgccacgggcaggtctccccaccccaactcccaggcaggggacgcgggccgggcgcgggagctctgggcgccttccgccctgtgggctcacctggtagatcatgactttaaagttgcggcgccgcagcagctcggcctcgttgacctccagcttcttgatctgccccgcctggcgctccaggctgccgcgcacggtcttcacgttgacgctgaccttgcgcaccttctccagcagcttgctcaccgtattgctcgtggtggcgtgcgccttgcccagcttgctcagctcgccctggatgctctgcactgcgccctccatctccgcctgccgctcctccagctgtgcttgagtcagctggatctggtctacggccccgatgattttgtccaggaggctcagcaccagcacgccgttcacctggtccgacttgatcagctcttctgagccggcccccgacggctcctccgctgcctgagccccagcggaggaaggctccggggcctcggcgtcggggtacccgggaagcggccgctcgacaatatagagcgtggggtcctccatggctacccggagccgtgcgggaccggccgggtggggctggagctggagcgggagacccggagagaagcaggagcggaagggaggagagctagcgggcgagagcggagagcagaggaaactcgagccacgtccgtgcgcaccgggacagcggccagaactgctgggcgggggatcggtgagctccccagctcccgggccaaactccggagtctgatcgctgattggctggccccaccccagaaagggagggaccggggcagaaggggagatcgacgaggcggggcggcggagggggacccaagagccgagcgccccacccttcccgggatggttggaatagttggagcgggagactagggcctccgctggcggcgggagcgggacgggcggaggaatgcgagctgaggaacggaatcaggttctaagagtgttgctctctgtttccctctcacttgaattgctcatccgaaaatcctcaagatctgggagccgggtggaccaggagattctgaaattataggcaaaatcttgtatttgcctttacctagattttgagcacaaaaggacccttgccctttacaatattttctaagaggcctctcggatttcctcatcaccaaccccaaccaggttactaactcaggggtaagcttagggggttgtttgtggggggcggggggagaaagagagaacgtatttggggtcacggtggtggtgaagggctgcgaagctcctctaagttctttttagaattgccctaacagagtagaattaagatgggcaatcaaacggaaaataaagcccacctcccaacccccctttctgagacagggtgtcactctgtcacccaggctggagtgcagcggtctgatcacagttcactgcagcctcgacctcttgggctcaggcaatcctcccacttcagcctcctgagtagatgagactataggcgcttgccaccacgcccagctaatttcaatttttatttttttcaatttttatttttttaagagacggggtgtacactattttgaccaggctggtctcgaactcctgagctcaagtgatctgctggtttcagcctctcaaagtgctgggagccaccgcgcctggtgtaaagccctttttaaaagcccacctctcttaggccaggcgcggtggctcatgcctgtaatcccagcactttgggaggcccaggcgggtggatcacgaggtcaggagttcaagaccagcctggcccaagatggtgaaaccccgtctctgttacaaatacaaaaattaggccaggcgcagtggctcattttgggaggcggaggtgggtggatcacctgaggtcgggagttcgacctcagcctgaccaacatggagaaaccccatctctactaaaaatacaaaattagccaggcgtggtggcgcatgcctgtaatcccagctattcgggaggctgaggcaggagaatcacttgaacccggggggcagaggttgcaatgagctgagattcgcgccattgcactccagcctgagtggaattctacagagtagaattcctcttttttccaaaagctttttcaatccttagtagaaggaatttaaattactttaatacatttctcctaaattctaaagtaagttggtaatctgccagttggtaatccactgtctgagtgcagacagagtgagactctgtctcaaaaaaacaaaaaaaacaaaaacaaaagcaacccacaaacccacgtctcacctctctctaaaactcacctttccctgtgttccccctcccaccgccccctcagaggcagctgacaccaatctcagtgagcaggatctaggagtccatttctctttcaagattccagggactaacagtaagccatcggagagaccatcaaatcccaccccctcatttgacagacaggaaaaggaaagcctgcagaagacaggtggcttgccagagatcactcgcaggttagtgttggcattggcacttgaacccaggtctggactcctgctttcatgctctttccaccttctgctctaagccttccactggggcagggagacaggcacccacagccactccccaactcccatgtgctgtttcagaagattaaccaaagcatattttcatccatgctgggtacaagggagcaggcaattctgagcaggcccaaggagggtccttagtgcagaaagtccagaaatagggaggctgcccatcctcccccattttgctgtctagcacagcactggtgctgtgagtgtctgaagtggcgccagctccctttcccacagaaaagcggcaacccttttccctccttaggaaaccacacttgggtttccccagctggctggatgatggtcctggcaaaaggtcacttctagtctggtatccattatcattaggaagagtgaaaaactggtctatggggacccagggcctcctcaacccagacagagaacccacaaactcagaaaggagaccgacagtgcagggactgggttagtgccctaacaacattgtagggttttttaagggtttacaacaccatatttgttatccgaaattctcatagaaaatggagccatcaactagggctgtttatcaggttatcctgaagtactgtttctgctagaaaggcaagatacgtggttactggtaacctctttttttcctttttttttttttttttcttgagatggagtctcactcttttgccaggctggagtgtagtggtgcagtcttggctcactgcaccctccacttcctgggttcaagcgattcttctgcctcagcctcccgagtacctgggactacaggcacgcaccaccacacccagataattttttttttgtatttttagtagacacggggtttcgccatgttgggcaggatggtctcaatctcttgagctcgtgatccacccaccttggcctcccaaagtgctgggattacaggtgtgagccactgtgccccgcctttttttttttttttttaagacagagtctcactctgttgaccctgcagcctcgaactcccgggttcaggtgatcctcccacctcagcctcccaaatagctgtgactataagcgcacaccatcacacccagctaatttttgtattttttgtagaaatggggtttcaccgtgttgcccacgctggtctcaaacacctaggctcaagggatccacctgccttggcctcccaaaatgctaggaatacaggcgtgagccacttcggctttgtgttttttccaactttttttttttttttgagacaaggtcttgctctgtcatgcaggctgagtgcagtggcacaatcacagctcactgcagtcttgacctcctggactcaagtgatcctcccacctcaccctctcaagtagcttggactacaggtgtgccaccacaccgggtaccctaacacttcaataactgttttctcacaaacaaatggctttctcatttgaggctcaagtagaattaagctagtatataagatcatatatacacatataactgctagaactggcagattaccaacttactttagaatttaggagaaatgtattaaagtaatttaaattccttctactaaggattgaaaaagcttttggaaaaaagaggagtgacagtagagaaccttataggaccttcatttcttaagtgtcccataagatccttagatgatgatgattattattattatcatttttttttttgagatggagtctctctctgtcacccaggctagagtgcaatggcacaatctcggctcactgcaacctccacctcccgggttcaagcgattctcctgcctcagcctcccaagtagctgggattacaggtgtgtgcccccatgcccagctaatttttttttttttttgagacggagtcttgctctgttgcccaggctggagtgcaatggcatgatctcagctcactgcaccttccgcctcctgggttcaagcgattctcctgcctcagcctcccaagtagctgggactacaggtgcctgccaccacgcctggctaatgttttgtatttttagtagagacggggtttcaccatgttagccagcatggtctcgatcttctgacctcatgatccgcctgcctcggcctcccaaagtgctgggattacaggcgtgagccactgtgcctggcctcgcccagctaattttttgtacttttagtagagacggggtttcaccaggttggtcagcctggtctcgaactcctgacatcaggtgatccacccacctcggcctcccaaggtgctgggattacaggcatgagccacagcacccggcctctaaaaaattttatctctatcccagcaactagtttcttttccaggagacatcaattattactatattctcttttttttttttaggtggagttttgctcttgtttcccaggctagagtatagtggcaccatctcggctcactgcaacctctgcctcccgggttcaagcaattctcatgcctcagcctcccaagtagctgagattacaggcatgtgccactacgcctggctaatttttgtatttttagtagagaaggagttttaccatgttggcgaggctggtcttgaactcctgacctcagatgattcacccacctcggcctcccaaagtgctgggattacaggtgtgagccaccatgccaagcctattattactattctcttgcggaatcttctatagactatttctgcatatatgatcatacatatatatatttcagcactttcctgttttcagttattaatatgttttatggatagttccatatcagtacatgtagaactgccttgttttccaatgtatacgtctactatatttgtttaaccagttccctatcaatggacatttacagattacaatttaaatctcatgggggaggagttgctgaagacaagtgggatttttttgtttttgttttttgcttttgaggcaggatctcattctgttgcctaggctggagtgcagttgctcaatcagggcttactgcagcctcgaactgctgggctcaagcaatcctcccaactcagcctccagagtagctgggaccacaggtacacaccaccacacctggctaatttttaaatttcttgtagagacagagtcccagccatggggttttgccacgttgcctaggctggtcttgaactcctgggctcaagtgatcctcccgtcttggcctcctgaagtgctgggattacaggaatgggccactgtgcccagcctcatcaggaaagtatttctataccacttcttcaaacaggaatgtcagaatttgtggatgagtcaagttatgtcccaggggtagtccagtgaatacatctctgactcatttaatgcctccttaatggatgatttctgtaaaagggccctacccctgcatgcctatgttggagaaaaatctgcatcaacaagtttctctcacattccttttcttactaaatgccagctaagtccaacagggggcatgctgaggcatattgtactagctccaccagcacagatgccgcaaactggagcagagcagtcctttccagagcatttcactccattccagtgaaaataagcagtttctcttcatttgtaactgcattcagcatgccattgcctgcattcagggttgttggtttgcattttccattgctcactctatttgcttgctgaaaggcacactgttccattgtgtgctttcagccactgagacagaatccataaaagggatagtgaggtaaaagcaaacaacccctttggcccagaaaaaggacaccaggatgcaacatgtcagcagttagaatcttacagggtgctctatcgtattcttccatccatctacttgttcaataaaacatgactacttcgcactagccatttactgggctagggactttaatgaggataaatcaagtctagtccttttttttttttttttttttttgagacggagtctcactgttgcccaggctggagtacagtggcgccatctcagctcactgcaacctctgcctcccagattctcctccctcagcttcccaagtacctgggatcacaggcacccaccaccacatctggctaatttttatagagttggggtttcgccatgttggccatggctggtcttgaactcctgatctcaggtgacccgcctgcttcggcctcccaaagtgctgggattattggcgtgagccactgcacccggccttttttttttttttgagacggagtctcgctgtgttgccaggctggactgcagtggcgcgatcttggctcactgcaacctccgcctcccgggttcaagtgattctcctgcctcagcctcctgagtagccgggattacaggcacacagcaccatgcccagctaatttttgtattttgagtagagatgggttttaccatgttggccaggctggtctcaaacacctgatctcaggtgatccacccaaagtgctgggattacaggcatgagacaccacgcctggccacccccagcattttttttttttttaaagacaaagtcacattctgttgtccaggcttgagtgcagtggtgcgatctcagcttgttgcagcctcgacttcctgagctcaggtgagcctcctatcagcctcccatgtagttgggactacagctgtatgccactacacctggctaaattttttttttttttttttttttgtagagatggggttttgccatatttcccaggccactcttgaactcctgggctcaagtgatctgttcacctcggcctcccaaagtgctggcattacaggtgtgaaactctgcacctggccagatgcatagtgtctgacacagctgaaagctcccccccagcatagggaaagcagtcactactctcaggaagagtggggaagggttcacaggtgagggtaggtacaaaggagggggaaaggaccccctcccaaacccagtatcttgcggtgtgaaagggcactggggaatagccaagcactgctcatctcctcttatcatggttctgccataagtcttatcagtttacatttagggagatccagcaaagggtgtaatatgtaatatgttctgttcagttttggatctgtgctgggagagatcccagggagactgtgtgttttgttaataataaacagctgggacaaatgatgtgtcttcacattgggacaaccgtctcacatgggaggctagccctcagcagctggctcacagctgccacaaacaacagtgattttttttttgccagttttataggcactattcttgtctctctgatatacatatatgaaaaatgcctataatatttgtatgtttctctttctcaaaatcccttcctttctttgccttcaaatattaatatatagggtaacttccctgaaccagaaaacagtcaaaattatttattaagtgctaatttatgcatagtttggtgctagaaaccatccaaaggacacaaccagcacttttgctgtggagtgggaattttagtttcagagaagcagtgattcaggctaacaaacagaaaatacaaaaaaacaggagaagggggctgcagaaaataaagcaaaatacatacagttttaccagcgtgggcaaagtggtaaaaccccgtctctactaaaaatacaaaaattagccaggcatggcagcgtgtgcctgtggtcccagcaactcgggaggctgaggtgggaggattgcttgagcccagggggcagaggctgcagtgagccaagatcgcaccactgcactccagcctgggtgacagagtgagaacctgtctcaaaaaaaaaagcaaaactaagaaaccctagattccaccaattgtttctccttttctttctttctttcttctttttttatgttgttgcccaggctggtctcaaactcctaagctcctgcctttgcctccaaactgttgggattacaggcatgagccaccacacccagccttttctaattttatttgaactctgatttagcactgctgaccaatttatctttgagattcttccctcttagccttggacactgtactatttttatttacttgtcccatttgctagcttattttttcttcctttcattttctttttttaaatagctttatttatttatttatattgaaacagggtcttgttctgttgcccaggctggagtgcagtggcatgatcacagcttactgcagcctcaacctcccaggctcaagcaatcctcctacctcagcctcccaagtagctgggactacaggcatgcaccaccacacctgacttacttttgtatttttgtagagacaaggtctcactatgttctccaggctggtcttgaactcctgagctcaagcgatccgcctgcctcagccttccaaagtgctggggttacaggcatgagccactgtacccagctaattttcaaaaattgtcgtagagatgggatctcgctgtttcccaggctggtttcaaactcctaggctcggcttcccaaagtgttgggattacaagcataaactggtacatttggacaaaaaaaaaaaaaaagcttttaatactgctttaaaaggttaaacaatataactttattgaggtagaattcacataccacacaattcacctaaagcatacaattgaatagattttaccatattcacaatgttgtgcaagaatcaactttcatcagcccccagaaagcccccgacaaagaaaaaacactaaagggagactttatcctaaagaatgtttgcaaggaggggaaaaagactgttgcaatacggggagggagtctattgcaatagggagaaggatcggcccatagttctgcaaatgtcttaagggccagacctttttccttttatagagaggagtaaacaaagctagaaagaaccaggtgtagagaataggaggaaagtggcctgatgagagaatagatcagagaatgttttaccctgaggtcaggctatcctcaggaggggttgtgtgctggctcaggcccagtgagggtgggccagagttcagggcctggaggaagaagaaaagcttaaacaaaatgtgttattttttttttttgaaacggagtttcgctcttgttgtccaggttggagtgcactggcgctatcttggctcatagcaacctccgcctcccaggtttaagagattctcctgcctcagcctcccgagtagctgggattacaggcatgcgccaccatgcccggctaattttttgtatttttagtagagacagggtttctccatgttggtcagcctggtctcgaagtcccaacttcagattacaggcttaagccaccgagcccagccttttatttatttatttatttttgagacggagtctcactctgtcacccaggctggagtacaatggcgtgatctcggctcactgcaacctccgcctcccgggttcaagtgattctcccacctcagcctcctgagtaactgggattacagacacacgccatcatgcccggctaatttttgtatttttgtagaaacgggtttcactatgttggccaggctggccttgaactcctgacctcaggtgatctgcccaccttggcctcccaaagtgctgagattacaggtgtgagccaccacgctgaaccaacaaaatttgtttaatgagcattttgttcatcgtgatcagtgttgggaaaaccagtttagctggtcattcatgaggcagagaataagaatttgaagttctgtgtctgttcctgtcacaggtaaacaatggggggcatctgcgagtcacatggggaagggtggttcttggcagtaaacaaaaacataggggattcctttaaccttggatgttttccaagagcacagggctcaggtgaaattcaccactgttacctcatacccattagctgtcactccccactcctctcttccctgtcccctagcaaccagtaagttttaagtctctatagattttcctgttctgaacacttcatatgaatggaatcatacaatttgtagccttttgtgtctcgcttcttttacttagcatgttttcaaggttgatctatgttgtagcatgtatcaatacttcattcctctttatggctatattccgttgtataaatatgccccatgctgtttatccattcatcagctgatggacgtttgagttgtttccatttttttgtttttttaagagacagtctccctgttgcccaagctggtgtgcaatggcacaatcatggctcactgcaacctcaaactactggtctctagccatcctccttcctcagcctcccaagtagcttggactactggtcacaacaggctaattttttttttagacggagtcttgctctgtcacccaggctggaatacagtggcacaatctcggctcactgcaacctctgccccctgggttcaagcaattctcctgcttaagcctcccgagtagctgggattacaggtgcgcatgaccacgtctggctaatttttgtatttttagtagagacggggtttcaccatgttggtcaggctggtctcgaactcctgacctcataatccacccacctcagccttccaaagtgctgggattacaggcgtgagccaccatgccccgcctaaaccaaatatctttcctcaaaagctagaatgcttcttggcttatttctgttgatggtgggaccgtcctatcaaacaccagagactccaaccttagaattatatttatctcctctctttctctcatctactaaagcaaatgaaatcccagatcctgccttccttccttcattatcactcccctgtaattcccatttctgtgactgtctgtctgatcctgttgttaccagctgatggctgttactgtactttcctagtttgtctctgtgtctccaaccttttccttccaattcataatgcattttagaatgaaaattgatttgaaaaactgtaaatgatagtttggaaggtgctgggactagaaaaaaggagatctaacaggagactactgcaatagtcccagcaggggaagatgatcatttgaactagagcattacggggcacagagagaggactgatgggtgagcactatagcatgaaaaccattagggcttgatgaatgagtacatgtagatactgaaggagaaggaggagtctaaaatattacaattttggctgggtgcagtggctcacgcctgtaattccagcactttgggaggccaaggcaggcggatcatttgaggtcaggagttcaagatcaccctggccaacatggtgaaaccctgtctctaccaaaaaatacaaaaactagccgggtgtggtggcgcatgcctgtagtcccagctacttgggaggctgaggcaggagaatcacttgaacccgggaggtagaggttgcagtgagctgagatcacgccactgtatcccagcctgggtgacagagcaagactctgtctcaaacaaacaaacaaattggcaaataaagagaatcaatgaagcattaatcctaccttttctggccggatgaagtggctcatgcctgtaatcctaacactttgggaggccgaggcaagaggatcacttgaggtcaggagtttaagaccagcctggccaacatggtgaagccttgtgtctactaaaaataccaaaattagccgggcgtgcttgtgcacacctgtaatcccagctattcgggagactgaggcaggagaatcacttgggcccaggaggcagaggttgcagtgatcactccattgcactctagcctggtggacaagagtgaaactctgttccaaaaaaaaaaaaaaatcttaccttttctgtttggattgtacctctgtgtaaccaaatagcggctgggtgaaggaaagcacttatttataaaataatttcagctcataaataaagaaggaatgatggattaaaatgtcactattttgtagcctctagtgaaaaaatgagctaatgatcattaatgcccgctaaaactattaggcagaaaattgtggggaactctattatatcaaagtaacaactcaacccactcactaatctttgtatttatttatttatttttttgaggcgggagaatggcttgagcctgggaggtggaggctgcaatgagctgggcttgtgccactgcactccagcctgagcgacagagtgagaccctatctcaaaaaaaaaaaaaatttaagtatgatagcagcattgtggttatgtttttaaaaaattcgtacatttttgagatatatactgaagtatttacagatgatatgatatcacatctaagatttgattcacaataattctggcggaagtagatgggatataaatgaaacaagctggactatttgttgattatggttgaagctgggtgatatgtacatagggattcattatcccgtctctgccttctgtatccttaggttccacacccatggattcaaccaactgtggatagaaattattagga

SEQ ID NO: 586 - DNA, 20001 bp, Homo sapiens
aaaaaatgatgagttcatgtcctttgtagggacatggatgaagctggaaaccatcattctcagcaaactatcgcaaggacaaaaaaaccaaacaccgcatgttctcactcataggtgggaattgaacaatgagaacacttggacacaggaaggggaacatcacacactggggcctgtcatggggtaggggggagcagggagggatagcattaggagatatacctaatgtaaatgatgagttaatggatgcagcgcaccagcatggcacatgtatacatatgtaacaaacctgcacgttgtgcacatgtaccctaaaacttaaagtataataaaataaataagtaaataaataaataaaaagaaaaaaagctcaacatgactgatcattagggaagtacaaatcaaaaccacaatgagatgccatctcacaccagtcagaatggtgattattaaaaagtcaagaaactacaggggctggagaggctgtggagaaataggaacacttttacactcttggcgggaatgtaaattagttcaaccattgtgaaagacagtgtggcaattcttcaaagatctagtagttctgaataaaacttcattatttcttcaagtagtttttcttccctcctctctttttttttcttttttttttttcttccggggaatctatgttatgtatattggctgcttgattttgtgccacaggtttctgtggctttctctgtttttctccagccttttttattctcctccctgttctttggattgaataattctacttgtctatcttgaaattcactcattttaaaattatgttttctcatttctactgttgatctatatttattttgaaaagtattaattttgtaaataaattttgtaagaaagctttatgactttgagttatacttctataaatatgatgacttctattcatctcattaaagatccttcaaggaaatttaaaattttatccataatggttttacacaccatttttgagatttattgctaggctttttcatattaaaggccttccctctgttttgcatgatttgagtgtaatttttttgctattgcatttcagagttggttatttctatttgataggaatgctgcttgtttttataggtaaatctattattcaatagccttgctgtattctcttattagttttacttattttctgtgtatattatcttggattttctaaatagacgatcatattaataaagacagcattttaaaaacatttcttaatatttaagatttctcatttcttttattgtctcaatgtcctggtgctttcttgagatgatccagtgtaatgtttgttagaatcattgctaatgagtatccttgtcttgttcataactttgctggggtctctaaagttttactgttccatttgttagatgacctttatcctctcaagggggctcctttctgttcctacttcactaagatatttttataaattataaataagcattgaattttagcaaatacttctattctgaatttaacgtgtgatgattttactgcttctctcattttatttgatgttgagccatccttggattaatggcatgtaccttagtcatgatatgctctttttaaaacatatatgatactaaatttgattttctatttattatttttatttgttttacttttttttttttttttttgagacagagtctctctttgttgcccaggctggagtgcagtggcacgatcttggctcactgctacctccacttcttgggttcaagcgattctcctgcctcagcctctggagtagctggattacaggctcacgccaccacgcccggctaatttttgtatttttagtagagacggatggggtttcaccatgttggtcaggctggtctcgaactcccgacctcaggtgatgcgccaatcttggcctcccaaagtgctgagattacaggcgtgagccaccatgcctggcctcctattatttttacattgtacaagctttgatgttgttatggattaaacgtttgtgtctcccacaaaatcaaatgttgaaatcctccccttaccaatgtgatggtgttaggaggtggggcctctgggaggtgattaggattagatgaggtcatgagggctcccgtttcatggatctgactagtgcccttaaaagaatgcttagagagcttgcttctctctgctctttgccgtgtgcaaatataagaagttggtagtgtgcacctggaagagagccctcagcaggagctgaccacgctggcacccggatctctgacttccaggttctgggactgagaaataaatttctgcatcaccattggcaaccctttcggtactttgttatagtgaagtggcatcatttgtttggggtaatacctgaggttcattgtcttacgccagggaaattgaggctgcagacacacaagaagtgagtttaagagcggaggtttcataggcaaaaggaaaagagaatagatctctctcctgcagagagagagaggggcttctgagtgggtcttccggttccgtggtaaaatggatggggttttatagatgagcttgaggaggcagtgtctgatttacatacggtccaaaagattggtcggaccaggcgtgtcatttacataacatgagaggaagctggctgccctaccctaatctttttattatgcaaattgtttctctacctggccagcaccatcttgcctgcttctttattgcacacgtggttgacaaaaagggaagatggagcctccatgttgaacatgcctggcccccaggtagccttttcctgttggcacagctgctggcattcacctgtgcaagcttccagcttgcttatccatgtctgcggctggattttataggctgctctttgctaggaaagaaatgatttgggagctgctttttgttaaaagggaaggtttcccaaggactctctagcctcactaactgcctaaataatttctttttatctcctgtatcaattgcaacccaactgactacaacagatatgtagcagttacatttttgatgagcttgacatgtttgcagtacattttttaaactcatgaattatttagaaatttatattctaccatagaagtttatgttctaccataatttaatcatttatttttggttaatcatttgtaatttaatttaatgttgatttaagaacacattagtcaagataggctagatcatgctacggtagtaaataatccccaaacctctgtggcttaaaacaataagatttatatcttacctacgctacataagtattaaaggtatgcagggggactgctagtggtagctcttagaggcacaggttggtggaacaactacatttcaaatgttgacagttgccatgtcagagggtaagggagaaaggaacagagagttctggaggatttccccatgggcaactaaatgctccaggccaaaagtgacacataccccttttgcttttcattcattggccagaattcatcacacagagccatgcataggagatggagttaggacgtgtcatccgaccatgtggctgaaagaggggagaaatgtgtcgggtaaacggcacagcaggatatcaattgataaccatttcctgattatttgttcagcttgagctatgagtttctgagtgagcgatattataatctcccaccatggctatgactagttttgtccatttctccttgcagctatgtttatgtatgtttgaaggtgatatagttaggtccaatttattattttgtacatttgttctgtattcttatctctgtcaaaattgatacaaatatggattaagaggatatgtcattttcctctacctggccatctttactaatggacaggacttgacacaggtagttatttgtagctggctatccacgatctcgttttattctttagcaccattgtaaggccactgcaggcttgttattcatgacttactcttgagcacatggagactcgggaaggctgtgcagctgtgcccctgccacaactccagaccacaaagaaagagcctcaaagtctgggctctgtcttctgcccacccttctcctagacaaggcaggccaacacatggaggccagacagctatgaaagacacgtctccctagaggttgtttggatggatttctttggtgcaaattcttgtattagaaatgacccatttgggttctttctctcgccacctgaacaaatagcaagccctggcgagcaagcgagctgcctctcactcccctgtgatcaggaggagctgaaggacttgcggtgaggcgaatgaagagcagcagttgttttttggagaggtttccttagtttgtagacctccctctttctaattctttctctgaaacatgtatccccttttctgtagctcattccctacatccttttcatgcaggtttccgttaggcagtccctgggggtgatgatttatgtttacacttccccttgattctttggctcaattcccttctggagtgcctgtggagcctaatcaactctggtgctctctatgccccgaacctagcttgggaaggggacttgattaggctcttagggcgactgtggtctgcaagggccacgctgtggcagagccctctgtctgcctgttctgcagaggggccctgttttccatgtaggaactcatatcagaggtcttttctctgttttcctggttgttttttcttccttccttcccttccctctctttttcccttgttccctccctccctcactgtctttgtctctttcttttctttcattttatgggctaattgtcccaagggcagcaaaacagaaactgctggctacgaatctgctgtggggctcagggcaacgtgacggatggtgtgagatgcagtcatcggcaaggttcattaatagttcactgctttgcatcagcctggttgccacgatacagcatcattcataatttagaattgctggtgtgccttctgtaatgtattatgactgtgttaggaaggcctggccccaaaagctcccggcatatgtgccagtggcctcagaggtcagactctgggcggctcctctgggccgggagagtagaatgttaaccgaggccctgggaatcaggggagggaaccctgcaacttccctcagcttactgtgcctctggtttgcataaagcttcctccatgagatggaacaaaattcatggaaataacattttcccagaaagaaacttggctgtgactgagatgtcattttgattaaaaatgtcaaaagataaatgaattacaaaaaaatagctaacagaggaaacccaattttatgtagtaaaattttcattttctatattcccacaccaggaggtatagttatgatttagcattgttttagacttggtaaaaggactttatactttctaactttagagaccactgcatcctatagacagtcaggcggctttccaggcactcttcctgggtgatgtgcctgcctagggggctgcagttttccctactctcaccttgtcatttactcactcgtttccctcccatatatcaaaactgtctcccagaggcaatccaccccttaccgtaacttcaaggcaatgtgctacctttcctggtgcttgcgtttaggcattctctctagtagctaaggatagcaaatttattttttcttctcaaaatccttttgggtgtaacacagtgggaggggaatgatcttgggtgaggtgtgagacttagtgttcctgaatgtatgccaagtaggtgactcactgcttttgctagtaagcttagaggccaggccaggggccactagttttgcttcatttaatatcatttattaatgaggccaaccagatatttccaattatttgtcacttggctctgagctattggccatcatttttaaaaggctgcaaatattctttgcatttctcaacaaactcgacctagttttctcattaggcatttgacctacacctgagaaggtgtaaatgatcaggaagtgaaagtaaaggaaatgaatatgtggcttccatgtctggagctttagtttctcagtgtctcagcacccctttttggagtggtgaggagaagcagaagcctttggggcctggcacagggaatggccatcctggctgggagagagagggagaatcagtgcttactgagcatcctccacaagatagcaaggtatcttagatatggagagatgtagcggggatcctgcagagagtagtgtgggagaggagtgccctcaggcctccctgatgtcagaaccatctgcacaggctaaacagagatcgattcttggaccttgtccctgtatcagagtctcagggcctgagccatgaggattcagcatctccaagatgttcagcctgagtgagttcgcaaacaggcaagcaagataatgggggcttggagggggaaatcatgacactggtattggggctattgagtttgaggtgccaatgggttatcaatctagagtccctggagctgcctgccaggggcaagagggaattaaatctgctggcatggatgaaatttatcattgatggtgacatgcatcacccatgaagtgaccttggtaggagagacagagccatcaggggaaagatgaatccttggggcagctttcagtgccaatgttaagtacctctcaaagggtgacttcatattttgggtgcacaggagtccggaggagcagatctggctgagttggatgatgacttatttagaacctggggctgctctcaggctactttcgagggagagctcacattaattgaccctccactgagagccaggccgtttacacacattctgcgacccttagactcatcagcgtctgagtttccccaggccagctctgagtatggtttggagcctggtgaatacccaatctacacccaaggcaaccatgtcattcagaagcccagagcctgatgactgctgagaagtggaagggaacagttatattttacaaatggaacttggctgggaaggggacagaaaccctgagtctaagacaactccagaggggtagggagagtcccatcatctttttgggtttctacctggaggccagatcatgttgaaagcctcttttccacctcctcctccactctgggaaactgaagctggttcggcagcattttcccaattctacaccctcaccccccaccaccaaacaactagcagctgaaactgtcagtgaatgaggacaacacacaccaaagccaggaagaacatgaggcaggacccatgaggagtaaagacatgaacaggctgagagactgaggaaggcgacaggcatgtagaggacatggcccaggggcttacagtggtggacacggggccacttggtgggctccaggtgtctgaggctgcacccaggcactaagtttgcaggtgcagagaatagaacatggccgcctcttccaagtctcaaccctgggggagcctctctatgggctgcattacattgcttgatcgtgatgcaataatgtcaactaattgttcttctaaaatccaggagtttgccgacttgaggctcggtgccagcccatctcttggaaagcaagctgccaagctgtgctacagcgcctttgcatggccaccccacaggcttttccagaattctgctccaggagctcagctctttcgacctttcctgggactcaaggcacatcctcagcttctcttcttgagccccccacccaacccctgctctctagcagctctgggggctgcaccagtctctccatggactgacaatagaaacacctggttggttaacttgaggtttcctgggtgcagtggcgtttcagaagccctttctttcccgacctcagtgtgggccagaaagtctagaaattagggcccaaagctattgaaataccatcagcaattcccattcctcttgcgtggtcactacctgggacatttagcttcagttccttccttttgagtaaagggttttaaattaacatttagtgttagctgtaaatattttttttctccctacttcctaccaagggagaaaatgcccatgaggaagatggactcatcttgaggaagatgcccatgctgcagacgtggagacatgtgagatagatgaggccggcacactccccacatcctggagaaaggcgggaactcaccaaatcccaaccccttagcctttcggatcccgcagtcgggcctgaggtgcagagctgggcttgaggcaggggctttgctaagagctgcaggagggccgaggcccgggaggtgtgtccttgcctgccacgcacattattttgctggtgttactgcattgcccagaggaatgagaattagaaatgtgaatgtgtgcaaagaaacactggggggaagaaagactttggggaaaatcttctcccaactcaaaaaatccccctgaatctctccatttctttctctaaacacaattctttattattttatgttgtgcacactattcatgtttactattgaaacattttttaacctatgaatttgtttatttcaccttgtgtcttctagtcagtaataagacacttgtagaaatcatgacactattgttcagatactcagatttctcaggtaaattaacattcccatcttgaccaataactcctttgttgcaaacattaaatctacagccaaagacaaatggaaaagtaggaatgaccaacaaggatagactaggaatgagacacccatttatactttatcattatcttaatgctggtactgtacttcacaccccaaaaagttacttgggagcagtctttgttttcagctattttcacttgtctatccataaaagaatggatgtataactagcagatggactttgggactcgctcacatagcatggtggtttcctgctaccgggaagcacaggtggttctgagcactggccacgccccactgagcagcacttaccctgtgtgtccatctctacatatggaagatgagaaaagtaatacccgccccctgggtttgcggtgagcatggatgagatcatgtacgtacagcacttagcaagggtcctgcccccatgaaaactacaatgcatgttgtttctctgggaccagggggcacacagcagaaagtgccttagcctctctgtcaaacgttcttttctggcgatttcatcaaggttgggaacagagagacaaccttcactttggaaggtaatttctccccttttctctatgccttctggctgatccaaggagtagacttccccagggaagtctgacaatctcagtggcttaggaaagtgctcctcctatgtggggttgagaaccaagtggccgaaccaaggagggtgagtggattgcacgagctccccaggacagggtggagctggagggctgtcttcccttcgacagtagcagctttgaagcacatgtgggtactgttagtgcaaatggcatggagcatctggtgaagggcagggtaagatttcaccagctgtcagtgtcaaatgtccccaagtctcattttgattgagatagaaaagacatcaaaacctaatctgttaaagcattgaccttaataatagtcgtatttttctatatcatccgtatcggtaagcatttttgtattcatgtgagctaatttgtgagatgatcaaggaatatggaaagaccaggccaccaagcatgaaagtctgattctgtggtttagtatgacacctcagaggttctagcagtccttggagggtcgtccaatcgcccaagtttgacctgggtggcactttagacctggcacgcctcttactctcagtattctgagagtaagctcagaatactctcagcttttgcagccatctgactctctgacctcagagcaaaggggctggagacagagctgggtgaggtgctgggggagagtcatttccactgccctcattacttgaaggatgcaggttgaaaattccctgttggtaattcattagcctgggaaataaataacgtggaaggcacagaggtggcatagaggaaagttgctcaccagtacccaacccccacaccggccataccaaacaggtatgtgggaacccaggtgcggggcacgatttgacaagtgggggtgctctccggccagtgctcgccaggcagcaacaggagcctctggtggagaagcagtgccagcaggatggctggcccacagtgcagaccggcttcctgggaaacaaggcaagtcctggctccaccacatctttggcaagtctctaaccctctttctgtttctgactgctcatgcttttagcacagggtttgacacatagtcgtaagagcaaatactggaacattattgatattattagtctctcagctcctgaaaccatctccagcaatctttctctgcccctgcacatggagtaagggtctgggtgggagaggcaggcacagttttatctggctttccctgaataccttaaagaaactccagcgggggtcaggtctgcgatgctagcgtaattgccgaagttcctctgtctcttcgaacttccctccaggacattccctccgcaagcctttctctcccctttctcaccatctggtttgctttcatacctacacttgccgtgcttctggacgtctgtggcaaccctgctgtgaaggtctcaggtacagaacttagtcttacgtggaagaaaacacagggcttcccaaaggtcttactgcaggtttaaactgtaatggtgttagaagtataaataatacaaacttagaaaaggcaacattgtaaaggataataatttaaacatttaagatactaatatctttgctatggacatgcaagataaccgctgtcttgtgctagtggttctagtccattttcaaactgcaaacacggagaagcagccacaggaaggttgcctttgaagatcctccaaagaacatcctgggacggaaggtctgatggagactgccagtgaacaacaaggcctctgccatgctgtgggtctggatgaacatctggacatggtctcacatgcagcctaaaagctgaaatgtaatactcaaatttgcaatgctgaagtaatggggaatatttaaataaacttccaaatgatgagttctctaagtctgcagcatttatatttctgatttgggacacactagatagctcagtaccaagctatgtatccaacccaaaaggtcagaagaagaatacagaataacacaaagaagtaaaaaaaaaaataaagataaaaacctttataaactagaaagcaaataatagggaaaaatactactctgaaaatcctaataaaatagattgaataataggcaaatgtgttcaataaaaatatgtgggaatataaccacagatacttatgtcttaatataacactttaatattttaggccgggcacggtggctcacacctgtaatcccagcacttcgggaggccgaggcgggcggatcacgaggtcaggagatcaagaccatcctggctaacacagtgaaacctcgtctctactaaaaatacaaaaaaattagccacgcgtggtggtgggcacccgtagtcccagctactctggaggctgaggaaggagaatggcgtgaacctgggaggcggagcttacaggtgggcacctgtagtcccagctactcgggaggctgaggcaggagaatggcatgaacccgggaggcggagcttgcagtgagccaagattgcaccactgcactctagcctgggtggcagagcgagactccatctcaaaaataataataatattttaatttttaaaaatgccccttattcaaaacaatgtagactctgagaaccaatcatttgtgtgcactgtttgtaccaagtgcttttatgccaaatctaacttgggcaatgtagtttcagactgttttctccatgaaatgtaatgtattctttcctcattcaatattgcgcttaagagtctgtgtaggggaattctgggcagataaaggtagtgcagtctagagcctggcacttcctcagtcatgccctattgcctcccctacaaacaaacaaaagaagtgcagatgagaactaggccaggacaaacctggactccaaagaatgacatgacagctgcaggaggagcccctcacaggtgggagaagagaggaacgaggacggccttgccaggcagagctgggatcaggtcacccaaacaagcgatggcccctggaccctggagggttttcttttccccatactcattggtgggtgaggggctgcgcagggctaggcctgtaaactctccaaagtgacaggttgtagctccctcccacgaccaggccccatgccacatcggccctgagaagaagctgttggggagagtctatgcagcgcagaccagttgctactgggaagagagggcccagagtgggcggggggacagagcggaggtctcaggaaggaagggcgcacttaggaaccagtgaaaaccacagcggaggggcctccagtgctgcgaagctggaagagcttcctaccctgacgtcagggaaacaacccctgcaaaggagtgacagggaaggactgtgcatcaatccaacaccaaatgtggccagtgaaaaagaataaggggcaggctggtggcctttgagactgtcaaagtttgccagaaagacatgctcaccaatgggtggaaaccataatccagtgtttcaaaatgaactcacataaattcagaaaataatagaagacatgaaagaacaataaaaatcagaattagaaaactcagaaatgagttagcattcgggaagaaattagcgaaaaagtaaaacatggtttgggaagggatgactcagaagtacagtaagggaacaaatgccacagatatggcaaggcaagcggtcaccttactgactgggctaatcaacccaggtcagcagaacaaggaggctgttgccacccagccaggcagggaagagtatgttggtgctcaggggatcatccctctttggtgcttggtgcccagtttgaatgacaaagaggcaaagctgtagccaggacccgaggagggcttgaaaccaggactttgggcccctcggcttcagggtctggctgaccccgccagggctgctggccaagggtgaagggatctcgaaagggtgcgggaggggtgggtgatgagtctcactttggccttgaaaccagctgcaggggggcctgtagctcctttcactttgctcttcccttgcaagagaagtaagacctcacaggcttactctggaagccggtgtccaagggtagacagtgatgggtaatgcaatctcctaggatcccctctggacacccacatgcccatggctggccctgtccctcaaaggcaaaaaccctcatttaaggttaagtccttgcccaggggatggctatgacaatggcttgctggtgtgggatccaaacacccctggcttagcttgggataaaggaagggctaccccagttccagggctcagttgcaactgcagcttctctctgcctggacctgccttcctccgtgacctgtataacctgtgatcactgccctaaaatgacctcatgtgactctgtctcagagtttagagaacccaatctaaggtggcagcaggctgcttggctggggtgggcgccctttgaaccttaacatgttgctgtttagagcttgatgatccctgatggtgtcagataaaggaggcttgaggagggtgagagacccatttgcccaggtctcccatccccatagtgactgggccaggaccagaagccaggctttggcattctctgtgtgatttccagtccagcacacgcaattctggaaggagtgccctttttggccggcactctttcctgcaatatgttcctctcaacgcatctggaggcttttgcctgacaccctggaaactgttttcttgaggaatatttcaattctggtatcctctgatctttacgttttcttctcatgagcattttcctatgcctaatcttttctaaatgagctacaatttgctttctggaaattccttgttgactttttttaaaagaaagaactcacaaccagatatgcaccatgattctttctgctgttgggaaatcagaacttcatgcaagaattccgctaagtggtttgagtttattgttgcaatgatggaagcagtttatctccacagggggaagcgtgctggctttcaccgtgttaagaataaatatgcactaattaattctgtacaagacacaaaatcatttgaagtctgctacttttttaaagctccatattcactgtaatagtttcctttttggaaattatttgttagttgttttctgcttatatgaggaaaacaaaacaaaacagaaccagcaagaagtggattcttatttcagttgattaaaaaaaaaaactgtacactgtatcaaaacaatccattttctatttcatgcaaaaaagcaaaataaggaatattcttaaaatgactttgcaggatgtgctttattttaagtcagccctgaacccaaactacacaggatcaatttttgacatattctagtccattcaatgattcttctcagaaactgtatcttaatatggaatgaaaactacatttcaatcataaatttttcatgctacattgttatttaatgaagaggttgtattaccaataataataatttaagaaaaggccatttttatttccccaagctcaatatacatatttctttcataattatgaacttaaaaaacccgtctcagatgtaaaaatgtgaattggaatatgtaaactctttgatatacctgaaaaacaggaaggaaaatgtcacatactggaaaaaccattgccttaaatcatggaaatgggaaaaagcacgttaagggaaggggaaggcagaagagcggtcctgacctcagttattaaagagttacaaagtattctaggtcccactgggttggtctttttactcttctgcctcatgtctgtttgcacaggagaccgcagccctccagaatggttcccctcattgaagctggtcactggtggaccataacaaagcaggtgtacacatcatttgttttgctccttttttttttttttcctgagaagtcactggtgtttaatggaaaggtatcctattagtccttggttaagataaggcagtaagagtatcactaatactatgtttttgcttagaatgaggctgatccttccactggcgtcttcacgggcaattagttccctctcttttgctcctagaaacacaggtaggagctgtctgccccctattgctgttgcattttctgagtgtgttgaaggctcatctagtctcatcacagcagcttccccagtggggatggagcgctgtatattgcattgtagcatctctccaggaagtgcacgggccccacagaggaaaacacaggcatctttctttctgactcctcttctgtttctcttagggacggggcccataaatgattccttcacatgatcaatcagaatgcgagacactgttgactaaaacataaagcaagtagccctgatttcagagaaatggagttacaaataacattttcaacagtgccttaacttgcaaggtagcttttactgcagaaggatatcagctccttttgtctacctatcagaagagaaacaaaccatttccgtcgaactagaaatgcttagctcttatgagaatattgtgcttttaaaaaaaattcaaatgttaacattatttgcagtctgtgttctaaggtttcaatttgttttttctctagtccatttgatcattgtctctggtgagcgatataggaatattaatttggcatagagatcttcttctagctccagttctcctgtctctcgaactaaaaaaatatctgtgcacaacttcaaaattcgatccacatttggaagctcttcaaacatgatggagtgagaaatcccactgaagaattcacggacaaatttcccaatcacaaggacaactgaagcatataatcccataatactgaaaaaaacagtaagtagaaattgcatacagcagttaaatatagttaataaagaaaagcatgtctaaaagaaaaaaatattactttccctcaaattctgtagaagaaataagcaaatcaaatcttacattttttccctttggttaaaaagttgactttttattatagaattattataaatagaaaatagaattatgtattacagaactgttagacttgaaaaatgaaagtcctttacaatctcacattctgtaaataatcaatgctaaccgtttcatgtatgaactttaggtggttttgttgcatatattaaatgcataaaccatataatgtatttggtagaaatgtaattatatatgattttctgtggcaggctcctttccttttagcaatactgtctctcagattaatttttataaaattctgggtgaaaatcatttcttatgaggctaactttgagaaatacaatattttacatttgtgtcttgtggggatgtgcgtgtcctaggatttaagcatcagaacatgatgcgatgtttcagaagttcaaaagcaggatgtctaatagatccatctgctaaggattagaaggaaatctaagcagaaaagtgatatttctgtgctaatttatacaagtaaacatgggattggattaaactgtgccataacaggaagacgtggagtaaagaagccatatacctgggctgtgtgagtcacactgggagttttgatctctttgggactctggtgcctcattttttgaaataaaatgcacacaaggatgtgtgcattttaatactgcagctctaaaattagcgaattctaagaagataaaaggcttcccactctcaactttacatgatacagaagtagactcttgtaactgtgaattgttcaatgagtccttacccatagccagccaggaaccccagacttgggggactgactttgtcattgaagaccaccagttccagggcctgagagttcggattgtatattctgtttccagtcaggttgagaacccaccactcactgttatatttagttgtattgtctctggacaaaatgatggtaatatccatgaaattattttctagaagggtagaaatgcaaaattaagttgacatgagaattttaggatttcatgcacagcaacagttttcagatggcaaaatctggttactaactatagcataaggttctaggatgaaaaggatgcatggacatactagaagcgtgaatgggcaaggaagagagggccctgggtatgtaagtgatttttccttttcagtgagagaggtcagccgctgttgctacatgggcatggcagcaaaaccacagggcaaaagtagaggatccaccacctgagcagctgagctgataatcccaaatgactctgtagacatttaaaaacccaaatttctgacttgtgatcaaatcaaccagtccattcatattaccagcatttgttgcatgtctcataggaggaaggcactcaattaggtgctaaagggttccaaaattgcatataacattgttccttatctccatgggaaaagactgtatacacaagcacaatttatgggcacatgacagccaccatgggaccagcattgacaaggtctgttggcttagagagaccacttctggatagtatgctccatgggtgcttcacagaggagataacttctgagctgagattcgccaagtgagaacttcaataggtgaaggtgggtgaggagggaagctcatttcaggaagagtgatgggacacagctcagcaaatctctgagaaccataatatcgggtcagtgattacttttattggagtttagggtgaatgcaaaagagttgtaaaagatagggtaaaaagcttgtagtgacattgtataggtctttctaagaagattccactcctgccaatgatactggtgcttcccctgagaaacatggtggtgaactataaactaaactgtgtgaaggtgggagcaacatcagcatcatttcatactaaattcctagatcacaggtgtccaatcttttgggttcgctgggccacattggaagaagaagaattgtcttgggtcacccaggaaatatactaacaccaaggatagcttatgagctaaaaagatcataccaaaatttcataatgttttaagaaagtttacagatttgtgttgggccacattcaacactgtcctaggccacatgcagcccatgggctgcaggttggaaaagcttgtcctagatggtaggaatccaagaatggtacttgacaaaaaatgtctatggcatggaaggatggatcaatgaagaagagtaaggcacagcatgatcctattagagccaaagtccttatcaaggaagaaggtgaaccacccagaacacacaggaacaggaagaatgttggttctgaagtcaggagacagctgtaaggaggaaacacaggagcttgcagcacagagtcacctcaggaagagcttgtggagggacagaattatttcatgggaaattactgattgttgagcaatctgcatgtccagatgaaacatttctacaactattcctgactgaaagggaaatagcaaacttcttaatgcgtcttgcaaataccttgtaagagatacttatttactgctgaggaagaaaggtgtgtgatgtggagcccggccttttgcccatccccagggccctccattgggcctctactaggccaatctctgtgtggctttccaactcttcacttatgtctgcatctttctagctaaacacagcagcacggagcccaggctccagcgcctggcctattgcctagtgtgtagtggcccatgttggagaatgaattaatgtgtgccagataactgcactggttttccgcgttgtccagatctatacatctgcttctggttcaagccatgaagtcaagcaattcttgataattaatagaatccagaaacatgaatttataccatccaagttatattgcgaaaattcaatcactaaagtgcctctagtgatactactaatccttgggctgaatcaagtacatttcatgctatatttttactgttcttattgtgaggggcagacatatttagcaatgtatgaggcagtttcctgtcagtaatctggctgctaatagaaacaagtctataatctgatgaatcagtactataagaaatttggtgcgaatatacgtcaatcaagttccatatctatgaaaaagagaaaatgaagaatgtgggtcccaggtgagtgagtgactcctttgggctagtgaaggctgtcaggggtttcatatatagtctgtcacacagggagagataactagaaagtggtttcatgaaggtccaaagcacaaactgttgaaattgaataaaactaggattgaaaacaattctgaaacaaatttttctcattcttaccagataaaagttgctttataggttttgagttagaatcactaggtgctttcacataatatggataaatcttttctatggtcctgtacattaagaaaaaaaagatacaattacgttttagttgttttacccacctaaaattgattttttgttgttattgttgaccttgtatcaccaaataatagtgaaagtttcatatatctgtacaatgtgtagacatcataatttacgggttcctattacagtcaaaactctctcatatggagcaaattcactgagctttatctgtatctgcatgtaagtctgtacaacaagctcggtgatggcttacaaacagccacaggccttttcccaattctgcagcttgtttctgaagccaaggggcactgtttcttgctaggatcctccaattcttatccataccattaagcacgcttcaaattttaatttttagattttcaaacatacctataatcaggctgatatggtttggttgtgtccccacccaaatctcatcttgaattgtagctcccgtaatccccacatgttatgggaggggctggtggca
